United States Patent 7,557,201 (NUCLEIC ACID MOLECULES AND OTHER MOLECULES ASSOCIATED WITH PLANTS) - sequence listing, part 3

SEQ ID NO: 12328 - DNA, 466 bp, Gossypium hirsutum
  Clone ID: uC-gsflmaxxa043e10b1
ttccacgcgtccggaagaagaagaagaagaaagatgatggaaattgaggaagtaagcaattatgaggcattgccattgctctcattgaatcatgtatcattgttgtgtagatcagttttggattctatgaggttctatgaagaaatcttgggctttgttctcatcaaacgcccctcttctttcaaattcaatggagcttggttgtataactatggcattgggatacacttaatcgagaacccatccattgatgatttcgacaccattgtcgaaccacggccaatcaatcccaaggataatcacatattattccaagtgtaggatgtggggcttgtgacgaggaggcttgaagacatggggatgaagtatgtgacagcagcggttgaagatgaacggaatgcggttgaccaggtgttcttccatgacccagatggatacatgattgagctctgcaactgtgagaaca

SEQ ID NO: 12329 - DNA, 466 bp, Gossypium hirsutum
  Clone ID: uC-gsflmaxxa043f06b1
ttcacgcgtccggcagtattttgctggaaagaatagagcgaacatggcgataggagttaaggccttgcacttgtcctttgtgcctcatgccctcgcgattgccggcgctgttatggtattggtttggtgcattcacttcaggggtggattagcttgggaatcttctaacaaaaatctcatctttaatctccatcctgtattgatgttgattggcttcattatcttaggaggtgaagccattatgagctacaagtcattgccactgaagaaggaagttaagaaagtcatacatcttgtgctccatgccactgctctgattctaggcattattggaatctatacggcattcaagaatcataatgagagttcaatacctaatctctacagcgtgcattcttggcttgggattggaatcattaccctttatggcattcagtggattatggggttctcatattcttctacc

SEQ ID NO: 12330 - DNA, 236 bp, Gossypium hirsutum
  Clone ID: uC-gsflmaxxa043g04b1
gtaagattcaaactcgtgctggccacgaacgctggccttggaggaggagccgcagatctcgaatcacgcaagccttggctgatgaatgttgtgcccacaatcgtcatggccaccttaagcgtgctctatgagagaggtctactcgtaatatatcatgactggctctaaagtttctatacgtatacaggagcatactaccttatgcacgctaatggtgtatttagcttgtatcaaca

SEQ ID NO: 12331 - DNA, 431 bp, Gossypium hirsutum
  Clone ID: uC-gsflmaxxa043g08b1
ttcttattcacaatttacccccaaataatgttgaagccacatgtttaccatcctcacaccaccaccaaaaccctagcctcgccattgcataagccattttcccacggcactgccctcgcatttcttcctttcaacgcctgttcttcattgggcaagacagcgaaaccttttaaagccagggttgttccgaacaaaatcaaagctgcggtagacgttaacttgaccgatgatggtatcctaactgactacactgtgaaaggtgtgatcacagttaaacaaactgtaggtggtttcctctccaacttagggttaagtagagggatagatgatatccaagacttgctcggcaaatcaatcctcttggagcttgtcagtctcgagctggaccccaaaacggggcaagagaaggagacgatcaaagcgtatgcaca

SEQ ID NO: 12332 - DNA, 191 bp, Gossypium hirsutum
  Clone ID: uC-gsflmaxxa043h07b1
tttgaatgaatatgcatataatatacatggggttggggtttgggttcgctatgtagatccagatgcggaagtggtttctttgtcgcctaaaacgctgctagaatcggaccgatacgtgtgtgagatctgcaatcaaggattccagggagaccaaaacctacagatgcacaagaggcggcacaagggttcat

SEQ ID NO: 12333 - DNA, 464 bp, Gossypium hirsutum
  Clone ID: uC-gsflmaxxa043h11b1
tagatcgctctcgcgctttcccttaatcaatgatttttcttaccatgaagattatagattttttcctgatctcgtcacttctcttctcaatctctagggctgaatctattggatcagttttcttcatcgacagtcctactcatcaattccttcgcgctccatcctctaacgatgcctttcagtcagagccaatgttgttacctgaagttggtgcgactgcatcagtcttgcttggttttccaccacccattacactttcagctgctggctcatctaagctgaatgaggttctcatttaatccatttgatagacctcgtgccgtttttatgcttgaagttagtggagttgatgatcctcttgttgttggacccaagaatgctctcttccacaaagccttgaagagtagtgttggtcttggttcaagtaaagtggacattcagcttccagatgaagaagcagtatc

SEQ ID NO: 12334 - DNA, 424 bp, Gossypium hirsutum
  Clone ID: uC-gsflmaxxa045a02b1
tttctgcttgagaatcggtcgccatcggcgtccgaattgtagtctggagaagcgttctcagcgacggaccgggcccaagtcccctggaaaggggccccgcaaagggggagagccccgtcgtgcccggaccctgtcgcaccaagaggcgctgcctacaagtcgggttgtttgggaatgcagccctaatcgggcggtaaattccgtccaaggctaaatacgggcgagagaccgatagcgaacaaataccgcgagggaaagatgaaaaggactttgaaaagagagtcaaagagtgcttgaaattgtcgggagggaagcggatgggggccggagatgcaccccgttcggatgtggaacggcgagagccggtccgccgatcggctcgttgcgtggactgacacggcttcgaggaggcggtccaagcccg

SEQ ID NO: 12335 - DNA, 344 bp, Gossypium hirsutum
  Clone ID: uC-gsflmaxxa045a05b1
tttctttcgtccgaaaaggggaaaagttgcagagcaaaagaaaagaactccaatggtgtgcgagaagtgtgacaagaagctgtcgaaggtgatcgtgccggataagtggaaggaaggtgccagcaacacaaactaaagcggtggtcggaaaattaacgagaataaactcctatctaaaaagcgaaggtggactccttatggaaatactaagtgcatcatttgcaagcaacaagtgcaccaagactgcaagtcctgtcacacttgtgcttattgcaaaagtgtatgtgcaatgagtggcaagcaagtgctcgacaccaagctttacaagcagagcgatgtataat

SEQ ID NO: 12336 - DNA, 326 bp, Gossypium hirsutum
  Clone ID: uC-gsflmaxxa045a07b1
tttttcttcagagccgaccgatatcaatgaacgtattgtagtgaagggattcgtccacaacttctgaaccaacaaaaatttctatagaaaaaaacaatccttactttgtgactccgagttgccccttatcacatcgtcacatatacgagaatccctctattttttttcctggaaaatgcatatctttaacgatcgctatgtctctgacagtactagggcgtgcttagagaccattaatatggggagcgacgttttacaacctcaggattgcttgatcagacggatcacagagaccttcgacagggtgtgcgggacgcagatacggg

SEQ ID NO: 12337 - DNA, 218 bp, Gossypium hirsutum
  Clone ID: uC-gsflmaxxa045b01b1
acaatatgatcaacaatatccttcagatcaggaacagttgcagcaagatgaccagttttagcatgctgctggagccccgcatcacattcaatattacccgcctggggctgagccaatctccggttattattttgtaaaatcctaccaataacaacttggccaataatcatcctcaattggaccagaaaaagcccaggcctaatgattcccagtggcac

SEQ ID NO: 12338 - DNA, 223 bp, Gossypium hirsutum
  Clone ID: uC-gsflmaxxa045b02b1
gtgattgagttcacaagatctcagatcatagctgcaatccctggaacctttttctgtgcatggtatgcctcgcagaagcattggctggctaataatattctgggtcttgctttctgcattcagggaattgaaatgctgtctcttggatcataaaagactggtgccattctcttggctgggcttatagtatatgatatattctgggtttttttactactgtgat

SEQ ID NO: 12339 - DNA, 482 bp, Gossypium hirsutum
  Clone ID: uC-gsflmaxxa045b03b1
tgtggtggtagctatggggttgctggttggagcgtttcttatggtggctattaaaaaggtgttggtccttggagctgtcggttcggtggtggtgccaatggggctgggattagcttggaattgcatttggggaaggaaaggcttgctggggttcattaggaaatacccagattctgagcttaaaggagctgttgatggccaatatgtgaaggttactgggattgtcacctgtggccgcattcctttggagtaatcttaccaaaaggtggctagatgtgtttatgtgtccacagaattgtacgagtataaaggatggggcgggaaaagttctgaaccctaaacatcgttgcttctcttggggaggtagttattgtgagagttacgttgctgatttctacatatcggatttccaatccggattaagagcattagtgagagcacgttatggcgctaaggttgctccatttgtcgaaccagtcacc

SEQ ID NO: 12340 - DNA, 460 bp, Gossypium hirsutum
  Clone ID: uC-gsflmaxxa045b05b1
ttttgtttccaagcaaaatatcatgggcaagggtcctggtctctacactgaaatcggaaagaaagctagagatcttctttacaaggattatcagactgaccaaaagttcactttgaccactagctctcccactggtgtttcaattacctctgccggaacgaagaaaggtgatcttttcttggctgatgttaatacccagctgaagtctaggaatgttacaactgatatcaaagtggacaccagctccaatctatttaccaccataacagttgatgaacctgcacccgggctaaaggcaatctttggcttcagagtccctgatcagaggtctggcaagattgaactccagtatttgcatgagtatgctgggattagctcaagcattggattgactgccaacccgactgttaacttctcgggtgtgcttggaacacatgttcttgcactaagtaccgatatc

SEQ ID NO: 12341 - DNA, 361 bp, Gossypium hirsutum
  Clone ID: uC-gsflmaxxa045c01b1
ggctgctgcgccggctggagccgccggggcggaattggcgggtcgcacgcggccttcgttgggttcgtaggtactagccggagtgccctaggtcggacctgacacttggagtgccaactcacaccgacatgactggcataaccatattgaagcctaatgatgtccagggcctccatgcctgtcaagctgaccatagtgatgagggggcatacataactaatgcactcattgtttacattggagacccagtccagattgtgagcgaccgaaaacttagattgatgctttgataaaaaattctggagaacccaaccctttggattactaaaagcagcccataaaattgagttatttaagcgag

SEQ ID NO: 12342 - DNA, 154 bp, Gossypium hirsutum
  Clone ID: uC-gsflmaxxa045c03b1
ctgctgcccccgctgctgccgccgcgccataactgcctggacccacgcgtccgttattcaccccctgcactcctaggccaggttgtgaccactcggtttcgtcgataattgataaggatggtgccacgggtgtcaaacatgaacagcgtaccat

SEQ ID NO: 12343 - DNA, 145 bp, Gossypium hirsutum
  Clone ID: uC-gsflmaxxa045d02b1
gtgttggaatgaactcaatcatggagagattttatttaaatacatttgagattatgcattgcagaagcaattgaatgaaaaagtagtaaggtattgccagtggttcttttaaaaaaaaaaacaataaaaaaaaaaaaataaaatg

SEQ ID NO: 12344 - DNA, 510 bp, Gossypium hirsutum
  Clone ID: uC-gsflmaxxa045d05b1
ttgtttgggaattgcagccttggattgccaaagatgacgaccaaggtcagaagatgtggagaatcaaccagcgaattgtaaaattgatagtcgagctgatgagaaatcatgatagcgcagaatcattggtcattgtggcaagtgcttctgatctacttctacgtgccacagatggtatgcttgttgatggggaagcttgtactttaccacaactggagctgctggaagcaacagctagagcagttcagccggtactcgagtggggagaatcaggactggcagtagcagatggactttcaaacctgttaaagtgtcgtctaccagctacgactcgatgcctttctcatccaagcgcacatgttcgagctctcagcacatcagtccttcgcaatattttgcatataggttcaatcaattcaaaatctaaggtggaaatatatggtatccgtggtccctctaccagttcttaatataggtgccatcaactggcaaaatgatatcgaaaagtgc

SEQ ID NO: 12345 - DNA, 448 bp, Gossypium hirsutum
  Clone ID: uC-gsflmaxxa045d06b1
ttttcgcgtccggtgagtttaagaaggtcccttttactgggaagaagcccttggggatttccgagacgggcttgaaggttaataaaggcagtgagagtaagaaaaatgaaaatgcgaggaatatgttaagcgaaagagaaagtagtagcagtgaagatttgagttcaaatacaaatagaaatgagagtagaattaggaagaatgaggtcaagaatgaagatttggaggctcataagactaacactgagttttcaggccatatatatgcggatggaaagagatggggttactatcctggattggactcaaggttgtcttttatagattttgtggatgcattttttaagaaagggaagtgtgatatgagagtttttatgatatggaattccccttctggatgtatagtgttaggcaccaaagggggcttgagagtctgcttgctcagcat

SEQ ID NO: 12346 - DNA, 515 bp, Gossypium hirsutum
  Clone ID: uC-gsflmaxxa045d08b1
tttttcagactctgtatcttctcttcctctgtactatttccttctttaagctaatttcttaggtccttgctagctaagcatggcaaaggaaggagagaacagcactttccatgccagggattatgttgaccctccaccagcaccattgattgatgcttcagagcttaagaaatggtcattttacagagcattgatagctgagttcattgcaactatgctcttcctttacatcacagtcttgactgtgattggtcacaagagccaagttgccacctaccctgacgcatgttctggtgttggccttcttggtattgcttgggcctttggtggcatgatcttcatacttggttactgcactgctggtatttctgggggtcatattaacccatcagtgacatttgggctgcttttggctcgaaggtctcactgatccgagccattgcatacatggtggctcagtcgctgtgagccatatgtggggttgggctggttaaggcattccaatcagcatacta

SEQ ID NO: 12347 - DNA, 461 bp, Gossypium hirsutum
  Clone ID: uC-gsflmaxxa045d11b1
tcgttatcactttacataccattaccacacctcttttttcttacataacatatctgttccattcggtagtaggttgaagaagaaatggcccttcttacagcttcagacactttcgttctttatttcctatgtttcatgttgtgttcatttggtatcagcaatggtggaataactggtaactttgtaagaaaaaagtattcacctgatatgccccttgacagtgatgttttccaggttccttctggttacaatgcaccccaacaggtgcatattacacaaggggatatggatggtagtggcagtgatcatctcatggataacccctgatgaacctggttccaacatggtttactattggcctgaaaatagtaaccataagaacaaagctgaagggatttttgtgagatacaagttcttcaattacacctctggttatattcatcactgcaccatcaacaact

SEQ ID NO: 12348 - DNA, 437 bp, Gossypium hirsutum
  Clone ID: uC-gsflmaxxa045d12b1
tctttcaacgataggttcaaagaacaaagaacattttcttcttcatcgcctgccctccgtctcctcggttccctcatgctctctgtccttcgatcctcagccaccatctccgccgcgccagaatgtacctgattcgccagataagttgattcccttctttttattccttccgatgcaatgatgtgctcaaccttattagcttctctgtttgtaaaaaggaaaatacaagtctgaaaatcaagacataaattttttgagtcatgaataaacacagcaatatcagatctatcctctttctcttctagcttgcgaatcaccgaccgagaatcaccctcaatctccacctccctcaagccaagatttaaagaactttttatcttcttttgaaaaaaaaaaacatattgagggaataaggtattaataaattgttgattttt

SEQ ID NO: 12349 - DNA, 288 bp, Gossypium hirsutum
  Clone ID: uC-gsflmaxxa045e02b1
ttccacgcgtccgaaaaacaactttttttgtgccaggaaaagtgacttctgtacaagctgactcattaatggctaccgccacttccatcgtacggtctccagggggcctactctctgccaaagtcactgtctgcgatcacaaaccaaccccaaccgatcaattgtcccgattcccttcaaaacggaggtggatcactgctcttttgtcttacctccacgacaacaacaacgacgacgacaacaacaacaacgggatctcgcatcccaagactctttcttcatcccagc

SEQ ID NO: 12350 - DNA, 493 bp, Gossypium hirsutum
  Clone ID: uC-gsflmaxxa045e05b1
ttttcttcggacgccgacgacgaatggggcccggacaaggaggagccagttgtaatcgagagtcctggagtggccgtggcggaagagaagaagcctgacgatgcgggggaaatagagagcttgaagaaagctttggtggattcgttttatgggacggatcgtggcttgaaagctagcagtgagaccagagctgagattgttgagcttataactcagctcgaggccaagaacccgactccagcaccaactgaggctttgcctcttctcaatggcaaatggattctcaagtacacatcattcccgggtctgtttccactgttgtcaaggggtcaatttcctttagttaaggtggaggaaatatcacagaccattgatgccgaaagtctcactgtgcagaactctgttcagttcgctggaccattggcctcaagttctattagcaccagtgctaaattcgaggttcgaagcccaacacgtgtgcagatcaagtttc

SEQ ID NO: 12351 - DNA, 514 bp, Gossypium hirsutum
  unsure (1)..(514): unsure at all n locations
  Clone ID: uC-gsflmaxxa045e06b1
ttaaaacaagttaggttttgcattatttatctaaataataaaagatgggattgttttggagagttcttattatattacctctcttttttgcatatgtcaactgtgaatactttacgtacccttcccgtcatactggcaaagccgagttagccggtttcaaggggccggactctcttgctaccgatggtggcggtttctttagcggtcccttggttgtcaatgatgatgtaactgctactcccggcaaccaaggtggaactactgaggtgacagttgaaaagcccggagacgatatcctcgatgcgtctctagctgatggcaatgatggagttggcaaggcaaatatgattgaggctgcaactacgtttaaagggagctgggaattgttccttgagactggcggtgtttccgccatgcatttgatattactntctaagatcaatcaagctttgatgtttgacgccacagtgtggaagatctcgaagataaaattaccaggaccgccatgccgaca

SEQ ID NO: 12352 - DNA, 399 bp, Gossypium hirsutum
  Clone ID: uC-gsflmaxxa045e09b1
ttctagagttcttcactgtgttatttgcaatccctcgaatggctgggtacttggcacactggcgtgagtctctagatgatcccgatacaaagataataagaccccagcaggtttataccggtgtatggctacggcattatatgccactcaaggagcgcatggcgttgaatgatgcagacaagcttactcaagtatccatatcaaatgcctcgagacggcgactggctggttcgggggtttaggctttactgttatattataacatcaccaagtgaaataaaatggcaaacgggccgtatatgtatctctgctaaaataaatttactacccttgtcaatggctctctgcttgaaaactgtatgcttttgagctgacataatgcaatttgccccttatctt

SEQ ID NO: 12353 - DNA, 506 bp, Gossypium hirsutum
  unsure (1)..(506): unsure at all n locations
  Clone ID: uC-gsflmaxxa045f05b1
ttatcattgcataccgccaccaaacacagtcctacatttttggaacttctcttctcttctctttccaaaaagtaaaaaccagaaagagatccaaaaaataatggtgcacggttctattagtccatggagaagggtgttatcggaaactacatattctctgcgacggnggcaatttggtcgacgacgctgcttctctctggtggctcacacagctgagcttgataaaaacaatatcgattctgttcctaaattgcctccctttgattactctccgcctccttatanccgtccttccgccgttgacatcctttccaaacgcaaggagtatctcagcccttccatgttttacttttaccagaaacccttgaacgtagtggatgggaagatgcagtatttgttcgatgagaaccgacgaaggtacctagacgcatttggaggggatgctacggtgagtagcggccactgtcatctgatgtggtcgacgcaatcgtcaccaaaccagcgct

SEQ ID NO: 12354 - DNA, 498 bp, Gossypium hirsutum
  Clone ID: uC-gsflmaxxa045f08b1
tttttcttttactagaactcaaacaatacattcacgacgactaccaggtcttgtggttggtgtttctcttcgacttctatcgatgtcggaaagggtcataacggtgtcccaagacggcaatggcgactaccgaacagtgcaggaagccattgacactgtcccactgtgcaacacctgccgcaccatcattcgactgtcacccggggtttacaagcaacctgtttacattcccaagaccaagaacctcatcaccttggctggtctccgccctgaactcactgttcttacatggaacaataccgctactaaaattcaacatcaccagtgttcgaggttaattgggactgcaacgatcggttgaggcactgtgatttgtgaagagaaagatttcattgctgaaaatgtcacatatgaaactcttgcgcgagggttcaggacaagctgttgtatcagagaacagcggatcgatgtgcattctataatgcaaattcctggctg

SEQ ID NO: 12355 - DNA, 410 bp, Gossypium hirsutum
  Clone ID: uC-gsflmaxxa045f11b1
tcttttaaaggaagcagtgcagagattataccatttttaaagacatgggttaatttgcctatggctgttgggttcatgttgttatacacaaagttggctaatgtgttgtcaaagaaggctcttttctacactgttattcttccttttatagccttttttggtgcatttgggtttctattgtatcctctcagcaatcacatccaccctgaagcagttgctgataagcttcttgcggtgcttggacccagatttcttggtcctcttgctattatgaggatattggagttctgcttggtctatgtcatggctgaactttggggcaacggtgtcatttctggtttaatttgggggggttggccatcaaattacttcttgtgaaggaagcaaaagaatctattccttggttgggc

SEQ ID NO: 12356 - DNA, 382 bp, Gossypium hirsutum
  Clone ID: uC-gsflmaxxa045g02b1
gctggtgcgcctgctggtgccgccgcggcgtaactgggtggacccacgcggccttcgttttgctgtgcaccgacacgcctaacatgccgcaacattagagcatcctaaacatgctgactctgtgcactacaaagtagcgggacaagacgtgagccatttggagccactggcactccagaccatacctcgaggactactgctgctcaggtggactagtggccatgcaagctcctgtgttgatgcatcagaagcttcactggagcttggtccgataccagagctgagaggaatcgggtattgcaggacagactgcagtgaccatgaactatatgctgtgatggatgctgcccatggtatgtcgtgaaagcaaccgttggctatg

SEQ ID NO: 12357 - DNA, 424 bp, Gossypium hirsutum
  Clone ID: uC-gsflmaxxa045g06b1
gccgcggcataactgggtggacccacgcggccttttttttaatgcctgcagtggggcagctgggtacctcgaaatggacgaagtgtgtcagaccaccacggagaagaaaacatagacgacggccggcaggagcctcacttgcccatctattgttaaggcggcgaccccatgccgaattacaagcaccattgacgaagacccgacaactcttggatctgataaaaccatctctagatcttttggcttgaaatgtgtcttcagatcaccgaacatacgatggcactgtacaagattaagcttgtgggtgccgaaggtgaaccgaatgagttccaaatccccgataccagatcatcttataggcaggcgaagcacatgagtagagctgccttattggtgcagagctggagcttgctctatatgtacc

SEQ ID NO: 12358 - DNA, 531 bp, Gossypium hirsutum
  Clone ID: uC-gsflmaxxa045g07b1
tctttttggagtgcatcgaattgtctcactagcagcaaaaataatgcattcttaacatactggctcaatgcactacagaatattgggacaacacgtgagccattttttgtgactgtcaatccagaccataccccgaagaataccttgcttaagtggtcgactggccatgcaattccctctgttgctgcatcaaaagcttcacttgagcttggtcagattcaggggaagagaggaatctggttctgtggctatgacttcaatcaggatgaactaaaggctggtatggatgctgcacatggtatctcgggaaagcattcttctgttctgcatagtccaaagagtatgtcaccctctttcatggaaacaacggcacgcctctctgttactaaattctttcaacaatatatatctatgggctgtgtaattctcttagaggaaggaggcagagttttcactttcaaaggaaacatggagaagtgtcctctaaaacagttctgaagtacataatcctcagtttactgaggatcatga

SEQ ID NO: 12359 - DNA, 441 bp, Gossypium hirsutum
  Clone ID: uC-gsflmaxxa045g11b1
aatgcaagcagtgtggaatctttgaacctcgaaatggaagaagtgagtcaaaccacaacgaagaagaaaacaaagatgacaaccgtcaggagcctcacttccccatctattgttaaagctgcaaccccaaaccgatttacaagtcccatcgccaaggccccaacatctcttggatctgttaaaaccatctctagatcttttggcttgaaatgttcctcaaatcaccgaacatcgatggcaatgtacaagattaagcttgtagggccgaagggtgaagtgaatgagttcgaagtccccgataaccagtacatcttagaggcagccgaggcagcaggagtagagctgccttattgttgcagagctggagcttgctctatatgtaccgcgaaggtcgtttcgggtacggtacatcaaccagaagccatctacctcgaggacgat

SEQ ID NO: 12360 - DNA, 348 bp, Gossypium hirsutum
  Clone ID: uC-gsflmaxxa045h02b1
ctgctgcccccgctggtgccgccgcgccggaattgccgggacccccgcgtccttcgttcacccggccggagtcatgactcgcggaccgattgctgctgcgacaacagccatggagttctctgcatgtatcgacgcggagcagactgctaaccggcttggaatcgccatggaagctcacaaagctgatccagcgccccagtcgggtaccattgctagcgctacagccggggtgatggaagcttgctctgctgaaaatgctgtgcagcgatcccttcttgttgatagaggacaggagggggtgctggttgctcaatacattgcatctattgtggctgtcattgccgaaag

SEQ ID NO: 12361 - DNA, 214 bp, Gossypium hirsutum
  Clone ID: uC-gsflmaxxa045h03b1
acacgtcagttcaaacgtacgatggagcgaccgggactgagacaaaatgagtgaatatgggctgcaatgggtgcttccctgacagcgctgtaacctgagtttacaccagatctttcttcagcactgtaatgagcgttaacacactacctggtgggtagagcggaatctgtcaccaaatgctaggctcaagatgggacatttatctaccaatatt

SEQ ID NO: 12362 - DNA, 371 bp, Gossypium hirsutum
  Clone ID: uC-gsflmaxxa045h05b1
tgttatcggcgccttttttttttttttttttttttgaccaaagacaaatatcattctggatggcttttttttttttttttttttgggggaaaatccaaaaccacacttgcaggtggcaccatttttttaaaaaaaaaaaaataatgggttttccaataaaacctgcttcaaatttccaatccacttaaaaaccaaggggaaaggctggccttcctttaatgtccattccataatttaaggtccataaccctaccacccttggttttaaagaaagcagggttacccagaagggggtggagggttagagtgtcagacccaccagcttgctttaatgacagttgttaacctttttttgagcctcgaaatttttg

SEQ ID NO: 12363 - DNA, 500 bp, Gossypium hirsutum
  Clone ID: uC-gsflmaxxa045h10b1
ttgtttcacgcgtccgcccacgcgtccgcccacgcgtccggttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagaaaacattgagggagcaaccaagtttttgctttaaaattgaggaccttcaatttttcgaggagagagcatgcatgatgatggatgctgggtgtttgttactacaggatggtgctgttgacccacatttt

SEQ ID NO: 12364 - DNA, 371 bp, Gossypium hirsutum
  Clone ID: uC-gsflmaxxa045h12b1
ttgttcgtaacctctaacttaacccgacccgcgatcgctttttccgcgaaccttcttgaatcttccgtcgattccgataaccctagaaggagcacttcattcttcaagtttagcaatggagatgaagtcgaagacactactcatactatacgcaactcagacgggaaacgcattagatgtagccgagcgtattgcacgagaagctgagcgaagagcctgcaccgtcgatattcgatcaaccgacgattatgaggctaattcgttgcctgctgaagacactgtcatttttgttgtctctaccacaggccaaggggatactccagattctatgaaagtattttggaggtttcttctgcaaagaaatcttggca

SEQ ID NO: 12365 - DNA, 525 bp, Gossypium hirsutum
  Clone ID: uC-gsflmaxxa047a03b1
taaaaagagcaggagggagttagttttggcttctgatctgcggaataaaacggtgttgatggctgcggcggtgaccgggaggattgaacgtcggcgttaacgctgactgtatcggtcacaccggcgttaccaatgacgtggccatcttaagattccagccaaaaaaaagaaaagttggcgctttctttttctaatactgaaaaccttcttaattatttatttcattctgatctgatctttgtttttggtttgtggtgttggttgaactgtgggtccctaagagtgtgtggggggagtgcatctgagctggttcagttctgggttgatttgaaccggtttggcttagagctggtttcctccttttctcgcaatcctgctttcagcttttctgggttggtgattcagttgaatattgagagattggatttggcatgcttataaaagatgtcattgaagagtattatgccaagagtaaaggaaatgaaggacgggattgtgagcatatcaaagagaggaggggaaagc

SEQ ID NO: 12366 - DNA, 53 bp, Gossypium hirsutum
  Clone ID: uC-gsflmaxxa047a04b1
cccctcccaatttcccctcgacccacccgtccgccttttttttctccctctcc

SEQ ID NO: 12367 - DNA, 485 bp, Gossypium hirsutum
  Clone ID: uC-gsflmaxxa047a10b1
atatttacactgtctcagtttgtagctgttgaagggaatctttcttttttttctttggttcctttctgtttcagagaagattcatggcggcaaccccagatcgtaaccctgaagagcaacaagctgatccagaaaacgtgaaggagcagcctcttccaacaaaaagtatgacgttggtttctcctaattcctctcaagatgctgccccagtagctcatcgcagggatggcgctggtcaatctggatcatttgcttcagctggagaccgtaacgtctactcgcctacaatctatgcacctcagcctcaggctttctattacagaggttatgacaactctgctggtgaatgggatgaatatccaccgtatgtcaatgctgatggactagaaacttggatctctgggtgtcttcaatgataatccatcacttgtcttccaccctggatatggctacaattcacaaatgcccgatgggccatattcccc

SEQ ID NO: 12368 - DNA, 477 bp, Gossypium hirsutum
  Clone ID: uC-gsflmaxxa047b09b1
gggcggacgcgtgggaaaaaattagaaggtgtgggaggcgttgcttggaccgaagaagaagatcagttgctcaagaaatgtatagagcgttatggagaagggaagtggcatcgggtacctcttttggctggtctaaacaggtgtcgtaaaagctgtagactgagatggctaaactacctacgcccaaacatcaaaagaggaacctttgcagaagatgaagttcagctcatcattaagcttcacaagctcctcggaaacaaatggtcattgatagctgggagactcccaggaagaacagcaaatgatgtaaagaattattggaactgccacctgagtaaaaagctcaacaatgctcaagaaaccgaagaggaatatcaaaatggcatgaaaatggaaaccctaaaaccccagccacgatgcattgcagtgacgggctcaattaaactcaagacccaagatcattttgctcctaagaac

SEQ ID NO: 12369 - DNA, 536 bp, Gossypium hirsutum
  unsure (1)..(536): unsure at all n locations
  Clone ID: uC-gsflmaxxa047c11b1
cccacgcgtccgcccacgcgtccgcaaaaatggcaaggaaaattgtgctcattctggtactgagatgcctctgcattgggctagcagctgctgactggaacatcttgaacccaatatggaatatcaatgcaagacaagatagcttgaaaaactactgtgaaagttggaggatcaatgtggagctgaacaacataagggagttcgatgtagtgccccaagaatgcgttgctcacatcaagaagtacatgacttcatcacagtacgatgctgactgccagagagctatcgaggaagtgacactatacttaagccgctgttgctctttgaaaggtgatggcaaagatgcatggattttcgatgttgatgatacactcatctccaccattccttacttcaagaaacatggttttgggggagagaaggtgaactcatcttctttggaggcatggatggaagagagctaggcaccagctctcgaccacacattcaagctcttccatgacataanagatagagggatgaaaatctttctggtc

SEQ ID NO: 12370 - DNA, 460 bp, Gossypium hirsutum
  Clone ID: uC-gsflmaxxa047d01b1
tttatgcgtgggcgatgctctcctggaaatgatggtctttctccttccctcacctagcatggctcagaagtatcgtgttgagaacttgaacgagggtccttttgatgatatgtatgccaatgctatcagaaactgggatcctgagggacctcttatgctctatgtttcaaagatgattcctgcttctgatcagggcatattctttgcttttggacgggtcttttctggcaaagacttaactgtattgaaggttaggatcatggccccaaactatgtccatggtgagaagaaagacttgtatgttaagagtgtgcaaagaactgtcatttggatgggaaagaagcaagagactgttgaagatgtaccttgtggtaacacagttgccatggatggataggatcagattatcaccaagaatgctactttgacaaacgagacggaaggtgatgcccacccaatt

SEQ ID NO: 12371 - DNA, 473 bp, Gossypium hirsutum
  Clone ID: uC-gsflmaxxa047d02b1
ttacgcgtccgcggacgcgtgggagagctgttctggttcaaaccctagcctctatctgggagccctttccaatggcttcgcgtcgactcctctcctctttcctccgctccacttctcgccgatctctctccaaatctcccagccctacccctcgcctcccttcaccttcccccacgcgccgcccttttccgtgcccctactttctctcacgcgatgctgagtactctacatctgcggctgctgccgcttctgctccatcgcagcctcctcccgctaagaagggcggaaaaggtaagatcactgatgagttcactggtgctggagccatcggtcaggtttgtcaagtaatcggtgccgtcgtcgatgttagattcgatgaaggcttgcctccgattttgactgcgcttgaagtgatggaccactcgatcccgcttgtgttggagtggctcaacacttgggtgaaaacatgggta

SEQ ID NO: 12372 - DNA, 391 bp, Gossypium hirsutum
  unsure (1)..(391): unsure at all n locations
  Clone ID: uC-gsflmaxxa047e02b1
ggaaaagaaaatcaaagttatttttctttcaattgagcccttcatttttctctcattttctttcttcccaaacaacaaattttaaagaaaatgccaacagatacaagcaaacccatgaaattagaacgatacaatagctatattcgtaaagtccatagtacgaagttgttgaatgcttcatctaaatttctatttcgtgttacccttcttattgctttagttttgatcttgtttttcaccattaattaccctccactttcggataatacccacagtgcacctcaccatcatcaccgtcatagctttctttcaacttcacttttctccgggtctttcctcgntggtggggccgcgtgggagaaacaagttcgtcactctttgacttcacgta

SEQ ID NO: 12373 - DNA, 481 bp, Gossypium hirsutum
  Clone ID: uC-gsflmaxxa047f10b1
ggctggactcgctgctagtccggctataaagttcaccgagtctcaggtaaaatgttatatgcatcagttgttatcggggctcgaacattgtcacaaccgacatgtattgcatcgtgatattaaggggtcgaatcttcttattgacaatggtggtgttcttaagatagcggattttggtttagcttcatttttcgatcctaatcacaagcagccaatgactagtagggtggttacactttggtatcgacctccagagctccttcttggtgccacagattatggtgttggtgtggatctctggagtgctggttgcattttagctgagttattagctggaaggcccatcatgcctggtcgcaccgaggtggagcaattacacaagatattcaaactatgcggctcttcttcagatgaatattggaaaaaagtaaagttgccacatgcaaccttatttaagcctcaacaatcatataaacgatgt

SEQ ID NO: 12374 - DNA, 440 bp, Gossypium hirsutum
  Clone ID: uC-gsflmaxxa047g01b1
cttttcttttcctttcgcgaggcgagcgagccactgtgatcttttcctttcctcacaacttactcatcaggtctctttgagtcgaagccatggccaccggacagttgttttctcgaacaactcaagccttattctataactacaaacaacttcctattcaacgcatgcttgatttcgatttcctttgcgggagggaaacaccgtccgtcgctggtatcattaatcctggtgccgagggatttcagaaactcttctttggtcaagaggaaatagcgatcccagtgcattcaaccattgaggcagcatgtgctgcacatccaactgccgatgtttttattaactttgcatcatatcgaagtgctgctgcttcgtccatgtctgctctgaaacaacctaccattcgagttgttgctataattgctgaaggtgttccttgatca

SEQ ID NO: 12375 - DNA, 467 bp, Gossypium hirsutum
  Clone ID: uC-gsflmaxxa047g02b1
ctgatacaggcgctgatgcttcaatttttcatcttggatcaagaataaaatctagggttagggttagctaaagagggtaaacccggaaaatggaaggctgggacccgaatacgaagtcgacgctgacccagatcccgctattgacgacgaaggcgggccccagagacggagcggcatggactcagaggcttaaagaggaatacagagctctaatagcctacacccagatgaacaagtccaacgataacgattggttccgtatatcggcagccaatcccgaaggtacccgttggacaggcaagtgttggtacgtccataatctccttaagtacgagtttgatctccagtttgatatccccgttacttatcccgccactgctcccgagcttgagttgcccgaactcgatggcaagactcagaagatgtatagaggagggaagatttgtttaaccgtacatttcaagcca

SEQ ID NO: 12376 - DNA, 459 bp, Gossypium hirsutum
  Clone ID: uC-gsflmaxxa047g06b1
gtttcatccccatggatttctcctactcatttacgggtacagctaaggaactgctcctctccctaatctccctcaccttcttcactgcgaaactgaaacaaaaacagacaaagaacaagtaccaccccgttgccggcacgattattaacctgctactcaactttaatagattgcatcattatatggctgatcttgcagccaagtatcggacctacaggctgctttctccttacaggagtgagattcatacctcggaacctgccaacgttgaatatatactcaaaaccaacttcgataattatggcaagggtgagtataatcacagcctgctaagggatttttttggtgagggaattttcacagtggatggggaataatggcgtcaacagaagaaggcatcaagctatgaattctcacaaaggtgttgagaagattcagcagtgttgtctttcgaaaaat

SEQ ID NO: 12377 - DNA, 392 bp, Gossypium hirsutum
  Clone ID: uC-gsflmaxxa047g08b1
atgcagggataaatagtactgaacctgggggatccttatgatggggctatcggccatcttgggttctcgaaggcggaacaaaggcttgccgagtgcaagaacagtgaaacctatgaaggtagccacagtcgatatgaagaaaccccaataccatttgtgcttttcagtggtcagatacacgatccccgtcactccgacacaggctccgagtgtagtactgagcaatagccagttgaaataccttgctagagctttggcttccttggggtctttatgatcaaattggtcaccaccaagtgctggaagagctcccttgaccccaccggcccccaatgccaacaaccccagtgaaaagtagaacatcaccgccttgctaccgtctatgcagctgg

SEQ ID NO: 12378 - DNA, 501 bp, Gossypium hirsutum
  Clone ID: uC-gsflmaxxa047g11b1
cggttgcgtgggcggacgcgtgggaattttgagacggtgctatttagcaatggcttctgctctagctcttaagaggctcgtctcatccaacatcctccctagctccttacgcgtcgccatcgctccatccatctccagactctttaacaccaacgccgccacgcctgatgaccacgatgatcgccgtcgtgctgacggtttcttcccagatctgcaggggcggcgccagggggccaaaaaagatatgtttgatcctttgtctccaacaaggagcctgaacatgatggatcaagtcaaggggaatcgatttctctccacatcccgtgacattccagggcttgggagcgaggccaaagaatcaaaccttcgcccgttatctcctcatcttcctatttataagccacaactttctgcgactctttcaattaccaataggatctccggggttttcctaactactgcacttttggtctcttatcttccttctctgaaaatgggttc

SEQ ID NO: 12379 - DNA, 343 bp, Gossypium hirsutum
  Clone ID: uC-gsflmaxxa047h03b1
ttcttttacttctttggagaagaaaggacctagggttgctgacacagtcattggggaggggaacactacagcatggaaaatgtgtggtcttgacaagagtacttgctttacggttttatttgatgtttcatccactgacaaattaaatgctcttggagttgcaaatccacagctctatttgcagcttcttacaagctatcaagaccctgagggtaaaacaatgctccgagttactactgtgactagacaatgggtagacagtgctgttagttctgaggaattaatacaaggcttcgatcaaaagactgcggctgatgtaatggcaagaataacttccctgaaa

SEQ ID NO: 12380 - DNA, 459 bp, Gossypium hirsutum
  unsure (1)..(459): unsure at all n locations
  Clone ID: uC-gsflmaxxa047h05b1
ctttaccctaaccaactccaagtgtcgagccacccagctcactattaacaatggcgcatcatcgtggctccgaccctgaaaccgaaccaaacacgcaactttacaacccataccaagacttgaaccttcaagttcccataaccaacctgtacaagctcccaacctctccggagttcctctttcctgaggaatccctccaccaacgccgctcttggggagaaaatctgaccttttacaccggttccgcttatttaggtggctctgtatccggcgcagccgtcgggctcttctcggttctcaagaacttcgagcaaggcgatactttgaagctgaagatcaaccggatcttgaatagttcgggtcatacgggccggacatggngaaaccggatccgggtggtgggcttgatttatgcggngcttgagagtggagtcgtggcngcgactgatcgtgatgatg

SEQ ID NO: 12381 - DNA, 468 bp, Gossypium hirsutum
  unsure (1)..(468): unsure at all n locations
  Clone ID: uC-gsflmaxxa047h09b1
ctttgtttcaacatcaaatccctaaactttttctttgtctctccatgaatttatatatatatgcatataacaaatgattcattgatttgggatcggttactgctctaaagaacaccagaaaatttatcaagagtggttcaacttcgttgattcagataatgatggacgcattactggaaatgatgcaatcaagtttattggtatgtcaaatttattgccaccagatctcaagcaggtgtggacaactgctgattctaagagacagggatttcttggtttcaaagaatttgtttttgctatgcagctggtttcgctggtgcaagaaggtcatcaaatatcacatgatctcctgaatggtgatggttttatgatttagcatgtccctctttctaaattgcatggtttgaatgtttatttcattcttaaaaattttgaggtgtatttatttatttaagaactgnttttttg

SEQ ID NO: 12382 - DNA, 488 bp, Gossypium hirsutum
  Clone ID: uC-gsflmaxxa047h11b1
cagattttaaggaaatggtttttcaattcaattttctaggtcttctattatgtcttatgtttttaatgtgtggcagaggcaatgcagtaagggatttggaagagaaatatgatcttgaaagccatggcagagacgacgaagtggagagtttagatgacaagtacgttaccgcttactttcatcaaacttttgattctgcaaatcactttgatggaggtgatgaagtgaagaatttagaagacaaatattcagcggcttacttccacaaatcgttagattctggaaaccatggcagagacgacaaagcaaagatattggaagacaattatgctactgcgtacttccacaagacttctgtttttgaaaaccatggtgaaggtgacaaattaaagagtttggaagacaaatattccacggcttactttcacaaaacaatatcttccaaaatgatgaaggatcacaacatggaacatcaccacctttaccat

SEQ ID NO: 12383 - DNA, 498 bp, Gossypium hirsutum
  Clone ID: uC-gsflmaxxa048a03b1
cgaaaggggttattacgaggaagagttgcaggcgagttcttgggatcacggtgaatctgataggttgaagaaagataggtaaagagattgtgagaggataattgtcgatagggatgattcgggtaattttgtgtcgagatctgatagaattgatagaattggaggggtatcgggctttgtttcgaacccgaatgtaccaccaccacagatgcacttgcaggctccggcaagggtgccttcacctgtaaggccaccacctgtgaagtcattgaagcagccgaagccaaaggctaaggatccgaacaagagggaaatgagtatggaagagaagcaaaagttggggattggattgcagagcttacctcaagagaagatggataatgtggttcagattgaaggataagaaaggtgggggggatacttttgtattgcatttacccttaaaataaattacttaaatgattttcagaacatcaatagaggtgtttttacagattg

SEQ ID NO: 12384 - DNA, 321 bp, Gossypium hirsutum
  Clone ID: uC-gsflmaxxa048a04b1
gttgtgttcatagtacggaaccatctgtaatttgtttgctgagaaattaacatgagacctcaggcaaacacagagcacatttataagccttttattgctcataactgccatctgtgtttgccttaggtctcatgtttatttctgagcaataaacggcttataaatgttctctttttgtctcattatatatcataatattaatcaaaattgtcatgaatgagtactgttgggcaggtctattgaattctggtttactgacccgtgcattcgtgggattagctctttttttgtgttacctatttctttttgatggccctcttt

SEQ ID NO: 12385 - DNA, 521 bp, Gossypium hirsutum
  Clone ID: uC-gsflmaxxa048a07b1
tcttctcttgagcccgcctctaacttgctggcgactcattcttcacaatttcttttttgaatttattctcgcgatggggtcatcggagctgatattcagaggccatgaaactcagcctgtttccgattcctattcacccaaacccgacaaaccatgggcttccgttacccgcccgattcgttacatgctccgagagcaacgccttctcttcgtcttcctcggcattgctattaccactctcattttcaccctcttcccggcctcacgtgctacgcaacacaacttcgccgattccataacctacttccccatcgacacacagagcaagttctccaacccgcaccgactcggattcggatcgtctaacccgactggcaagatcccgttggggttaaaacgtaaaggcctgaggatcgtggtaacgggtggagccggcttcgttgggtctcacctcgtggaccggttaatagcaaggggagatagcgtgatggtggtggataaccttcttactggcaggaaag

SEQ ID NO: 12386 - DNA, 518 bp, Gossypium hirsutum
  Clone ID: uC-gsflmaxxa048a08b1
ttttcttccaatcatatacaaaaagactctccaatggcttctactatgcctctccccttcttcggcggcacttgcactaaggctgcattctctttctcactcagatcatcttctcctgcggttccgtttgagcgtctccagctttttcgatctacttgcagaacaacaacaaggattcgatcttccttgtttcactcaatgaaagctaaagcaacggccgatctagatcaagataaggaatcaggtgtagttgccaccgggaagccggtggtggagcattcccgtacctacattgaagctcgctccgagcaagaactcctatctgtacttaggacggaagcagatgccggaaggctacctccaattgttgcagcagggatggaagaagtgtatcacaattacataaacgcagttttccaaaggggagatcctgcagctgttggggttgtatccgtaaacattactgttgcatttgaccattgatttttggatgcgaagatccttttgaattgaaccct

SEQ ID NO: 12387 - DNA, 492 bp, Gossypium hirsutum
  Clone ID: uC-gsflmaxxa048a11b1
ttcttatataacaacaatcaccggggaaaccccattcacctgtaattaaacgcaggtctctttcatttcctttacgtttaataatcccttcataacaccatggacatgaagaagatctccaccgccatcattgttgccgctgcctcaatgagcgccgtcatggccgccagtgcaccagctacttcaccttccgccggtggtgctgagcatatctcctctcctgattctggtccagcacctggaccagactccagcgtcgctgctgctgccttgcctgttcttggatcattggtcggggcttcccttgtttctttgttttcttacattctccagtaagctgataaatggatgaagaagtgcataatcggaggttgaagatgaagaacatggagctttatatttatactgtaaactggttactatatatatataagttatatttatatatgtaatcattttggggctctttttcaattcctttgtaaaattttg

SEQ ID NO: 12388 - DNA, 308 bp, Gossypium hirsutum
  Clone ID: uC-gsflmaxxa048b03b1
ttgtggggtgattggccctgatcgctttaattgggatatcaaaccaatgtgtgacgaatatagcttgacagttgggggcaatagacctacatggcgtcaggcagcttcgatgacaaagtgccgaggaacaatttttggttgcacgcagctaagaatttaggtcccccacttttttttcttcttttaaagtagtctgctggtttttttgtgaaaagttaactccttattttgtcgaggcattgcaaatcttccttattggagatgagaaatgaatgtttctttctaatggtaccttggtttcgtaagcc

SEQ ID NO: 12389 - DNA, 374 bp, Gossypium hirsutum
  Clone ID: uC-gsflmaxxa048b10b1
ttcttttttcgttcatcattgaagttcatatcttgctatttagttacaacaagtgcacttatatggggctctatgatggatcatcattgggttcatcattcttttgccgcatgtggggcatgtggtccatgctaagggtatttccaaaacatgttccatttgttggaaagaacatctgctaacgagccgaggctgatgtatttctcctgacaccatggcataccccacatagaggaaattttgttcttggggatcaatatcatgcgtattaaaccgtcgcaagtacattctgctggaactctgtttcgacaatgagtccgcattacccatcaaaaggagcctacctcctactaactcgacctacagcatgttct

SEQ ID NO: 12390 - DNA, 487 bp, Gossypium hirsutum
  Clone ID: uC-gsflmaxxa048b12b1
tttcacgcgtccgtgaccgagagagaagcagccgtaaagctcgaaactctgccgccatgggtcgtatgcatagccgaggtaagggtatttccgcatctgctcttccgtacaaaagaactccacctagttggctcaagatctcctctcaagatgtggaggagaacatttgcaagtttgcgaagaagggtttgaccccatctcaaattggtgtcattctccgtgattcacatgggattgctcaggtgaagagtgttacgggcagcaagattttgcggatactgaaagcccatggtcttgctcctgaaattcccgaagatttgtaccacctgattaagaaagctgttgccatcagaaagcatcttgagaggaaccgcaaagacaaggattccaagttccggttgatcctggttgagagcagaatccatcgccttgcccgcttttacaagaagacaaagaagcttccacccgtgttgaaatacgagtcgac

SEQ ID NO: 12391 - DNA, 505 bp, Gossypium hirsutum
  Clone ID: uC-gsflmaxxa048c05b1
taatcctataattttcagttcattgtttactgttcatcttcctccactagaaaacttgtgttttgatgactttctttgttctcatgctgaaaatctgaaatcttttgtgtgtttgaaattattactgtttcagtccttttgtttttgatttccttttgtttcagtccttttcttttcaagctaagtgttgatcatatatggattctcttcagggtttccaaacatcaaatataaacccttcttccaccaccaatttgaatccaaatttccctgcaaacctctccatcaccaccgtgggaaccaccgccggcgccaccaccaacacgatccctttatcagcagccgcggcctcctcctcctcctcctcttcttccacttctccttcgacactcagtcgctacgaaaaccaaaagcgccgtgactggaacacgttcgggcaataccttcgcaaccaccgcccgccgctctccctgtcccgctgcagcggcgcacacgtcctggagtt

SEQ ID NO: 12392 - DNA, 511 bp, Gossypium hirsutum
  Clone ID: uC-gsflmaxxa048c08b1
ttttaaacccaatttccctttctatattcgtccctttgctttgattcgctgaacaaatagcaattcaattgagcttttaagttgaattcttgaacaaatttaaaaaggaatttacaatatgggaagtccaaataaagatcagaataaagggtttttctcagcgatgacctcgggtttatctttgtttggcaacgccatgcacagatctgtcaacgggttacttggttatgaaggggtagaagtcataaatccagaaggaggaaaagaagatgctgaggaggaagctcatagaggaagatggaagcaggaggtatgcatctttaactgtgttatttagatctctcttttatagaccaattcaacagatgctcttgtttttgctttgctctctctatctctgggaacttttaggaatagttaattgtacttgtaaccttttcttacgggcgatggagatcaagagagacattcgttaatttcactagttttcgaagctgatattttgactact

SEQ ID NO: 12393 - DNA, 478 bp, Gossypium hirsutum
  Clone ID: uC-gsflmaxxa048c09b1
ttatttcttatatagggtcgggcactgttgaacgcaattggaaatttagggcttactggagcttatgcagaggccttgagcaagcttggacacaacctagaaaatatagcttcccaggagcctgatgctgccctagggaatggaggccttggtcgacttgcctcctgttttctggattctttggcaacattgaattatccagcatggggttatgggcttagatataggtatggcttatttaaacagcgtattacaaaggatgggcaagaagaagttgctgaaaattggcttgagatgagcaatccttgggaaattgtgagaaatgatgttgtatatcctatcaagttttatggcaaagttcttacagattcagatggaaagaaacactggactggaggagaggatatacaggctgttgcttatgatgtcccaataccaggatatgaaactaaaaccacgattaacctaagactttggt

SEQ ID NO: 12394 - DNA, 419 bp, Gossypium hirsutum
  Clone ID: uC-gsflmaxxa048c11b1
tcgtttcaaattcgcttaaaaattccccctctttggtccaatcctttctctaattacactaaacgccccttcaatatttgataaacttaatttattgttaaaaaattttcccattcttttttttttaaattcgagatttttccatggccgccgatgtagaataaaccatacattgattgaattattggggtttcgcttcagctgtatggggtttatgaaatgcctgagctgcgaaaaggtttttttagaggccacgccacgttagtacaacctttgcagccacaataaactcggaaacaaacgaggaatcaaggtcgtaaacttgctgttgtgacggttattgaggtaggcagaccaaggtctagattggccgccaagagacttacggatgcggaagaacaccctcaggttgttgcgat

SEQ ID NO: 12395 - DNA, 536 bp, Gossypium hirsutum
  Clone ID: uC-gsflmaxxa048d04b1
gggttctccccctcattctgagaaccctcatatggatactactcctcctcttgataacccccatgacatgggtagttcacacatagatattcaacaagatctcaactctcatatggatactccccctcatactgaaaaccctaatgatatgggcagtccacatatagatattcatcaagatctgtttccagattactatggtggaacagcttctgctccggctccggcttctgccctggattctgctccgtctgagccaaaacttgaatttgagggaaatgataaccataatggaaataatgatagtgctcctgtaattaaagataataattcccctccaccagttccacctggtagtagtggggaaggattaccttatgctcctatacattggccaaatgctggtgatatttggacctggaaagtggggaggagagtcaacagtgctggcttctatggtgatagatttctccatcttcccgaaagtcttcgaaaggcaaatagtccaaaagtctttgcgagcagccagcacttga

SEQ ID NO: 12396 - DNA, 411 bp, Gossypium hirsutum
  Clone ID: uC-gsflmaxxa048d09b1
tcgtacgcgtgggcggactcgtgggttccgtgaatgtcaagctgaactttgtgaccctttaacctgaagggatcgatattgttaccatcaatcgtcccaattcacagaacttcttgaccccgacccatgatggtggacttgaccaaggctatcaaggctcttgcgaaggacaactcggcgcggatcataatctggtcaggagctggacgggctctctgttcaggcgtggatttgacggctgcacaagatgcatttaagggtgacattaaggacccgtagactgatccggttgatcagtatggagcattgccccaaacccatcataagatcttttaacggcgttgctattactgtcggcattgagatcgacctagctagtgacacgctggtcggtgctaagggagccacttt

SEQ ID NO: 12397 - DNA, 371 bp, Gossypium hirsutum
  Clone ID: uC-gsflmaxxa048e04b1
gtatgtagctcaggttgggtctgcaaactggaacttcatgagcaggaaccatggggcggtatgggacacaagcagagtcccaaatggagccctgcaattcagatttgtggtgacatctgggtttgatgggaagtggatttgggcaaaaagtgtgcttccagctgagtggaaaactggagttatttatgattctggagttcaaatcactgacattgcaaaagaaggttgctctccttgtgatgacagccactggagatgagatcttagatgccaattccttaaagtgtgtactgtgaagagataatgggaaagtttcatttatcttaaacaaaaattaaaaaaacctttcttacctcttttttcgatttttt

SEQ ID NO: 12398 - DNA, 536 bp, Gossypium hirsutum
  Clone ID: uC-gsflmaxxa048e06b1
taagtcctttaaaggcaaccactcaagaaacgaatggtaagaagccccaagactggagggttgatattgcttctcctcttgctgctactgtgccaggggctcgtgagaatggttttaaggagaggaggaataatgagaatgcgagatctgcaaagtctgaaataaggcggtcccttttcagtaataagaattccgatgacaagacgcacaaaatcagtggttcaaagtctggctctcgtgttgctccttgtcaagaggaaatcccagaatccactgttgtggttagtaatgcctctgaaaatctcagctcaaaccacaaggactgcgaggatttatctttgatccgcacccaactggttcagatagaaaagcagcaatctagcctactagatcttctgcagagattcatatgcagctcacagaatgggatgaattcactggagacacgcgtgcatggtctagaattggctttggatgagatctcatatgacttggctgtatcaactggaaggatgtctactttccagccgaccact

SEQ ID NO: 12399 - DNA, 528 bp, Gossypium hirsutum
  unsure (1)..(528): unsure at all n locations
  Clone ID: uC-gsflmaxxa048f08b1
tacttaagtggaaagtggcttggcagtcggcagattcgttgtaattgggcaacaaagggtgctagtagcaatgatgacaagcagagctctgatgccaaaagtgtggtggaacttaccaatggctcatctgaggatggtaaagagacaaccaatactgaggctcctgagaataatcctcaatatactactgtttatgtgggcaatcttgctccagaggtcacccaacttgaactccatcgtcacttccatgctcttggtgctggggtgatagaggaggttcgggtccagcgtgataaaggctttggctttgtgagatacagtactcatgctgaggcagctttggctattcagatggggaacgctcagtcatatctatgtggcaagcaaataaagtgttcttggggcagcaagcctacaccaccagggacaagctccaatccacttccncctcctgcagcaccattacccgggttttcagccactgaccttttagcttacgaacgacaacttgccatgagcaagatgggt

SEQ ID NO: 12400 - DNA, 453 bp, Gossypium hirsutum
  unsure (1)..(453): unsure at all n locations
  Clone ID: uC-gsflmaxxa048f11b1
tcgttgctgtcctgcgtgaatttgccaaaacccagattgattatatccttggcaaaaatcctcgaaaaatgagctatgttgtgggctttggtaaccattatccaaagcatgttcaccatagaggtgcatctatccctaagaataagatcaaatataactgtaaagggggatggaaatggagggatacgtgtcaggaactgaatcaatcaggtccatcttattgcacccacttcaatcatcaacaatccccatactcagttcatacccccagaaaaaacaaaattataagtttccctttgcacaattntggtttttggnntngttttttttggggtgttccaaacacacgttattcccaccaggtggccggcacaatgggctacatgcctgccgagtacccgtgaatggaacacaacggcgacggctgtgttctccattttaatccctgttgta

SEQ ID NO: 12401 - DNA, 499 bp, Gossypium hirsutum
  Clone ID: uC-gsflmaxxa048f12b1
ttcggaacctagaaggctctttctttggcactgaaatttgaaaatcgccggggaaattgtggaggctggcgttaaaccggtggttgggcctacctccaggggagatcccgtcacggtccgttcagattctgccacgtttttaccacgaaaacgtcatcgaacactacaacaatccccgtaacgtcggttccttcgataagaacgatccgaacgtcggcaccggtttggtcggagctcctgcttgtggcgatgttatgaagcttcaaatcaaaatcgacgaggaatcggggaagattgttgatgcttgctttaaaacattcggttgtggatcggcgattgcgtcttcttctgttgctactgaatgggtgaaggggaaaagcatggacgaagttcttaccattaaaaacacggagattgcgaaacatctatcacttccaccggttaagctgcattgcagtatgcttgcagaagatgctataaaggcggcccgaaaagacat

SEQ ID NO: 12402 - DNA, 527 bp, Gossypium hirsutum
  Clone ID: uC-gsflmaxxa048g03b1
gctggataaacagaaatggcatgtgtactctgcatctgcagaacctgtgaccgccactggcccggtttacactctagaaatgtgcttgactggtttggacagggataaggcgtaggttttctacaaagaccaatcaggctccgcagctgtgatgaccattaattctggcataaggaagatccttccagagtctgagatatgtgattttgagtttggaccctgtggttactcgatgaatgcgattgaaggtgctgcaatttctactattcatgttaccccagaagatggatttagctatgcaagctttgaagctgtgggatataatctgaaagattagaatctgatgcagttggtcgggagggtgttgaaatgcttcaaaccgagtgacttttctgtagcagttcacgttgatgttggtggtggtcagtcacttgagcagagctgcctgctggacgtgaaagtatactgttgcagagagatgggcattgtagggcttgcaagtggaggttccatgatgtaccagaaat

SEQ ID NO: 12403 - DNA, 518 bp, Gossypium hirsutum
  Clone ID: uC-gsflmaxxa048h01b1
ttgacgcgtgggtaactgacgtgggtcttgggaggacagatttaggcaatctcttatggaatctcttgctattatcttatgctgccaatttcaagatgaaaaccatgcagagacaatttctgaaaatgctgaattctggtttccttcctgatttgactactttcaatataagagcattagccttctcaagaatgtctatgttctgggatctccatctcagccttgaacacatgaaacacgaaagcattgttcccgatttggcaacttatggatgtgtagtagatgcatacttggacagaaggcttggaagaaatttagatttcattttgagcaatatgaatgctgatgaatctccaataatactaacagatccacttgtgtttgaggctttgggtaaaggggatttccagtcaagttcagaagcctttatggagttaaagagtcaaaagaaatggacttataggcagctaattgcagtttatctcaaaaatacagttccgagggatcaaatcttttgg

SEQ ID NO: 12404 - DNA, 524 bp, Gossypium hirsutum
  Clone ID: uC-gsflmaxxa048h04b1
tatttagcttcaactccactttacctgtgaaaaagcttcactcattcattcatgcatctctttttttttcctctaagaagaacaagagagttgcttgaattgaattgcctcaaaactctttgatgtctgtcccaaagctgtttcctttaacttctctttgtctcctgttctcgaagaagaggagcctgtgatatagattgaagaagcaagttagatttaaaaaggacaatgcggttgtttccatcgaattcgagtaagggtcagagtaatggtggaagcaatcgtgctttgttgtatctcaatgtatatgacctcacacctataaataactacctttactggtttgggattgggatattccactcgggtatagaagtacatggtttggagtacggatttggagcgcatgagtaccctacaagtggggcgtttgaagtggaaccaagaagttgtcccggcttcatcttcagaagatcaatattattgggcagcactaacttgtctcgttcagaatttcggtcact

SEQ ID NO: 12405 - DNA, 472 bp, Gossypium hirsutum
  Clone ID: uC-gsflmaxxa048h09b1
ggttaccatgttgggctcaaaggccaatacactgggagcaaggaagagagatttttcattcacaaccatttggcatttactgtcaagtaccatagggatccacaaactgactcggctaggattgtgggatttgaagttaaaccgtacagcattaaacatgaatatgaggggaaatggagtgagaacactcgtttaacaacatgcgacccccacactaaacacacagttgttaattctaacactccgcaagaagttgaagcaaacaaggagattatattcacctatgatgttgaataccaggagagtgatgtgaagtgggcatccagatgggatgcatatcttttaatgagtgatgaccaaatacactggttttcaattgtcaattctctgatgattgttctcttcctttccggcatggtagcaatgattatgttaaggacactttaccgtgatatttctaagtacaatggac

SEQ ID NO: 12406 - DNA, 529 bp, Gossypium hirsutum
  Clone ID: uC-gsflmaxxa048h12b1
ttcggaagttcagctcggaaaagaaagcagcggcgtctcctccggttttaatcccaaaccttccaccggtcaccaccaccaccaccaccaccaccaccagcatttcaattaccaccaccgtttacaacagctttccgatacaacagcgccggcggttaccgggacgtctccggtttacgttttccctcagataattactcagaccacgtctggaaatgatgcgattgcacctcctccgtcttcatcttccacttctccgaccccttacaagagacgccttttgacccaaacgccgtctctcaccaaatcccctactttgtaccatttcaccactcccccgcagttcaattcccggaatacggcgtcgttcttttccttctccgtcgctgctaaatcgtccttttatcgaatcctccaccgtttcaagcacctgcgtcgtcttcgagtttacctacgcttaatcctccttttatctctcccctttttgtacttcttactttcacctccaagccactcccttttacttgac

SEQ ID NO: 12407 - DNA, 340 bp, Gossypium hirsutum
  Clone ID: uC-gsflmaxxa049b02b1
tccacgcgtccgctcgagcctcggttggaccgcgggcggaaattggcctcccgtgcgctcacagccagcggttggcctaaattcgagtcctcgacgacatcatcgtcgcgacgatcggtggtaatgctgcaagcaacctcgttcggagtcgtgcgcgtccgtcgatcgagacccttgaaccctttcggcatcgcaaggacggtgctcgcatcgcgaccccaggtcaggcgggattacccgctgagtttaagcatatcaataagcggaggaaaagaaacttaccaggattcccctagtaacggcgagcgaaccgggaaaagcccagcttgagaatcggtcg

SEQ ID NO: 12408 - DNA, 339 bp, Gossypium hirsutum
  Clone ID: uC-gsflmaxxa049b11b1
tttactcgtgcgattacgggttctactcgacttgttttatttagagaaatcaacatggatctggatctttctccaaaggtggcaaagaaagtgtacggtgacgatgctggaagctactacgcatggtgccccgcagaacttcctatgtggcgacaaggcaacactggggcagccaagatggcccttgagaagaatggcttagccctccctctgtactctgatgatgccaaggaggcttatgtccttcaaggggctggtgacgctgggattattatccctgaatcagaggagaaagagattgcaatcaagaagggtgaagcaactgctactgcatacggt

SEQ ID NO: 12409 - DNA, 319 bp, Gossypium hirsutum
  Clone ID: uC-gsflmaxxa049c02b1
tttcttgcgtgcgctatgacacttggagttcatagggtgctcttgatatcaatggtcgtttggttagtaccggtggttacaacaatggctctgacaccgtgagaattcttgacttatgagatacttgtgagtggcacgaattttctggtgcactaggaaacggaagatggtttgccacacaagttacattatctgatggtaaattcgtagtgttcggcggtcgggatttcctgacatacgaatttgttccgtcagaaggtcaaaaaaacaccatctatgtagtgaacatattcccattcttgaaggaaacacacgatcc

SEQ ID NO: 12410 - DNA, 341 bp, Gossypium hirsutum
  Clone ID: uC-gsflmaxxa049c12b1
tcgtaatctccatttgcctgctctgcacccatttttttctgtaagggaaaaacaacgcttgctttgggaattcaagcatggcggtgatggaaggaggagggacattatcggatgtgtatcaaagcgctagaaagctacttcttcgagcaagggatgggatcgaacgcttagagagattcgtgagctccgtctccggtaccgattctcctgaactctccttcgccgtgaagaaagatatttctcagatccactctctatgcgctgatatggatcgcctcttggcgttctatccccgtcaaatcttaacgcgatctctggaaaagaaaagttgaacaagtggc

SEQ ID NO: 12411 - DNA, 334 bp, Gossypium hirsutum
  Clone ID: uC-gsflmaxxa049d02b1
caattatgctttagcctgagtacttatcttttctttttgggcactaagaaatcccttaggctgcaggtttcagatgactctcctgaataccattctgctgttagcctgcagcagccgacacttaatttactttgttcgcttctgaatggtgtcataaattccctagaaagagcagctgatgaaaaatcattacttctgaataagattcgagacataaatgaactatcatgacaggaggtggatgaagacataaatatgtggattacgcaagatttgggttcggggtctgacgacctacaaatgaggcgaggtataccactggtctgaacgtgcc

SEQ ID NO: 12412 - DNA, 341 bp, Gossypium hirsutum
  Clone ID: uC-gsflmaxxa049e09b1
ttctttaattggttccctttgaggagtgtattgagctacattctagcgataatgcagttttgagagttcctgagtatcttctccttacacataatgggcgcaccttcaacataattgttgatcctatgaatcttcgtgatggtcttcattattatgaagtctatggaattgactgcaaagccccatggcgtggtcctcttttcagaatcccgattactataacaaagccaaaggctgtaatgaatcggccaccactagtttcattctcaagaatgtcattccttccaggccacatagaacgaaggtatatagaggtgccacttggtgctagttgggttgag

SEQ ID NO: 12413 - DNA, 325 bp, Gossypium hirsutum
  Clone ID: uC-gsflmaxxa049f12b1
ttcttgcggccagcaaaaatccaatccagatttctacaattggaaccggattaaggttatgtactgcgatggatcatagttcaccgtggatgctgttgttcgagcacaataatctcttttttcaaaggaaacagcatatgggaatatatcattgctgatctactagcaaaaggaatgagaaatgctaaaaatgctattctttctggctgttccgctggaggattggctttgatattgcactgtgacaggtttcgagctattcttcccgcttttactaaagtaaagtgcatttcaaatgctggctattttctccatgcgcaagatg

SEQ ID NO: 12414 - DNA, 66 bp, Gossypium hirsutum
  Clone ID: uC-gsflmaxxa049g01b1
ttcatatgtacgggttacttatttgttaaaacaccacagggtttgttttttccattatgcattcac

SEQ ID NO: 12415 - DNA, 337 bp, Gossypium hirsutum
  Clone ID: uC-gsflmaxxa049g05b1
tttatttcttgtccgaaactaaaactcttccaaagtctccttttgtcttacaatgtctgtatcaggcttaacggtgcttgacggaacccatctccgatcattcaatccctctttacctgaacttaacggctccgtcagtggagctcaactccttgaaatcgccgactccaaagcctccacctttctctttggtctcttattgcctcaaaaccttaaggcttccgctctttctcgtgtcatcgcgggacccggtgatcatgctgacgttactttccggcaaacagagctcgaaaaagataaagcattccaagtgtctttttgattacatctttgccat

SEQ ID NO: 12416 - DNA, 267 bp, Gossypium hirsutum
  Clone ID: uC-gsflmaxxa049g11b1
ttgtctacgcgttcgaccacgcgtcctaacgaggggtcttaggcgagccttgacatattcgaaactggaccgtgataaccgacacttttctggatcttcaagataactgctggccttgcatgtttttattacatgggagtatcactcaacattcagcgtctgctttcgttcacctaactcttgaaggttcaaacagattattcaatggtattacgtgctaatttgggtggtagggcattacatgaactaccatcgaagtttattcgg

SEQ ID NO: 12417 - DNA, 336 bp, Gossypium hirsutum
  Clone ID: uC-gsflmaxxa049h05b1
tttttggattcttgtagctcccaactataaagggtgtgtttttgatactcattgaattgatctgaagctgcctttcattggtttaaagaggtaatcgtgagaactccaacgatatatgcatcaatcggacttggaaatttctatgtgctgccatacattacttggattttgactatatgaacaaataggaaatgcaggatccctaattgtataggtcttaggaaagctgctgaattcgatatccaattggaaaccgaatagtgtgttaagaactacaacactttggttaaagaaggagctaaaagagggctctttaagttgcccccggaacatcat

SEQ ID NO: 12418 - DNA, 284 bp, Gossypium hirsutum
  Clone ID: uC-gsflmaxxa049h06b1
accaaaaaaacagagctctcaaaatctcaccaaactagtatttccaaaaactcgccattcttggtttaactagctatagctaagctatatcctatatcccttatttgatatatatatattagttttgccttctttttatttggcatcctctttttaaataattttttatggttcattcttaagcttaggcattttcctaccctactccctgcctcctaattttgtaagttatgtaacatccatgtacattttgctacttcatagatgaaaaagccattgtgcat

SEQ ID NO: 12419 - DNA, 350 bp, Gossypium hirsutum
  Clone ID: uC-gsflmaxxa049h07b1
tttttcacgcgttcggactatgtaagcttgtgcgggttgacggtagtcaatcacactacctgtggaacaccaaatggcagctgctgctgaggaccgtgatgctggcggctatgctggagctactgcagacctgtggtcgtgtggaagtgatagctctgtgtgttgctcgcaggttacttgcctttcgatgaccgtaatcttatgaacctgtgcaaaaagattccagcaggtgaatttacttgaccccataggataagttgcaaggcaaggaagaagagcacttatgttctggcttgcaaactgctctcttaacaaactatgtctgtaatttttgaaagaggaggggtttt

SEQ ID NO: 12420 - DNA, 251 bp, Gossypium hirsutum
  Clone ID: uC-gsflmaxxa051a02b1
tcgtttaaacccagatttgttctctctctctctctctttctatttccaatcaattaattcctccattggaggagcttatgattttatacattctaaaaatttttttaacatatttttaaatctttctttaataaactctataattatctaatctttactcaataatttctcaacctatatacaaaattatactttaatacatcactaaatattttatacttattaattatatttctctattttatttatca

SEQ ID NO: 12421 - DNA, 231 bp, Gossypium hirsutum
  Clone ID: uC-gsflmaxxa051a04b1
ctcacgcgtccgttttgttattaaaatataaacttacgatatttacaaatggtgaccttagtgctacttagagtagaaagcttggcaagcagtggtaatttatatattttgtttgtatttttatgtcttaagatgttttttctttttaatctatcttattaccttcattatatatatttatatttttttttactctttttattattttttactaatttatattttattttt

SEQ ID NO: 12422 - DNA, 257 bp, Gossypium hirsutum
  Clone ID: uC-gsflmaxxa051a09b1
ctctctggtttgccggttctttgattgcgacacgaaggctgagtaatccacctgcattgactccctcgacctatcggctttagaacggtgcctacgagatgcgtgcttatatttctcaactgttcaatatctagcccatattcacgctttattgctaatttagtgtatgaaatggaaactgtcatcaaggtgttacaaacttctatcttttttataattacgcttaaaatttcttacctaaagatacttcaataata

SEQ ID NO: 12423 - DNA, 575 bp, Gossypium hirsutum
  Clone ID: uC-gsflmaxxa051b06b1
tcgctcacgcgtccggtagcagagtttctagggactcattggaatttgatgaattcccaatgggttcttcacaatgcagaagtcggcgaaaatggtcatctctttgatctcaatggcaattggtcggttttagtgttttactgttttactattttttcttctacttttctctttatcttattttcctttttttctcttttttttatattttttttttttttctttatctttttctttcttttacttttttatttttatctttctttttttcttcttttctctattatatcttttttctttatttctctcttttttatttttttttttctcttctttatctttttctatattttttttctttattatctttcttttttacttttttaccttttttttattctctttttatttacttctccttcttttattattttacttttatttctctttcttcctatctcctctttatcctcttctttttttatttaatttatcttttatcttttactccttctttttatttttttttttcttatatctattcctcattttttactattcttcttctttttttt

SEQ ID NO: 12424 - DNA, 112 bp, Gossypium hirsutum
  Clone ID: uC-gsflmaxxa051b08b1
ttagtttcttggttgaattcacatatttactgtaccatttaattagatcattctctacttctcttcattactattttaaattcttcctcctttcttctatatttcactttat

SEQ ID NO: 12425 - DNA, 100 bp, Gossypium hirsutum
  Clone ID: uC-gsflmaxxa051b10b1
ctcacgcgtccgattttccaccaaaaaagaaactccattaatggctcttcctgtcgatatcgaagctcttgataaagccttctcaggaattggagtggat

SEQ ID NO: 12426 - DNA, 59 bp, Gossypium hirsutum
  Clone ID: uC-gsflmaxxa051c04b1
ttcgttcacgcgtccggatcagattgttctcctccgaattaataaaaatattaccctcc

SEQ ID NO: 12427 - DNA, 93 bp, Gossypium hirsutum
  Clone ID: uC-gsflmaxxa051e03b1
ctatcttcctttcaacacctaacaaactaaggggtgttattttttaataaaaactctccagtcacctacaaaccaataattaaactatattaa

SEQ ID NO: 12428 - DNA, 242 bp, Gossypium hirsutum
  Clone ID: uC-gsflmaxxa051f07b1
tcgtccccgtccaaaatagacgaacaggaacaagctgaataaaggcgcgagagagagagttgatactcagctcacctcccctcttccacaattaggtgaggaccagggaggccggaaaccccaacggtaaaccttttaccgcgccacacgattctttcgcgaagcgctctctcagacgttttcactcctgcccccgcaagcaaagaggttttaagatcccatttctatcatgttattgttaa

SEQ ID NO: 12429 - DNA, 513 bp, Gossypium hirsutum
  Clone ID: uC-gsflmaxxa051f10b1
tcgtaaaaactcacaggttagggatgatcctccgggatattttaaaaaaatgtttagacatatttctaaaggatcatggacgttctctgaccgcgatcatgtatgttatgtttctgtttgtctttttaacgttttatgttcttttattttttcccttttcgtctctctctcttcttttcttcattcctcttttttttattcttttttttttttctttctttctttttcccttcttcttcttctctttcttttctctttccttctttatctttctttcttcttattttttatctttactcttctatttctttttcttctatctttttattttctttttcttctctttcacttctcctttattttcttctttatcttctttcttattttttttatcttttatttttctcttttttattccacttctttctctttttcgctctcctttcttctatctctatttttcttccgttttctattccctttcttttctctatcctccttctctctctttct

SEQ ID NO: 12430 - DNA, 86 bp, Gossypium hirsutum
  Clone ID: uC-gsflmaxxa051h07b1
atctatcacgcgtccgcatagatataataagcacctccttttatgcaaaccacaaaggaaagcttggagagagacccaaaaccaat

SEQ ID NO: 12431 - DNA, 140 bp, Gossypium hirsutum
  Clone ID: uC-gsflmaxxa051h08b1
atcgctcacgcgtccgcccacgcgtccgatcagtgcattaccactttgatctaatcctcaatttcccaatttctcttgaaaccctaatcctaaatcgatttcccaacttcggcgttttattggccactgaggaaccaact

SEQ ID NO: 12432 - DNA, 61 bp, Gossypium hirsutum
  Clone ID: uC-gsflmaxxa052a01b1
gtattgtatacaaaactcattaagtctctattattagtatcgtaatcacctcattcttttt

SEQ ID NO: 12433 - DNA, 74 bp, Gossypium hirsutum
  Clone ID: uC-gsflmaxxa052a03b1
tttttatttcacttgatacgacaatataattattggttattttattataaaaacacctaaattattttttatta

SEQ ID NO: 12434 - DNA, 128 bp, Gossypium hirsutum
  Clone ID: uC-gsflmaxxa052a08b1
ttcacgcgtccgatttcaagtaaaataaaaacccaaactttttctttagtttagaggggaattggcacaaaatggttatgttttgatgctaagatggagggttacttgttcttttatcattttttcct

SEQ ID NO: 12435 - DNA, 246 bp, Gossypium hirsutum
  Clone ID: uC-gsflmaxxa052a10b1
ttcaagtttacttggcaaggcttgctgagcaagctgaacgatatgacgaaatggtcgaggccatgaagaatgttgccaagttggatgttgaactgactgcggaagagaggaatctgttatctgtgtggtataagattgttttctctattctttcttcattcatttttcttatttcctttttatttataattcttttttttttttttttctatttttttccttatttataatttattttcttatttt

SEQ ID NO: 12436 - DNA, 231 bp, Gossypium hirsutum
  Clone ID: uC-gsflmaxxa052b06b1
ctcacgcgtccgcaagtcttcccctttcttctacctctagaattttgggtgcttcaaattttggagtgcacttttagtttatattctttatttacattactatcttttttctttatctcctttattctcttttctttctctcttttacttttaactttattatttatatatctttttttttcttttcttttatttttttcttttatatttttattttctatttatttttta

SEQ ID NO: 12437 - DNA, 55 bp, Gossypium hirsutum
  Clone ID: uC-gsflmaxxa052b07b1
tatattttcctcagggagttgacctccaatgcttttgatgcactgaacaagatta

SEQ ID NO: 12438 - DNA, 53 bp, Gossypium hirsutum
  Clone ID: uC-gsflmaxxa052c07b1
tcgtccacgcgtccgaaaagatcgaattaaagtagaatcagtagcaaaaatcg

SEQ ID NO: 12439 - DNA, 119 bp, Gossypium hirsutum
  Clone ID: uC-gsflmaxxa052c11b1
tcgtaacttactagtagcaaaactcgctgccccgctgactccattactcactgcttcttattgcaaagccaacactctttcatcagcttccagtatctttaaagctcttaatcattttt

SEQ ID NO: 12440 - DNA, 95 bp, Gossypium hirsutum
  Clone ID: uC-gsflmaxxa052d04b1
ttttcgcgtccgcccacgcgtccgattttatttgtcctctatgttaaatttaactctataaaactatctccatatcattaataaaatcatttcac

SEQ ID NO: 12441 - DNA, 90 bp, Gossypium hirsutum
  Clone ID: uC-gsflmaxxa052d07b1
tcgtacctccaccgatccacctccggtcctccacacggtttcgcccaattccagaatcagaggttagcttagagcagtgctactaccgtt

SEQ ID NO: 12442 - DNA, 107 bp, Gossypium hirsutum
  Clone ID: uC-gsflmaxxa052e04b1
aaaatatgcaagtatcaaaactgttcttcttcacttctccgtctcctcgatgctgattcattccgatggctgttgctgcatctagtgatatacatttcaaccttcct

SEQ ID NO: 12443 - DNA, 86 bp, Gossypium hirsutum
  Clone ID: uC-gsflmaxxa052f04b1
aactaaacttgaactgcccaccatgtaatcggaactttaggacatcttagcacggctcagcttctgattaaaactagtgctacatg

SEQ ID NO: 12444 - DNA, 64 bp, Gossypium hirsutum
  Clone ID: uC-gsflmaxxa052f06b1
tcttttatctcatccggcattgggtctcatagtatcagaagttttaggcaaactgcgaaaagat

SEQ ID NO: 12445 - DNA, 54 bp, Gossypium hirsutum
  Clone ID: uC-gsflmaxxa052f07b1
tcgatttgatatgttcagagaagattttataatacacatctttactggatggag

SEQ ID NO: 12446 - DNA, 154 bp, Gossypium hirsutum
  Clone ID: uC-gsflmaxxa052g01b1
atcttatggcccgtagctgactctgtctatgcaaaaatgctgataaaggttggaggtgaaagggaaatcaaacaaagtgatcctttacttctgaattacggatgtctaagacaatgacttttttttcctggattattggatttgttataccacc

SEQ ID NO: 12447 - DNA, 275 bp, Gossypium hirsutum
  Clone ID: uC-gsflmaxxa052g03b1
cccacgcgtccgggtatttaaagttataggttcaaaaatgaagttcctacagttttcaatgttactgctccctattcttttggatgctcttttgtcgttttcaatgggggcatcgactcatcaagattttcttcaatgcctttcccttcgatcaaatgattctacttccatttccaaagtgatttacacacgaaataattcttcttattcatttgttctggaatctacgatacgaaatcttaggtttaattcgacggataccccaaagactttgc

SEQ ID NO: 12448 - DNA, 54 bp, Gossypium hirsutum
  Clone ID: uC-gsflmaxxa052g10b1
tcgtaaagattcgtttgagagctgaagaggaccatggaagtattgaacagacca

SEQ ID NO: 12449 - DNA, 396 bp, Gossypium hirsutum
  unsure (1)..(396): unsure at all n locations
  Clone ID: uC-gsflmaxxa052g12b1
tctttagatgaggcnaacgacagtaattaattttttttaataatataagatagttttaatatttttatataatataatttactataaattataattattattataaaataattatatattattataatatacattatttttatttttaaatactatatttgactaatatttaattataatatacattttttaatattataaataattaaattatattatttatataatattattaatatatatatataattataatataatacttatattattaataaaattttttttaaacattttttatttttttcatatttattaaacctatatattttttaatttaatattaaaaattatctatcttttcttatttatataataattaaaaaatatttataa

SEQ ID NO: 12450 - DNA, 57 bp, Gossypium hirsutum
  Clone ID: uC-gsflmaxxa052h01b1
atatttagtctccaaggtgaacagcctatggtcaatggaacaatagtatcaaggtaa

SEQ ID NO: 12451 - DNA, 240 bp, Gossypium hirsutum
  Clone ID: uC-gsflmaxxa052h03b1
cgttcggatctaaaaagttattggtatggaagccaatggcctacagttacaaaagttcccgccatttcatttattgcacatcgttatcatcgtttcgctttcacttgtctttgcgttctgatatggcccgtttctcggccctctgcttttcttaccctctttgaagcccaagcaatgaccgagtccgctttcccatcttattccaagtacttccattgcatcccctactttttcataaat

SEQ ID NO: 12452 - DNA, 549 bp, Gossypium hirsutum
  Clone ID: uC-gsflmaxxa052h05b1
tttcttggaagtatgcagtgatagtgaaacaagaaccgtcgtcgacgtcgtcgtcggaggataaaaaggaagaagaaaaacccaaagatggtggtaaagaagagaataaatatgtatatagttttttttttatttaattatttattttttttttattttattatatatctatatttaatatataatttactactcttcttatcatctatccttttatattctattatcataactttttatacattatatttttatttctttatttttctatattatattatcaattctatacttttctttttttttatatatatattctattttatttatttcttattttcttcttatctctttatttatttattttatctcaaatattttttattatattttatctttcattttatttttttattttatatttttttatatatttttattttttattttttatttttttcattttctttctattttttaatttaatttattttttaattacttatatttattttacatttacttttcttatatatacttatttatttt

SEQ ID NO: 12453 - DNA, 132 bp, Gossypium hirsutum
  Clone ID: uC-gsflmaxxa052h06b1
tgttaagcgagtgtatcaactacagcttcacttacgaatcgccgcttcctgttgggagactcgtcgtccagttcgtcgataaagcacaggtttgcacccaacgctcttggaaacgaccttacggtgttgttc

SEQ ID NO: 12454 - DNA, 371 bp, Gossypium hirsutum
  Clone ID: uC-gsflmaxxa052h11b1
tcgatcaacggagtggcagaagaacacaaccattgtgagttgatggtaccaaggtagtcgatcggacgatcggcatctgccctttttcggagcaacgcaacgtgttggcgttgaccatatttccgtttacaagtgctccgatggtatcatcgatgctattcaggggtccaccgccattaccatttccaactgccacttcactgaccacaacgatgtgatgctgtttggagcaagcgacagctacagtgctgatgagaagatgcaaatcaccgttgctttcacccgcttcggtaaaaatttggtacaaaggatgcctagggtccgatttggtttcgtccatgttgtgaacaacgattaccgtcattggatca

SEQ ID NO: 12455 - DNA, 410 bp, Gossypium hirsutum
  Clone ID: uC-gsflmaxxa054a05b1
cgtggagagcctttttttttgtgtagcgattctgggttagtcttttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgactgagaggttcgagaaggaggctgatgcattgaacaaaaggtcattcaagtctgctcgggtgcttgacaagcttaatgctgagcgtgaacgtggtatcaccattgatattgccctgtggaagtttgagaccaccaaatactattgcaccgttattgatgcacctggacaccgtgactttatcaagaacatgattaccggtacctcacaggctgac

SEQ ID NO: 12456 - DNA, 418 bp, Gossypium hirsutum
  Clone ID: uC-gsflmaxxa054a09b1
tcgtgtataccgagaatccgtctttttagggggggggggggattttaattttggagcggggggcggaggaatcggagagtaagcagtcggcggtggagtccgtgatggagaagatcagcgagaagattcacggccatgattcatcgtcatcttcggattcggattcggatcatgagaaaccggcttctccttcttccgttaaggctaagatttatcggttgtttggaagagagagaccagttcatcatgtgcttggtggtggaaaacctgctgatgcgttcttggggaggaacaagaagatttcagctggtgtccttggcggagcaaccccaatttgggtcctttttgagttgattgaataccacctacttgctttaatctggcacatttcgatactctggcttgccctcctggtttt

SEQ ID NO: 12457 - DNA, 417 bp, Gossypium hirsutum
  Clone ID: uC-gsflmaxxa054a11b1
tcgctttctgtctgttgtccgttccttttctaggcccgcttccaggcaaaaactgcgttaatctggttccctctgccgtttcctctccaacgctcgtcggacgaactcaggcaacccttcctcaagtcaccactgaatcgacccccagttgcaaccccaacattactgcctgcaggcacgggcctccactgcaaacaaggtaggaaccccttaatgtaaaaccatcttcaaggccagaatctcgcccgaaacgtttctggtcacgacaccttttccagatctgatttgaatcagattgaaagctgcatcgaagttaaccttcacctctgcgtcgaatgggggactccacatcgcaaaaacattagatctggaatgtgatttcttctctatcgatccaggtcataccaaccggttgga

SEQ ID NO: 12458 - DNA, 509 bp, Gossypium hirsutum
  Clone ID: uC-gsflmaxxa054b11b1
tcgcttatccaacatagcgttactattaaaaaaaaaacccccctctttccaaatataaagaaaagtaaatatggaagaggagagactggaaatgatgttgggaagttacggagggaaggtgagtgtgttggaatgggagacagaatctggtgctgcggaggagacgatgctgctttggggaatccaacagcccactctctccaaacaaaacgccttcgtttcccactcttctctccaactccttcttgatgcctgcggccattctctctccattctccagtctccttcttccttgggaaaacctggagtaactggagcagtcatgtgggatagtggagttgtgtagggaagtttttggagcatgctgtggacttgggaattcttgttctgcaaggcaaaaaggtcgttgaattgggctctggctgtggattagttgggtgtatagcagcttttttaggtgctcaagttatcctcactgatctgcctgatagattgaggcttcttaaaag

SEQ ID NO: 12459 - DNA, 272 bp, Gossypium hirsutum
  Clone ID: uC-gsflmaxxa054c05b1
gttatttttacgacggcgggcctatcgacgtgtgggctctttcgaactgattatcggataatcacttctaagtgcacagtctttggtatcagcaatcaattgatcccatcattgctaaattatgtatcctcttccatcagaccatggattgatacttcgagttgtgcccgaactttctattaactactcccctaagctttaatatgtttttcatgctacactctcggcaagaagctttctactcacaccctcggagggactcactgggacct

SEQ ID NO: 12460 - DNA, 292 bp, Gossypium hirsutum
  Clone ID: uC-gsflmaxxa054c06b1
gctattttttctacgacaagacgatcatcgtgtgcgacggttcgaaacactcaactgagcatgctttcatagtcgaccgacgccggagtcatcaataaatgtgagcccctgattgcacatgtactggatcccacctactgatgataccgtttggaatcacgggctatacgcgtaggtgcttgtcactactcgcttacattttaaggagtttttctggctacattttcgaaaacaacggttaaaactagcacccttggagccattcactgaagaaatcaatttttaatgaaca

SEQ ID NO: 12461 - DNA, 452 bp, Gossypium hirsutum
  Clone ID: uC-gsflmaxxa054c12b1
tttctttcgcgtgggtaaattctgtttgtgtgggcaggggcaattgtttgtataattagaggagaaaaatgggtgttttcacaaaagaagcagaggtgagtaccccactcccaccagccaaggctttcaaggcctttgctgtagatatcgaaaacctaatgcccaaagttgccccacaaacagtcaagagcatcgaggtccttgaaggaaatggtggccctggtactatcaggaagatcacctttgctgaagggcatggattaagtcatgcgaaacacaaggttgatgtattagacaaagacaacttggtgtacgcttacactgtgatggaaagcgattttttttaacaagaagatcgagaaaatcagttacgacatcaagtttgttgcagcagctgatggagggtcaactgttaaggtagctgccacgtttacaccgccggtgacacctga

SEQ ID NO: 12462 - DNA, 104 bp, Gossypium hirsutum
  Clone ID: uC-gsflmaxxa054d07b1
tgtttacccgtccaaacacactaccatcaacggggacttttaaaaaaaactctcctttcataaaaccttcccatccaaccaaatcaaaactcactcaaacaaat

SEQ ID NO: 12463 - DNA, 466 bp, Gossypium hirsutum
  Clone ID: uC-gsflmaxxa054d08b1
tttcttatccgtacaaaaacaaaatcatactagtgaacggttaaaaaaaacatttgtctcatcatccaaacatagcccacaaaggcaaaacatataatacatcattacatctgatcctttgagtgactattagatcatttcgcaaatgagtgagaggatacccacattgttaggacttattcagtgagtatgtagagaatcagccgctttttgtcccgctattctttatctaatgactcaacaaatgtgtatatcaatgaaactgtatacaacctatttttctgaaccaagttttgtcacacaatcatgcatttcacgcgttattatacgactagggcttgttaagggttattcctaaccctatgcagaatgctaaccattttagaactattacaccgttgtcaaatttgaaatctattattgcaaactctaggatcaagcggttttattgcagtttagggcctaa

SEQ ID NO: 12464 - DNA, 504 bp, Gossypium hirsutum
  Clone ID: uC-gsflmaxxa054e05b1
ttttctttttcgcccacgcgtccgcccacgcgtccggggagctcttgttgtcaacgcctgatggcgaaggcggctcgactggaaatcgttgttctaagactagaaaacttcctccaggtccaccaaggtggcctatagttggcaatcttcttcaattaagctcactcccacatagggacttagcttccttatgtgacaaatacggtccactagtgtacctccggctcggtaaggtagatgccatcaccacgaatgacccagatatcatacgtgaaatacttcttcgccaagacgatgtctttgcttctaggccacgaaccctagctgccgtccaccttgcctatgggtgtggtgaatgtgcctagggttcccttaggccgcattgcgaacctatgagaagcaattgtttggagcatttactaaccacaaaaagcattgaatcattcgcgaaacaccgagccgatgaaactcaacaattggtgcgagatgtatcggcccagccga

SEQ ID NO: 12465 - DNA, 444 bp, Gossypium hirsutum
  Clone ID: uC-gsflmaxxa054e08b1
ttgttttcgcgtggttcaagatcacaaaaaatgggggccattaaaatcaaatttgctagggtttactttacttgactgtcaaaccaccatgaacctaggcaattaccatgctcagattgcatctctagctcaccattctaggagcgtcatcacaaatactagcaatctatttgaatcaacggccaaatatccatactctgcttgctctgccttggtaattccccacagagcactgctaagaatactgcctaattggtagccctcataggcgaacatatgctgatcatacataaatggaagagtgagaatgtgccctaagaaaaattcccacttgcttgagataggggatccatgtgagacaagaattgagctgggcaaaattattttatagacaatgaaagcttgtccccgttgagatgccacagaaataggccatgatgagaa

SEQ ID NO: 12466 - DNA, 535 bp, Gossypium hirsutum
  Clone ID: uC-gsflmaxxa054e09b1
tgatttacttctttatttctacgtttttgaatgtttagtttgcgaaaatgagagagttcatttcagttcacatcggtcaggctggtatccaagtcggaaatgcctgctgggagctttactgccttgaacatggaatccagcctgatggccagatgccaagtgacaagactgtcggaggaggtgatgatgcttttaacacctttttcagtgaaactggtgctggaaagcacgtccctcgtgctgtctttgtggatcttgagcctactgttattgatgaagtgaggactggtacttaccgtcagcttttccaccctgagcaactcatcagcggcaaggaagacgctgccaacaacttcgcccgtggccactacactattggcaaagagatccgtgacttgtgcttggaccgtatcacgaagcttgctgataactgtaccggcctttaaggtttccttgtttcaacgctgttggggaggcactggatctggcttggttccctcctttggagcgtttgtctgttgatatggcaagaaat

SEQ ID NO: 12467 - DNA, 517 bp, Gossypium hirsutum
  Clone ID: uC-gsflmaxxa054e11b1
ttgctttagtttccttcccttctttcttcccaaatctgtcaagatccagaagagagaccgccaaatattcggctgcagcaatgccccacctactcctccactatcacgttccaattacaaccgtccatctcagatgttctttcccctcccctaaaccaacggcccatattcacctacgctccaatccaacaacaggcgcgaccgtaaagtgcatggccaatcctaggagagttaaaatggtatcgaaacagataaggagagagctttcggacatgctcttaactgacaaagtgttgcaatacgctatattgcctgaagccgccttaggagccgaccgctacctcttttcccttactaccataagtgatgttgaagtttcagctgatttacaggttgttaaagtgtatgtatctgtttttggtgatgagagaaggaaggagattgcgcttgccggattgaagtcaaaagctaaatatgttagaagtgaagctggggaagcgtatgaagttgcggttta

SEQ ID NO: 12468 - DNA, 529 bp, Gossypium hirsutum
  Clone ID: uC-gsflmaxxa054e12b1
tcgtccacgcgtccggtgatctcgaagcatccagggggttgatatacccttcttcaatttcccgatttcaacaaagtgatttcgaaaaaccctaaccctatctccagcttcaaccaagtctcgaattcttttcgcttttcttatcgtagatcgttgctaattctctcttttcttaatcgatggcggctaaacctcttacgagtgaagcaatcgccctcacagaaaagaaaatggacatgacattggatgatatcattaaaatgtcaaaaaatacttcaaataaatctaagaagcagccaaggataccgaataaaatccagagacctgtgagtaatgctgctaaagataaggccttgaaggtacgacagtacatggactcgcgggcttctgttagacagggggttctagctcaaagaaggtctaatttccaggggaacccggttccttttgtggctgaagctgcacgtagagctgcagttgctccatttcgcaatagagcatttaatagtaggagggtggttaattggac

SEQ ID NO: 12469 - DNA, 543 bp, Gossypium hirsutum
  Clone ID: uC-gsflmaxxa054f02b1
gatctcctcatctctcccactttttttctttcttctagtgacccaatggccgtcactttctcaaatctccacaccgagtctggtcttaaagctcttaatgacttcctctctggaaaatcttacatctctgggaataagctgaccaaggatgacataaaattttatgctgctgttctgaagaaccctggtgattctttccccaatgttagccagtggtataattctgtttcttctcaacttgcggccagcttccctggcaaagctgttggcgttgggtttggtggcaaagctgctccagctgagtctgctaaagctgaggctgcagatgatgacgacgacttggatctattcggtgatgagacagaggaggataagaaggctgcagaggagagggaagctgcaaagaagtcagctaagaagaaagaaagtggaaagtcctctgttctcatggatgttaaaccatgggatgatgagactgatatgaagaagttggaagaagctgttcgatccgttgagatgccttgacttttgtggggagcatca

SEQ ID NO: 12470 - DNA, 473 bp, Gossypium hirsutum
  Clone ID: uC-gsflmaxxa054f10b1
gtaaattgtttttcgtgtttgtctaattttgtgggggttagggtttttaatcgatctgagagagtcagattatgggtggggatggcgattctagtgagtcaggactcggtgacaatggaggaggagaagaagagggagtaatggttaatatccgatgctctaatggttcaaaatttacggttaggaccaaactcgaatcaaccattggatctttcaaagttgttttagctcagagttgcgatatcccagctgatcagcaacgattgattttataaaggccgaatcttaaaagacgaccaaacccttcaaagttactgtttgccaagctgatcatactgttcatatggtccgtagttttgccccatcttcatcagcccctcctcctgttgctactacaaatgttggaactcctaatactacaccaggggtcacttcgtggtgttggttctatgagggtgctggtcagggagcat

SEQ ID NO: 12471 - DNA, 498 bp, Gossypium hirsutum
  Clone ID: uC-gsflmaxxa054f11b1
tctgtctaaaaaacacccaattgaccaccatgtgtggattaatcaacatcctaaccgtccttgtgctacttacatttagttcggaaattgcagatgccgcacctccgtgccaggaggttatcgtgtcgattaccccttgcttgagcttcataaaaggccaacccgatccggcaccaggatgttgttcgggtgctaaagggcttgctaagcaagctaacaccaaactagataggcaaggaatatgcgagtgccttaaaggtgtattgccaaaaataggaccatatgaccctaaaagattccctcttattgcccagaaatgtggtatcaatactttaattcctccaatttctgccactactgattgcaccaaggtgtgaagagtgaagtggggggaatgtgaaaatggaagagcatgccaaatgaattaaaaaatgggcagaactttttcataatttgatctggaatcaccccttgtattgcacttaagttatgataatt

SEQ ID NO: 12472 - DNA, 492 bp, Gossypium hirsutum
  Clone ID: uC-gsflmaxxa054f12b1
tcgcttacgcgtccgcccacgcgtccgcaaaaatttgatggctcggaaattctttgtcggtggcaactggaaatgcaatgggacaactgaggaggttaaaaagatcattacaacattgaatgaagctgaagttccttctgaggatgttgtggaggttgttgtgagccctccatttgttttccttacctttgtgaaaagtctgttgcggtctgatttccatgttgctgctcagaactgttgggttcgcaaaggtggtgcttttaccggagaaattagtgctgagatgcttgttaatctgagcattccatgggttatcatcggtcactctgaaagaagggctctcttgaatgagtccaatgagtttgttggagacaaagtagcgtatgcactttctcaaggcttgaaggttattgcctgcattggggagactcttgaagagcgagaatctggctctaccatggctgttgttgctgcacaaaccaaagcaatttg

SEQ ID NO: 12473 - DNA, 227 bp, Gossypium hirsutum
  Clone ID: uC-gsflmaxxa054g03b1
attttatataaagctggttgaaattgatgtgcagggggggagttgattcttggactggagtgatcaactattatgggcctcgcccaagcacacggtctcatcaggtatttgttgcaaaccatacatcgaaaatagatttcattattctggagcaaatgacaacacttgtctgtattatgcaaaagcattctggatgggttgcgtttattcataagactatcttggaa

SEQ ID NO: 12474 - DNA, 487 bp, Gossypium hirsutum
  Clone ID: uC-gsflmaxxa054g05b1
attgagttctcgtgtgttgctctctcctatccagggctttcatcccactctctcttcctctgttttggtttccgtttctttattttccagtaaacatggagatggtgacgatagcataattatctctagtattagattatcctatcttttttcttaaagatcgaagcaatgagaagtagtagaattcagagctcaacttggtattcagcatcatcttcctccacgtttcctcgtcctccatgtctcacctctacctctcgccattgcaggctgtctatctctcagagggtgtctagaatttctctactttcaagctgttcctccggattgtctaagacacaattgtcagtttctacacaacggaacgaacagaatttgttgtccgtgggcgtcggtgcggatgctttggtgacttcaaacgctccaggtgtctccaatgagcctcttgttgccgaggaaaagattggagtgctgttattgaaccttg

SEQ ID NO: 12475 - DNA, 489 bp, Gossypium hirsutum
  Clone ID: uC-gsflmaxxa054g09b1
ttgtttgtggttcttggaaatttggctttgttgcttgacgtgacatctgcgaggaccgttacaacggaccgaaaatctcgtcccttggcgatcgacgtcgttttgaatctgcagaagagggatccgcatttctcccacgtttctcttcccaacaagagccaactcgactactgggacggggagaatcgggcaccccgtgccgtggctcgtggcaaagcgaattcgaaagtaaaggcggtggattttgacgcggcgtccagtgacgacgatgagaacggcaacggatttgaggaggaagaggaggagtacgattgggagaacgaaatgaggaagagagttaaagaaattgaggagatgagggaattggagaagaaagcagaggagctgcagagtaaagcggaagcagaggaaactgaaggtgaaaggtgaagtgcatgttgaggagaaaccgaggaggaaaagaggatgagagtgagaaaagagctcgaa

SEQ ID NO: 12476 - DNA, 237 bp, Gossypium hirsutum
  Clone ID: uC-gsflmaxxa054h01b1
gttttgcttaaacgtcgattacccaatactatcaagggctcacctaataaaaacgacgggctctcaaaggctacatcatgcataagtgctcagccctcaaccagcaacatggctcatactttgaacatcggaattacaaaaatgtatacaggagtaacgcttggctgtttcttttaggacgagttgacactgaagaaaaagagctagcaataatggaagtgatacatttcttggatg

SEQ ID NO: 12477 - DNA, 345 bp, Gossypium hirsutum
  unsure (1)..(345): unsure at all n locations
  Clone ID: uC-gsflmaxxa054h02b1
cctttgtttccgcccacgcgtccggttttctcctggctggccccttatcttctctggggctcttcatattcttcctttctcttcttcttagctgccgtttcttgcacccctcttgggttggcgattcttttttttccccgaataatcattaatcgttcggttcgtttgcaccaatagttttgtgcacatgcctctntattctattttacacgggtatgatcctaacggtagattggtaagtgtaaaccttccaatccatgggtaagatttggttttcgagtaaataaatcgtgtgtacgatttatttcacttattgggtaatccgggttcttcgatttctgaatc

SEQ ID NO: 12478 - DNA, 167 bp, Gossypium hirsutum
  Clone ID: uC-gsflmaxxa054h03b1
cttttctttaggttaactgcagcgcgccatttgctgcggggatggatgttctcacttgtcaaaaggtaacaaagaaattcaggtgtgtaatacgattcgttgctgtaattccatggcgagtagaggatttccgctctcctgatggagtttatagggttaagttcacc

SEQ ID NO: 12479 - DNA, 434 bp, Gossypium hirsutum
  Clone ID: uC-gsflmaxxa054h09b1
ttattaatttctcgaagatctgcacaacaaagagggggtttttttcctcactgagcagagcgatgaccgaccccatcggaccatcaacgtcaacgattccgaatccaagtgcgaccactcttctccacccgcgacgcgagcctttcgagcacggcctcctaccaatgcagaagctcatattcactgacccactccaggccctaacctctctgaagcaaaagctcgtatcatcctccattcaacgagtcgactcggcggccctcgctgacgccctccagatctctttggaccatgcacgtctcgtcctcgacactctcgcctcggtgctccactccgaatccgaccctctcgtcacctcgcgcttcgacgatgttgactccgttggtgctgatttgcttgatctgatcctggttttggacattcaatcgtataaa

SEQ ID NO: 12480 - DNA, 406 bp, Gossypium hirsutum
  Clone ID: uC-gsflmaxxa055a02b1
gattacatgcagttatacccagtagtaagagaagtgaggcatacaagttgctttttggtgaactaaatgaagagaggcagaaagcacgccatatgatgaagagaatgttcaatacatcttttggggccaccttcctcactgacaaaggtcaagaatctgtttttgcttattacattcatcaatttgctgatgtgtatcactagtaaaccagaaaacttttttgttctttttacccgagacgtggctttcatgcacccctgggatatcaagatcatgccttatcatgtgaagatttcatctagtttattcaaaacatgaggatgtttctcaatgccttaaaaagattgttgggcccattttgttaagctcaaaatttggcaagcttattgatgtttctgcactgcga

SEQ ID NO: 12481 - DNA, 427 bp, Gossypium hirsutum
  Clone ID: uC-gsflmaxxa055a04b1
tttcattctttgtcgtttgaacttccggttctaggccgcggtaaaagacgtgcttgagattatggacccaagagaggtgtgctcttagttatggattctatgtgggagcttttgtatttgcttgagcctgccccactgactcttatacttacagctatggctgtgacatttggatctgcatttcgcgctctgaattatgggaaagaaatggagcggaactgacactttgtcggaagcatcaatttactctagatcggtcccaagccttaatgatcccaaataatgcgcttcctgtcacttgcttttgatgggtaacctattttcttctggccaacaacttttgactgcatttacagcttttgcctatgtttcgtcctttatttttctgccaaccccgcacttgcctatttgaatcacaccttggttg

SEQ ID NO: 12482 - DNA, 97 bp, Gossypium hirsutum
  Clone ID: uC-gsflmaxxa055a05b1
tgtgctacttaatgggtttcaagcccgtagcctgcttgaaggctcccaagcaaccagagttcctaaccctcaggaaacccgaatcttcaatcttttc

SEQ ID NO: 12483 - DNA, 241 bp, Gossypium hirsutum
  Clone ID: uC-gsflmaxxa055a06b1
catgaggtaaacgctgtcaatttggaaaaacgcaagcgcaaacagggatcgcattaggttatcttcttcttctttttttcttttttcttttagcaattccttcaactgaaaggggaaaataaccctaattttgtctttggattggtctcccaagtgaggaaagggagaaaaagaaagaaactttgaagaataaaaatggtgtttttactttaaagcccgaccagaggttggcgatttcaca

SEQ ID NO: 12484 - DNA, 348 bp, Gossypium hirsutum
  Clone ID: uC-gsflmaxxa055a11b1
tgttggaacaaagcaatgatcttttgggagggataaagcagcttttttattgatcatcccggagctgtacccatatctacagcccatggggaggagctgcaaaagctgatcggatcaccagcttattattgagtgcagtgcaaaaacgcatgagaatgtgaaggcagtgtttgatgcaaccattaaagtcgttcttcaaccacccaagcagaagaaaaagaagagcagagcacaaaatgcctgcaccatattgtgactgggaataggtaatgtaaaaagattagggccttctatcctaatcacggtgcctcgacttgaccctttcataaaggtgcccttgacttggac

SEQ ID NO: 12485 - DNA, 372 bp, Gossypium hirsutum
  Clone ID: uC-gsflmaxxa055b01b1
tgcctaaacctttcaaccaacgtcaatctcgacggcgtcgacacctccgccatcctttccgaagccacctcttccgtcgctaaactcatcggcaaacctgaggcctatgtgatgattgtgttgaagggtttagttcccatgtcatttggtggtaccgagcagccagctgcctatggagaactggtatcaattgggggccttaatccagatgtgtacaagaaactgagtgcttgaattgctgcaattcttgaaaccaagcttcaagtgcctaagtcacggttcttcctcaaatttctacgaccccaagggctccaactttggatggaacggatccaccctttgagcctggcatgttctgaattttctcgaaac

SEQ ID NO: 12486 - DNA, 389 bp, Gossypium hirsutum
  Clone ID: uC-gsflmaxxa055b02b1
tgctttgaagttgaaaggtgtttcttatgagtacataaatgaggatttctttggcaacaagagcgatttgcttttgaaatacaatccggttcataagaaagtcccggttcttctttcacaacgggaaaccaattgtagagtctcttgttatacttgaatacattgaggaaactttggaagcataatccctatttggcacaagatccttatgacaaagctaccgtttcgattcttggatcaagttcatcgccgaaaagtgctatcctaccctttggctagctgcatggagcgcctagaatgagcgagaaaaagagacgaatgaagcttgcgagtatctgaaaacgccttgaaagtgcgcttaatggaagaatatttttggtggagaaacc

SEQ ID NO: 12487 - DNA, 374 bp, Gossypium hirsutum
  Clone ID: uC-gsflmaxxa055b04b1
cattatcatgtgtgaggatccaagatgccaagtagggcaacactttggttgtgttataattccagagaagcctatggagggaaatccagcagttcctgatttcttttattgtgagctttgtcgactgaagcgagctgatcctttttggcttactattgcaaaccctttttatccagtgaagttggcgattgcaaatatccctactgatggtacaaatccaatgcatagcgtggagaaaacgttccaaatcactagagcagacaaggagttgttgtccaaacaagagtatgatgtccaggcatggtgcttgcttctgaatgacaaagttccattcaggatgcagtggcctcaatatgcagatctacaggttaatg

SEQ ID NO: 12488 - DNA, 419 bp, Gossypium hirsutum
  Clone ID: uC-gsflmaxxa055b05b1
ttttagccaaagaaaactccatggctaaacttgttgctactctcttcttggctctcattgccatctccatggttcaaactttggttatggcatcacatggacatggtggtcaccattatgataacaaacgttatggacctggaagtctcaagccttaccaatgttcatctcagtgcacaaggaggtgtagccagacacagtaccataaaccatgcatgttcttctgtcagaaatgttgcaggacatgcctttgtgttccttcagggtattatgggaacaaacaagtttgcccttgctacaacaactggaaaaccaaggaaggaggccctaaatgcccttaaatgactcaaaagaagaccctttgtttgctttgtacattattatccctataaattgtctatttgaaattcaagtcattt

SEQ ID NO: 12489 - DNA, 303 bp, Gossypium hirsutum
  Clone ID: uC-gsflmaxxa055b09b1
gggagagctacttgcgggcacccccgcaaaacgtcaggctgtgacctatccaaccaacacagtttttggaaccaagcgtctaatcggtagaagatatgaagatcctcagacgaaaaaggaaatgggaatggttccttttcaagattgtcaaggctcccaatggagatgcgtgggttgaagcaaatgggcagcaatattctcctagtcaaattggggcatttattttgaccaataagaaagaaactgcagaggcttatcttggaaagggtgtctttaaagcagttatcactgtttcagcttatt

SEQ ID NO: 12490 - DNA, 226 bp, Gossypium hirsutum
  Clone ID: uC-gsflmaxxa055c02b1
aaaaatggaatttagaattgtgtttgtgtgagaaaatctgaaaggggtgttgtttgggaagcacattatgattttgccgttaggattgtcgggaagataatgggataagtagaatgtattgacgtatttcataccgctctgaagacatcttttttgaatttgttataacctatatgcgaccttatgtttggctgagaaatccaccttttgatccaacataccattg

SEQ ID NO: 12491 - DNA, 355 bp, Gossypium hirsutum
  Clone ID: uC-gsflmaxxa055c08b1
cattatcaccttcttcttcactctttttaatttcttttcatctccaaggtctatcactaattttcaagcatccagtcaagctagctttgtaagacagtcaacttcactgcttcattttcagttctattctctcaacacttttcagccactaagtcagggacatagcaatggagtacgtagagcctgttgttggcattgcaatttgtcctcggcactcctgtttgtaaatatttgcaatattcacagaaagctgaacgactatgtgagaaacttcaagaggatcagagatgagtttaattgccaaatggaagatatagagctgcaattgaaagcagagcttcttcggcctctgggg

SEQ ID NO: 12492 - DNA, 455 bp, Gossypium hirsutum
  Clone ID: uC-gsflmaxxa055c11b1
tccgctaaagtattcttcgaagaacgttttgatgagggatgggaaagtcggtgggtaaaatctgactggaaaaaggatgagaacatggctggggagtggaattacacttctggaaaatggaatggagatcctaacgacaaaggtattcaaactagtgaagactacaggttctatgctatttcagctgagttcccagaagtcaacaacaaagataagactctagtcttccaattttctgtcaagcatgagcaaaagcttgattgtggtggtggctacatgaagttgctcagcggtgacaattgaccagaagaaatttggtggcgaaaccccatacagcatcatgtttgggcctgatatctgccgctatagcacctagaaagtgcatgctattcttacctacaatgggacaaaccacttgatcaaaaggaagttccttggagactgccaactcacta

SEQ ID NO: 12493 - DNA, 364 bp, Gossypium hirsutum
  Clone ID: uC-gsflmaxxa055d02b1
ccagaaacccggatctgatccgtggtgtgggaaagtattccaggtctaagatgtaccacaagcgtggcctttgggcaatcaaggccaaaaatggcggtgctttcccccgccatgatcccaaacctaaggcccccgctgccgctgagaaacctcccaagttttacccggctgaggatgtcaagaagccgttccttaacaagcgcaaacctaaacccaccaaactcagagcaagcattacaccagggactgtgttgattttgttggctggaaggattatggggaagagagttgttttttttgaagcaacttacttctgggctccttttggtcaccggaccattcaagatcaacggtgttcctttaa

SEQ ID NO: 12494 - DNA, 475 bp, Gossypium hirsutum
  Clone ID: uC-gsflmaxxa055d06b1
ccctgtaaattcaaagccttctccaagaaaagccactgcctcttgctcaactgcttccgattccactgaaaaacaattgccaaactatctcaagcctacgaagagttcacgcactgatgctgcactcaagaatttaaagaaaccgggggccgaagacccttgccaaagttcaagtgttatgagaagaagatcttttgataggcctccctcagctgctcgagctcacaaggcactgatctctcctgttcgacaaaaatcagcatcagcatcagcatcaacatcaacatccccatctttttcttctaaatctgctactgcacccaaggcacctttggaaagggttgccaaaaaggcaattgctgcagccaaaccacacacgcagacgttatcttcgttaggagggcccctataccactacctctgctctactagaactagttgagtagaggggacttctactcttcatgaaacttca

SEQ ID NO: 12495 - DNA, 390 bp, Gossypium hirsutum
  unsure (1)..(390): unsure at all n locations
  Clone ID: uC-gsflmaxxa055d10b1
cttcaactctgactctccgnctctgaacctccttctttcgttcttttcttattcagtattgtaaaagatggccgatgctgaggatattcaacccctcgtctgtgacaatggaactggaatggtgaaggctggttttgctggtgatgatgctcccagggctgtttttcccagtattgttggtcgaccccgacacactggtgtcatggttgggatgggtcagaaggatgcctatgtaggagatgaagcacaatccaaaagaggttttcttactttgaaatatcccattgagcatgggatcgtcagcaactgggatgatttggaaaagatctggcatcatacattttaccaagagcttcgtgttgcttctgatgagaccctgtttttttacgg

SEQ ID NO: 12496 - DNA, 367 bp, Gossypium hirsutum
  Clone ID: uC-gsflmaxxa055e01b1
caagagctaaccacaattacagtggtgaagacgaagacgacgacaagattaccagtttcttttttccttcagtcaaatccagtcctcgcaacgcttcttccaaatacgacttcgtcaaggtgagggtctggttgggtgataacgccgatcactattattgtttatccagatttttgctcagcagaatgttaactgtcacaaagattccgaatcatgtagctattaaaatcgcttttgagcctcaagaagctgcttatagacaacagcccttttggatgtctcaccagactggatttggaagttaatctttttaagctaatggagcggcgtggttattgggaagagtttataaatgggtcaagatgat

SEQ ID NO: 12497 - DNA, 376 bp, Gossypium hirsutum
  Clone ID: uC-gsflmaxxa055e02b1
ggttttgatcatcggaggaactggatatctgggaaagttcattgtggaagccagtgcaaaagagggtcatcccactttcgtttttgtaagggagtccaccgtctccgaccctgttaagggaaaacttgtcgacaacttcaagaacttaggggtccatttgttgttaggggatatgtacgaccatgagagtttggtcaaggcaataaagcaagttgatgtggtgatttcggttgtgggtcaaatgcagttagcagatcaagttaagatcatttgctgctattaaagaagctgggaatgtcaagagattttttcccatcggaaatttggaatggactgtggacaagaacaattgcggttgagccagcaaaaatcgaca

SEQ ID NO: 12498 - DNA, 291 bp, Gossypium hirsutum
  Clone ID: uC-gsflmaxxa055e08b1
agctgccaccggtgactgagatccgatcacaggtgcttgctgagggatcttgtatgttgggtgaggaggttctcaggaaaatgtctgtatcccaagctgttcagcgaacgaagcccatgtccgtgactgctgatgctgctcctttattactggaggccaaatcaggcgaagaggctgctccactgaatgatgttgcacacaggaataggctggcgaatgagaccaggctagatataaggcatgcgacagacactgggagtcgtgagttgcatcaccacaactcattagaca

SEQ ID NO: 12499 - DNA, 434 bp, Gossypium hirsutum
  Clone ID: uC-gsflmaxxa055e11b1
cggagaagagtttcaagtacgtgatccttggcggtggtgtagctgctggatatgcggcgagagagtttgccaagcagggagtgcatcctggtgagctagcaattatttccaaggaggcggtggctccatatgaacgacctgccctgagcaaagcatatctcttccctgagggagctgcaagacttcctggtttccatgtctgtgttggaagtggcggagagagattgcttcctgagtggtacaaggaaaaaggaattgaattgatccttagcacagaaatagtgaaagcagatcttcctgcccatactctagttagcgccactggagaaacattcaagcatcaaatcttgatcattgcaactggttcaacggttatcaaattgacagattttggagtgcaaggagctgatgctaaaaacatcttctatttgaga

SEQ ID NO: 12500 - DNA, 381 bp, Gossypium hirsutum
  Clone ID: uC-gsflmaxxa055f01b1
tttcacacctaaactttttctttctttcgacagttgtttgatcaccgcttcaatttgggttcatctcattgcttaattcttcatttacaagttcaagatgcttggaaatggtgttgttgggattctttccgagtcatcaaataaatgggaaagaagggttcctctcaccccatcacattgtgctcgacttttacacagcgggagggagaaaacaggtttagctcgtataatagtgcatccatcggcgaatcgcatccatcacgattcgctttccaggatgttggttgtcacatattagatgacttattcagaatgtggttttttttttgggttttcagccaccaaagttagacctgtttcttccttataagagtttatgcc

SEQ ID NO: 12501 - DNA, 217 bp, Gossypium hirsutum
  Clone ID: uC-gsflmaxxa055f02b1
gcatgataaacacagtgattatgatgagttcacccttttgcctcaacctcagcctttttctttgccttctacaatcccagattggcctccaggtcaaggatttgccactggaaaaattaacctaggagaactagaagtggttaaaattaccaagtttgagggtgttggagcttgcgattcggtgcaccggtaagctaaaggttcccacatttttaca

SEQ ID NO: 12502 - DNA, 445 bp, Gossypium hirsutum
  Clone ID: uC-gsflmaxxa055f04b1
gatcccctcaagataggtcctggggacaactcagaggtgattgggaatgctctgggacttgggatcttgtccggcaaaaattcaacgaccgtggtgatgtacttagattttggatttactgccggaaagtttaagggcagctctattagcatattttcaaggaatccgttaataaagatggaacgtgagctttcggtggtgggaggaagaggagaattcaggatggcagaagggtatgcacgactcaagaattactttttcgatggcaccactgttattattgaatataacgtgaccgtaattcattactaagaggacattctcttggactgtgcaaaattcacatggttttgcagcacttgattagaataaatgtatgagaaatttagtaaatttcatcatacctttaaatgaattcaacttaaaattgactcatattatttgt

SEQ ID NO: 12503 - DNA, 324 bp, Gossypium hirsutum
  Clone ID: uC-gsflmaxxa055f06b1
taatataaaataattgcagtagttgacatttcgagtagcaatggctcctggaggcagcgcttgcaaagaagtcattgaatctcattcccctgttgcagattatgacatagcttcagcaaaatctgagagtaataatgccactagtactactacaacaacaacaatgaaaacttcagttaatttagttggaaaacatggaattcattcaaacaacggtgtttatgagcttcttgagtgttctgtatgcacgaatttgttgtattcactaatttaccagtgcccaaatggacacactttgtgtttgaactgcaagaatagagtgca

SEQ ID NO: 12504 - DNA, 451 bp, Gossypium hirsutum
  Clone ID: uC-gsflmaxxa055f08b1
tctatgtttagaagattcagatcgtgacccgccggatccagtatcctctaattgacagtagccgtccgttctagctccttctttctctgaagtttcaacttccacgaagccaatttgaaagggaaaggaaaaccttctcgatccgcttgcgtttcggatttttatttggatgctgcacctgcttcctcagggtattggacatggatgaaatgatagtggagtagcataattctaagcagagaatcaagtaaatggaggatctttccaagtatgcccatagtccagctcatttagctgttgctcgccgtgagtatgctgggcttaggcgccattatctcaacactccctcggcttgccaaggctggcgaggctaatactgaagttgaatctctttgggctgatgaacgggctgatgcttgtctagcctgtattaaatcgtcgcgatgcccca

SEQ ID NO: 12505 - DNA, 346 bp, Gossypium hirsutum
  Clone ID: uC-gsflmaxxa055f11b1
gaattgtcttcagaatcttccgagatcctatgccttgccatttcaaggtttcaagtgcaatccaagaaaactactttcttgttcccttaatatgatggtacatttccagggcgggatgaactcgagtaatgtaccgcggagtatggtagttaaggcaattcctggttccacattaagtgaaaaaacgagtaactttgactcagaggggaaaaaatctgagacatatagtcatgatatgacagaagctatgggcgctgttttgacttataggcatgaattgggaatgaactacaattttatttcgttccgacctaattgtaggttcatgttttgagacttctgaaga

SEQ ID NO: 12506 - DNA, 408 bp, Gossypium hirsutum
  Clone ID: uC-gsflmaxxa055g01b1
tcccccagtccggatattttatttattaccagagtcacagtcgtttctattttcccggatttccctttcctttcgctctttgctctttccgggtccttcctgtttcacgattcctttcgtgttcttcttatctatttatttattccttcactgtttctttcaaaattccctgttttccaatggcgtctattcaactaactcgtgtactatggtcttgcaaattatctgccaatattgcattatcgtctcgtaaatgttgcagttttaggcgtactaggcaactggatttcggtcctttgttgaaaagaaattttcaaaataggaaattgacggctattagatctggaaaatctggaaatgaaggttccttttttagtgcaattgaaggagaagaaaatctgatgtttt

SEQ ID NO: 12507 - DNA, 341 bp, Gossypium hirsutum
  unsure (1)..(341): unsure at all n locations
  Clone ID: uC-gsflmaxxa055g02b1
aacaaagcaatgaagccagtctttaccattatatcggcattattacttgccgtcatcgccaccgtcaacagctgccctccgtcagacatntcnnacgctgttagcattcagagcagctctccacnaatcatacgtaggaatcttcgattcatggactggcacgganngttgccacaactggtactgtgatagctgcnacagtgagtnacaccgagttgccgacattagnnttggtggngagtcccaagaccccattttcgaacgagctcaccggaccgggtatatggtagtgnnnaactcaccggaaatttgcaagttgacccggctttcaaggattacta

SEQ ID NO: 12508 - DNA, 315 bp, Gossypium hirsutum
  Clone ID: uC-gsflmaxxa055g04b1
gaagagtgcataaccgcatggataagctcacactaacccgtcaattttggatccaattcgggattttccttggggggtatcagtaaggaattggaatgtaataatattgattcatataggaggaaaaggttctctattgattcaaatgctgtacctatgggatagggatagagaaagaggaaaaaccgaagatttcacatagtgcttttgatcgaaaaatcaatctgatttatttcgtacccctcgctcaatgagaaaatgggtcagattctataggatcaaacctatgggacttagggaatgatggaagggaat

SEQ ID NO: 12509 - DNA, 481 bp, Gossypium hirsutum
  unsure (1)..(481): unsure at all n locations
  Clone ID: uC-gsflmaxxa055g08b1
ggtgataaggaaataggctccttncctgcaacaccaagaactggttcggcagcacctnnnnngccgatatcggctcctccttcccaactgnnttctccctctcttactcgatcaccgcttcgnnncacggatgatcacatacaacctgcaagcaaaaccccaaaaagttcaaccccaaggattagaaccccacgttttattactcctttgggaagtccaattagaagggctttttaagcttaccaggcttgaccctcaatgatgcttggcttcccatcactgagtcaaggaatggaaatgcctattacgctgcaatttatactctttgttcagggattggtattcaagcccttgtgcttcctggtgctttcacgttccttgggtggtcttggggaatcataaacctgactggggccttatatggcactttacaccctatcttacctggccacctccatgatttcctgaaactggattgcgt

SEQ ID NO: 12510 - DNA, 444 bp, Gossypium hirsutum
  Clone ID: uC-gsflmaxxa055g12b1
gagatggctaaaagagggttgcttccaaaatgcatctccattcaagttcactgcatttcaggcaggaccaagaatatgccttggaaaggactctgcctatctccagatgaagatggcattggccattctgtgcaggtttttcaaatttaatttggtgccaaaccatccagtaaagtataggatgatgactattctatcaatggagaaaggtttgaagctcaaaatagccagacaatcttgttgaggtggccaatggtctacttctggtccaaagttaaaccataccaaatgttgtccaaacgataaatatacactttagaattttgcaagcaatcaattcggattcttaacttataaaaaaaaaaattcttttttctaccttcttatattctatattcctctactattcattttcattctttggctgtcctcttttatatagta

SEQ ID NO: 12511 - DNA, 402 bp, Gossypium hirsutum
  Clone ID: uC-gsflmaxxa055h03b1
tttccccagaattggagatcagcttctccgacgctacaaccatgggatggatcttttctgtaccccgactgggctcagagccataatcagcctggaataagcagtggagttgtcccaaaccagatcagtaatcattcttcaagcctaaaggaacttactaataatcattctattttgaaaaggaacctatcaagcgtatctggatcagagcgagctctaaggaaaaagagaatcgatcaggcatatcgggaaagatgtaagaatcacaaaatggaaatgcaatcaaatgtggagaaccttaaagacgaaaatgatttctttaaagaaagagaattcgtccttactaaaggattattccttaatgaatcaaactttgagagatcaagaaaaaaagattgaaca

SEQ ID NO: 12512 - DNA, 431 bp, Gossypium hirsutum
  unsure (1)..(431): unsure at all n locations
  Clone ID: uC-gsflmaxxa055h05b1
cgtggncgactcgccgaggaacgtaaggcatggaggaagaaccatccccatggttttgttgcgaaaccagagacgttgcctgatggaacggtcaatttgatggtgtggtattgcacgatccctggtaaagcaggaactgattgggagggtggctactttccgctcacgcttcatttcagtgaagattattccagcaagccttcaaagtgttaattttcccagggctttttccacccaaatgtttatccatctggtactgtttgcctttcaatcctaaatgaggatagtggttggagaccagtccttactgtgaagcagattcttattggaatccaagatcttctggatgctttcaaaccctgctgatcctgttcaaactgaaaggtttcaccttttcattcaggaagcttatgtaatataagagaagggtt

SEQ ID NO: 12513 - DNA, 309 bp, Gossypium hirsutum
  Clone ID: uC-gsflmaxxa055h07b1
caaagcggtgaatccacaaccggcgatcgtttgggcttcgtcgagctccgtttatggactcaacactgaaaacccattctccgaacgtgatagaactgaccgtccggcgagtctttacgccgcaacgaaaaaagccggtgaggaaatcgctcatacttataaccatatatacggcctttccctcaccggacttagattcttcaccgtttatgggccatggggaagacccgatatggcttacttcttttttcactaaagatattctttaagggaaacccattgatatctacagaacccaagatcaaaaag

SEQ ID NO: 12514 - DNA, 271 bp, Gossypium hirsutum
  Clone ID: uC-gsflmaxxa055h08b1
ccccagggacactgtcgttacgaccgacacgacgacgttttaaaaaaggattgttacgctcactccgtcgtgttcgatttacaaacaaatgaaatccgaccgttgatgatcctcaccgacacgtggtgctcgtcgggacagttcttacccgacgggacgcttttacaaaccggaggagatttagacgggtttaaaaagatacgaaaattcgaaccgtgtgaaccggaccgtttttgtgattgggttgagcttaaagacgtggagttgataa

SEQ ID NO: 12515 - DNA, 317 bp, Gossypium hirsutum
  Clone ID: uC-gsflmaxxa055h11b1
ttcatacgctctcccacccatggcaagcattagatcttccaaggtttctatggtctccactgttgcacctagctccacaggggttgaagatctgaaacggcctgtcatggctccaaagctggggcaccagacttcccacaccatgccacctgagaagatcgagatctttaaatctttggatgattgggctagggataacagtttgattcatcttgaacaagttgataaatgtcggcaccacacggattttttttccgatcattaccgcgaaggattttgaagatcaagttcgagaacttacagaacgggcaagggag

SEQ ID NO: 12516 - DNA, 357 bp, Gossypium hirsutum
  Clone ID: uC-gsflmaxxa057a02b1
gtttagttttgccctccccatcggccaatgctggggaggggtaatttatatgagggggcggggaataaaatcaagagcttgttacaaggcaatcgaatctaaatgtgcatgcaaatctatttctcgtttatttactggtctttttgggttactcctagaaactgttgcaatctgtttttaggctgtttcacagagtttatgaaaaaaagcatccgacagctttttaggtgtgagagtaaaaaatatcggattgagttctttatttttatgatgctctggtggtctaacagtacattgcacgattatttttaattggctgtaatgggatcttgttcactaaacaaaaaaacctcacat

SEQ ID NO: 12517 - DNA, 506 bp, Gossypium hirsutum
  Clone ID: uC-gsflmaxxa057a09b1
tcggttttcatcatctggctgctaatgatggggtcagggaaaccattgatccggagatcactgcaacttgcaaagatcttggagctgttaagaaagtttttcagcttgcccttctatgcaccaagagacacccatcggatcgaccaacaatgcatgaagtgacacgagttctaggaagcctaatgccattggaacccccagcaaagcaaccaaccacaatcccaccggcaccactttcatctaccaagggcacttcttacatggatgagtatgcaaatctcaagactccacacttagtcaattgcccatctatgagtacctcagatgcacaacttttcatcaactttggagaggttatatctcgaaacagtgagtgaaaggaagtccaatgtcgtcaaatttaaaatcaaaatcaaaatcaaaatatttcatgaatgtgcattagatgattgaaagataaaaaaagatgatgggaaattgtgtataaagactctggtagactggga

SEQ ID NO: 12518 - DNA, 466 bp, Gossypium hirsutum
  Clone ID: uC-gsflmaxxa057b01b1
aatttaaggtttctaattgatttaatctgaacggggcgagatttaagggtttacccttcattcccagaaagactgaactctgtcaggttatagggtttagttgctttgaggttcaaaggattttggtattggagtcctttttggatttgatcaggaatgactcgtagggtgcggcgcaaggtggcaaagaaagggaaggacgacgctgtttcactaagttatcttgaaattgaagttgaggatttaggtcttgagagaaatggcgatgttgattggacaagcttgcctgatgatacagtgattcaattgtttttttgtctgaattatcgagatagggtaagcctgtcgtcaacctgtaagacatggagagttttgggtgcttctcagtgtttatggagttcattggatcttcgagctcataaatttgacactcgaacggctacatcacttgttttaagtgtgtgta

SEQ ID NO: 12519 - DNA, 452 bp, Gossypium hirsutum
  Clone ID: uC-gsflmaxxa057b02b1
gttggtcagagctctgacacatcatatccttgaaatcaagaaattccttaattgtagcagaaaaactctgaaaagcctcatccacaagggatgatagcttttgagctacttcttttgactcttgagcttcagaaatcagatcttctacttcctttgacagctcaattacaaaatcgcaatccccattctttcttcccccagattcattgtaggcaagttcttcacgagccactctagtctcctctcgtgcattaagaagctctttgcaaagctcatcaaacttctccctcgcacttatattctgctctgtagcaagttcgacaagacaattcagattttcttggcttgaagacttttctgtttccaatatctcaatcttctcttgaagttgcttgatcacaagaatagcttcagattccctcaacccaatattcttgtcagcataatttgtt

SEQ ID NO: 12520 - DNA, 444 bp, Gossypium hirsutum
  Clone ID: uC-gsflmaxxa057b04b1
aaatatgtcttacaatttttttttcagtaggaaaacgccttcttccattccccttccccttccccttgcaaatcagtgccattgccaggtaccctacccctgccctgaattcctcaagagctgtgcgatttcgaagaacaatgatgagaaattttggtcaaggaccaatgctagggtcggtgttaaagatgctgacaatatggtttcgggtttgagccaaaacttgagtttgtacgtgcagttttaggaccttgagagagaagttctcggacatcttctacagagaactcattttttatatttacaggttgggattcgattttcccgcatttgatttctttgaaatggagtaaataattgagaattactggaacgcatttgatttttgtggtggtaactgatcttggagaagaagcaattgtgtacattaattgcacaccattt

SEQ ID NO: 12521 - DNA, 338 bp, Gossypium hirsutum
  Clone ID: uC-gsflmaxxa057b06b1
cttttcttttcgtctttttctcccctcttaaagggcctggcatgctctgagctttgctttgtctgtttcaatcttcctcactcttattctgcctttccctttcctcttcttcattgattgaggttaagattgatcattccctgaattttgagactgtcggtttcatcagcgtgcaaaattaccgcttttcttggtttccgactatcatcagctgaaatttcatttttcaaaatacggctgttttttgttatttctatattgacactatgcataagaggtggacaatttgaaagcctctagcaataatatgggcctatttgaattctggtttgcaatct

SEQ ID NO: 12522 - DNA, 526 bp, Gossypium hirsutum
  Clone ID: uC-gsflmaxxa057b10b1
tcgaataaagagagaagaaaatgaatcgttttatagtaaggtcggtgatgcaaaaccacctgagcaatggccgaagcatcagcaacggtcacgtttgcagctccgccatagttgggagaagcttggagttgagcggacaacataacgttgtgatgcttgtaagatttgaatggagaaggatgatgagctctactcctgcttctgtggaaaaggtgtcgtctggaagggaagagaaaatggagaactcggtgacggaagagacgaagggaaaggattcgtcggcgttaagttattgggggatttctagacctaagatcaccagagcggacggcaccgactggccctggaattgtttcatgccatgggaaacttacagcgcaaagctgtcaattgacttgaaaaagcgtcatgtcccaaagaaacttggtgataaattcggtttcaggattgtcaaacttcttcgccttcctacagaatattttcttcagagacgatacggctctcgagctatgatgcttgaaacagt

SEQ ID NO: 12523 - DNA, 446 bp, Gossypium hirsutum
  Clone ID: uC-gsflmaxxa057b11b1
tcgcccacgcgtccgagctgaccttaagaaggcagttcgccaaagccttgacacttaccaagcacaaagagtacctttgcaagtaaacaaccatattgtctcaccaaatgatgtctccaatgaaggtttgaatgaaactgatgtgtttggtactggcctccagaatgaagttggtgaatataattgttttctgaatgttataatacagtctttatggcacttgagacggtttcgtgatgaattcttgcggagatcgacatcagatcatgttcatgtgggagagccatgtgttgtctgttcactatatgaaattttcattgccctgaacattgcatctactgatgcacggaaagaacctgttgcccctacatcacttagaatagctcttagcaacttgtattcagatagtaactttttccaagaggctcagatgaatgatgcttttg

SEQ ID NO: 12524 - DNA, 408 bp, Gossypium hirsutum
  Clone ID: uC-gsflmaxxa057c01b1
cttacgctttcgcccacgcgtccgtttgtgcttgggaaacttaaaaaaaactgtggctttttctttgctagggtttcaacttgaccttgggtgtcgttgtatgtgtaccactccccaccgaggacccactgtggccggtggacggagttacgcaaaaagggggttgagaccctcgattcttcatattatgagggcacaaattgcccaacccaactgacggaggacgagaacttcaacccctttttagatctggcctcgacgactgagaacaagggtttcaactaccagaccgctaggtgactcggagagaatcattaaaagcgtgcatcgacgggcattgcgcgctgagagggccttactgacgtgcagggaacatatggaggagcgggggttgaaagccaaaatgac

SEQ ID NO: 12525 - DNA, 410 bp, Gossypium hirsutum
  Clone ID: uC-gsflmaxxa057c10b1
tcgctttggccacctgaagccaggcagagtttattacttgcagtgcaggagctagggactcgatttccacaagaccttacaaaacttaatcctgttacggacatgaaaattgaagatcaagaaattgttgagttagtgaaacaaattgaggaacacgaaaagaagttgtttgctcatccactccacaagtctcaagatgagaatcaaattagatcttttcagaggaaggcagaggtgaatcatgagattcaacagctcaagtcaaaaatgcgtgattcccagcttcaaaaattccgtgatgaacttaagaaccgttcaagggtcctgaagaagttaggccatattgatgctgatggtgctgttcagttgaagggacgggcagcctggttgatagacactggagatgaact

SEQ ID NO: 12526 - DNA, 516 bp, Gossypium hirsutum
  Clone ID: uC-gsflmaxxa057d04b1
cccacgcgtccgcccacgcgtccgtgccttgcaccatggttttcgtaccctactcgtactgccattcggcgaaagtttaatctcgagggaagctgcgaggcactccataggtcatgtggatgttgtggaagctgcgtagaagatgagttgcaacgtgaacaatgtgaattaacctgtgacttaacaacccatgtcttgtgccatccttgtgccgactgtcaggaaggtcgtgagattcgtcgaaggttgcaccatccagggttcaatgctcaacctgtcttcaccatggtccctcctggcgagcaaaccatggcccgtggagcctaatttcatgttctgcccattccctaccttataactaaaggtaatctagtagctagctcaacaacattttgctgcgtgatgtctatgttgtgaaaaatatattgcgtgtaatgtgatgtggaaataaagctaaaaagcagctttatgttacattttctagtatgaaagttgattgctctgttatgggcagat

SEQ ID NO: 12527 - DNA, 490 bp, Gossypium hirsutum
  Clone ID: uC-gsflmaxxa057d05b1
cttacgcgtgggttcgggatatatgctgttgtatgtctgatatcgtgggtgtttgtgttcttgaaagtaccagagaccaaaggaatgccacttgaagtcattaccgagttcttttctgttggtgcaagacaagctggtgctacaaagaatgagtgaagtcacactgctttcaatggtgtcaaattcttttttcaatttcggccgttaagctttcatcatttttgttccttcttgttgctttgaaaattagggatcctcttattcaaacattaaaattataaaattttcccactagaaattgagtttacgtgtattttacatggtgaaccaccctttttaacttggatttcataaacaataattgcatcaacaaggtatgtggatggatataggtcctgccgactagacgactagggttttcttatgataataaaatccaagacggtcagagagaggcaggactttcaatcccatcgtatctcagttgatg

SEQ ID NO: 12528 - DNA, 525 bp, Gossypium hirsutum
  Clone ID: uC-gsflmaxxa057d08b1
tcgcccacgcgtccgcggacgcgtgggcaagagcaaaccaaaaaaaggctgcaaattcagcttttcaatatctgcttttgatcaatcgaaatggcttcacaagtttctcaaatgccttcttcatcacccctttcttccaataaggatgaaatccgtcccaaagccgattttcagcctagcatttggggagatttcttcctcaattgtcccgacaagaatattgatgctggaactgaaaaacgccaccaacaattgaaagaagaagtgaggaagatgattgtggcaccgatggctaattcgacccaaaagttagccttcattgattcactccaaagactgggtgtgagttaccatttcaccaaggagatcgaagatgaactagagaatatctaccataacaacaatgatgccgagaacgacctctacactacatctcttcgattccgactactccgagagcatggatacaatgtttcatgcgacgtattcaacaagtttaaagacgaagcagggaatttcaagtca

SEQ ID NO: 12529 - DNA, 485 bp, Gossypium hirsutum
  Clone ID: uC-gsflmaxxa057e01b1
ggccgccctttttttttttttttaacagaataggtggttacactttattcagggagattaaaaaacatattattttggatattgaagacaaagtgcaagaaagatcaagcagggatgaatctaatccattgagataagctagggatgccattattaacaacagtaagcaaatagtaaccaggtggtgccacattcggcgacggtggagcctccaaaacagcactcatcgaaccaccgccgtcccttgttttgtgccggcacctcagtttcagcaacctttgattcattgaaatggaatgcgtcgtgaacggcggcgcataaacactatattccacgtctttacttggccttcgtccaagccagaaatgaatagtaaacgctgtcccatatgcaacaccagatgaatgcccctcatactctatcgttacattcccagggtctaaatcattgaattggcgggccatataatcagggacaaaagcttg

SEQ ID NO: 12530 - DNA, 486 bp, Gossypium hirsutum
  Clone ID: uC-gsflmaxxa057e02b1
aatagagatggcgtctgtaataaaatctgcaatgttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggttttggttttgaaggtggtcctgataaatgttgttcttctggatgttccggtaattgtaatcctggtggtttcgttctaccatttcctcaaattccagaaatcccaagaattccagaaatcccacaaatcccacagatcccacaaatcccacaaattccactaatcccacagatcccacaagtcccacagatcccacatgtcccaaaaatcccactaatgccaggacagtcgggatgtgagagtggagagtgttg

SEQ ID NO: 12531 - DNA, 454 bp, Gossypium hirsutum
  Clone ID: uC-gsflmaxxa057e06b1
gtattagcagcttgtgtagggggaaaaaattatgaagagggtttcctttgttgccttgtgtgtggtggcactcgcggtgttgcttgtttcgggtgaaagtcgcacggcggaggcagtgacatgtaatcccgtggagcttgccccctgctcgccggcgcttacgtcgtcctcgcctccatcaagcgcttgttgcagcaagctgaaggcgcagcagccatgcctctgtggatacattaagaacccatctcttaaacagtatgtcaacagtcctaacgctaaaaaggttgcttcgacttgtggagtcccatatcctaagtgttaaatgttgcttaatggtgtatctactatctactggcagcaaataagtgattctttttgctgtcaagtactgttctgaataaaagaataatgataaaatattagttctcccaataccattttcttctctcatctt

SEQ ID NO: 12532 - DNA, 518 bp, Gossypium hirsutum
  unsure (1)..(518): unsure at all n locations
  Clone ID: uC-gsflmaxxa057e11b1
tcgcttctctcgaggtctctttctaaaccatcatagatacacagttcggtaatgagatcaaacacattagagacaacaagcaataaaacccatcatctttcttcgctaataatttaagcaaactttatctttttgctgggtgatggatccaccagctatgatgagcgatggggggtacaatctagcagagatctggcagtatcccgtgagtgaatctgggttaaggaggggtcagtttgggaatgtgccgccgcctcattacgaccaccccaatccagaggtatcgggtggtatgaggagaaggcgtgatggagaagatgaggcagctaaggttgtctccaccagtagtggcaatggcgtgagttttggtgatggaaagagacttaaagcatcaggatgcagagaggagaatgatgattctaaagttgaagcagcagaacccagttcaggcaagccagtggaacatacagcttaaccacagagccacctaaacaagactacatncatgtgcgagctag

SEQ ID NO: 12533 - DNA, 528 bp, Gossypium hirsutum
  unsure (1)..(528): unsure at all n locations
  Clone ID: uC-gsflmaxxa057f04b1
atacaacctcccgagggagtaaattcagtaacgtttcagggaagaaaatatggggagtgaagaggaaccaaaagaaggtttcccgaagatggtgaaccctgggaaagccacaattctggctctgggaaaggctttccctcaccagcttgtcatgcaagaatttctggttgatgggtattttaagaacaccaactgcgatgacccagatctcaggaagaagctaagccgactctgcaaaacaactactgttaaaacaaggtatgtggtaatgtcagaagaaatcctgaagcagtatccagagcttgccattgaaggactccccactgtgaagcaacgattggatatctgtaacgatgctgtcacggagatggctgttgaagcctcacgagtttgtatcaaaaaatggggacggcctatatcagacttaacccacttagtctantgtttctcgagtgaagctcggctgcctggtggtgacctttacttgccaaaggacttggactcagccctgagacgcacgtgtgatgc

SEQ ID NO: 12534 - DNA, 520 bp, Gossypium hirsutum
  Clone ID: uC-gsflmaxxa057f07b1
tcgtgtgtttctctccatctcgccgtctcgcgggcgccctgtggctctcttcagccctcgcatatctcttcaagatctgatctgatctgacaaaaaaatgttcgggagagcaccaaagaaaagcgataatactaaatactatgagatattgggagtgcccaaaaccgcttcccaagatgatttgaagaaggcttatagaaaagctgcaattaagaatcatcctgataaaggcggtgatcctgaaaagtttaaagagttggctcaagcttatgaggtgctgagtgacccagagaagcgtgagatatatgatcagtatggcgaggacgcccttaaagaaggaatgggtggaggcggtggtgcccatgatccatttgatatctttcaatccttctttggtggcaatccttttggtggtggtggtagcagccgaggccgaagacaaagaaggggagaggatgtaaatcatcccctaaagggtttctttggaagatctctataatgggattttccaaaagctttc

SEQ ID NO: 12535 - DNA, 440 bp, Gossypium hirsutum
  Clone ID: uC-gsflmaxxa057f10b1
tcgattttggctttctataaaaaaggttaattttatttactactttttttcgttttgttcgattatcaaaataaaaatggcaacagcagcatctgcgacagagacaatttctcagatgtcttgtttctcttcaatcaaccggagatttcagctatatcatcgatcaacttttcgatccactactttctcaaagtcatttgtcgttacaagaggacatgggcatggggctgaaactactggcaatcaacctaaaactacgccaagctatattgctggagaatgaaactcatttatagaatatatgcctaggacatacgcatacgcagaagagcatgttcctcaaaatacaacttatttacaagaggaacatggtatcattcaacaaaagagggcagcaagaatacatgatttctggtctggcattccttatggtggtcttg

SEQ ID NO: 12536 - DNA, 483 bp, Gossypium hirsutum
  Clone ID: uC-gsflmaxxa057f12b1
tcgcctacgcgtccgttttgtttttaaaatataaacggacgacatctacaaatggggacctcagtgctacctagagtagaaagcttggcaagcagtgggattcaatcaatcccgaaagaatatatcaggcctcaagaagagcttacaagcataggtaacgtgtttgaagaagagaaaaaagaggaagggcctcaggttccgaccatcgatttgacagaaatcgagtcggaggacaaagaggtccgggaaagatgtcagcaggagctgaaaaaggctgccatggaatggggtgtgatgcaccttgttaaccatggcatctccgaggagctcatggatcgggttaggaaagttgggcagaaattctttgaactccctgtggaggagaaagagaagtatgccaacgaccagagctctgggaatgttcagggctatggtagcaagcttggtaacaatgctagtgggcagcttgagtgggaggactta

SEQ ID NO: 12537 - DNA, 488 bp, Gossypium hirsutum
  unsure (1)..(488): unsure at all n locations
  Clone ID: uC-gsflmaxxa057g09b1
tcgctgttcgcgtgggcaacacttctctcctctgtcaaaactccgcggcgcagatccgaggagtttgggaaaccctatctctctctaaatatcaaccgaaaaaagctctcaaaaaactaccctttcttccccccccctctctctctctcactttctctcattctctttctttccagcctttctacactctttttttccccatcgctcctactgttttcatctgcttcaagtcatggcaggtttggcaccggaaggatcccaatttgatgctcgccaatatgatcagaaaatgactgagttgctccaaactgatggagatgattttttcacgagttatgatgaattttatgacagttttgatgcaatgggacttcaagagaatcttctgaggggtatctatgcgtatggttntgagaagccttctgcaattcaacaacgaggtattgttccattttgcaagggtcttgatgttattcagcaagcacagt

SEQ ID NO: 12538 - DNA, 389 bp, Gossypium hirsutum
  Clone ID: uC-gsflmaxxa057h04b1
gataagggtaggttctttgctttcggtcgggtcttttctggcagaggtgcaactggatcgaaggtcacactcatgtgtccaaactatgtacctggggagaagaaagacttgtatgtaaagagtgtacagagaactgtgatttggatggcacagaagcaggagacagacgacgacgttccttgaggtcatacagttgccatggttgggttggatcaacttatcaccatgaatgctacattgaccaatgagaaggaagttgatgcccacccaatactggccatgaagatttctgtgtcacctgttgaacgtgttgctgctcaatgcaaggctgcatcagatctttccatacttgtttgaaggttgaagcgtttggccaagcttgatactat

SEQ ID NO: 12539 - DNA, 454 bp, Gossypium hirsutum
  Clone ID: uC-gsflmaxxa057h07b1
tcgccctcgcgtccggttctgcaagattttgcgagcagtggcctctcttttacagtcagctactttattattcatattctccattacattgattcttgtcccaaacagacacgctattcccttcatcgtattgcacggtaatgttcttatctcaatatcttttctttttaattttaattgcctattgggtttgaattaatcaaagtttctcactttcacttgttatgttgggtcaattgttgatttccatggaaatgggaaccatgtttttggagaaaccaatgaaccgcaatgattgtttgcttggtgggggtattgaaacctttcatatgctatgaagctccattagtaattgtagaacatggtgataaacaaaatgattagtgcaagatgtttgttatcgtcttgctggccaattttgttccaatgcaaggatgaaatttattgttctact

SEQ ID NO: 12540 - DNA, 468 bp, Gossypium hirsutum
  Clone ID: uC-gsflmaxxa057h12b1
tcgatttttggcttctctttcagatttcaaaggggggtacatcaaggaagaggatccacaaagataaggatgctgaaccaacagaatttgaggagtctattgcgcaggcattcttcgatttggagaataccaatcaagatctgaaaagtgaccttaaagatctcttttaattcagcagtccaaattgatgtttctgggagccggaaagctgttgttatccatgtcccgtatagattgaggaaagctttccgcaaggttcatgttaagcttgtgagggaacttgaaaagaagttcagtggcaaggatgtgattcttattgccaccaggaggatattaaggcctccaaagaaaggttctgcagttcagaggccacgcagccgcacattgactgctgtacatgaggcaatgctagaagatgttgtcttacctgctgagattgttgggaagcgcactagatatagaattgat

SEQ ID NO: 12541 - DNA, 514 bp, Gossypium hirsutum
  Clone ID: uC-gsflmaxxa058a01b1
aatttggtttcatgattcagaacatgatgaatgagggaaggattgtttcttccgaggtaacaattaagcttcttcaaaaagcaatgttggatagtggtaatgacaagttccttattgatggttttcctcgtaatgaagaaaacagagctgcatttgaagctcttactaaaattgagccagaatttgtcctgtattttaattgtcctgaaaaagaaatggagaggcgaattcttaatagaaaccagggaagagaagatgataacattgaaacaataaggaagcgatttaaggtgtttctagagtctagtcttcctgtaattgagtactataaaggaaagggcaaggttcgagagattgatgctgcaaagccggttgaagaggtatttaaggaggttaaagatattttaaatccaaaagcccaaaagtccccaaagacaaaaatgttgaggggagatgcatgtgttgtgctattctgtaggtgcccctttagctggaaaacaaaactagtattgag

SEQ ID NO: 12542 - DNA, 426 bp, Gossypium hirsutum
  Clone ID: uC-gsflmaxxa058a05b1
gtttctggtcaagccaatctcaaaagactccccttttagcgcacagctcctctcttgagtactataatgggtaaggagaaggttcacatcaacattgtggtcattggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgagcgtgaacgtggtattaccatcgatattgccctctggaagtttgagactaccaaacactactgtactgtcattgatgcccctggacatcgtgacttcatcaagaacatgattactggtacctcacaggctgactgcgctggtctcattatcgactcgaccact

SEQ ID NO: 12543 - DNA, 356 bp, Gossypium hirsutum
  Clone ID: uC-gsflmaxxa058a11b1
tttgatttttgtaagaatcaacaatggcgacggcgctggttacaacaatcctcttgtcttctttccttgctgattcatcagctgaaatctcgagcaagattggtataaactacggtcgaataggaaacaatttgccatcaccatatcgaaccatcgagaccatgaaatcgatgaatgcccggcgtattaagctctatgattccgaccctgaaatactgaatcttttatcaggtaccaacattcatgtatctgttatgggacaaaacaatgacataatccgtatcgctttcagccaagctgttgccgaacaatgggtacaagacaatgtctttgctttattacccccgacccgatga

SEQ ID NO: 12544 - DNA, 304 bp, Gossypium hirsutum
  Clone ID: uC-gsflmaxxa058a12b1
tttgatttgttcgaaatctatgaatccgttatggatgggtttgaataacctgacgtggggttggagttggttagaacgatggatggcagcttgaccatgggaaggacatggagtgacaggaaaggaaccgaacaacgaccagtcattggtatagagtgcacatttcgaaggagaaatcagcaaagcttacgctcgttaccaactcaatttggataataaacaatccccgaaatcgagccaaaagtctaaccgtacatcaaggtaacctatcccccttcttcgaaaccaccttttcaaaccattc

SEQ ID NO: 12545 - DNA, 496 bp, Gossypium hirsutum
  Clone ID: uC-gsflmaxxa058b01b1
ccttcgcgttcgcccacgcgtccggtggatttagggggagggtaatagtgccaagggccaattacaatgagaaggataagacttttgtctatcaagaggaagggatggcagtgtttaagttgtatgcagtgcattcccgtcaaatctccgctcagcccctcggctaccacaacattagccctgagcctcacattttctctcagttctacactttcaacgccgactcccattccctcatgatccgctgcatccgcgagcatcgcttggccactcccgctgagatccgagccgctacgccgcgttccgtcctcaaatcgtggcgggccgtgtggaaggacccgaacgaggacaccgcttaccttaccgcttgggagcggatccaagacaagcttaccgggcacgtggatcccgattccggtaatgaattcatttgcttcaagaacaattctagccaattcgttttacatgttaatcaatggcaagaaattgttatgag

SEQ ID NO: 12546 - DNA, 502 bp, Gossypium hirsutum
  Clone ID: uC-gsflmaxxa058b02b1
tgtttttttagttcaagcattgccagagtttctgggggcgtttggttctatgtgcagtcctgctgatgcactggtggaagcatttgttaggacagatgttgcatttagagatgaacttgattctcatcgaaaatcaaggagggttattcagaaagactggcatcctggctgcactgcagctgttgctctaattgttaagaacaagctttttgttgctaatgcaggtgactgcaggacaattttatgtcgaagagggtgccctgtagctctaagtagggatcatgttgcaagctgtcctgaggagagaaaccgtgttgttagtgcagggggggaggtaaaatggcaagttgatacttggaggggtggtcgggctggacttcaagtaactcgctccttggtgatgatgatttaagcctgctgtaactgcagaacctgagataacagaaactgtactttcagttgaggtgagttctgggaatggctagtgatggactttgggatg

SEQ ID NO: 12547 - DNA, 339 bp, Gossypium hirsutum
  unsure (1)..(339): unsure at all n locations
  Clone ID: uC-gsflmaxxa058b05b1
tattattttcagtttgccaagggatactcaacctgggctgttaagggctaagaatggaggtaaaaagctgatggacttggggttggaatttattcccatggagcagataatcagagatgcggttgagagtttaaaaagtaagggctttatttcatgaatgtgtcttctacactaaaagctgtgctgtatagctgatgaggttgcagcttccccagaatcgaaagtagaaattgctactgaaattgccagtggcttgtcgaggaaaatgggaaaggatggattagtagacctgaaagagatggctaaagcagttcaatatgataaaagcaatggtnacac

SEQ ID NO: 12548 - DNA, 378 bp, Gossypium hirsutum
  Clone ID: uC-gsflmaxxa058b10b1
tggttttttgcaaagagctactaacggtcgaatgtggcatttatatagttggcatgttgtggtgcaaatgcctggcggagaagttgttgatcctccccattctttgaagactaccgaagtgtgtgatgttgatcagaatttgaagattgaagggcgtgttccagacaaagtaaactgttaccagggagttttctataattactttagcataggaatggatgcgcaagtggcttatggatttcatcatttacgtaatgagaaaccttaccttgcacaaggtcctattttaaacaagattatttatttcggttacagttgcagtcagggttggtttctcacaccttgcatgagtgatccaggttttaggggactcaataa

SEQ ID NO: 12549 - DNA, 532 bp, Gossypium hirsutum
  Clone ID: uC-gsflmaxxa058b11b1
tttcttttcctactacaattcttttcttcgatccttcttagcttgaagttggggtcttagctgcttctttttaggtttctgggtaatttgttaataaagttgcaacctatataatattattattattctaatggggtcttaatgatttttactgtgttgggaatattcaattcaatacatttttttggttgtcctttctgggttttggataatgttcattggtattcttggagaacgtctttgatccttgtctcagtttcgctaccatctttaatttaattctacagaaatatttggtttttttttttttgaagttttcattgaaagaaaaatgaagggttctactctgtttcaagtattagctattttatccgtaattgggaagtgttttgagcaaggagtgtaccaacactccaactcaacttttatcgcatacttttcgttaccaactgttgaaatcacaaaacgagacatggaagcaagagatgtttgcttattaccacttgatcccaactgatgaactccttggtct

SEQ ID NO: 12550 - DNA, 488 bp, Gossypium hirsutum
  Clone ID: uC-gsflmaxxa058c02b1
cgtgtcgcttggggtttttaaagaaaaaaagtttggatttttaaagcgaaaccattgttatatgagagggattagtgtttgagatttgggtttttttattagtcggaaatgttaagatttgggacattttaaattttttttttctagtgaaccccttcaaggatatttttgtagatcgaagaagcagaggtgaagttttcaagtgctcgaaagagagtaaagtttcgaatttttctttatcaagatgaagtttatgaaactgggatccaagcctgattcatttcagactgatggtgatcatatcaggtatgttgcaaccgagttggcaactgacatagtcgttaatgttggggatgtgaaattctactgtcataagtttccattgttatcgaaaagtgcacgtttgcaaaagctggtcgcgacgtcgaatgacgagaacggtgatgaactacaacattcaagacataccgggcggacctggagctttc

SEQ ID NO: 12551 - DNA, 404 bp, Gossypium hirsutum
  unsure (1)..(404): unsure at all n locations
  Clone ID: uC-gsflmaxxa058c06b1
ctcttcctgcgcttgctggagcaactcggtccacagctcttatactcgattttcgccagcgtttgcatgatggctgtgatctttgttaaaaagaacgtaatggagaccaaaggaaaatcacttcaagaaatagagattgctcttctcccaccagaatagagttggtacattatctcccaaatttattttttgcaattcaattttttatcttacttttatagagctaagaataataaccaataaccaccacacgtgtcagtacatgtgagtgtgacgatgtcagtacatgtgagtgtagataattccttctgacttgatcaaatgaatttatatatgcagatcaaccttnnnnnanaaaaaannaaaanaaaaaaaanaaaaaaaaaaaaaaaaaaaaagggcgg

SEQ ID NO: 12552 - DNA, 478 bp, Gossypium hirsutum
  unsure (1)..(478): unsure at all n locations
  Clone ID: uC-gsflmaxxa058c10b1
tttctataacaacaagagccatcatcccagtttcaagatgcatgtcctgggatccgacatgtcctaaaggatgtaaactgcaaagccaaaccatgggaaatcctcgccattgttggtccaagtggagcagggaaatcttccttgcttgaaatccttgctgggaaattcaccccacaaagtggttctattttcgtcaaccaaagccccattgataaagctcagttcaggaaaatctctggctatgttacccaaactgacaatctttttcccctccttacagttgaagaaaccctcatgtttagtgccaagttacgtttaaggcttcctcaagctcagttgagtagtagggttaagtccttgatccaggaacttggactagagcatgtagccatggctcgagttggtgatgatcgggttcgtgggatatctggtggtgaaagacgacnggtttctataggtgtagatgtgaatcatgatc

SEQ ID NO: 12553 - DNA, 520 bp, Gossypium hirsutum
  Clone ID: uC-gsflmaxxa058c11b1
tttcgtttgatgggatcagaaaagtggtgtttggaggtcatgtgaccgatgaagaatttgaaagcttaaacaaacggaaaccttgttctggatataaaatcaaggagatgaccggtagtggtatttttgcagccgatggagaaaatgacgaatcagaacctggtagtgcaaatcctactccaaacaacaaaacagcaatacgaatgtaccagcaatctctagctggaatcagtcacatctcgtttgccgaggaagagagaattacacccaaaaagccaactactcttcctgaggtggcgaagcagcgtgaattgagtggaacactacaaagtgaggaggcaaagttgaagaagcagctctccgatgccaagtcaaaggagcttggtggacatgacatctttgcacccccaactgaaattgtgccgaggccaactactgtacgcgctttggctttgaaggacaattttgacatgggagaacctgatacacataaacctgctggaggtagcacgccagtgag

SEQ ID NO: 12554 - DNA, 530 bp, Gossypium hirsutum
  Clone ID: uC-gsflmaxxa058c12b1
gcatcatgcaaagaattgtgggaccatatttcgtggacctcaaaacgcaattccacaaaactggttccatcttcctattgcctatcatgggcgagcatcatctattgtcatctctggaacaaacattaatagaccaaggggtcaaggctatccaacaggtcaatctccaccatattttggaccttcattgaagctagattttgaacttgaaatggctgctgtggttggtccaggaaatgaattagggaaagccatagatgttaatgaggctgcagatcatatctttggacttgtcttgatgaacgactggagtgctcgagatattcaagcatgggaatatgttcctcttggaccctttcttggaaagagttttggtactacaatatccccttggattgtgacacttgatgctcttgaaccttttgcatgtgatgctcctaagcaggatccccatccattgccatatttggcagagaaaatatccaaaaactatgatattgaattgggaggtcaaattaaaccttctggac

SEQ ID NO: 12555 - DNA, 436 bp, Gossypium hirsutum
  Clone ID: uC-gsflmaxxa058d04b1
atttatctttcccggaagctttccctggtgacagtgttgggttcaacgtttagaacgttgctgttaaggatcttaaacgtggttttgttgcgttaaactgcaaggatgatccggccaaggaagctggcaacttcacctcacaggttatcatcatgaaccaccctggacaaatcggaaatggttatgccccagtcctcgactgccacacctctcacattgctgtcaaattttctgagctgttgaccaagattgacagacgatctggcaaggaactcgagaaggaacccaagttcttgaagaacggagatgcaggtgtggttaagatgatttccaccaaacccatggaggctgagactttctacgaatacccaccactcggacgtttagctgtccgtgacatgcgcgcgaccgttgctgacggagtcatcacaagtgt

SEQ ID NO: 12556 - DNA, 511 bp, Gossypium hirsutum
  unsure (1)..(511): unsure at all n locations
  Clone ID: uC-gsflmaxxa058d11b1
cttccctttgtcattctctgtagcatcaacaggtgagggaaaaaagagaaggatctgatgtacctgccggttgatcttaattatacacaagatcatgatggcccttgaaaataaagaaactatgcagaactgcgaggcaaccttaaaatgcctccagacgaaggggttcccgtacaacctgcgatgtactgggaactcaattgaaggccgtccagagcttaaagatgaaatttgtactcacccaggtggggatgttgtagaacctgtttgctctttaaatgggcagtttatggaataccacaaacctacccttcggcatgagtctggctcttggtcgaccttctatcctgacacccacaagttgcagccatacccaccaaatgcttttggggggcagttntaccactttcccatggataaccgatttcattatgcccccattcatatggtcacacatggatacccgtatgaattncagttncaagactttcagtacttttgtggtaattga

SEQ ID NO: 12557 - DNA, 350 bp, Gossypium hirsutum
  Clone ID: uC-gsflmaxxa058e01b1
gtttgttttctgcttaaacatcaaacaaaaacaggggttgttttatatacatggcggtaaaaagcatgctacgccggaaagggaagccaaacagcgggcaagaccaaactgggatgaaactaattcaatgggaaaagctagggatgcctatatggacaacagtccgtcacagagcacgattgtggtgcctcatggcgtgacagcggagccttctaaacagcaactactcgaaccaccgccatcccaagccttcggtcagcccgtcacacacagagaccatagactaagggtaatggaacgggtcttgtacggccgcgcatacacactatactctacgccaaaacttgggt

SEQ ID NO: 12558 - DNA, 531 bp, Gossypium hirsutum
  Clone ID: uC-gsflmaxxa058e06b1
ccttcgcttccgtctcatctccttccttcaatctccagctttttttttttcactttttatttttggctgaaaaaaaacaatgaattgaaaggtgtttcagcttttcctctttgaactttagctgaaaggaaaaacatatttttacttcattcattcaaattcccacacaaaaaggggaaaaacccagaaattttaagccatgaaacagttacacaagcaatcaagcattaaccataggcgagatgaagagatcttaatacctcaaacacctccttactcacccaaatccttaaaacaccccagatctctccctagatccattaactatctcttcaaagaacaacgccttttgttcatcttcatcggcattttaatcggttctactttcttcatcctccaaccaactctctctcgtttaggcccaaccgagactcacccttcggtccccaaatctttctctaacaacgtcgtttcccacacccaagagttttcccgtttcaatcagatcctattcatggcaaaatgggtcgt

SEQ ID NO: 12559 - DNA, 506 bp, Gossypium hirsutum
  Clone ID: uC-gsflmaxxa058e09b1
tagtcaatccaacaaaatacacatcgaatagatgccttggtcttcacaaaaaagaagaagaagaagaggctgagcatctggtagctttctctttgttcctccaaactgtgtgcttagatttgaagacctagtccctgtgatcaaatcttgttgttcatttctgggtttaatttctcaagaaaaagaagatgacaaaagataggcaaatcggtgtagcaatggatttctccaagggaagcaaagcagctcttaaatggtcaaccgacaatctggtagacaaaggagataccctttacctcatccacgtcaaacccaatcagagcgacgagtctcgtaaccttctttggttcaccagtggctcacctttgattccattatcggagttcagagagaaggaagtgatgaaacattatgaggtggaacctgatcctgaggttttagacttggttgatacggcttcaaagcagaaagaggtgaatattgcacaaagatttactggggtgatg

SEQ ID NO: 12560 - DNA, 503 bp, Gossypium hirsutum
  Clone ID: uC-gsflmaxxa058f01b1
atcttgagttggaaaggtgcgtgcttttatgagaacaccgctaggatggagttccataacaagagtggcagtgagttcggtggtggaactctccatatcaaggttagcaaagcccatagttggacgtgtctggatctttatctctttgcaactccatatcgtgtaacttgggattattattttctatctcgggagcatacactcgagattgacaagtgggaagacagagctgagtatgaatatgtgaaaaacaaggggatttctatttttctgatgcaagcagggatgcttggaacacttgaagctctatgggaagtcttcccattatttactaacactggatggggtgagagtgccaatctcgggtttctcaagaaacacatgggggcttctttcgaatcacggcctcagccctggtacaccaacattagtgttgatgatatacattcgggagatttccttgtaatatcaaaaattcgtgggcgcttgggcggttttgagac

SEQ ID NO: 12561 - DNA, 530 bp, Gossypium hirsutum
  Clone ID: uC-gsflmaxxa058f04b1
ccttcgcttccgcccttgataactctccagcagccgcatgcaagtaagagatgggtgaggaagctaaggctgtggttcccgagtcactattgaagaagaataagaggaatgaagaatgggaacttgctaaaaagcaggagcttgaagttgcaaagaagaagaaagttgagaaccgcaagctgattttctctagagccaagcagtatgcaaaggagtatgaggctcaggaaaaggagttgattcaattgaagcgcgaggccaagttgaaaggagggttttatgttgatccggaagctaagcttttgttcatcattcgaattcgaggtattaatgccatgcacccaaggacaagaaagatcttgcagctcttgcgtctgagacagattttcaatggtgtttttcttaaagtgaacaaggcaacaatgaacatgctttaccttgttgaaccttatgtgacttatggataccctaatctcaagagtgtgagggagttgattttacaaagaggttttgggaagttgaacaagcag

SEQ ID NO: 12562 - DNA, 521 bp, Gossypium hirsutum
  unsure (1)..(521): unsure at all n locations
  Clone ID: uC-gsflmaxxa058f06b1
cgcttcttacagttcctctagattctgaaagtaatgctgcagttcaaagtgagactgcagaaattggtagtgcagttcaagatgagacttcagaaagtagttctggaggtccaagtgattctggagaagaaaaacctactctactttggagtgcgttgtatagtcaggagctaactttgggtcaagttgattttatctgttcaactcccatgccagatggtaaactgaactacaatgatctcatagatacgacttttaagatatttcaggagatttaccctgaggaagaattctttccggagacatccttagagaatcctgaggttgatggtgatgcttctccggagacataaagatttactgaatggaatataatctctacctaatggagcatctaacaattcaggtccttttccaagactgtggnttagtgattggaggatgccgttatcaaatgatgtatttgaagttgtgaaaaaaaaaggaaagggatttgagaggacattggggttacggatttt

SEQ ID NO: 12563 - DNA, 455 bp, Gossypium hirsutum
  Clone ID: uC-gsflmaxxa058f07b1
tcgcctacgcgtccgcccacgcgtccgcccacgcgtccgcccacgcgtccgcccacgcgtccgcccacgcgtccgcccacgcgtccgtgaattaataattaaattaaagagtgaaattcattagtttatggaagaagaagaagaatcggaatcggaatcggaatcggaatcggaatcggaaagggaagggagaagccaaaagatcgaaacagaaacttcaagctttgaactaacttccatgttcacttgatccaaagaaaagaaaaaagattttgtaagtgatcaaagttttcaatgggaaaaggccccttctcgttccggcgcccttctattaggcgccgccgtccgaaatctacggcggtacctcaatcgccaaagccgataccgactgctggggccgtcgcttcttcattttcgccttcggctcctagcactggtaacttgattggtggagg

SEQ ID NO: 12564 - DNA, 446 bp, Gossypium hirsutum
  Clone ID: uC-gsflmaxxa058f08b1
tcgaattgtcacaaagacaaccttgtaagaaattttaacctttgtaggaaacaaatgaactctcccctgcaacgcatgccacaaattagatttagagggctaatcatttatttcatcataaccatgactttactttacatttcatactcaaatctcctgttcagcaagaaagaccggaaatcctcggatataactattgtctccaacaaaattgaagcgccaccctttaaccattcctccaacaccacctcttcccatgtccaaaacccagcagaccaaaagcgaccaaaccttgttgaaccacctcctaggagatacctacgatacgatactcatctcaaacacattgccttcgggatagcatcgtcttcgaatttgtgggagatcagaaaagagtacattaaaacatggtggaggcccaaagagacaagagggtggtttggttg

SEQ ID NO: 12565 - DNA, 532 bp, Gossypium hirsutum
  Clone ID: uC-gsflmaxxa058g07b1
tcgccttcgcgtccgcatcgatcctgataccggtcgatcccttccgaagaataccccgggcgaattgtgtgtcaggagccaatgtgtaatgcaaggttactataaaaacaaggaggagacaaatcgaaccattgacaagaatggatggctccatactggtgacattgcttatatagatgatgatggagatattttcattgtggatcgcataaaggagttaatcaagtataagggttttcaagtagctccagcggaactagaagccatcctccttactcattcctcagttgaagatgcagcagtggtgccgctgcctgacgaagaagcaggggaaatcccggcggcatgcgttgtgatgaacccaaatgccaaagaaaacgaaagggacataatggagtatgtagcctccaatgttgcacactacaagaaagtgagggttctgcaatttgtggacaccattcccaaattcccatcttgcaaaatcatgcgaaggcttttgaaagataagatgatggaaaatatgcccaaaccc

SEQ ID NO: 12566 - DNA, 460 bp, Gossypium hirsutum
  Clone ID: uC-gsflmaxxa058g08b1
tcgcccacgcgtccgcccacgcgtccgagagccccaatgtgaagtacacagagaatgaaattcagtctgtttacaactatgaaactacagagcttgttcatgagaacaaaaatggaacctatcaatgggttgttaaacccaaaactgtcaaatatgaattcaagactgatatccatgtccctaaattgggggtgatgcttgtgggatggggaggaaacaatggttcaaccctcaccggtggtgttatagctaacaaagagggtatctcttgggctactaaggacaaggtacaacaggctaattactttggttcattgactcaagcatcaacgatccgaattgggtcttacaatggagaagagatttatgctccatttaagagtcttcttcctatggtgaacccaaatgatattgtgtttggaggatgggacattagtgacatgaacctagctgatgcaat

SEQ ID NO: 12567 - DNA, 512 bp, Gossypium hirsutum
  Clone ID: uC-gsflmaxxa058h03b1
cggtcgcttgtgtttgttaggcctctttgatcaaactaaggttcatgtttgatcttgacgttcaaattcctactgcctttgatccctttgctgatgcaaatgctgaggactcaggtgcgggtgcaaaggagtatgtgcatattcgtattcagcaaaggaatggtcgcaaaagcctgacaactgtccaggggttgaagaaagaattcagctataacaagatacttaaagacctgaagaaggagttttgctgcaatggaaccggtcccaaacccactcccggtcagaccgtcaccgttcactgtactggatacgggaaaaatggagatttgtctgagaaattctggagcacaaaggatccagggcagcaacctttctctttccaaattggcaagggctctgttataaaaagatgggatgaaggtgtgatgggaatgcaagtggcaaaagttgctcgtcttcggtgctccccaaactattgctatggtgctggtgggtttcctgcatggggaata

SEQ ID NO: 12568 - DNA, 520 bp, Gossypium hirsutum
  Clone ID: uC-gsflmaxxa058h05b1
ctttcttttctctcttatcaattttcccccatctggaaacgttttgaaaattaacaatgtccgctgttgctccttctttttccttgagtgtgctctgttttgcttcattgctctcctttttggctgtggtgaatgcaagaatccctggagtttatactggtggagcttgggaaagtgcccatgctacattttatggtggaagcgatgcttctggaacaatgggcggtgcatgtgggtacgggaatctctacagtcaaggctatggcgtgaatacagcagctttaagcactgcactttttaacaatggccttagctgcggtgcttgctttgagattaagtgcgcaaacgaccccagatggtgtcactccggcagcccttacattattatcactgccactaacttttgccctcctaacctatgctcttccaaatgacaatggtggctggtgcaacccttcacgccctcactttgaccttgccatgcctatgttcctcaaaatcgccgagtaccgggctggtt

SEQ ID NO: 12569 - DNA, 510 bp, Gossypium hirsutum
  Clone ID: uC-gsflmaxxa058h10b1
tgtttttaaacctgataaccaggggcgtaaaagccagaggaatagacgaggaagacctagccgacagactcagtgagttaccggataatgttattttgcacatcatgtcatcgcttccgatgaaagaagcagttcgaacatgccttctgtctaccagatggaaggatctttttacttccatatccaatattgagctcgatggagttctaaggaagggggctttacgtaatagattcatggaatttgtggatggatttctgtccttgcgtaaggatatcagtgtggatagatttcgcctctgctatggacccggaattgatcatcgcaagatcaatgaatggatactgtacgcagtaaggcatggcgttagagaacttgaattgatctttcaaagtggaacccttcaaacaagacatttcactgacctggaactcggggtttttacttgtaaaacactgctcacattgagattattcaaccttccaagtctttgcctgactatttccaccc

SEQ ID NO: 12570 - DNA, 381 bp, Gossypium hirsutum
  Clone ID: uC-gsflmaxxa060a03b1
gccggtaccgaatcgcagtttcggcccacacctacgctttctatcactgcgtcctggcacagaccggccactaactacgacgaaccactggctcccggcgagcgtcttgcttttaagccggaatcaggcgtaggaatccatcgtatcacacgaggaaggaaccccgcccacatggatgctgtaaaatcggcgattaagtcttcgaagatggtccaacaccccagattctgcagattgatggttcttgacaagaacggattccagcactggaggaaaaccccaacagacattggccaacatgtaggttgtcgttaactgccggattgataaatcgggcaattttatttgccaaacacaaggttttaccaccaccgaagaaga

SEQ ID NO: 12571 - DNA, 421 bp, Gossypium hirsutum
  unsure (1)..(421): unsure at all n locations
  Clone ID: uC-gsflmaxxa060a08b1
atatggaaagctgangcgcctgcaggtgcaggtacataatcggaagaacagccaccacccacgcttttcgtttacgcgtccgaacacatacaaaccaataacaaaatggcagaaagaggctgaggagagcgtggagcattcaggcgtggcttaggtggaagaaccgaccgtggccaaagaggaaggcgacgtggccgcagagaggaagaagagaaatgggtgcccgaaaccaagcttgggcgattggtcaaaaccggaaaaaaaacgtccccttgagcaaatctacctccactccctccccatcaaagagtaccaaatcatcgaccaactcgttggcccttaattgaaagatgagggcaagaagatcactccagaccaagaacaaacccttgccgggcagggtacccgtttcaaggccttc

SEQ ID NO: 12572 - DNA, 235 bp, Gossypium hirsutum
  unsure (1)..(235): unsure at all n locations
  Clone ID: uC-gsflmaxxa060a09b1
aggaaataaaataaaaaaaaggtgaaaaaagaaaaaaagggagtaggagaggaaatgaaggaaaaaaaaaaaaggggggagtggtaggaaaaacaaaaaaaaagataaaaaaacagaaaanagaaaaataaaaaaaaaagaaagaaaaaaaaaaaaaataaattttttagttttataaaagaagaaagaaaataagagaaaaagaggaaggggaaaataatgaaaaaaaaagagg

SEQ ID NO: 12573 - DNA, 109 bp, Gossypium hirsutum
  Clone ID: uC-gsflmaxxa060a11b1
taccgttaaatgtcttaagcttgtcaaagcgcaaaaggctaggaaacttccttcctttgcccttttagctttatatatatcgatctgttttcattctcatttttatatt

SEQ ID NO: 12574 - DNA, 302 bp, Gossypium hirsutum
  Clone ID: uC-gsflmaxxa060a12b1
tctcatctctctagcttttgttgatattttattaggtttaacattgttaatttgtactctctctttttttttaattttccgaatccaatatcaaaatggagcttcaacttggtcttgctcttccaactccaaacatggtaaaggggtttgtcttgaacacccttgggacttgatcagctcaacgaaaatgctggggcttctgaaggtgcatcatggtgccttttaccccttctcttttgtctatatcccttggattatgactcggaactcgtctggcttatcgattccaaattccccaaaga

SEQ ID NO: 12575 - DNA, 319 bp, Gossypium hirsutum
  Clone ID: uC-gsflmaxxa060b04b1
ttcacgctttcgcattaccatcccccttttggagacctcagccactccgatctccgcccatggctgcagccctcgagtgctggtccagccgagccaccaccgccgatgacgacatggtcgagcaggttttgatgcgctccaacgaccgatccgaggacacctcctcctcctcctctgattttgccaaacttgaagccccgttcgccaagaacaaacgggttccagaggtgagccggaaccgtttcttgggccaactgcctctttcaagaactctttcaatctcgacacttcctccccacgtgatcagcttcctcctcct

SEQ ID NO: 12576 - DNA, 201 bp, Gossypium hirsutum
  Clone ID: uC-gsflmaxxa060b05b1
tttacgctttcgaaagcccagaaatcgactatgaatcaacccctttttcatctctaatttctcaatcctttgccacaaccaatcgaaaatctgttgcgaatcatttcctttccacaaaattctttcaatttcttttgctctctacttcaagaccccttagttttacccgtatgttgcatgccctagcttaattgttgtgat

SEQ ID NO: 12577 - DNA, 82 bp, Gossypium hirsutum
  Clone ID: uC-gsflmaxxa060b06b1
ttcacgctaccgctttttgttttacgagctcaatctgggtgtgcattaaaataaggtatcttttcacaccaacccgattata

SEQ ID NO: 12578 - DNA, 241 bp, Gossypium hirsutum
  Clone ID: uC-gsflmaxxa060b07b1
tcggttaatatcacaaatcttcttctccttctcagaaatcttagtatcatcactatggcctcaaatcccaaggtcttctttgacatgacgatcggtggtcagcccgctggtcggattgtgttcgcgcttttctccgattgacctccttgcatttcttaaatctttcttttttctctctctcttatttcatctttttttttctctcacttttatcccctttccttcttcattttctctcttt

SEQ ID NO: 12579 - DNA, 477 bp, Gossypium hirsutum
  Clone ID: uC-gsflmaxxa060b09b1
gtgatcgtcgattcaagaggtctcctgtcaggccttcttctacacatctgtccagcatcagcgacttctccattgacagtgcacagaaatctcataaagagcaggactatttcagagaacgtttattggccatggaagaagaaacaaagatgctgaaagaagctttggcaatacgtaacagtgaactactggcttcaaggaacctgtgtgcaaagacatccagcaagctccaaactttagaagcacaacttgccatcagcaaccaacaaagaagtccttcaaaaacaattgttcagattcctacagaggtttactccagccaaattgctagcaatccaccaagtatgacttctgtgtctgaagatggaaatgatgatgatagaagctgtgctgagtcatgggctacagctttgatctctgagctctcacatttcaagaaagaaaatagcactgaaaagtccagcaaatctgaaaatg

SEQ ID NO: 12580 - DNA, 371 bp, Gossypium hirsutum
  Clone ID: uC-gsflmaxxa060b12b1
ttcacgcgtccggtttgaaacgcgggagacgaaaaaaaaaatatcttcgttgccttttggccttacctgatcttattttttcattcctttgcaaatcaaatttcgaagtttttgatctctgcttcaaacagttcttagcaaaaaatggggtatataggatcacatggtgtacaagctttgaaaagatacaaatacagtggtgtggatcactcttaccttgctaaatatgtattacaacccttttggagccgttttgttaatttcttccctctttggatgccaccaaacatgataacacttaccggatttatgttcttggttacctaaaccgtgcttgggttatgtttattccccccacttggattttacct

SEQ ID NO: 12581 - DNA, 109 bp, Gossypium hirsutum
  Clone ID: uC-gsflmaxxa060c07b1
tctacgccatcttaaataattttttccgatgatctttgttagagattagctccctaactcttcatattggtacagatctacatcccattcactttcttctccactcctc

SEQ ID NO: 12582 - DNA, 343 bp, Gossypium hirsutum
  Clone ID: uC-gsflmaxxa060c12b1
ttccacgcgtccggttcgatgcggtttggcatgggccaaaacagcgatgtagcttggcacattgcaatgattctactgaacccatgcctgatcttaatcgatcacggtcattttcagtacaattgtatcagcttgggtcttaccatagctgccattgctgcagcactctctcaaaaggatcttgtggcttccgtgctatattgtcttgctctcaaccataaacagatgagtgcatattttgcacccgccttttttggctatctattgggtaaatgcctgaggaaaaagaatccactgctcgaggtgacaaaactgggattgatggttataggaacatttgttg

SEQ ID NO: 12583 - DNA, 664 bp, Gossypium hirsutum
  Clone ID: uC-gsflmaxxa060d09b1
ttttcgtggacgcgtgggctgacacttggggtggagatttataattaaaattatattttaattattttaattaaatttatattttaaaattaataatttttaattttaaatattattattttttttatttaaatttttatataaatttataatatttattaataaaattataatataaatatatatttattattattttttattattttataattaaataataattatatataatataaactatataaaataatttttttataatatatttaataataatatatttattatttatatttattttaaatttataatttaaattatttttaattataatatttattatattttaatatatatttaaatattaataaattacaatttatataatttaatattatatttattaattaaatattatatttattttttatatataattagttattatttatttatttatattatattatacattattttatttaaatattattataaatctattatatttatttatattatttataattataattaattattatcatttaatttattataaactgtcataatttatattattatattaaaatcaatataatgtacattaatatttctatagatatatataaattaatatttaaaatatataaaatataat

SEQ ID NO: 12584 - DNA, 346 bp, Gossypium hirsutum
  Clone ID: uC-gsflmaxxa060d10b1
ttccacgcgtccgatttgaccagcgagaaaggttgataacgggaactgcttgagtaacagatttgaagattcaactcggaggaaactttgatgataaagcaatctcgacccacagaaacaaagtgagaggcatagatacactacattttttgtttgttaattcaacataaatgaaagccttaaacttggtaaattcttagccaaatggatgtttaacagctaagcacttgggatggccttacttaaaagctctcaaagaacttgatgatgttctagctaaagctttgtggctgtaattccttatatgttactttattattttatatctcgagaaagtagtcttttt

SEQ ID NO: 12585 - DNA, 329 bp, Gossypium hirsutum
  Clone ID: uC-gsflmaxxa060d11b1
ttcttatcttcgaccattgatcttctatattctggctgctcttgcaatattcatgcttatttctccctcccattcctctttagataatgttaatgacagggttactttgtcactgtactatgaaacaagtttatgccagcattgtgcctcctttatctccaatgaccttgtcaaggtcttccacactgacctccataccattatcaatctaagattggtcccttggggcaatgttgaaatccattgccagcatggagaagaagaatgctacttaaacactatacatagctgtgtcatccatttctggcccttgatgtgaatgagcactt

SEQ ID NO: 12586 - DNA, 367 bp, Gossypium hirsutum
  Clone ID: uC-gsflmaxxa060e01b1
tatgaccgttgatggtccatcaatgaaggatgggagaggtggtagagctgcctccttcaatatcattcccagcagcactggagctgccaaggctgttggcaaagttttgccagcattgaatggcaagctcactggaatggctttccgtgttcccactgttgatgtctctgtagttgacttaacagtgagacttgaaaaggctgctagttatgaagatattaaggctgccatcaagaaagaatctgaaaccaacttgaagggaattcttggttacgtggatgaagaattggtctcaacagactttgttggcgattccaggtctaccattttccatgccaaggctggaaatgctttgagcgacaaattt

SEQ ID NO: 12587 - DNA, 57 bp, Gossypium hirsutum
  Clone ID: uC-gsflmaxxa060e05b1
ttcacgctttcgaaagcaattcatctttataggtagaggattcatataaatgggtaa

SEQ ID NO: 12588 - DNA, 73 bp, Gossypium hirsutum
  Clone ID: uC-gsflmaxxa060e06b1
tttacgttttcgaaagttcttctagtcaagccgaatgggtatctaaaaaatgggtaacctgtttaaaacgttg

SEQ ID NO: 12589 - DNA, 480 bp, Gossypium hirsutum
  Clone ID: uC-gsflmaxxa060f02b1
tttattttgaaagatgaatggtttaaaaagggttacaagcctcctgtgttcgaggagaaagacgatacgaatttagacgatgtataagctgtttttaaagattatgaagagcaccatgtaacataacagagagaagaacaaccaacagctatgaacgctttcgagttaatttctatgtcaaaagggttaaaccttgggaacctgttcgatgcagaagagggatttaagagagaaacaaggtttacatctaaatgttctgctaatgagatcatccataagatccgagaagctggcaagcctctcgggtttgatggccacaagaaaaactacaatatgagactccagaatttgaaagcaggaagaaaaggaaaccttaatgggctccactgaaatatttcaagtggcaccttgttaacatatggttgaggtcctaaaagcaaatggggacacattgtaattaatacgttttacaaagccttt

SEQ ID NO: 12590 - DNA, 376 bp, Gossypium hirsutum
  Clone ID: uC-gsflmaxxa060f04b1
tttctcttttcaactacaccttcgctcttgccttcgtctcttcaggaaatggaatgcgttgaggtagctttgaagaccagttttagaaaggaaatggctttgaaaccaagcccccaggcgtttttggaggatatttgggttgttaatggacaaaatggggtgtcttgcgatgatttttcagttgacgacctctttgactttagtaacgaagagggtttccttcaacagaaacgtgaggatgaagaagatgaggaggaagaagaagtacccagctcccttcttctttggctaatagaacatatgcttttcccaaacaacctccattttttgtacctcagtacttactaattttggtttttgtttcttgtttaccaaa

SEQ ID NO: 12591 - DNA, 105 bp, Gossypium hirsutum
  Clone ID: uC-gsflmaxxa060f07b1
tcgtttacgcgtccgaggacaaaatagggggtgcatgactatatacaaacacattcgcaacattcttaattgatgtcatagcatggctttctttattctttaaaa

SEQ ID NO: 12592 - DNA, 462 bp, Gossypium hirsutum
  Clone ID: uC-gsflmaxxa060f10b1
tttcacgctgtcgaagaaactgattatcaaaaagatcttatatattgccttgtttctttctttgtgcaagggggtcagcaaaaatggcaacaagtgggacctaatctggatcaaaaccaccatctatctacccaactatggaatatgatgatggcaatctcataatcaacccttaatttgatcatcatcatcatgatcatctgctggagtacgattaggaggatgtatggaacaattcaaaagatcaatcaacaaccaacttagaagccaaaaaaccattgccaagcttaccgagcttcctctaaaaaagctgtcaaacagaatgactatcatattagccataataatgaccataggagtgcccaaatgactgcagcttctgcttcaatgccggacagcatcactgactggaacacgattctcaaagcggattacatgaaacatgggaagaccgatgaagat

SEQ ID NO: 12593 - DNA, 480 bp, Gossypium hirsutum
  Clone ID: uC-gsflmaxxa060f11b1
ttttggatgactatacatgtaatttacccaaacattagtattataaatattatcatattaatcaaatatgacgtgaattcatcaaccgaagcaaaatactctcgctttcaataacttcagccgcaagtaaccgagatttcgcaaccacaaatgtttccgaaacatgaaaacagcccttttttgtgagcacgtcttcttgaatgtctcgactttttggttgacgttgtcggagtctgactagaaaggaagctcgaaaattcattacttgagtcataaaccggtgggagttcggttctccaccgttcgagtttcgaatcgagcccttccatgcttccatctaaactccatccttcgcccaccgaactctccatcttttccattttacggtttcttgttcctcagcaccgcagccgccacttccgatggcgatggacccaattccgaatcggtccaaattatccgcccacccgttaacccact

SEQ ID NO: 12594 - DNA, 291 bp, Gossypium hirsutum
  Clone ID: uC-gsflmaxxa060f12b1
tatctaacgaccacgctcgattttgtcaactgtgctatcataagtaaagcacctgacacacagtactactgcttcactgagtaagggggcaaagatgctatagaggctagtggaggagctgaccttgaggatcagggaactgttatggtgaagtttgggggtctgagaaacggtggccaacgaatgagagaatgacagcgttgatccgaacgaggaacatgagaacgctgatgaaaggagatagagacctccgctggtcccatattgaggcttaacacagatccactgata

SEQ ID NO: 12595 - DNA, 363 bp, Gossypium hirsutum
  Clone ID: uC-gsflmaxxa060g01b1
acgttaaaatttctttatccggacggaacttcatttggttcttatttattactcagatctgacaggtgccgtttcttataccttatcagctcagatctagctgagttgaatccgacgcttggtatacgtgccggcacacattttaaaaaagaaaaagaaaaaggggacaattttgatttcttctggggaacaagattcaaagagcttggcactggtcttggtgatcatggagaggcaagcgccttgcctactttttgggattccttaccggggatcggccgcgttggtgggcagagttcagggaaatcttaggtgttggaaagcgttgtccgccaggattttttacctcgtggatcccggatt

SEQ ID NO: 12596 - DNA, 467 bp, Gossypium hirsutum
  Clone ID: uC-gsflmaxxa060g02b1
ctcggattttaagatttggcttcttacaatctaatggagtggaagcaaaggttgccctagaagatgaacattttgctttgtgacaatctgaagcaggaagttgcgttttcttccacagcagtggcattgagatggatatgaacttcactgctgattcttccctggctccatccagatggagaaaagttgcatacggagggatgcaacccggatacgacgacaaccacacagatgaaactttccttgaagatatggcaatgaatgctaatgtcgttaaacggaatatgcttaaggtgatgcaagattcgggttccatctcacaatatctatgcattgtttttcttggggtcttggtatggatctacacccttaagtcaacccttaatgaaaacttccttttgcttcttgatataagccttcttggttctgggttcattaacctagtattaactggagaaatgctcttc

SEQ ID NO: 12597 - DNA, 421 bp, Gossypium hirsutum
  Clone ID: uC-gsflmaxxa060g07b1
ttgacgcgtgggaaaattttctttcactttcccaagaaaacaaccaaaaatcccagaaacctctaaaaactcccccaacccatgccctctcctctgggatcaccgacaagctcccggtctgtaacccagaccgtcaatggctcccaccgtttcacgatcaaagggtattccttagccaaacgttccctgaagcttttagagattgctctacatgatttcaaggctcaactagaggaagacccaattgttcacaggcacctttcttagctataagacactctattggagcagaacctgagccgattgagtgagcctttctcaagggttgagaatgcacatattgctgaactgattgagttgacttgagaccatttggaggaagaaacttttttagaatgattcttgattaagaagtttttca

SEQ ID NO: 12598 - DNA, 398 bp, Gossypium hirsutum
  Clone ID: uC-gsflmaxxa060g09b1
ttgacgcgtgggattccagtagacagcagcggaaccttttgctttgctttcgcgggtaccatgagtggtttgtccataattggaaacattcagcagcaaagtttccgggtggcttttgattcagcgggttctcggatcgggtttgctccccgtggatgcgcttaaacatgggtatggttcttttatctatttttactaaggtaagggataaatctctttccctgcctctattttagggtaagaagggaagaacaaaaacgatcttccatggatttgaatgtaagacaggaggagagggagatgataaaaggcgggtagtttgttagaaatagcgaatcaacgttgttttgcggtttttcaggtgttatcaattgtatttttcaaatatgaaggtcgat

SEQ ID NO: 12599 - DNA, 459 bp, Gossypium hirsutum
  Clone ID: uC-gsflmaxxa060g10b1
ttctcttccactcaatcaaatcccagcttagcaacctcacaaattttttctttaaaaaacccatctttctggttctaaactcacccccatccatctcttttgcatataccttcagtcactaagcaatagcagccactactgcaaatggcttccaacaaaacctgtgctgtccttacagttttctctcttcttcttttcaacttatcattcaccaatgcttgccattcatgcaagccaccaaagcccattccaccacctgctgcatgccctccaccaccagcaaagcctgcttcttgccctaaggacacattgaagctaggtgtttgtgctgacctacttggactggtaaacatagtggtgggaacacctcctttgagcaaatgctgtgctttgctccaaggcttggctgattaagaaactgccctttgcctttgcaccgcctttaaagccaatgtgctt

SEQ ID NO: 12600 - DNA, 295 bp, Gossypium hirsutum
  Clone ID: uC-gsflmaxxa060h06b1
ttagaatagctcaaaaaagcttacaacattttgaagaaacaaagaataaaacatgtcgaaggaagagagagaagaagggatgagccgaaaggactatgaggatcctccaccggcaccgctcatcgacgtggctgagatcaagctttggactttttacagagctctcatcgacgaattcatcgctactctccttttcctatacgtcaccatagccaccgacatcggccacaagaaacaacacgaagcatgcgatggtgtaggaaaaaagggtatagctagggctattggaggcatg

SEQ ID NO: 12601 - DNA, 465 bp, Gossypium hirsutum
  Clone ID: uC-gsflmaxxa061a05b1
agttaatggaggaaagcaaagttggctcttggcttgaacatgtgtttgtatgtacctcaccaaaaacttgatgattcatcaccatcattgaccattatgcatcaccctgttactgctaatgttccttcaaggtgttcttcagatgctgttcctctgtctccttcacccaacgactgtggccccactactcctaccccttcctcttacggcctccgcctctccaaatccgtccctaaatcttacaagaaaacctgttcgatatgcctgacatcgatggtactagggcaaggccatgccattttcacagcagaatgctcccattctttccactttcactgtatagcttctaatgtaaaacatggaaatcagatatgtccagtttgcagagcaaaatggaaggaaataccctctcagaggcctgcttctcatcttcccaatggaaaatcaagaataatccagcagatt

SEQ ID NO: 12602 - DNA, 399 bp, Gossypium hirsutum
  Clone ID: uC-gsflmaxxa061a07b1
ttgttcttgtaaattcacaagtcatttaatggtgagttacattttctgtttagttggctctctcgcgacccgtgtcaagtgaactaacggtctggttgatgggccaaatgtattattgacggtggcttgtacatagaccttgctcgaatatttgccttgcattctgctatgattggcgatgcccgctggcgtcactggaatacagataatggggctcattagctgctcggtcctggacatatggtagcttattttcatgctactgatgcatatcatcacccataatgatctgtacatatgagctcgacagattgagctgattatttagtagatcaataccaaggtccatggctcccccatgagaaccgaacacattaacgtcaacagctattgtgctag

SEQ ID NO: 12603 - DNA, 483 bp, Gossypium hirsutum
  Clone ID: uC-gsflmaxxa061a09b1
ttcttttcaaaaatggcttcttctttgttagttttagctaccatttttgtgttatgcagctttggtaaagctactcatcctggtctcattttaacagtcgttaacaactgccctttcaccatttatcctgctatccaacccaacgctggccaccctgtcctcgaacgaggcggcttcgctcttcataccctcacccaccgttccttccctgcccccaccgtccactggtctggccgtatctgggctcgaactggctgcacctactctaacggacatttctcctgtgccacgggagattgtggccaccgcattgaatgcaacggtctcggtggagccactcctatcacaattgctcagttcagcctccaccacggtggccataaagatctctcttcctacgaagtcagccttgtggacggttttaacatccccatgactgttaccccgcacgaaggcaaaggcctttgccccgtcgctgggtgc

SEQ ID NO: 12604 - DNA, 494 bp, Gossypium hirsutum
  Clone ID: uC-gsflmaxxa061a12b1
ccctcgcgtccgacaggaaggtgatgaagcaatttgcagtggagttggagaagctggctgagaaacttttggacatactgtgtgagaatcttgggttggaacagggttccctgaagaaagtgttttatggttccaaagggccaacttttggtaccaaagtcagcaactacccttcatgccctaaacccgacctaatcaaggggctaagggctcacactgatgctggtggaatcatattactcttgcaagatgacaaagtcagtgggcttcaactgctcaaggatgaccaatggattgatgtccctccattgaaacactccattgtcatcaaccttggtgaccaacttgaggtgatcaccaatggcaagtacaagagtgtgatgcaccgtgtgctggctcaaacagatgggacccgtatgtccattgcttccttttacaaccctggaagtgatgctgttatatatccagcacctgctttggggacaaaagagctg

SEQ ID NO: 12605 - DNA, 587 bp, Gossypium hirsutum
  unsure (1)..(587): unsure at all n locations
  Clone ID: uC-gsflmaxxa061b02b1
cggacgcgtgggcggacgcgtgggcaaagctggtaacagactttggatcactcgaactttcacccaccgatggtcgttccctgactgactttatgcatctaaggggactaaaaatgcagtctttgggtcgtgtggttgaacttgctgagaagctgcctcacatacaatcactttgcatacatgagatggttactcgagctttcaaacacgtactcaaagcaatcgttgcatctgttgacaaattcgaggacttacctgcagctatagcttcatccctaaatttcttactcggaaataatggatcagaagataatgctgaaaatgcaaatgatgactatttgctaaaattgaggtggttaaaaaggtttctttctgcaaaatttggttggaaactacgagatgaattccggcatttgagaaaactatccattcttcgagaaacttgccataagggtggtctagagttggttcctaaagactatgacatggaattgcaagaacctttcaaggtngcaatattattagcatttatcctgtttgaaagctatagtatgcacttcttgcgatggcaagacattgtagagtca

SEQ ID NO: 12606 - DNA, 529 bp, Gossypium hirsutum
  Clone ID: uC-gsflmaxxa061b03b1
agtgagcaaaataagggaaatttagggttttatttgaattaggggaaaatggcgatgaggaaagtttacagcgagataaaagggatgaaattgaaggaagttcctggctacttcaagccgatgctatctatgggttacttgaagaaatctgttcagaggggtttggacaattaccatgctaagtacattgagactgattctatcgaacctctctaccatgtctgtttcggtgggatgatcttttcttaccttgttgctcttcccaacgagcgacgccacctcgagcacaagaagcatgctgagcaacacggtcatcattaatcccatctagctttaaagatggtttggatcgttgctgtgcccttctcggttttatccagtaacaattcgatttgcttaatgctttctggttgcaatttgagaacaatgtaggcagaggaagatgctgtcttgatcaaatgcaaaaataaaagagtacattttctttataatgaaccacttaatatgccagattgtgctttttttttcc

SEQ ID NO: 12607 - DNA, 501 bp, Gossypium hirsutum
  Clone ID: uC-gsflmaxxa061b04b1
ccctcgcgtccgcttgccgggagtaagttttgtttgttcgagtacggaccggagatatcggcgatcggtgaagcgatgagtttcgggtgtgtgcccgtggtgattactgaccgtccgatccaggacttgccgttgatggatttgcttgcgtggcaacagatcgcggtgttcgtgggatcaagcggtggagttaatgagatcaagagggttttggggcgcgtggtggtggaagagtacgaggatatgagggaatcagctgcggtcgcgagtaagcattttgtgtggaacgatacgccagatccgtgcgatgcgttccatatggtgatgtatcagttatggctgagaaggcataccatcagatatgctgagagagaatgggcttaagagagcttaaggatttaaagagttttagcaccgtgatatgttgttgacttctaaactttggacggtggtgatcacataattcttttgtgaattaatgttatataaataaaaactaaa

SEQ ID NO: 12608 - DNA, 566 bp, Gossypium hirsutum
  Clone ID: uC-gsflmaxxa061c01b1
gcctgatgcaagaggtccagtgctgtgctttgttggcccaccaggtgtggggaaaacatcattagcgtcatcaattgctgctgctttgggtagaaaatttatacgtatatccctcggaggtgtcaaggatgaggctgatatccgaggacataggagaacatacattggaagtatgccaggacgtcttattgatgggttaaagagagtaggtgtttgcaacccagtcatgctattggatgagattgacaagacaggttctgatgtgcgtggtgatccagcttcagctctactggaggttcttgatcctgagcagaataaatcttttaatgatcactatttgaatgttccatttgacctatcaaaggtgatttttgtggctaccgcaaataggatgcagcctattcctcccccactcttggacaggatggaagtcattgagctgcctggatatacagctgaagaaagctcataatagccatgcatcatttgatcccaagagtcttggatcagcatggattgagctctgcgttccctcaaatccagaggacatggttaaacttgcattc

SEQ ID NO: 12609 - DNA, 589 bp, Gossypium hirsutum
  Clone ID: uC-gsflmaxxa061c05b1
gaaatatttacgaagttctaccgccatggggagaagacctgcaaggtgttatcgtcagataaaaaacaaaccttacccgaagtcacgttattgtcgtggtgttcctgatcccaagattaggatttatgatgtgggaatgaaaaagaagggtgtggatgagttccctttctgtgttcacttggtctcttgggagaaggaaaatgtctctagtgaagctctggaagctgctcgtattgcttgcaacaagtatatggctaagtatgctggaaaggatgccttccacttgcgagtccgtgttcacccattccatgtcttgcgtatcaacaaaatgctttcatgtgctggagctgataggctccaaactggtatgcgaggtgcttttggcaagcctcagggaacatgtgctagagtagccattggtcaggtcctcctttcagttcgttgcaaggacagcaacagtcatcatgctcaagaggccctccgacgtgctaagttcaagttccctggtcgccaaaagattattgtcagcaggaagtggtgttcacgaagttcaaccgaactgattatttgaaatttaagtcagagaatc

SEQ ID NO: 12610 - DNA, 559 bp, Gossypium hirsutum
  Clone ID: uC-gsflmaxxa061c08b1
ctaatgatacgatgatgacaaagcagaggccttgattactacaatcctacggtcttccactctggaagatcctcacaaattccatctccaaatcccagcccaaagctaaaaactatgtttcttgtcgattggttctacggcattcttgcttccctcggcctctggcagaaagaggctaagatcctctttctcggcctcgataatgccggtaaaaccaccttgcttcacatgttgaaggacgagagattggttcagcatcagccaactcaataccccacatcggaagaacttagtattgggaaaatcaagtccaaagctttcgacttgggaggtcatcagattgctcgcagggtctggaaagattactatgctaaggtggatgctgtggtgtacctggtagatgcctatgataaagagaggtttgcagaatcaaagaaggaacttgatgcacttctttcagatgagtccctcgccaatgtcccgtttttattctaggaaacaaaatcgatataccctatgctgcctcggaggatgaagtacgttaccatcttgggctcac

SEQ ID NO: 12611 - DNA, 454 bp, Gossypium hirsutum
  Clone ID: uC-gsflmaxxa061c09b1
ctctcgcgttcgcccactcgtacgaccacgcgtccgctgtgatttttcgaaattgataggattatcttacgtttgcgatcggacgtttctgatcgggatcaccgctcgtttgatcttattcggatcggagcgattcatctctaaatttaaagtacggtattcaataaaatgcactttaagcttaataatattgtttcgttcatgtggttgcttgaattattggattaggtaacgtgccaagcaaatgtttatgtttgaattttagtgatgccttgaatttttatttagctttccgtttggtttatgagagaatttgatgagaaacggtaggaaaaagacagagattgaaattatgcgataccttgtgtagaggacaaacatgaacgctgtgggaactaggagagctggatgatattgttacggtggttgctatttaacttaagatcgtgaaatt

SEQ ID NO: 12612 - DNA, 523 bp, Gossypium hirsutum
  Clone ID: uC-gsflmaxxa061e03b1
caaatagaaaatccttcttcacttcattgtaatcaaaaggcagcaatttcgcattcttctgaggatacccatttctccaacattcgaaacaacatcttttttttttttgtgggggggggggtgtttgttcttgtatgtgtgtttcctctgatacagaaatgggggttccggtgatcaaattatcaatctttatggtggttagaggtctggacaatagaataacagctattctttgcgcatggactgctcatcacagaggaggattggctctcatctatgataacatagagctgatttttaatgtccatgctgttaaaacggtcattggattagggctattaaatggagaaaacatgctggcatacaggacttgtcctgtgacaaaaatctacaaaaagttaagtcatctcacagatcacgggcttgcctttatgttgagcactatgggcgcatggtctgctttgaagtgtcacatggttccaggcatattaaacttttcagtctacactcatggtggggcata

SEQ ID NO: 12613 - DNA, 542 bp, Gossypium hirsutum
  unsure (1)..(542): unsure at all n locations
  Clone ID: uC-gsflmaxxa061e06b1
atttgggtataaagcaaaagaagaagaaattgagttctccaatgctgccagtggtggtgatccagttcaaaatggtgctgctctggcatcattaccaaggactggtcactcgccgtctaccaagatggctctgctgctgttgggagaagtggtggcaatctctctcttgatgccttagccaaagctaaaaaggctttacaaatgcagaaagatttagcagagaaactgaagaagatacctttgttgaataaaggcacaggctccagttcagtggcgactagtgtaacagttcagggaccagtctcatcagtgactacagcaattgcaagtggtccatcaagctcgtcagtgctttcttgtacctctgcatcagcagcttctatgaagccaccagctggtggggtggctgctgatcctggtcttgcttcaatatcaaacttagaagcntgtgaacgtgctcaagaattggctgctaagatgggatatcgcctggaccctcagtttgctcctctaataaactggttcccctgacaggtgcaagc

SEQ ID NO: 12614 - DNA, 583 bp, Gossypium hirsutum
  unsure (1)..(583): unsure at all n locations
  Clone ID: uC-gsflmaxxa061e07b1
tctttatctacacaggattgatatacaatgaatttttttcggtcccatttgaactgtttgggccctctgcttatggatgtcgtgatcctgcttgcagagatgcttctacagcaggcttagtaaaagtacgtgccacttatccttttggtgtggatcctaagtggcatggtactcggagtgagctaccatttctcaactcactgaagatgaagatgtcaattttgcttggagtagctcagatgaatcttggaatcattttgagttacttcaatgcaaagttttcgggaaatgaactcaacattcggtaccaattccttccccaaatgatctttctgaacagtctgttcggatacttgtcactcctcatagttgtgaaatggtgcattggttctcaagctgatctttatcacgtgatgatatacatgttcttgagtcctacagatgatcttggtgaaaatcaactnttctttggtcagaagtttctccagatggtattactgctagcagctctagttgctgtaccgtggatgttattttcaaagccttttctctaaagaagcatcatgaggaaaggcaccgtggt

SEQ ID NO: 12615 - DNA, 517 bp, Gossypium hirsutum
  Clone ID: uC-gsflmaxxa061f03b1
tatttgctctcatcagccccacaacttcaaaaagttttttttctttcttttcctatctctatttgaaatctgtttcaagggaagaagaaggaaaattttatgattttttgagggtttgctaagaataaatagaaaacaatggcgaacaatgttgctgttattggtatctgttcggtgttcttggtggcagcagtggtggcagcagtggtgggtgttacgcatttaaaaaacaatggtgattcgaaaagcggtgaaatatcgagttcgacgaaagcggtgcaaactgtttgtcaacccacacagttcaaagaggcatgcgagaagagcctggagtcatctaatttcaccgaccctaaggagctgataaagacgagtttccaagcagcgatagaggaaataaggaaagtgtttggcgaattcagcgatgatacacgacttgaataaagatgacaacaacaaagcagcccttaaggtttgtaaagaagtcttggatttatcaattgctgacctgcaactt

SEQ ID NO: 12616 - DNA, 511 bp, Gossypium hirsutum
  Clone ID: uC-gsflmaxxa061f07b1
tatccttccatagctctttccagcgaaaaccctgaacgcgttttagagagggaaagagaagggactgttactgtttgttactgtattccaatatgttgtccagcttccttaatggcgtcctgattgttggtattcagagagaagacgaactctctgaatttcttagtctcttttttttttctaaaattttaaaattctgtttatattgtttggacctgttagaaagagaaagagacggcgaggaaagacaggcgagagagaaaaagaaaattagaagtcgttttctgagtttgagttgactggctgtatcggtgtatgatttgtcgcgtttctttcattcgggttcatggctctactcgtatttagaagcggtaaacggtttcatggaaatcttaaatggcttagaggagttgcgagtttcgacaaggaaaagccatctttcagataaatttcttgataggcaactttccacagacggttgtcttggctgaacgattctgatctgttcatc

SEQ ID NO: 12617 - DNA, 291 bp, Gossypium hirsutum
  Clone ID: uC-gsflmaxxa061f08b1
tcggtcgcgtgggtacgacacgcttacactgtactaccttggctaagatcaaccctatgagctgtatcaccaagattgcccatatttgtctaaagtctgtattgcgtcttatgagctagtactaagtttaactaatactctatacgttattcttgtgtagatactatcacttggttatgaagaattgactgcaaaaataacaactgatgactcacataaatatgggggggcggtctaaatgagccatagtatacgacgctttacactggacaggacaaccttttatatgaa

SEQ ID NO: 12618 - DNA, 477 bp, Gossypium hirsutum
  Clone ID: uC-gsflmaxxa061f10b1
tccctcgcgtccgaacacccccaaaaaaaattccaaaaaaatataaaagaaaaagaaaatgagccgaggaagtggaggcggctacgatcgtcatatcacaatcttctctcccgaaggtcgccttttacaagcggagtatgcgtttaaggcagttaaagcagctgggatcacctcgattggtgttcgaggcaaagactctgcctgcgctgctactcagaataaagttcccgacaagctattggatcagactagtgtcactcatcttttgcctattaccaagttccttggattgttggctactggcatgacagctgatgcaaggaccttggtccaaccagcaaggaatgaagcagccgagtctcggttcagatatggatatgagatgcctgttgatgtatcgtctaaatggactgctgacaaatcacaggtttatgctcaacatgcttatatgagacctgttggaagctgtgctatggt

SEQ ID NO: 12619 - DNA, 467 bp, Gossypium hirsutum
  Clone ID: uC-gsflmaxxa061f12b1
ctctctcgaggggataaacagcttaataaatgatattgccggcgtggccggcaaaaaaaagggttcagagatggctcgattaacattagtatcgtggctatttctctgggcaggatcaatgcttatggtccaaggcagagatcccaccctttttttcgaatggaacgtcacctatggcaccattgctcccttgggagtgccacccaagggtgatccttattaacgggcaattcccgggaccaaatattaactctaccaccaacaacaatattgtggccaatgcgttcaataaccttgatgagccattccttgtgacatggaacggcgtgcagcctaggatgaactcttggcacgatggttttctgggaaccaactgacctatcccccctgggaagaactacacctataaatttcaggtgcaggatcagattggcagctacatctactatccggtgacggacattcat

SEQ ID NO: 12620 - DNA, 437 bp, Gossypium hirsutum
  Clone ID: uC-gsflmaxxa061g07b1
cccacgcgtccgctgctttccagccaaacaactagttcccaagcctcaacattcccaaaatccgacgacgaacggagagccctccccacggcattagcacgacggtatggtgaacgtggggcgtgggtcgtgctacacgtgagatggccggacgggtgaggtgcgtcgacgtgcgtggtggaggggagcagcagctattctcttttttgctgaaaagttagtctagtttcgggctgcttgggctctagggttaggtttattttgggcttataattgggtttgttgtttttgtaattttggactctttttggatttttttgggttctatttattgggctggaatcaagtagcccgggctaaagttgggtcttacatgtattataatctaatttatcaagaaatccattttcccacttgacccgaaaaaagcaaagaaa

SEQ ID NO: 12621 - DNA, 499 bp, Gossypium hirsutum
  Clone ID: uC-gsflmaxxa061h06b1
ccttctcgtccgctccattcttggattgcagtttctggtctacattctggtgatctttgggtggattcttgttgccggcacatctattttatgtggtgtatttaatctcctccacaatgttgcaggagatgcatgtgttgccatggaccaatgggttcagaatctcactgcacatactgcgctagatgacattctgccatgtgtggacaatgcaacggcccaagagaccttgttacaaaccaagaatgtcactcaccaacttgtaactgtcgtgaatggcatcatcaatactgttgccaaccgccatttgccaccacaattggtacctttatattacaatcaatccggtccattggtgactgttctttgcaatccattacattcaaatctttctgagcgtatgtgtgcatatggtgaagctagctcgtacatttctcctgaggtgtggaagaaatatacctgtagcatatctacaccttccaggatttgtactacacct

SEQ ID NO: 12622 - DNA, 499 bp, Gossypium hirsutum
  Clone ID: uC-gsflmaxxa061h10b1
tctttaacttttattcttccttttctgggtgaatcaagttctttaaccattagtgaccgtatcagcatactaaaatatgggtcgtggtctgggatccaacaccatgtattcggttatggcacgattgctgttgctgagtatctgcataggaatattggcgaatgcggcatcagcccaagtgaatcccccatatgcgttggcctcaaaactggggggctattgcggcaagagtaccatgtcctgctccatgaaatgcggttatctcggctgccttgcaggctgtgtgacatctgcctctataggatgcggctataagtgctcttctcaaaacaccagttgccaatttggctgcacccccttcgatattctaggccaatcagcctgtgttaagacctagagggacatatatacatgtgagggcgcgcatcgttggcttcttattaagtgtctgttattattattacagacaaataacatgatgatacacaatgaataatgt

SEQ ID NO: 12623 - DNA, 554 bp, Gossypium hirsutum
  Clone ID: uC-gsflmaxxa064a01b1
cttactcgtccgcccacgcgtccgctcatattaagttttcagagaaaattattattaagtattattgcctttctcgtggcttgctaaacacttgaattttgaaacataaggcaatcacttgccaaaatgagggcagctaggaggatgacttgaagacatctagatgattttatcataaagatgaggaagagagccactatgtgaagctgcaaggagcagccgcagataaccccttgcagtttgtgaacatagaccgaattatcaatttattgccaattgacccagaaagtgaacgtacttttaggcaaagaagaagggaatggttagcccaaagacaagttgaagaaatgaatcaaaacccaagaaaagacacaacttgtaataatcaggatccgatccttgttgctgatggcagagatcgattgattaggtagtatactgtgcctttatttagtgaactcaatctagggattgtaagacctgagattgatgtccttcagattaattaaagccggtgatattctagaagttgcaacagtggaacagtcagtggg

SEQ ID NO: 12624 - DNA, 544 bp, Gossypium hirsutum
  unsure (1)..(544): unsure at all n locations
  Clone ID: uC-gsflmaxxa064a03b1
cagatttatgtacggatctagcaccaaataggaacccaatcgattctattagaaaaagtaaatataattgaaatttacaaaaaaaaagaaagtatttttagaaaaagcataccaggtgaacaggagctttgatgtgtttaacgagcgaagagctgcactgattttctttaacctcgagttcgtggtacctcttgatgaactcttctgccctcttgctaaacccgttcccgttcatggtgatataatcattggtcaccatcgaagtaaccttagcaaaaaccgtggcccgaggaagagaagaggaaaaagccggtccaaaagctgacgccgggtgctagcgggtccggttatcggagagtcctagaaaggtccgaaacaaaacgccatcgccaggctgttttttttataggtccaaggattttttggactgatgcagtgaaattgagaacgacggcgtacttaagccttctggtttggtgttattgggcccaattttcaggcccaaagtttcccngccaaggatctatttttttggcctaatcct

SEQ ID NO: 12625 - DNA, 305 bp, Gossypium hirsutum
  Clone ID: uC-gsflmaxxa064a05b1
ccccgcgtttttttcctcgtctcagatccggagcattattgacttcaaagaaaaaaaagtttgggttgtaattcgaaatcggattcggcagatattaagcaatgtctggagaaagggctttgttcaagctccttaagcctgtgcagcgtctacagcccgccgacgttcaagctgccagcatgtggggcgtcgatgccactaccggcgctctctggctcattcagcctttcgataggatgacgacgacctttctggcgaaaccagagtcggattcgaagcatatgggacatcttgcacctcattgc

SEQ ID NO: 12626 - DNA, 292 bp, Gossypium hirsutum
  Clone ID: uC-gsflmaxxa064a11b1
tttctttacgcgtgcgaggacgcatgggattgtgcaggtgatggaggacagaagtcagcaggccaatcaaaggctgaagagtctctcactgcatatctttctgcagagatccctgctgagaacccaccaacgtctttatggacgcctctacctagtccacacaagactacaagccagataactggtcactctcctggatgccctcctttgcactacccgttctatgacatgaatgccacgatggggggcccaagcccagactatggaccacatgatgactcatcgcctaccc

SEQ ID NO: 12627 - DNA, 487 bp, Gossypium hirsutum
  Clone ID: uC-gsflmaxxa064b01b1
ttttgttactaacaagttcaatatttaccctgagcaaatttcttcatggcttatggattggatacctgaaaaaggtggttatctactcggcaatctacagccagctcacatggattttaggttcttcacactcgggaacctctggtccattgtctcatcgctgggcactccgaaacagaacgaagctatattgaacttaatcgaagccaaatgggatgatattgcagggcaaatgcctttcaagatatgctaccctgctttggagaatgaggagtggcgcataattaccggcagtgacccgaaaaatacgccatggtcctatcataacggcggatcttggccaacacttctttggcagtttactttggcatgcatcaagatgggaagattagaactagctcaaaaagcagtttctttggtcgagaagaggctctcaatcgaccgatggcctgaatattacgacactcgtagggggaagttcattggg

SEQ ID NO: 12628 - DNA, 492 bp, Gossypium hirsutum
  Clone ID: uC-gsflmaxxa064b02b1
cctcgcttccgcggacgcgtgggcggacgcgtggggattaaaaaaatatccaatctttctctgctgattactaaaatggcccttcttactctatacttcttctttcattcgctttccggctcgagtggggagttctcaagtcaagcgggagtaaactacggtcagctggggaacaatctgccatctccgaaacaatcggataagctaatccaatctctgggagccaaacgcgtcaaaatctacgatgcaaatcacgacatccttaatgctctcaatggcacaaaccttcaagtctgcatcatggtccccaacgagatcataaacaacatctacaccagtcaaaagctagctgattcctgcggggaaaccaacgtcgagcctttaaactgtacgacgaaaatccgataccttcttgtcggcaatgaagacattagcggctcccctcaagacatctggtctaacatcgtgccggccatgcgtaaaataaagaaa

SEQ ID NO: 12629 - DNA, 262 bp, Gossypium hirsutum
  Clone ID: uC-gsflmaxxa064b06b1
taataatgaccgcttcccactatacacccgcggaggatttttttaagctagtacccgcgtttggccacgcgagcatggtaaagcaccaaccaaaacacatctcgaggataataccctcactaatggccccccacctatctctaaatgaacaacaatattcttcccccagaacagtgctccgacaaacccagaacccacagttaaactcccccccgtgctctccccaaatcagtcacgggaacatctgcgcttccagaagtgt

SEQ ID NO: 12630 - DNA, 561 bp, Gossypium hirsutum
  unsure (1)..(561): unsure at all n locations
  Clone ID: uC-gsflmaxxa064b09b1
tttgttaaaacaatggctgcaatatttgcagcagagaggaaaataaatgacacgggatcagccgtcaaatctagcaggtacgtaactgctgggacagcttggttaaatggtgcgttcagcaaagttgcaaaggctgggcaggttgccggaacaaaaaccaaagaaaagttcaacctagccatgtcaaacttgacagccaaggatggaattgcagtgtaagttggaaatttatggtgttaaggtcgcatcgcatcggatcgccttgttataatgtttcatcgggtggagattcttgtgatagagtgcacaaagttgtgttcagttttgggtattgtggcgtatttgatttgaggttttgtttacaatattattctttgattagtagagggtattgcgttgtaattttcaagccttttagatttggttttcagctcaggaaaaggaaaaagaagctgtaattcatgttagcattctgcacgctcactctttnttctgccttaaaagacgagacctcaaattgcaggcttctgtttttttagattgatgtgaaattgaagctcg

SEQ ID NO: 12631 - DNA, 462 bp, Gossypium hirsutum
  unsure (1)..(462): unsure at all n locations
  Clone ID: uC-gsflmaxxa064b11b1
ttttagactgcatccacctgcgcccatgctgatcgccagagaagccatctcacacttcaacatcaatggttaccacatttatcccaacacacttatccaaatcaatgtatgggccattgcaagggacccaaagtactgggaaaaccctcaagaattctccccagaaaggtttatcgataacgccgttgacttcaaaggacagcattttgagctgttgccatttggaggtggcagaagagggtgtccggggctgtacatgggaaccgtcacaaccgagcttttactcgcaaatctcttgtattgtttcgattgggttttgcctgatgggatgaatgaggcagatattaacatggaggaatgggctggtaagtgccttaccctctccaagaagacacctcttctccttgtgccaatcaaatacctncatgcccagccatctgtgtagacaaatttaatggaagc

SEQ ID NO: 12632 - DNA, 341 bp, Gossypium hirsutum
  Clone ID: uC-gsflmaxxa064c01b1
ctcactcgtccgaaagaagccaccttgtggaaacagcagctgtcgattgagggttttctttggtggaaaaagcaaagccatggcgatgaacggtggtcttagatcggcttcgaagtttctgacttcgtcctctcaatcacttctccacaagtctggcaatagagggtttcattcaactggagcgaagagaatggggggagggcatgggcatgatgaaccgtattacctccatgctaaacatatgtacaacttggataggatgaaaaatcagacgctgacaatgtctcttggagttctgacagcctccaccactggtgcgtttgttccccactatgctgtcc

SEQ ID NO: 12633 - DNA, 247 bp, Gossypium hirsutum
  Clone ID: uC-gsflmaxxa064c02b1
cctatcatagcatagcagcttagtccaacagtccaactccacacccaccaccattggctgtttctgatcatccgaaaaagaatggtgaccgtggaagaagctcgcaaggctcaacgcgcccaaggccctgccaccgtgttggccatcggcacatcaaccccgcctaattgtgttgatcagagcacataccctgactcctatttcttgcccacaaatagtgtgcccacgaccgagctgcaagtagccg

SEQ ID NO: 12634 - DNA, 65 bp, Gossypium hirsutum
  Clone ID: uC-gsflmaxxa064c07b1
acctcacgttagctagaattggaagacctctagaaggccaatctttcctagtgtttcggttcctt

SEQ ID NO: 12635 - DNA, 84 bp, Gossypium hirsutum
  Clone ID: uC-gsflmaxxa064c08b1
acctcccacgcgtccgcccacgcgtccgaaaaaaaagatttaattaaaaatcaaccagcctatatacaacaaaaaaaaaaaata

SEQ ID NO: 12636 - DNA, 115 bp, Gossypium hirsutum
  Clone ID: uC-gsflmaxxa064c09b1
tctttagatactcacaaaacaagtctctgtagctttaacaagaaatggcgaaagacttcacggcgccgccaacggtcattctctacttctgattcttctaccttctcttcacgga

SEQ ID NO: 12637 - DNA, 497 bp, Gossypium hirsutum
  Clone ID: uC-gsflmaxxa064c10b1
ttgtttattcagaaagaaataaaggaagaagaagcaatggccactcttacagtgcccacgacagttccttcggtgtctgaagattgtgaacagctaagaaaagccttttcaggatggggaactaatgagggcttaatcatagatatattgggtcacagaaatgccgagcaacgaaacttgattcgaaaaacctacgctgaaacctatggagaggatctcctcaaggcactagacaaggagctctcgaatgactttgagaggctggttttgctttgggctcttgatcctgctgaacgtgatgcccttttggctaatgaagccaccaaaaggtggacttcaagcaatcaggtccttatggaaatagcttgcacaaggtctgccaaccaactgcttcacgcaaggcaggcttatcatgctcgttatagaagtcgcttgaagaggatgttgctcatcacacgactggtgacttccgttagcttctcctacctctagtgagt

SEQ ID NO: 12638 - DNA, 366 bp, Gossypium hirsutum
  Clone ID: uC-gsflmaxxa064c11b1
tttacaccccgcatattgctgttgccatcttcttccacctatttggtggttattgggctacgcaattttttatagcgtgttcttcaaccgtgattgcgggttctgttgcttcttactattgggctcggggtgaaacatcgccagagatcccatttcttcctgtttttgcctctatgaagcgtcttatacgatacaaccttgggtcagtggcccttggctcattggttgtatcctttgtggaatcaattcgtttcattcttgagtcaattcgtcgtaaactcaaagttgctggtgttacatcagatggttggcttggaaagatcggacatcatacttcacagggatgcttgagatgtgttgagtgga

SEQ ID NO: 12639 - DNA, 380 bp, Gossypium hirsutum
  Clone ID: uC-gsflmaxxa064c12b1
atcgctcgagcggccgaagatcatatattattggtggttttttttactcgatccccctcagtctcacccctcttacaatacatcttcaattcccttagtacccacatgaaactactctcaacaccacactaacaatatatatatcctacatatcagctattaaaaattactttcatcacataaccatcattcctggacctctatccacaataagcatcttcccttctctcaacaatctgttttatttacatcctatgataacgaaaatcctctatgataaacagtcaaatacgaaaaagaaaaacgatctttcaaaataccacttgaaaaccgtcttttattcaccctttttggaaccgacttaccagaattattcttcc

SEQ ID NO: 12640 - DNA, 85 bp, Gossypium hirsutum
  Clone ID: uC-gsflmaxxa064d02b1
gttaatcgcaagtgctattgcccttcacaagggttggtatacactaggattccacccgtttcggcaaccactcgtagatatagat

SEQ ID NO: 12641 - DNA, 104 bp, Gossypium hirsutum
  Clone ID: uC-gsflmaxxa064d04b1
gataacagccatagaagcaacaacaatgtggagatcaattataattttcactctctttgcctttcttttcttccctattacagcgacgacagatattcacttta

SEQ ID NO: 12642 - DNA, 280 bp, Gossypium hirsutum
  Clone ID: uC-gsflmaxxa064d05b1
ttcgtctaactctaaggttttgattgttaagtgcaatttgaagacacgttaagatggtgatgccaacagcaatggagtcctacataaacctaacatcacctatcacatacaaaaacaatcatttcctttatcattatttcaatcacttcattaaattaataatgctactactcacctaactattatacatactatcaacactgcatatttaggtcataacttatctcatatatccacctcatattaataaattcataacattacaaatagtttacactca

SEQ ID NO: 12643 - DNA, 545 bp, Gossypium hirsutum
  Clone ID: uC-gsflmaxxa064d07b1
ttggtttcttccctgtttctccgatccccatccatgtcagaagctgaacaagccaattccccaaagcctcctccatatttagaggttttatgcaaaagttccggcaagaaaacccggtttgcagccggcactaaggccggatttgcagtgtcattgataaatagaaagttgggtatcggagctccggttgccttgcatattgaatcctttagagaaggggaggaacccattatttttggccctgatgctgttcttgtgaattatggcaatggttggaatttgcaaactgttaatgaaatggattttcctggcattggaaaaggcaaacatgttcggggatttccgacacagctccctaatggaaagaacgttgatctcactaattctcgcaaaatggtttcaaaaccaggaataagttttctttacattgcaaaagtcttgctagctcttggctcggatgttcatgtggcgggagttttcatgttggctcttgaaatcttcctaaactattttactctttactttccatgaactatgtaaattga

SEQ ID NO: 12644 - DNA, 229 bp, Gossypium hirsutum
  Clone ID: uC-gsflmaxxa064d08b1
tcgcttggcgtcgcaagaatacttggacaagatgaaggtccgtcaggagtatcggaatctctggcacacggatctcatgagcagcattcaacgcgaccctccttattgctgcttggctttttggtgtggcccatgtgtatcctacatgctccggaaacgagctctttataatgacatgtcaaggtatacatgttgtgctggttatatgccatgcagtggtaggtgtggc

SEQ ID NO: 12645 - DNA, 245 bp, Gossypium hirsutum
  Clone ID: uC-gsflmaxxa064d09b1
atcggtctgatttacaaagacacccagagagatggcgtctgtactaaaatctgcaatcttaattctgtcggtgccctcctctgcacccctccgctgttccgctcgcctgccccactcccctcccccctccccctccctctcccctcctcccgtctcctcccctcctcgtcgcccccactccccctcccgtcaccccttcttcctcacctcccttctcccttctctccccctcctctctctctctt

SEQ ID NO: 12646 - DNA, 363 bp, Gossypium hirsutum
  Clone ID: uC-gsflmaxxa067a04b1
attcccgtaaattagtttctgcttaatgaatcaataactataaacaaagataatcatagtagggatatattcttgttcaatttcattcttttttgtttccttttctctttttttcttccaaatgaatatcagatctcttgggttttgctgttcttacactctctaaagctcccgcccccttcttttcttttctcttttttttttctttctgctatacttctttaaactctttcctctatggcaatcaaaggtgtcgatttcaagtggattgatgggttcttcttgtctatgctggctacaagtgtaatcattggtgctattcattggaaagcgtatcatcattgggcatacccgttgcatata

SEQ ID NO: 12647 - DNA, 68 bp, Gossypium hirsutum
  Clone ID: uC-gsflmaxxa067a06b1
gcgtacgtcttacacggtcatggtcttcggagtgctctcggccttaatccgcaagaaggtttgaggag

SEQ ID NO: 12648 - DNA, 495 bp, Gossypium hirsutum
  Clone ID: uC-gsflmaxxa067a07b1
tctagatcgcgaggggccgccctttatcttatagggggctttttaaaactttacattcctttgttttacaaaaaaaaaaaaaactttacgatcctttctctatttctcgatcctaactccgggattttttttttccatttagctctctgggaaatagttttcccggaaaagccgagccaaagagtatatcggaccactcggaaaaacgagtcagatagctttcttttgaagggggcaacaacaatcaaaagacgagttgctatacaatcaagtcaatgtgtggtaacgcagaagggatcaaatctcttttccgtgaaggcgcaggcctcgagtggatggatagagaagggaaaacgccgctgatatgagcgcgtaagaatccacagcttttcgatgtggccaagactttgatcgaacttggttctaacgttaacgctaatcgtccgggacgccatggggggacacccttgcaccatgcggcaaaaagaggccttc

SEQ ID NO: 12649 - DNA, 340 bp, Gossypium hirsutum
  Clone ID: uC-gsflmaxxa067a12b1
caataaacgaagaaaataaacaaattactctttttattaaaaggaaagaaggtggaggaggaaatggatggaaaaagaatcgagggcaatgaagtttatgctctagcaatgtgtgtaagtattctcctctttgctccgattgttgtgtcacaaccaataccggcagataaatcccaagtggaagcttggtttaatggcattatcaagccggtgaaggaaaggggtacaaccttagaccctgaattggttcaagccgagacagaacctagaatcataaaggtgatgcaagggggggggtggagaattcgataccataaccaaagccatcgagagcgttcca

SEQ ID NO: 12650 - DNA, 409 bp, Gossypium hirsutum
  Clone ID: uC-gsflmaxxa067b04b1
cacgcttagcactcacagcatttcacggtttacaccattgttctctttcagatttgctttaattttaccttcactttagacccataaaagaagaaaaggaaaacaggaaggagacatcgaaagaacccatcgttgttgctgcagaaatctcaaaagggcatggcctcaaccgagagttccagatcttcaactgctggctctcccgattcatacataggcagcttgataagcttgacgtccaagtctgaaatcagatatgaaggtgttctgtttaatatcaacactgaagaatccagcatcggcttgagaaatgtaaggtcatttggaactgaagggcggaaaaaagatggtccacaagtgccagcaagtgaataaatttatgaatatatactgttccgtggaagtgaca

SEQ ID NO: 12651 - DNA, 501 bp, Gossypium hirsutum
  Clone ID: uC-gsflmaxxa067c01b1
gggacccacgcggccgccgtttttactgctatgctcggctatgaccaagctggtagccattggccaccgtatttccaacggctctggggaaagaggagctggccatggaggctcccacggttaggaacttggactttttggagatgtggagaccctttttccagcctgaccatctcatcattgttcaggatggtgatcctaccatgaccatcaaggtccctgaaggcttcgattatgagcttctacaataggaacgacttgaattctatgacaaaggtgttgcacctcgtaaaaacatcgatgtaatgaaatctgcgattgaaagtcctcagaagaagcatactgaattggcagaagttgaacctgaagaagcttgcgcaaagaaaagcacgagaccgaagtcaaaaaccgatgatgctccagctgctgctacaaatggagatgcatcggtggatggtcaatcggagaagaaaaagaagaaagagaaacgaatgaaggagc

SEQ ID NO: 12652 - DNA, 280 bp, Gossypium hirsutum
  Clone ID: uC-gsflmaxxa067c02b1
aaaagatggaaactaatcatgggagtgaaagggtgagaatctctacctcatgaaatatcagtctggaggtgccagttggcagtctggttgcagttggtgatggatctggtcaagggaaatcatggcctatgtacctagtgctagggatgattcctgcgagtgctaatacaggtgttgccataggaggaactggcgcgaatgaaacacatgtgcaaaggatggataacgctcctgttcgtgacaacatataggttgggtgaagctatcaacctgcacggtc

SEQ ID NO: 12653 - DNA, 455 bp, Gossypium hirsutum
  Clone ID: uC-gsflmaxxa067c05b1
cccacgcgtccgaacaacaaaaaaaatctttccaggttctattttctaaaaacaaaactgaaaatgtcttgctgcggaggaaactgtggctgcagctctggttgcaagtgtggcaatggctgtggaggatgcaagatgttccctgacataatagagaagactacaactgagactattgttcttggtgtgacaactcacaaaatgcactttgagggatctgagatgggagttggggttgagaatggatgcaagtgtggagacaactgcacttgcaacccttgcaattgtaaataagagggggggaaaatgaacaacaaagagaagcacagaggcctctgtctttctaactaaataaattctattactgtagtatgtatcagcaaatcttcatgaggatttggctcttaattatgtgtaatgtgggcgtttctgctatgtcagaatgtattatgata

SEQ ID NO: 12654 - DNA, 456 bp, Gossypium hirsutum
  Clone ID: uC-gsflmaxxa067d01b1
attgttcaatcgtctacgctgttagaccgctagggggcagatttaaaccattttttccccaaaactaccagaagacgcagatctttgtgaaaacccttactggtaagaccatcacccttgaggtagaaagctccgatactatcgaataagtcaaggccaaaaaccaagacaaagaagggattcctccagaccaacaaaggcttatctttgccgataaacaactagaggatggccgaactctcgccgactacaacatccaaaaggagcccaccctccaccaagaccttcgtttaaggggtggcaagcagatatttgtgaaaacccttactggcaagaccatctcccccgaggtggaaagccattgatacgacagataatgtcaaagggcaagaaccaaaacaaggaagggaaccctccacaccaacagaggcttatctttgcaggtacacagcctgg

SEQ ID NO: 12655 - DNA, 498 bp, Gossypium hirsutum
  Clone ID: uC-gsflmaxxa067e09b1
atttttcaatcgtcttctcttttaatcctctcgactccaaagcaagcttccgattccgaatctctaccagaagatgcagatctttgtgaaaacccttactggtaagaccatcacccttgaggtagaaagctccgatactatcgataatgtcaaggccaaaatccaagacaaagaagggattcctccagaccaacaaaggcttatctttgccggaaaacaacttgaggatggccgaactcttgccgactacaacatccaaaaggagtccaccctccacctagtccttcgtctaaggggtggcatgcagatatttgtgaaaacccttactggcaagaccatcaccctcgagttggaaagttctgatacgattgataatgtcaaggccaagatccaagacaaggaagggatccctccagaccaacagaggcttatctttgcaggtaaacagcttgaagatggccgaactcttgcggattacaacatccagaaagagtctac

SEQ ID NO: 12656 - DNA, 488 bp, Gossypium hirsutum
  Clone ID: uC-gsflmaxxa067e10b1
ctctcgcgtccgcctcaacctacttcagccaaaggggtgggctttagactccattgtccccaaccgcacgcgcattcgccttttgaaaacaattttcagcctcgagatccctccttcaccctcaatttcgacgaagcaaggaggagtcaatggaagattcgcgagggaagccttttattctcttctctttttttttgaatatcagaatcacaaatccaaaaaaaaaagagaaactaaagaaaataaagtgtttagggattttttgaatcgaaaatcaccttgctctgttttatcgattgctttttattgcgttctctttgtgtgcgtaaaaaatatacaatggctattacatggcttttatagccggaaatagagaaaaatgaaaaagaaaatacaaatttcttggcggtttctttctttctctttgctgtgctggtgtttttgtatttgcttgcaggtacggagtccgctggcatgcgatggccctt

SEQ ID NO: 12657 - DNA, 126 bp, Gossypium hirsutum
  Clone ID: uC-gsflmaxxa067f02b1
tttttgggcagcggcctgggaaaatcttggtaggggggctcttggaacaaatttgtccttgaaatcaccagaagaggtctctctgttggggactacaaaagaggtcattgtcaccggtgacaagtc

SEQ ID NO: 12658 - DNA, 388 bp, Gossypium hirsutum
  Clone ID: uC-gsflmaxxa067f03b1
cgggacaccccaggggccgccgcggaattctctcgggggacccacgacgccggccttttcatatggtgacctgtgagcagatgagggggggaatttataaaccggtttttccctgtaacctcaaagtatggactattggccggggcgacccgtgacgccagggccattggtcagcggattgaatgggacaccgctggaactaggaaaaatatgaggagaggatatcgttgtgggatactcaaaaaaagctctgtttgaaactttatagatatgcgaaatgtactaggtggacacggaaaccgatgtcaaatttgagagctcgacatatgatcatctggaaggagttgctggatctcctgctagaggattgagatttatagataatgcg

SEQ ID NO: 12659 - DNA, 413 bp, Gossypium hirsutum
  Clone ID: uC-gsflmaxxa067f04b1
cccacgtttacaattggtgaccttggtgctccctggcgtgaaaagttcggccggcaaagggcttcattcagtgaaaaaggactatatggcgcctgatgaaaagcttccaagcgctggtaacaagatcgctgaagaagccgatgacgagaggactaagggaaccaccatgagcatggcaacctacgagatctacgtacttaaggtcctgaaacaggtgcatcctgatgctgacattggcagccatgctatgggtattgtgaacagttgtataccctgcattttccaaagggtggatgaagaatcttaggagcgtggacgctataacatgagacccaccagtacctgacaagagattcattctgcccgacgattgctcttacatggggagttgctctagcatgctgtttgataac

SEQ ID NO: 12660 - DNA, 455 bp, Gossypium hirsutum
  Clone ID: uC-gsflmaxxa067f05b1
gccagtttggatactaggagatcttcaagaagaacgagggtgaccttgcaggccctgtatgtgttgccaaggacaaggctttcatatatattgccggctctgcatctgttgaggtaaatgctgatgtgcctttgccccttgggcgaaaggaggacagggctcaaacccagcctgggtttgctaggggtctgtctgatggtcttcccaagtttgtcagatcagaaggtgctgttggattgtacaagggtattgttcctctttggggccgacagattccatataccatgatgaaatttgcttcttttgaaactattgttgagatgatctacaagtatggtattcccactcccaaggagcagtgcagcaaaagtctgcagcttggtgttagatttgctggtggatatgtcgctggtgtcttctgagctattgttacgtatcctggtgacaaccttggt

SEQ ID NO: 12661 - DNA, 483 bp, Gossypium hirsutum
  Clone ID: uC-gsflmaxxa067f11b1
cccacgcgtccgcggacgcgtggggtaacagtgaaaccttctcccctatcaaatggcaaaggaggcgcacggtagcctcgcctccgacgccgacgccatagaagcgacggcggaagatatcgagtcacgtattaccaccgccatgcactctcgcgttggccacttcaaggaacaagccgattcgttgaccttcgagggagttcggagattgttagagaaagacttggggttagagacctttgctttggatgttcagaagagattcgtcaagcaatgcctgctaaagtgtttagatggtgcaaatgaggatggctccaagagttcttgtgaaacagtggagaaaaatgtaagtacaaccactgaaggaacagaatcacccaaagaacgagaatctaagaaagaagtaaaggaaccttgctctgaagatgaggagaaattagatggctctccagttttgggccttctggctggatataaaactac

SEQ ID NO: 12662 - DNA, 176 bp, Gossypium hirsutum
  Clone ID: uC-gsflmaxxa067g01b1
gtttttgagaagtgttgcgctacagtatgggagacggtcgggtttagaggagttttggatatgatatgaaccatctgtgttatgaaggggtgttggagtgtgtaacgcacagccgacggagtattaatgatgatgaggaggagaaattgatgggaaagacggacattgtttgccac

SEQ ID NO: 12663 - DNA, 249 bp, Gossypium hirsutum
  Clone ID: uC-gsflmaxxa067g03b1
acctttcgtccgcccacgcgttcgctattaagtgtgagattgtaagaaacgctatctctcttctgttgcggccgctgttcataatcaaagaccgcaagtaaatatgaatagagattgactaatgtcgacattaattaacaaattgggagccgtctgcccattgcctgaatgccacatggaacctatttccacaacattgaggggaacccgggtcaaggcggaaagtttgtctcggcggctggaactttc

SEQ ID NO: 12664 - DNA, 381 bp, Gossypium hirsutum
  Clone ID: uC-gsflmaxxa074e01b1
gtttgttttttacaacaaagcctgtaccctgtggtccttcgtgcttgccaaagtatcttccgagcaaagagtctgatgcaacgatgaggaatgaagaacctagaacacatggaacaacatgaaccatgggccagatacctgaacttgagaggaaagcagcaagacagtctagagctgccgcagcacccgatgctaatgcggagacagtcttgtcaatgcataaaagacaaattgaactccaattaggagagccggagggagaagatgaatcctcatcctgaagaagttgcctcaggctctcctatagagccacctagaccatgccatgctggtgagtcataagcagatgcacatgggaatttttccaggagaggctcccat

SEQ ID NO: 12665 - DNA, 68 bp, Gossypium hirsutum
  Clone ID: uC-gsflmaxxa074e03b1
gttacgtttttgataaagagacgatacctcgaggggagctacagattatataaagcttcacagttttt

SEQ ID NO: 12666 - DNA, 140 bp, Gossypium hirsutum
  Clone ID: uC-gsflmaxxa074e04b1
gtttcgtttttgataaagagaagaaacttctaggagaggggtagatttaatgaagccatgcagttttacagaggaatatgaggagaggatgagtttgaggacagagaaaaatgaaaaggtaggatttaaaaccgaaaaag

SEQ ID NO: 12667 - DNA, 347 bp, Gossypium hirsutum
  Clone ID: uC-gsflmaxxa074e10b1
aaaaagaaagaaaaaaaaaaaagaagaagaaaaaaaaagaaaaaaaggaagtaagaaaaagaaaaaaagaagaaaaaaagagaagaaaaaaaaaaggaaaaaaaaagagaaaaagaaaaaacaaagaaaaaaaagaaaaaaaaaaaaaagaaggaagaaagaaaaaaaaaaaagagaaaaaaagaggaaagaaaaagacaaaaaaaagagaaaagaaaaagaggcaaaaaaagaaaaaagggaaagaaaacaaaaaagagaaaagaaaaaagagaaaaaaaaagaaaaaaaaaaaggaaaaaagaaaaagaaaacagagaagatagaaagaacagaagataaacaaa

SEQ ID NO: 12668 - DNA, 458 bp, Gossypium hirsutum
  Clone ID: uC-gsflmaxxa074f01b1
cgcatacgtttatgcgtcgctctgtgaattgattttcagattcggactccaatcaagtgaagtgctacatccagcggcaaaggtttttcatttcttgagatcccaactctgatcccttctgaaatctttccttttacagttctcaccaagatgttcaaaaaattttcatctgaagatgtgtcttcacaaaaccaagtcaaagcatctgtgcagcggaaaattcggcaaagcattgctgaggagtacccaggacttgagcctgtgttggatgatttgcttccgaagaaggcccctttaattgttgtgaaatgtcaaaaccatttgaatctggtattggttaatagtgttccactattcttcaatattcgtgatggaccatacatgcccactctcagactccttcaccagtatccgaacataatgaaaaagtttcaagtggatcgtggtgcgataaaatt

SEQ ID NO: 12669 - DNA, 52 bp, Gossypium hirsutum
  Clone ID: uC-gsflmaxxa074f02b1
cttttgtctctagcccccgcggcgccccccctcggggaggggcggattacaa

SEQ ID NO: 12670 - DNA, 98 bp, Gossypium hirsutum
  Clone ID: uC-gsflmaxxa074f04b1
gtttcactggtgctaaagagacgaaacctctaggggagggggagattataatgaaccacgcagttttacagaggaatgtggggagaggatgttctttg

SEQ ID NO: 12671 - DNA, 424 bp, Gossypium hirsutum
  Clone ID: uC-gsflmaxxa074f10b1
tcgcttctgttgaagggattgaagacgctacggtggggtgccatatttccttaggagatgtcagtattgcacatagggaagatctcagactgtctaagtcactgaggagggatcatatgacatgatggtgcgcatgtatgtgagcgcgcttttggcaaaaaaaaaagaaaagaaaaaggcactgtttctaatggaggtgctattattatgattggcggatgatgaagactgcgaactggtataagtactctccaactaaaacttgaaggatgtctcaacatgtatgttgccttcatacggagagcttcaaaatagtgctactagaatcatattatattcaataactacgatttctactggagaaaaaaaacaatgctcctgttctctcatgcctggcggaacaaatccttatgggatggaacaa

SEQ ID NO: 12672 - DNA, 106 bp, Gossypium hirsutum
  Clone ID: uC-gsflmaxxa074f12b1
tcggttttgcataagggaattagaacaatacgcggggaggtcttatccccagaggagccgatgcaattgcccattggcacgacaggcgggtgcctccctctctgag

SEQ ID NO: 12673 - DNA, 396 bp, Gossypium hirsutum
  Clone ID: uC-gsflmaxxa074g02b1
gttttggtttgcaagtttttgtgaagaccctcacaggaaagactattaccttggaagttgagagttctgatacgattgacaatgtgaaagctaagatccaggacaaggaaggtattccaccggatcaacagaggctgatttttgctggcaagcagctggaggatgggaggacccttgctgattataatattcagaaagagtcaaccctccacttggtgcttcgcctgcgtggtggaatgcagatatttgtgaaaactttgaccggtaaaaccattacgttggaggtggagagctccgacacgggtgataatgttaaggccaagatccaagaaaaggagggtatcccacctgaccaacagaggttgatttttgctcgaaagcagctcgaggacggga

SEQ ID NO: 12674 - DNA, 76 bp, Gossypium hirsutum
  Clone ID: uC-gsflmaxxa074g08b1
gcagggacggattcggagggtcggggcagacccacgcgtttcgggtattaaacagaaacaaagacacatcgggggg

SEQ ID NO: 12675 - DNA, 149 bp, Gossypium hirsutum
  Clone ID: uC-gsflmaxxa074g10b1
gttttgcttgttataaaaagacacaaccccaaggggcgggggtgatttaaagaagccaagcagttcaacaatggaaaaagaggaaggggatgtaaaagtggacagagaaggtcgaaggggaaggaatcgaaaacgaaaaaggacgacaa

SEQ ID NO: 12676 - DNA, 81 bp, Gossypium hirsutum
  Clone ID: uC-gsflmaxxa074g11b1
ctttcacttgtgacacacaaacacaacccctaggggaggggttgattaaatgaagccatccagttttttagaggaaaatca

SEQ ID NO: 12677 - DNA, 251 bp, Gossypium hirsutum
  Clone ID: uC-gsflmaxxa074h02b1
tcgtctactcttgcgaaacgacttaataggtgtagggttagtgttagctctcgggcgaaattgaaataccactacttttaacggtattttactaattcacgtgaatactgcaggcggcactacggcaccttttttaggacccaaggctcgtgttatggcggccgatacggccgtaagacattccatggcgaggagtacgtctgcgacggcacagactacaaaagacttggcaaggacgctaataatgacca

SEQ ID NO: 12678 - DNA, 438 bp, Gossypium hirsutum
  Clone ID: uC-gsflmaxxa074h08b1
tcgcctacgcgtccgctccatttatattttctctacaggtttcatttagatttcgtttacatctgatttgaaaaagttttgatttgattttcgaagtttttgatttggttgtcaaattttcagagagaaaaacaaaacaacactcccgaaatggcacgcaagaagatcagagagtacgattccaagagattgttgaaagaacattttaagaggctttccggtagagatttgccaatcaaatctgcacacattacggcatcaactgatttcaatcagctcgtacagaaggagccatggctttggtcacagaaactggttgttaaacctgatctgttgctcggtaagcgtgggaagagtggtttggttggcttaaatctggattttgctcaagctattggtttcgggaaagaaccccttggcaaacaggtggaaatgagt

SEQ ID NO: 12679 - DNA, 485 bp, Gossypium hirsutum
  Clone ID: uC-gsflmaxxa002d09b1
aaacatttttctcacttatttattctttcatttatgtatttgtaaaaactcacacaagtttaggaagaagaagaagatgtcgtggcaaacgtatgttgatgatcacctgttgtgtgatatcgaaggcaaccatctctctgccgctgctatcatcggccaagacggcagcgtttgggctcagagctccaatttccctcagtttaagcaagaagaaatcaatggcatcatgaatgacttttctgaacccggatcacttgccccaaccggattgtaccttggtggcactaaatacatggtgattcaaggtgaaccaggagctgttattcgagggaagaagggacctggaggtgttactgttaaaaagaccaatcaggccttgatcatcggcatctatgatgagccaatgactcccgggcagtgcaacatggttgtggaaaggcttgggtgattatctcattgatcagggtctttgatctcattggtgt

SEQ ID NO: 12680 - DNA, 412 bp, Gossypium hirsutum
  Clone ID: uC-gsflmaxxa002e06b1
aatgagtgcttagactaaaggttagagaggcagcgaaaaggcagagaggacaagggagagaaccgggagcctgggcaattgcagggcatggtggtgctggcctcgaccctaatctccctaaagaaagacaagaggaggctaagggactcctcactcgttgccttgatattggaatctctgctatccgctctaacctacacgacattgacgttgatgagcttgtcacgagagaattggaaaccggtcctctgtataactccggccgtggctctgccctgacagagagtggaacggtggaaatggaagccagcattatggatggtccggagaggcagagcggcgccgtttccgggttaaccaccgatgagaaatccgtttcccttgcccggcttggaatgggaaaaggaccaca

SEQ ID NO: 12681 - DNA, 521 bp, Gossypium hirsutum
  Clone ID: uC-gsflmaxxa002f03b1
ctgttttttctttttaaaagaaaaactcagcgaccggggggaatcaaatctcgccggagggtcgcttattctgatcgtcagaatttgtgagttgttccttttttttcaaagctgccgagagaattgaatttcattttttttcaaattgatgttaaatggttatgtaattatggttttgtagaagaaaacaaaaaaccaacaaaaaaaaaaaaggggaaagtgttctctctctctcttgtggcgagtaatggcttgcaatgcagggaaaaagatgatgagatcccttgctttgtcttcttcctctatgccttgattttttttacccttttatctctctcggaattgctctttaaaaaaaaaaaattgaatgagtgttgctttcgacctgggtatcaattcatgaaacggcttgcagaaatttgaacaaattttgttttggcttcaaaaggtccatcaagtcaggtggagttgcaaccggcaaatgttggacttttagctttcagtttttcagattgtctggg

SEQ ID NO: 12682 - DNA, 495 bp, Gossypium hirsutum
  Clone ID: uC-gsflmaxxa002f12b1
gttaaatacccaagtatctataaatttaaatgtgtggattaataagcaccaatctatggctcaactagggtcgtctctgtcagcagaaaccgagacactgagcaatgtcctaagcctggtggaggccttcagagcatttgattcagacaacgatggcgcaatcaatgctgcagagctagggggaatcctgagttcgctggggtacaacgctagcgagcaagacgtgagggccatgatgcgagaaggggacaccaacaaggacggattgctgagcatggaagagttcctagagatgaacaccaaggacatggagcttggggagcttgccaatttcctcaggaccgctttccaagcttttgaagtcgaaggggatgatgctttgacagctgccgacttgtatgaggttatggggaaccttggcatcgatcagctttccttggaggattgccagagtgttattgcctccatggatgctgatggtgatggagctgttag

SEQ ID NO: 12683 - DNA, 522 bp, Gossypium hirsutum
  unsure (1)..(522): unsure at all n locations
  Clone ID: uC-gsflmaxxa002g09b1
cccacgcgtccgcccacgcgtccgctaatctttcgctcaacgattccatatggagcaacagttatgtctctaaaaggcctgatgaaaggaggaattttgatatcagagtcggtgaagttaattctgttaacaacttgaagcccaaagtctctgatttcaattctttcaacaatgatggatggaaaattggagccaccaccaacaacatagggttcggccccatcgctccgaagaataccggaatcaacggaggattcaacaaaggggtttattcgaagccggcgaataacaataatttcaatgttaatttgaaggggaataagaatagaggagagggatgatcatggtagcaaaagcgggaagaagaatagtaacaagaagaagaacaataacagcgacaataacaacaacgaaactaaagatggggggagtgctgctgacaagaggttcaagacactgccaccgtncgaggctttgtctaggaacgaaactgttggaggctacatcttttgttgcaacaac

SEQ ID NO: 12684 - DNA, 560 bp, Gossypium hirsutum
  unsure (1)..(560): unsure at all n locations
  Clone ID: uC-gsflmaxxa003d03b1
ttctcgcgtccggctctttacaagtgtaacatggctggaaagcctgcagtcgtcactcgtgttgtggacagtatgactgacaacttgaggccaactcgtgctgaggcaactgatgttgccaatgctgttcttgatggaagtgatgcgattcttctcggtgctgagaccttgcgtggattataccccgttgaaaccatttctactgttggcaaaatttgtgctgaggcagagaaggtattcaaccaggacatgtatttcaagaagactgtcaaatatgttggagagccaatgacccacttggaatccattgcttcctctgcggtacgagcagcaattaaggtgaagtacattttgagttgaggaaatggctttaggctaatgttagtcccgaagttgctgcatcatacccgattatttatggaggggtncgtcactgctgcaaactgcaaggaactagcaactcagcctgatgttgatggttttttggtcggtggagctttacttaagccggagtcattgatatcataaaatctgctgaggtgaagagaatgcctaaggtt

SEQ ID NO: 12685 - DNA, 248 bp, Gossypium hirsutum
  Clone ID: uC-gsflmaxxa004a09b1
ttttgtttcctctaaactcagagaaaattcgacaatggtgcacgaaacacatcggtaaggaaaccctactgacccaaacgccgatcaaaacgctgctttgatcaattctttcattgaaattacttcttcttctaaagaagaagcccttttctttttggaatctcatcagtgggacttagacgccgtcgttttgacttttcttgtcagcaattttaccgtcgtactacattcaacattttattgtttca

SEQ ID NO: 12686 - DNA, 61 bp, Gossypium hirsutum
  Clone ID: uC-gsflmaxxa004c03b1
ctgttcaatctctatcaaatccggagattttcgcgagacagctagagatcgagagagaaac

SEQ ID NO: 12687 - DNA, 169 bp, Gossypium hirsutum
  Clone ID: uC-gsflmaxxa004c12b1
ccctcgcgtccgttatcctattctttcttgttttgaggttcttcactcactggcccaagtctctcaggtgaacggagatggcaggaaaaggtggaaaggggcttttggcggctaaaacaacccgcagctaacaaggacaaggacaaggataaggacaagaagcgcccgg

SEQ ID NO: 12688 - DNA, 530 bp, Gossypium hirsutum
  unsure (1)..(530): unsure at all n locations
  Clone ID: uC-gsflmaxxa004f12b1
cttgttccaaatgttgtttcttacaacaatttgattaatacccattgcgataggggtgaagttgatattgctatccaagtttaccacgagattttggagaaggcaccttttaacccctctccggtgacgtataggcacttgaccaagggcttgatcgatgctgggaggataggggaagcagtggatctgctgagggagatgttgaataaagggcacggtgccgactctttggttttcaacaaccttatatcagggtttttgaatttggggaatttggacaaagccaatgagttgtttgatgagttgaaagagcgttgtttggtttatgacggggttgtcaatgctacgtttatggaatggtggtttaatcagggaaaagataaggaggccatggagtcgtataagtctttgttggataggaaatttaagatgcctcctcccacttgtaatacccttttggaggttttgcttaaacatgggaagaccaaagaagcttgnaccttgttcgaagatatgtnggataatcatac

SEQ ID NO: 12689 - DNA, 440 bp, Gossypium hirsutum
  Clone ID: uC-gsflmaxxa005a09b1
tggagcgcttcaaatatctctccgaattctccacctcttaacatagatttgatttctcttttagtcaagtaatgtcagggaagagaccacgtccgatgatggggaaattgtctgaattattggtttccggcaaaaaacccgtatttttggatgctgttgttacaagccctaggagtccactagatttgaagacaccatcacctagaagttcgaagagatatgatgttggtgggcgttggactagggatctgctgctgcactagataacaagtgtagtacccattcctgcaggcatactatttgtagctcaaatgtaattgctgtgaaatctggtgggaagaatttagagatggaaagtttggaggattttacgtatgtgactacccatggatctggcaagtcgtctacaaaggtggtttatgatggaggtgaagaaagga

SEQ ID NO: 12690 - DNA, 562 bp, Gossypium hirsutum
  unsure (1)..(562): unsure at all n locations
  Clone ID: uC-gsflmaxxa005c03b1
aaacccgtaaggcgcaaggaagctgatatggctattcaaaaatttgggtcttagaatcttcacaggagcaaattttcagagtgaaccaagagaatggctcattgaaacaaaatttgaatgcaacaaatgcggctccgagtgcagctagaagtgaaatttccaaagtatcaaataatggaattaatgcactcaagggaaaaggtgatcagtcagcaaaccgacagcataagtcaacaagtttagtgaaaaactgttatgctggaatccaaatgtccaatggtcttagctctaaacatgatgaggagcttgcagatttgctggaagaaaaaactaggtccctggaggccattcaagctagtcatgaatcacaaataaagcaattcaagatggaacttgaaaaagagcatgataaattagtgaacgtacagataagattacaagaggagcacangctgaatgagtcttttcaggaggagcttaggttactgaaaatagacagggataaacgctcttcagagttgagcaatattcgcaacgaattggatgagaaaacaaaagaaat

SEQ ID NO: 12691 - DNA, 445 bp, Gossypium hirsutum
  Clone ID: uC-gsflmaxxa006e09b1
cttacgggatcacccactgagtcgatggatgtaaacttatttacaaaaggagactcaccagaaatacattagttacagttgagtcattcaattgcacggaactggagatcccataaatactgaacctattcaaattgatgactcgaaggaagtgaattatggaggtatatgcagaatggaagacatgcgctaccatgtattatgaaagagacgagtgtgcaggaaaggcatgaacgtttgatggaacctgtgatatatgcttgtgaaggaattagatgcagaaagtcggatgtgattcttacgacgagcattgagaaacttggcaaagctggtgagactgtaaaagtcgctcctggttattttcgcaatcatctgatgccgaaattgcttgctgttcctaatattgataagttcgcttatttcattaaggagcagcgttagattt

SEQ ID NO: 12692 - DNA, 51 bp, Gossypium hirsutum
  Clone ID: uC-gsflmaxxa006f06b1
gctgggacgcctgcagggaccggaccggaacggcattcccgggccgaacca

SEQ ID NO: 12693 - DNA, 529 bp, Gossypium hirsutum
  Clone ID: uC-gsflmaxxa008c03b1
attatcctctctacttgtgtgtgttttttctcccatccatattcaaaatgaaccaatcccagttttcgagccaccaagctggccagaaaatgggccaagctcaggagaagaccagtcagatggctgacaaggctagggaaactgcacaatctgctatggattcaatgcaacaggctgggcagcagatgcaggccaaagcacaaggcgcaacagatgccataaaggatacaatggggatgaacaaatgaaacttctgctgcttgatcccagaccgcacctctccggcacctacaatattcatcttttgagctttagttttattttttggcaacattttcttaaatttgctcatatgttcttgagctacaattttcagtttcaatcatttctacaagttttatttttagccatttgtacaataaaatttgggatgtaataatggtgccaattacttaaagtgtgtactgtgaagagataatgggaaaggttcatttatcttaaataaaacttatctcctaccccctatatc

SEQ ID NO: 12694 - DNA, 207 bp, Gossypium hirsutum
  Clone ID: uC-gsflmaxxa008c12b1
gactttccgaatccctttcacccacgcgccgtaacgctaaaagagcttcctgtctatcagcttttttaggtacttaagcctttttccctcggcctaggcttatctatcattatgcttacagatcgaattaaaaacaccatatatctttgaatctgaaccctttggagaacttaagaagaaatgccaccaattcccctttacccaaca

SEQ ID NO: 12695 - DNA, 226 bp, Gossypium hirsutum
  Clone ID: uC-gsflmaxxa008f12b1
tagatgagatggcgtctgtaataaaatctgcaagcttatttctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtac

SEQ ID NO: 12696 - DNA, 482 bp, Gossypium hirsutum
  Clone ID: uC-gsflmaxxa008g09b1
ccgtaccggaaacccttaaaagacccacacccacgtttaaaacccaaacaaaaaaaaaccaaccagggtgtaaaaaaaaaaaaaacccccacaaatacccaacaaacaaaaaaaaaaagaaaaaaaaacaaacaaaaaaaaccaaaaaaagaaaaaaaaccaaaaaaaaacaacaaaaaaaaaaaaaaaaacaaaaacaaaaaaaaacaaaaaaacaaaaaaacagaaaaaacaaaaaaaacaaaaaaaaacaaaaaagacaaaaaaaaaaaagaaccacaaccacaaaaaaaaaaaaaaaaaaaaaaacaacaaaacaacaaaaacaacaaaaacaaaacaaaacccacaaacacaacaccaacacaaaaccaaaaaaaaacaaaacaagaaaacaaaaacaaaaaaaaaaaaacaccaaaaacacaaaaaaaacaaccaaacaaacaaaacacaagaaacaacaacaaaaaacaacacac

SEQ ID NO: 12697 - DNA, 337 bp, Gossypium hirsutum
  Clone ID: uC-gsflmaxxa008h06b1
ccgaatagggggaaggcgccaaaaaaacaggggggaattaaaaaaaaaacccgaaaaccccccacacacaaaaaaacaaccaaaacaaaaaggaaaggaacaaaagaagggggggggaaaaaaaaaaaaaagacaaacaagaaaaaacaataaaagacccggggggagggggaggagaaaaagagaaaacaaaaaaaaaaaaaacaaaaaagagaaaacaccaacagacgaaaaaacacacaagaaaaaaacaaaacaaaaaacgaacaaaaacagaacacaaaccagaacaaaaaaaaaccccaaacagacaaaagacaaaaaaaagaaaccaaaa

SEQ ID NO: 12698 - DNA, 474 bp, Gossypium hirsutum
  unsure (1)..(474): unsure at all n locations
  Clone ID: uC-gsflmaxxa009a03b1
gcgttgacgcgtgggctttttttttttgaagaagccgagacctaatgctttttttttctccctttccagctgttcatctaacattattcagactctaaattttttaaaagaaaatatcattgtctgatacattcagatattagtacaagatctatgatcccctgaataattaacaaaatttaaaagaaattgaatatacttgtgttgaatacaacactcacttcgagtccgtctaacgtaactgtccaaaacctctgctggacctgttgttcatggccaagcaaaactcggataatttaatcgacagataagctatttaaatgctataaactcatccttcttctataggattgaatttagggtaaagaagtatttgaatgttgcagagttgaagtccaatcttaatcgaggacaaattgggagtggangaaccaggatagctgctcatgtttctttttcagtatcattctcact

SEQ ID NO: 12699 - DNA, 256 bp, Gossypium hirsutum
  Clone ID: uC-gsflmaxxa009g12b1
ccgtgcgggccccggcgcggtatccggggcgagccacacgcgcgcgtttacgcgcattttaggatcattgccatattgtaccgaacagggtataaggcgtgaggttctaaagagttcattgcttactgccgttcacatctccaacgctatgaatgcactcgccgctagcaggctaggcgccaccacgcctggactcgccacacggatatacggggagctcacacaaaccacctacagtagcggattcctgatcaca

SEQ ID NO: 12700 - DNA, 344 bp, Gossypium hirsutum
  Clone ID: uC-gsflmaxxa010a09b1
ataggaggtaaaatggcatatggtaatctggaattgagcccgaatcagggagagaaagaggaatctgataaaagtagaggtggaatggacatgcttctatctgctgccagtactctacactttgtggagaagttgaatgcgaatggcaagaagagttagaaagaccttgcacttgggaggacataacatgatatgatttgtttttcacggtataatgcctttaccttttctattatggatagctcagattgacaacttattttcacttcattttttgggctgggaagcagattggtgtaggataaggttatttacttcattagatcttacttgcatttggatga

SEQ ID NO: 12701 - DNA, 418 bp, Gossypium hirsutum
  Clone ID: uC-gsflmaxxa010c12b1
ttacatgacgacggcaactatccactacgggcaggctagaaaaccaactggggacttacttagggcaaaagatgaagaacagcctgagatatctgaggaatactcggtttctgctgtgcctttttttgtcttcttcaaggatggaaaggttgtcgataaattggagggtgcagatccttccagcctggccaacaaagttgccaaggttactgggtcaattaacccccgagatactgctgctccttgctagtcttgggatggctgctggccccaccgtcctcgagaggtgtcacatatttggcaaaggcaaccggttcttcccaaatgggaaatcaagtgcaaacttgtctttcatcaccaaaattaaaaaaccattgcagaaatggaatgactctcatcctcgaatgctattcatgaa

SEQ ID NO: 12702 - DNA, 159 bp, Gossypium hirsutum
  Clone ID: uC-gsflmaxxa010f12b1
ataatttcttccgttgatctttgttagagattagcgttttaatttatcattatgggacggatcaagatcggaatcaatggatttggaaggaccccccgctctaccccacctcccccatccctcccctctctcctctccacctatcctctccttctctct

SEQ ID NO: 12703 - DNA, 510 bp, Gossypium hirsutum
  Clone ID: uC-gsflmaxxa011b03b1
cggacgcgtgggcggacgcgtgggcggacgcgtgggcggacgcgtgggcaagaggaaactacttcgggaaaaatcaatggatttgacacctaacgttgtggtcgctaaggatggtagtgggaaatatgattgcatcacagaggccttagctgaagtcccgttgaatagttgcgatcgatttgttattcacattaaggctggtacttataaggaaaaaatcctcgtgaccaaggagatgactaatgttatgttccttggtgatggcccaactgagaccatcatcaccaactgcgttaactgctgtaaggataatgttaaaacattcaacactgcaactgttggtgtggatggggctggtttcatggctaaaggcattgggttcgataactcagcaggacccgaaggtcatcaagcagtggcttttagggcatcctgtgatatggtcgacatgtttaattgtcatttcactgggtaccaagacaccctttacgctcacaaagagaaacaatt

SEQ ID NO: 12704 - DNA, 274 bp, Gossypium hirsutum
  Clone ID: uC-gsflmaxxa011h08b1
tcgatttacagctgatcttttcgctatgaaccatacggatttcatcatcaccagtaccttccaagaaattgccggaagcaaggacactgttgttaatacgagagtcacactgttttactctttctggtctttttccttttcttactatttctttttttttttccttctctcttcttttctcttttttttcttttacactcttatttttttctttttttttcctctttttatctttttttttctctattatatctctttttttattacttttttt

SEQ ID NO: 12705 - DNA, 433 bp, Gossypium hirsutum
  Clone ID: uC-gsflmaxxa014a06b1
ccaggaactctccattaatttgtaccaaatgtggagtaaactcaataatttacataggccagatattttactaacaaaatagtgattcaaacgtgtgagcagggtcaaactactagcttctattaatggaagctaatcattattccttatgaaaaagacaattgtgggtgagattgtgcggccttgacatggtttcggtcacattttgggtggtggggttatctctcatctcttaaggtttacttggggtactcaggttggaaccaggattctagcttttgatagatcttttttacttgctgaaaagatctataaggggttgagtgtaatacccattcgggtcagtctaaacccgcgtttaatattacttacattggcaatggtagttcttgttgactttcttactgattcatgttgaccataacacaattta

SEQ ID NO: 12706 - DNA, 410 bp, Gossypium hirsutum
  Clone ID: uC-gsflmaxxa014b03b1
ttcactcgtccgcttccttttaattattttcttcgtcatttgccagataatttttttttttaataaaattattggctgaattttcgttgtttggcacgttttcatacagagatttctctgtttattgcgctgcgttttgttgagaaattcgaaaagcattaaggctgcgccagtgctggtcttttgtttggagtgaagagaagagaagagaagagaagagtgagtgtttttgctttcttttagatgcggaaaggtggatttggtttaaggaaagaagcgatgggagattttggttaatgaattctaagtaggttttgtttgggcagcgctcaaagttcaaattgggtgtggttaattgcactgaaagaggatgaagatgttttccctgcttaaatccttgttctaaagat

SEQ ID NO: 12707 - DNA, 464 bp, Gossypium hirsutum
  unsure (1)..(464): unsure at all n locations
  Clone ID: uC-gsflmaxxa015b09b1
tcgttcacgcgtgcggttcgcctaacacagatggggaagcactttacggctcatagaatagaccatatattaggcttgtgtagaatttgggaactaccagacaatgctatgacgggtctgattggaaaattccgaccctgtatccctctaagccaggaagaacttgaaagagagggtatttgggactttgaccgcttgactcgcccatatgttcgaaaggagttttacaggaaaattttggagattcttggattttgattgcggcaaatttttttaaggaatatctagaccgttatgagttcaaggaggagtgcaacacggagaaaaaaattgctgccaaggcgcactcatgtgcgtagaagtccttgctaccagagagcgaagacaagatacgttgagatctatttgatcttctaaagaacatagttcttatcagagatctagaacatgacanaagtttctat

SEQ ID NO: 12708 - DNA, 78 bp, Gossypium hirsutum
  Clone ID: uC-gsflmaxxa015h04b1
ccacgcgtttagttttctccgcaacgcgaacgcgcacgggggagggttttggctaagcacccggggggtgcaccccgc

SEQ ID NO: 12709 - DNA, 472 bp, Gossypium hirsutum
  Clone ID: uC-gsflmaxxa026f02b1
tttatatttaattttctttcttaatcatcctccccattcatctgtcgctataaccccaaaaagcctgcaaaccctagtctcaatttgtagaactgagcccaggcttgctgatttttctttttctttttcctactttttttggttgctttacatttttattcggatttatttcgttttatttttaaggtggctaataaacttgattaattttattctgaacactgttagttccatactgttaataatctcaaaatgttcttatttggttcttttaaattgcaatgttgtcattatatagcagcctttaatgcagttccttgaaaaattatgctgttactgatttttggaatgatgattttctttttaacatttttgattttttttttttggatcctccttttgcagctatttatcctttgcattgtacgagaagaaataaagacagtggatcgtaaagagagcgcttgtcgtc

SEQ ID NO: 12710 - DNA, 511 bp, Gossypium hirsutum
  Clone ID: uC-gsflmaxxa026g08b1
taaggaaagctggtcgccttggtcctttttatttgttgtctacccacgctttttttacgctaccgtggacgcgtgggccgatttttccggcagattctttttttttctttttatttaccgataaaaacctgaaccctaactatttaaagtgtcttgattttcagtgttttctgcatgttcgcttggggctagacatcctgtcggttagtttctaagtagataagttcatattatagagtctgtgcagtttgttttgtttgaaaggtacggattaggagttgtaaggtatggaagttcctagtgcgaaacatgaaacaatgcatcgtaggttgaccccgcttagggtgttaaggggtctgatttgtttgcttgtgttgcttttaacaagctttatgatgatagtgtattgtggcttttttagtacttgtgtatagaggcttttacgcttttattacagccgaaaagaaccgtcttcttttttagttcttggattttattatgcccttttttt

SEQ ID NO: 12711 - DNA, 527 bp, Gossypium hirsutum
  Clone ID: uC-gsflmaxxa027a02b1
acaactttgaataagaaatggcccgacttctcccccctcagcttttctttctactgaccttggtggtcatcatccatccctcatacggacttaagcatttgaaaggtacagccctcgttgacgaggtttgccgtcacacattccacaatgaatattgcgtcaataccatagtcccaaagccgccattatccggggaaaggatcgccagtaccactttgggttgggcacagataaaagctttggaagccggaaccatcatagctagtctacttaatgattcttcttccatcttaccagtagcaaagaaccctctacaggccaaagagcttcttcaaatatgttgggattctaacatgaacaaccatggaggacctttggattgctagcagtttgctttacaataagatcattcaatcccatgattgctcgtctgtataatgctgcaaataccactagagttttgccaaatggcgtaaaatggaacccggtttacagccttaactgttaagaacgaggatttaattaac

SEQ ID NO: 12712 - DNA, 545 bp, Gossypium hirsutum
  Clone ID: uC-gsflmaxxa027e04b1
gtccttcgtagagatagcagatttgatttacagagaccaaagggggggaaatggcgatcacactgaacaatggatttaagatgccagtggttggtttaggtgtttggcgtatggatggaaaagacgttagagacctcatcatcaactccatcaagcttggttatcgtcattttgattgtgctgctgactacaagaatgaagcagaagttggtgaggcattgtctgaagcattcaaaactgggcttgttaagagagaggacctctttattacaaccaagctttggaattctgatcacgggcatgttcttgaggcctgtaaagacagtcttaagaagcttcaattggattatctggatttgtatctagttcactttcccgttgctgtaaagcacactggagtcggtcaaacggacagtcctttggacaaggatggagttctggacatagacacgactatatcggtggaaactaccttgcacgcgatggaagatttggttttcaagggttagttcgtagcattgggatcagaactatgacattttttt

SEQ ID NO: 12713 - DNA, 406 bp, Gossypium hirsutum
  Clone ID: uC-gsflmaxxa027f01b1
gttttatcgaaggatgtccaaaatatgatgatcagaaaacccattacacgacccttgcccaccgtcaatatccccgactgggaaccgttaaatgattcggcggataactttctggctgtcggctataactgcaatgcaccctgcagcccttgtcccgtagaataccttacggcgctccggcgataccttcccttgaacgatctcgagcccgacacccttagtgacgactccgacgtacacatcatcgatgcattctcgtgcgatcatttccgtatgtaccagttcaaggtgaggaggtgtgctcgtggcaggtcacatgactggacctagttgtcgtacccccacccttgggagaaagttcggtggaaggatccagggagttccattactttggatccgcttgccc

SEQ ID NO: 12714 - DNA, 486 bp, Gossypium hirsutum
  Clone ID: uC-gsflmaxxa027f10b1
ccgaatcagaaatcaacagcttcgatgatttccatgccgccattcttgatatcttgaatgttattagcacagcattacctgtaaacattatgatgccccatctcgccgtgaagtcgagaaatgttttaaagcatgggaaaacgaaaaagaccctgagaaaaagaagaagatatttatgaaatttatccaggaaataaaacttagccagctcgataacacaaccataataacgggaatagtgacgccgccagcagccatggcagcgaagaaagcgggagaatttttgcctcatttgagcgtgataaagacgattccggatgtagttttcgtaccatcggtgacaatggcgaccttagtcatttccaagctttctagaaggcttttacgggcgaagcgccacccctgtgccaacaaaatcagcgtcctttaatgtggataagcctgaaagacttgaacctgccgccgccaagaaatcccacgtcacct

SEQ ID NO: 12715 - DNA, 526 bp, Gossypium hirsutum
  unsure (1)..(526): unsure at all n locations
  Clone ID: uC-gsflmaxxa028b07b1
tcggttcggatctggaatgaaacatggttgtcgagtttcttttacaagccttgcaattatgaactatttgtgaagcagtctctcaatatggaaatggccattgtcatggcaagggatgctggaatggagtggatactgcatcttgatactgatgagctaatacacccagctggtgcaagtgaatattctttgaggcagttgctacttaatgtacctagcaatgttgatatggtcatatttcctaactatgagagcagcgttgaacgagatgatatcaaggatccttttactgaggtgtcaatgttcaagaagaactatgaccatctaccaaaggacacatactttggcatgtataaagaatcaactcgtggtaatccaaattatttcttgacttatgggaatgggaaagcagctgcccgcattcaggatcatcttcgtccaaatggtgctcacagatggcacaattatatgaaaaccccaaatgaaatcaaatnggaggaggctgctgttctacactacacatatg

SEQ ID NO: 12716 - DNA, 427 bp, Gossypium hirsutum
  Clone ID: uC-gsflmaxxa028d10b1
acgcgttcgtccacgcgtccgatttcttcacactctccgacgaaagaaaccagagataaatgaccaagtgttacccaaccgttagcgaggactaccaaaacgccgttcaaaaggcttagaggaagctaagaggtcttatcgctgagaagaactgtgctccactcatgctccgtctagcgtggcactcagctggaacttttgatgtcaagaccaagaccggatgtccattcggaaccatgaagcaacctgctgagctcgctcatgctgctaacaacggtctctatatttgcagtcaggcttctcgagcctgatcaaggagcagcttcctatcctttcatacactgacttatatcagtttgctggtgttgttgctgtagagatcaccggtgggccggaaatttcattccatcctgtaagagaggacaag

SEQ ID NO: 12717 - DNA, 534 bp, Gossypium hirsutum
  Clone ID: uC-gsflmaxxa028f04b1
gtatatccaagggaacaacccaagtactccttataggcaacttgactaaagctgccttttgcagtctcctctgcccatgtgcgaaaagggcatatttgtcactgtatttcgagaggatgaatcgataagcttgataagccacttttcaccaaatctgagggtaaattggttacctctaagagttatagctcttgcaaggtatggttagttggagatgacttgaccgaataagagcaaagaaaggcaaataaaggaacactatttattcccttttcgcaacttccaccaaaaaaattgcgcaaggactgcttctatcacacaacaccagcgatgcatacttcgacggcccttgagaatgtggattcttgctagaacctggtgccaaggatagtgatgagcgtatggcgcataactgggatactgcatgctctggaatgatgggaagagcactaatgtggttacaccatgtcttacatttgacaaagttggtaagcatgcctaaagcatggtattcagcctctgaaggtccaaact

SEQ ID NO: 12718 - DNA, 551 bp, Gossypium hirsutum
  unsure (1)..(551): unsure at all n locations
  Clone ID: uC-gsflmaxxa028g01b1
gttctttcaccaaaacaaaacactttcttctttcttttttttctcctccccaccatgactgacagagtttacccttcatccaaacaacccacaaatggcaccgtccccaccaccacctccgccgccgctgccgccaacccttcgtttcccgccactaaatctcaactctatggagcctctcgccctctataccgtccgcaaaccaagcgccaccgttaccgccgctcatgctgttgttcttgctgcctttggaccacaatacttatccttgttcttatcctcctagtcgccatagctggtgctatcttatacgtgctttaccgtccccaccgacctactttcacgatctcctccctcaaggtctcgacccttaatgtaacctcagcttccaaggtcatcaccaacatgcaccttaacgtcaccgccaaaaacccgaacaaaaagctcgtctacatttacgacccaatcaccatatctcttatcacatacgacgagatcgatataggggaggggtcctttngctccttcgtgcatggcaataaaaacacgac

SEQ ID NO: 12719 - DNA, 257 bp, Gossypium hirsutum
  Clone ID: uC-gsflmaxxa029a03b1
tcgcacaggcttggtttttgctcttaccgatgaacatgaatctgaggtcaaggctcaataaaatgaagaaagggaggaaaaaggcagattctctagaaataggggcgagtatccctatactagctgcagttaaagtaaaatctcatgaatcaaggatggtaacactagaggaactatataaattgacgatcgaaacttggactaagaggaagggaatggagctcaaaagcacagagatcattgccaataccccattg

SEQ ID NO: 12720 - DNA, 275 bp, Gossypium hirsutum
  Clone ID: uC-gsflmaxxa029a07b1
cggtcgctttgggcggacgcgtgggattgatcccatctgtgcccttcaggctctcatggaaggacttcaagttttgacccttgaggatgttgtctacgaggctgatatctttgtcaccacgactggtaacaaggacatcatcatggttaaccacatgaggaagatgaagaacaatgccattgtttgcaacatcggtcacttcgacaatgaaattgacatgctttggtctcgagaaattattctggtgttaagcgcattaccatcaagcctcaaac

SEQ ID NO: 12721 - DNA, 531 bp, Gossypium hirsutum
  Clone ID: uC-gsflmaxxa029a08b1
aattagttttacggaggagcggggagacacgggaaggagggggggcaaagagaagctcacaggagcccaactctctagcatattccagaagctactggcgccctcgactgctgagcacaatttcgggccccgaataagggctagggaaaggaaatgggtaaataaaaaaagggaaagaaaagtatctggactggaacaagctaaaaattggccctgaaaatttgaaaaaggacctaagaagaacggactaatacaggcacaaaataaaaataaaaacccgggatacggcacgactctctaagggatacaccccaaacgaggctcggggccaaatgggcccaaatacaaggaagaaataggacaacctccaaaaggcacaggatggaccaagaaagaacacaaagaaacactaatcaccctctaagaaatctaaaaacctggaaagagaaggcaaaataaacaaaagaaacccaagcggaattaaaagaaacatcgcgggaggcttccggttccggtaaaaaggggaaagaa

SEQ ID NO: 12722 - DNA, 390 bp, Gossypium hirsutum
  Clone ID: uC-gsflmaxxa029a11b1
ccttctctttcgcccacgcgtccgcacggcatccgcagtgggtgttcatttatcatttttcatctaaatcttgatacgaaacaaaaaacgtcaaatcggtgggaatagctatgggttttgagaagatcaaggacgccaatcccatctttttatattggccggaaatgaaatgaccagagttatttggaaatcaattaaggataagctcattcttccctttgtggagttggacataaagtactttgaccttggtctttcacatcgtgatgctaccgatgaccaaagtacaattgaaagtgcagaagctaccttttaagtacaaatgtcgccattcaagtgtgcctctattactccagatgaagctcgtgttaaggagctttgacttgaagc

SEQ ID NO: 12723 - DNA, 223 bp, Gossypium hirsutum
  Clone ID: uC-gsflmaxxa029b02b1
gctggccgcacgccgacgggcctgaattccttgctcgcccacgcatccgaacaattattttattccttccccgaacaaataccctgatgggtgggtgtatttggcactaatctgaagcatttctttacgctttatgggaaagctctggagagaacaagttgcgacagtagtgaaatgatgattatcatccagagcgcacttcgcctgctctgaaaaccccgtc

SEQ ID NO: 12724 - DNA, 272 bp, Gossypium hirsutum
  Clone ID: uC-gsflmaxxa029b05b1
cggacgcttgtttaagatttgctttcctcaagtggggttctaatgcatttgataacatgcttgttgtcccccccggatcaggaatcgtacatcaggtcaatttagagtatcttggaagagtcgttttcaacacaaatggtgtgctttaccctgatagcgttgttggaacagattcttatacaactatgattgatggtttgggtgttgctggctggggagttggtggtatagaagctgaagccgtcatgcttggtcagcccatgagcatggtt

SEQ ID NO: 12725 - DNA, 373 bp, Gossypium hirsutum
  Clone ID: uC-gsflmaxxa029b06b1
ttttgctttcacttttttctaaaaagtttcagagcaatgacgaggataagtcggacttttggtgatacaatgaaaaaggaagcagttccagctgtctcagctgatgtaatatttgcttcgacttcgagtcggcttcccagttacagaattgggtcaaataatcagatcattgatgccaaagaaaattctaaagttttgtctatgaaggaggttgtggcaccgtgagaccgtgttgttgttggagcattaacaacgccttctggttcgtgatcttgctagtaaattcgagaaagggttagctgctgttgcttagcttatttaataggctatacttaaaaaggctgcttcaatggagaaacatgttcttttgaag

SEQ ID NO: 12726 - DNA, 59 bp, Gossypium hirsutum
  Clone ID: uC-gsflmaxxa029b08b1
ctataggttaagctggaacgcccgcaggtaccggccgaaatccggtcgaccacgcgtcg

SEQ ID NO: 12727 - DNA, 490 bp, Gossypium hirsutum
  Clone ID: uC-gsflmaxxa029b10b1
caccttattaacacgacactgctcgctagtccgggtgctaagggttcagtggttggaattggtgacccttctatgaataataatctggttcagaccacagggctgcagggtggtgggatggggatagttggtttaggctcacccgcaagccagatatcttctgatgtggtttcaaagaacagcaccgataccacttcgccatcaccagttccttacatattcggccgaagaagaaaatggggtgcaaatttggagaaagtatttgagagaaggcaaaggagaatgattaagaacagagagtcagctgcaagatcacgagcttgcaagcaggcttatacattggaacttgaagcaaaggtcgcaaagcttaaagaaatgaccccaagaattgttgaagaaacaggttcctattatctgcttactaagattctttgtgttttatttgaaaaaacgtccggtagaccgccggtcttaaccatactttggttgg

SEQ ID NO: 12728 - DNA, 303 bp, Gossypium hirsutum
  Clone ID: uC-gsflmaxxa029b11b1
tttaatttttgataagtagagagatctaggagggggcgactgtaaccagattacacaccaatttttcagagaaaaaaatgggtgggaaaagtaccatggctgctcttttagtaattttagctgcaaatctgttgcagagtacttttgggataaacttacacatagtgtatacttccatcggtttggggaattccctgtttaaaaattaactgatgatttttattgatgatttgggcctgacatataaagtaatttttctttgttggggatgtttctagtggttcaaatttttactatatgggc

SEQ ID NO: 12729 - DNA, 214 bp, Gossypium hirsutum
  Clone ID: uC-gsflmaxxa029c04b1
cccacgcttcctttaaaccttcattccatcccactcaccccgaacggggtcttttcaacaacatggggaggacacgtggaatgggagcggggcgcaagctgaggacccaccgcaggaggcagaggtgggctgataaggcatacaagaagtctaacccttggaaaatgaaaggtagaagccctttgcccgggttcttcccatgcctaaaggaatt

SEQ ID NO: 12730 - DNA, 447 bp, Gossypium hirsutum
  Clone ID: uC-gsflmaxxa029c05b1
ggcgtcttgatacacgcccccatttattttatttttcaaacaaatgggccctttaattttcgtataagggcctaggaaaagaaatatgacagagtgcatttcagttcacatcggtcaggccggtattcaggtcggaaatgcttgctgggaactttactgcctcgagcatggcattcagtctgatggccaaaagccaagtgataagactgttggtggaggagacgatgctttcaacacccttttcagcgaaactggtgccgggaagcacgtccctcgcgccatctttgttgatctggagcctactgttatcgatgaagtgaggactggtacgtaccgccagttattccaccctgagcaactcatcattgggaaagaagatgctgccaacaaatttcgctcgtggccattatacaattgtaaaagagattgatgatctctgcttggatc

SEQ ID NO: 12731 - DNA, 537 bp, Gossypium hirsutum
  Clone ID: uC-gsflmaxxa029c10b1
gctactcttgcttctagacccttctctcccatcactttatgggtttcttttttccctcttttaaaagccacccctgaaacacacccagtgtcttttgtcaccccacaaatagctttgctgtcaacattttactcaagattttcctctttttctttcctcccaaactaactatgtatcgttttgcttcaagccttgcttctaaagctagggctgctaggaacactacatatcagattggtagtaggctgagttggaataggaactatgctgcaaaagatattaaatttggggtggaagctcgagcattgatgcttaaaggtgttgaagagctcgctgatgctgttagagtaaccatgggtcctaaagggcggaatgtggttattgaacaaagctaccgtgctccaaaagtgactaaagatggtgtaactgttgcaaagagtattgaattcaaagacaaagtgaagaacgttggtgccagtcttgtgaaacaagttgcaaatgccaccaatgatgtagctggtgatggaactacctgtg

SEQ ID NO: 12732 - DNA, 543 bp, Gossypium hirsutum
  Clone ID: uC-gsflmaxxa029c12b1
ctgggaaattaaaaaaagaaagaaagcagggggatgcttaatctatggaatcttctcttcctctcctttgttcatttctcatcattcagtgttactttgggtggggtgtcgggaaacccatttactccaaaatcctccttcattcgctattggaacaaagagctccacaaggaaatccccaacacccattttttactctctaaagtttcaccattaactgccgtcgactccgccagtttctcgaaactcgcctgccacaacaacctcgcttctcgtcttcctttcttttgttcctccgctaaactcatttgctttcccgacttatcggccagtctcgagaaacattccaaagacgttaacttcgccgtctacctcgacaggaacttcactaattacgactcccatcgactcgctggactcgactccttcaagaactactctgaaaacgacaacgttgtcattgactcttttcgtcgctacagccgggactccgcgggtcacatggaccaattctccattacgccagtgcatcaaatgtcgtcg

SEQ ID NO: 12733 - DNA, 572 bp, Gossypium hirsutum
  Clone ID: uC-gsflmaxxa029d03b1
actatagggaaagatggtatcggacgcctgtagggacccgtacttaattgctggacccacgcatgcgtccttccattttttctgagaacggtccgcatggagaaaagaagagggaaggaggagaagaagcctaccattgttgtcgtccaaggtcctaagcctgagaaacctactgactgttccaggatgagacagattctagtgaaactaaagcacaacacaccttttcacctgaagcacatgtccgtcaccaactccagcatcttgtttttgcataagaacttgatgcaagagctgaaaagccttggacagttcctagtaatcaatgagatttttgagaaaatcactacctagaacaagatctactggatttgatttctaaataaaagttttactggttattataacaagtacaaggaataccgggacacaacttttaatggtgcagttgaactaaattactcttgatatggcatcttagtcacagggtgaggtttccatggattcaaattatatagacaggtactatcccaaataaacttttgaggagggaaagtaactaagaattttac

SEQ ID NO: 12734 - DNA, 272 bp, Gossypium hirsutum
  Clone ID: uC-gsflmaxxa029d04b1
tcgctaaagctaagatttaattcccaaataagaagaaaccaaaactgagggtgaaagataataaagaaagaatggcgttgaaattgaatcactttccacaaaaactcctatgttttggtcttccggcaatggctactttctcatcttccaagtttttcatggccttcactctcctctttgccttcaaaggaaggtgaaaatctgaaaaagacatatatgcctcggcgacatatgcatgttcaattcacacattccatgcccccgccaaagat

SEQ ID NO: 12735 - DNA, 420 bp, Gossypium hirsutum
  Clone ID: uC-gsflmaxxa029d06b1
cccacgcttccttccacgcgtccggagaaaggatggttttctcaacggtgttaacatcagttccaaatctttaccttaccaggaaacccaaggatattcacatcccaattcgatgccaatcgtcaccttctgtatcaatttcaagtcaatcaaattttgcccaattcgatttaaaggcttactgggctaccctttatgcaaaaatcactcaaaagcttgaaaaagcaatcccagtgaaatacccagatcagatcttatgaagctttgaggtactttgttcttgcaaagggtgcttagcgagccccttctgttatgtggggggctgccctatgaaatctttggggattatcgactcgctggttttcctactgcttgtgctcttgaaaagggtcatgctgcttcattaattcatgatgacct

SEQ ID NO: 12736 - DNA, 528 bp, Gossypium hirsutum
  Clone ID: uC-gsflmaxxa029d10b1
tgcaattttcacaccaaggggtcggtacagtgtcgaacttgatctttcattcttgagactccaagggcaggcaaatgatttcaaaattcagtatagcagtgttgttcgcctgtttttgcttccaaagtccaaccaacctcacacttttgttgttgtcacgcttgatccacctatccgcaaagggcaaactttgtacccccatattgtcatgcagtttgaaactgattatgtcgttcaaagcaccttgtccataaatgaggatcttttgaatacaaagtacaaggacaggttggaaccttcttacaagggactcatccatgaagtgtttaccacagtaatgcgtggtttatctggtgcaaaagtttacaaagccagggataattccgtaactggcaagatggttatgcggtcaagtctttcctgaaagctgaagatggtgtcctgtttccacttgaaaagaactttttttttttacccaaccacctacacttatctttatgaggatattgactatttcgaatttgaaaa

SEQ ID NO: 12737 - DNA, 481 bp, Gossypium hirsutum
  Clone ID: uC-gsflmaxxa029e04b1
ggcaaggcttattcagttctctgtaatgaacaagctcaagagaagagctttcaaggcaatagttgggcgtttctctgtggaggaagttgcaggcataaaagagggattccaattgatggatactgccaatagaggcatgattaacattgatgagttaagggttgggttgcataagcttggtcatacgattcgtgatgcaaaccttcaaatactaatggaagccggcgatgtagataaagatggatatctggactatggagaagttgttgtcattacgttcacttgagagagatgggcaatgacgagcaccttaaaaaggcctgtaaattaatcgatcgaaaacaggaggatatattgagattgaggaactaatagatgccttattccgaccaagttgaaaagacattgaaggagtcaacagtgccatcatgcatgatggggacacagacaaggatgggagaataggttatgaccagtttgc

SEQ ID NO: 12738 - DNA, 383 bp, Gossypium hirsutum
  Clone ID: uC-gsflmaxxa029e06b1
ctttttacatattttaaatgctaatgtgatctaccgtgatttaaaggcttccaacattcttctcgattcggactacaatgcaaagctttcagatttcggcttggcaagagatggtccaactggcgataacactcatgtctcaaccagagttgtaggcactcaaggatatgcagcccctgaatatgtagcatcaggtcgtttgaccccaaagagtgacgtggtctgcttggtagttgtactattaaaattactttcatgtcaatcagttaatttttgaatgacccatgcggataaggtcctattagaaaaaacttagttggtttttgtgtttttcggtaagtgttccttttggctgtataactggtgttgatccatttcctatg

SEQ ID NO: 12739 - DNA, 514 bp, Gossypium hirsutum
  Clone ID: uC-gsflmaxxa029e10b1
attttctttttccttccttcgccgtctattgcttttagttgcctcgatttcaagtgaatcagaatgggtaaggaaaagactcacattaacattgtggtcatcggccacgtcgattctgggaaatcaaccaccactggccacctgatttacaagcttggtggtattgacaagcgtgtgattgaaaggtttgagaaagaagctgctgagatgaacaagaggtcattcaagtatgcttgggtgcttgacaagcttaaggctgagcgtgagcgtggtatcaccattgatattgccttgtggaaatttgagaccaccaaatactactgcactgtgattgatgcacctggacaccgtgactttatcaagaatatgattactggtacgtcacaggctgactgtgctgttttgattattgattccaccactggtggttttgaggctggtatctcaaaggatgggcagactcgtgagcacgctttgcttgcttttacccttggtgtcaggcaaatgatttgct

SEQ ID NO: 12740 - DNA, 216 bp, Gossypium hirsutum
  Clone ID: uC-gsflmaxxa029e11b1
acgaccacgtttttcgatcatcgacttccaagttacaaatacgggggcaagaaaacaagtaccggcgggagcggacaaagttttgcaccttaaaattcaatctctgtaattctcagaaaagaaaaaagaaaaatggctgggaaattaactacaggaggtggcaaagaactttccccggtgatatgaacaggaagtcccgaaaatacggacacacta

SEQ ID NO: 12741 - DNA, 211 bp, Gossypium hirsutum
  Clone ID: uC-gsflmaxxa029e12b1
tctgacccactgcgtcacgacttatgtttcgtttttaacaaaaaaaaaatccgtttcattgggaaaaagtgagcttttgggactctgtttttcatcgccaaatccattattgaaaccgtagcttgcgatcttccattgatttttcgaaagcgttttcgtgctttacagattctttcattgccatagtctcctgcatctaaccagatttgag

SEQ ID NO: 12742 - DNA, 316 bp, Gossypium hirsutum
  Clone ID: uC-gsflmaxxa029f05b1
gctcaccaacaacaacaagcttgctgggggccattagaaataaactgcgggtgaagcacaggtcttcacatgccgatgtgagaaacttgcaatgcttgtggcacctgatcacttcaagcttgacagttatatgagcacaggcgtggatcttatgcaaaaggcccacttgtgactttatgaacatggtcagacctagctcaccagagaactcgcacccgattcacagactaacagtctgtctactgtcacaattctatcatattgtaagaatatgaatttagggcatatatattttttttaaaggaaattgactttg

SEQ ID NO: 12743 - DNA, 328 bp, Gossypium hirsutum
  Clone ID: uC-gsflmaxxa029f06b1
cccacgcgtccgcattttttttttatttcctttgccgcccctagggtttaattgcattccttacatggcttatgggggtgtccaataccagtgctttgtcggaggtcttgcatggaccatcaacgaccgtgctctcgaagaagccttcagtgcttacagcgagatcgtctattttaatgtccgtttgtcgcagtgaacgatctccaaatctgactcgaattcaacctcacctgggcctccatgtctatgactcttcaattctttgatcccgttttttcagtgcctactacctcaaaaactctctttgttactaattctaaaactgttt

SEQ ID NO: 12744 - DNA, 386 bp, Gossypium hirsutum
  Clone ID: uC-gsflmaxxa029f07b1
aatttaattagagagatggaaagaaagagagataaaggggtggtttttatttgtaaatggcgtggtttatacttttgaagaatgtacgagctctgatatctgctgcaatttatacaggttgatgggaaggagattagaggccaaacagtgagttgtttgtgttttggcaggaggaaagaggaagagtgacagtgactagagatagaaagtggtcagagagagagagagataacaattgttcgcctgatgcattattcaagaagattggtgttgaaattgacactgatatatgctcgttttggtggttgtgattagagtctcagggaatttgggggttttactaaaaccaagattggggattgagtttaatttccagttagggttta

SEQ ID NO: 12745 - DNA, 463 bp, Gossypium hirsutum
  Clone ID: uC-gsflmaxxa029f08b1
gggctgctttcacggcggcccaagccaaaaccttctaggaaggctgactttgacttgaaagaaacagaatagacccatgttaaaagacccagtgtcgggatttgtagtcagatagagaaattggcttcttgtaattggtatagggaagcgctagaattgtttgatattttggaacttgaaggtggttttgatgtgggtttaagcacgtatgacgcattagtgagcgcttgaattgggttgggatctgtaccagcagttaatagagtctttagttacatgataagtaatgggtttgagccggatcatatatgagtaacagggtgctgattatgcatgtgaaatgtcgaatgattggttatgcacgtacgtttattttgatgaaatgcccgaaggaaatatggttcatggaataccatctaagctggactggtcgatgttgggaatacttttaggcctttaggtt

SEQ ID NO: 12746 - DNA, 385 bp, Gossypium hirsutum
  Clone ID: uC-gsflmaxxa029f10b1
caagaactagccaagttttggaagcagcatccagctttagtggaggcagaattgttgatccaagcccagttgactcgtgagtctaaagctctgacaccagctttgttgcgtgattttagacgtatgctagagctttcaccccgccttcttgaggaactagtgaagatggcattgctaccacgtactgctcaagggcatggatggttgagacctgctattggcgtggttgagctttctcagaatatcattcaggctgttccgctaagtgctagaaaggttgctgggggatctagtgaaagtgttgcaccctttctacagttgccgcattttagcgaggccatagtttaaaagatagcacggaagaaagtgcgaacgtttcaagagc

SEQ ID NO: 12747 - DNA, 482 bp, Gossypium hirsutum
  Clone ID: uC-gsflmaxxa029f11b1
catcaactattttctgctcaccaacaacaacaagctctgcggggtccacttggcatgagctccggtggaagcacaggtcttcacatgctgcaaagtgaagctagcactacaggtggcaacggagcacttggagctggagttttccctggtttcaggcatggctcttctggagaaggcaagcaagacattggaagtgcagggtcagccgaagctcgtggagttctcggctgcgattgacggcctaatggtctgtctactatcctgatttagcatagttaagaagatgaatttaggggatatatatttttttaaaggaaattgtttctgatgcaaggaacaatgttaggacataaactttagaccttttggtctgtgttttctagtacgagacagagcatcttatggtaaacttaacatgtaattttgtagggtctcatgattctactttccaaatctgtgtttttacttttaaaaaactaaac

SEQ ID NO: 12748 - DNA, 377 bp, Gossypium hirsutum
  Clone ID: uC-gsflmaxxa029g01b1
cggacgcttgggttgctttcttccttcaatctggttcttttagcctcggagttactgctaggatggctgccgcttcagggactcgtccgaccagataggctcctctactactcttcagcgcttcacttgctaatatatgcgcaagataatcaagaatctattgtcaacaaggaggaaaatttaatggatgaatcaccatttcttaaactgaagcggtggcaatggtggcttttggtggcaatcaacatattcttcctcattgctggccaagctgcagcagttcttctggggagattttattatgataaaggtggaaacagtaaatggatggccactcttgtgcaaactgctggcttcccagtcctttgtatcccttg

SEQ ID NO: 12749 - DNA, 260 bp, Gossypium hirsutum
  Clone ID: uC-gsflmaxxa029g02b1
ctccattttacatttagatggatctgaagcatattgagatgggaaatggaattttctaagaaggaagtggcgcttatgccagagttgctgactttaccaggagctgattagaacttgggtaaggcagaagatcgccatggctgtttgagaagagaatagtgcatgttaccgattttcattttaacaatgctggcactgcctttggtgccggatacaatactggacttgagcctagcattattcaagaaaacaaatgttat

SEQ ID NO: 12750 - DNA, 373 bp, Gossypium hirsutum
  Clone ID: uC-gsflmaxxa029g03b1
cccacgctttcggtttggctctcgcaagatggtccagagcttgaaggagattgttaactgccctgaacctgagatctatgctatgcttaaagactgtaatgtggaccctaacaaggctgtcgatcgcactcctctctcaagatccttttcacgaggtgaagagcaaacgagacatgaaaaaagagagcagggactaaacagaagcgtggttttgtggtgccaataaccatgggagtcatggtggtgggagtggatcaaaccgatatgctgggcgtggaggttcattccattacagttcaaatgagtctggcccttcacatggttagcaagagaatcccaatgaatggggatgccattctgcttcactggactc

SEQ ID NO: 12751 - DNA, 264 bp, Gossypium hirsutum
  Clone ID: uC-gsflmaxxa029g08b1
ctcactcttaccatgtcgcttccgttttccaactgcggctgggtcctacttaaaacaagacgtggttcctatgccactcctcttaacctaaacactaactgaacctttcttatccatggccactatgcccactgccctatctaaaccgctatccggtcaacctccatctttaaatcctgtaaacaactaatctacggacactgtttcatgctttgacagttcacatccgagcttatgaatgccagctttactatttccccaaac

SEQ ID NO: 12752 - DNA, 387 bp, Gossypium hirsutum
  Clone ID: uC-gsflmaxxa029g11b1
cggacgcttgggcggacgcgtgggcggacgcgtgggaaactgtatggcagtcacaaacgaacacttcgcgactgctcttggaacaagcaatccatcagctctgcgtgaaactgttgttgaagtgcccaatgtcagttgggaagatattggaggccttgagaatgttaagagagagcttcaagagacggttcaatatccagtggagcatcccgagaagtttgagaagtttgggatgtcaccgtcgaagggagtgctattctacggccctcctggatgtgggaaaacccttctggccaaagctatcgcaaacgaatgtcaggcaaattttattagcgtcaagggtccggaattgctcacaatgaggatcggagaaagtgaggccaatgt

SEQ ID NO: 12753 - DNA, 187 bp, Gossypium hirsutum
  Clone ID: uC-gsflmaxxa029h03b1
cccacccgtgcgacctcctttaccgatctcttaaccctgattactacctggacgatgatctcaaaacctttttaggccttaacatcaaatccaaaacaagggactggtatttcttcttccactacatccaaacccgtacaaatcttaaggcctgaataaggctaatttgtgtcgatatatcttctac

SEQ ID NO: 12754 - DNA, 540 bp, Gossypium hirsutum
  Clone ID: uC-gsflmaxxa029h04b1
atcgatgtttatctacaaatcgttggtgatggctcacggtcaggtggtgcctaaggaaccaggggggctttgctctgccatcatctgtcaacgctgaaaatcagattaagtaaagggattattttgaagtatgtcagattattttttgccacaaaactgaggtgaaaatagcagttattagttcatgaaaattacagaaagcacagttcctaaagaaaagcagataaaatatgaaaatccttccttttttttttttttctaatctctccaaaaatgctgctattaagtaaggcatgtaaacttgttcaatttaacaaaaagacttttaaaacccgcataaatggttaatgtgggacccaaaagaaactttttttaaatttaattagttttctccaaaagcttgttacttaataaaaaacttaaggatgctgctaaataatctcattagtttaaaggaaaattcaccttaattttttcgggggggccccttttaagaaacaaattttctaatccgggtttaggaaagaatttttttttttt

SEQ ID NO: 12755 - DNA, 455 bp, Gossypium hirsutum
  Clone ID: uC-gsflmaxxa029h07b1
cccacgcgtccgcccacgcgtccggtcattcttcaggacttcgggtggtatgacttcattctaaaactgcacaagctctacaacggcacacatttgtcactgaataatgtgacctcaagaaatgtatatacgattgaagtagatgagatttcagggggtggaaacattttcattcagtctgatggggaacatctaggatttcttcctaggaagttgtctattctacctggtgctatcgagatgatatgctaacgtgaaccctggaagaaattgatcctatacaaccggcgtatcagcttactccgaaactatgcatctccatggatagagtccagtaagacaagcaattgacgtcatcaaacttagaagtaggaagatatgggacagaagaaagatagtgatggagatgagtcattagtgttaccccttatttaatattttagttacttgtgctt

SEQ ID NO: 12756 - DNA, 517 bp, Gossypium hirsutum
  Clone ID: uC-gsflmaxxa029h09b1
attttatttttcaatccaattctttatctacagtagaggacgggttactttcaaaccccattttgttcctagagtgatttcttgtatttggacgtcccatcatccatttgattttggttaccctttgtctttttgggtctttttcttccttcaaaatctttctattatcgactctgactatcacaaattaaaggaaaacagaagcaaatctttaccttgaaatgattcacatggccgaatactgtgaaacaaccatcatcacattggatgaaccctaaacaccttccaccgtagtactattactgtttacctgatcaaacccaagccatggctacaaagagaattgaatttgttaatgaaagatttatatagcttacaatttatattagttaggcagagccctccctttcgccttgggtttactcttcggcacttgaaatccagaccaaaacaaagtccaagtttaaaaaagaaaattccacagagataacccaaacacccacccttgtttcatttt

SEQ ID NO: 12757 - DNA, 482 bp, Gossypium hirsutum
  Clone ID: uC-gsflmaxxa039b02b1
attaatagaaaaacaatcacacattgaaaaaaccctaatcttaaccctagattttctgcaattaattcccaatggctagcgacaccacagattctcatcgaaggaagcaccatcgttctccatccgacgaagaggaaaccgataagtcctccaaacgccacaagcatcgccaccacaaacatcgtcaccaccgccaccgcagcaaaaagcacgaggacgaagccagagatggtggtgaagatccgcttcctcctccttcgattcctcgacctgatgatgacgtcgaggaaggagagattcttgatgaggaaccgaccgccgaaatcaaggctgatcaatctcgcgatggccgggatgtttcggatccgggagctggcgaaaatagtaattctgtggatgagcaagtaagagggattggtgacaagagtgaagataggaagcataatcatgctaggctctctggaaattaagtgttgagtctc

SEQ ID NO: 12758 - DNA, 444 bp, Gossypium hirsutum
  Clone ID: uC-gsflmaxxa039b11b1
tttttcttttctcctccataggctatataacttcagcttctctgttatttttttttcattttcagagaagctcagtgtttttttgcttaaacaaggctaatcagagatggctgatgaggatattcaacctcttgtttgtgacaatggaactggaatggtcaaggctggttttgctggtgatgatgccccaagggcagtgtttcctagtatcgtcggtcgaccacgccatacaggcgtgatggtgggaatgggtcaaaaggatgcctatgtaggagatgaagctcaatcaaagagaggtatccttaccttgaagtaccctatcgaacatggcattgtcagcaattgggatgacatggaaaagatttggcaccatactttctacaacgagcttcgtgtcgcccctgaagaacatccggtacttcttacagaagcaccgcttaaccc

SEQ ID NO: 12759 - DNA, 262 bp, Gossypium hirsutum
  Clone ID: uC-gsflmaxxa039c08b1
cccacgcgtccgcccacgcgtccggcaaatggcaaaaggaagcaaaggacgacgtagaactgctttcaggcaattccggccaaccccatactcattgtcctcacggcgccaagggatctctggggacttgtaccacaaaaactgttccaaacctttggataagaaagactgggaagatgtcacatgttctgtttgcatggtgtgccttaacattgctgttcctttctcatggctagctcatgtctagccctttcttactcta

SEQ ID NO: 12760 - DNA, 91 bp, Gossypium hirsutum
  Clone ID: uC-gsflmaxxa039h03b1
cttttcttccggtcccctgttgagaaccataacggagggcccccatggtccttgagcaattctttttgattttgtagattcctggtgggac

SEQ ID NO: 12761 - DNA, 547 bp, Gossypium hirsutum
  unsure (1)..(547): unsure at all n locations
  Clone ID: uC-gsflmaxxa040b06b1
ttttactcgtgggcggacgcgtgggcggacgcgtgggcatagcatagcagcttagtccaactccacacccaccaccattggctgtttgtaatcatccgaaaaagaatggtgaccgtggaagaagttcgtaaggctcaacgtgcccaaggccctgccaccgtgttggccatcggcacatcaaccccgcctaattgtgttgatcagagcacataccctgactactatttccgtatcacaaatagtgagcacaaaaccgagttgaaagagaagttcaagcgcatgtgtgaaaaatcgatgatcaagaagcgatacatgtaccttacagaagagattttgaaagagaatcccaatgtatgtgaatacatggctccttcactggacgctaggcaagatatggtggtagttgaggtgccaaagctaggcaaagaagcagccaccaaggccattaaggagtggggccagcccaagtccaagatcacccaccttgtcttttgcaccactagcggtgtggacatgcctggngctgactaccagctcaccaagcttt

SEQ ID NO: 12762 - DNA, 352 bp, Gossypium hirsutum
  Clone ID: uC-gsflmaxxa040c03b1
tttgtatgttcctttgttccccttcttttttcataaaaattaacgccggagaattatgctctgccggagaattttactaataaaagtctggaacaacggtcgccgatggcttcttccttcttcatctctgtcgccgggttcaacgacggcggactactaacgtaagttttgcactcacagtatggcggcgaggccgttgaccctcaagaacccctataatctacaaggtgttcaggtggtttatcattatcagatcctgggtagtgctgtttctgtgcccttacttttttcgaatttctgatattccttatttgttacttgatttaatctcttcttgttcatacattctttc

SEQ ID NO: 12763 - DNA, 445 bp, Gossypium hirsutum
  Clone ID: uC-gsflmaxxa040c12b1
tcttctcacgcgtccgcggacgcgtgggagaaaaaaaaaggaaaagaaaatcaaagttatttttctttcaattgagcccttcatttttctctcattttctttcttcccaaacaacaaattttaaagaaaatgccaacagatacaagcaaacccatgaaattagaacgatacaatagctatattcgtaaagtccatagtacgaagttgttgaatgcttcatctaaatttctatttcgtgttacccttcttattgctttagttttgatcttgtttttcaccattaattaccctccactttcggataatacccacagtgcacctcaccatcatcaccgtcatagctttctttcaacttcacttttctccggttcttccctcgttggtggtgcggcgtgggagaaacaagttcgtcactttttgactccacctatggttaatgggtttt

SEQ ID NO: 12764 - DNA, 481 bp, Gossypium hirsutum
  Clone ID: uC-gsflmaxxa041f01b1
ttatgaagaagaaaagaaaaaaaaaatgaagtctcagatctgtttagcctttggaactttggccttgttattagcttcagctttggccgatgacgtcgtcgtactgaccgaagcgaacttcgataaggaagttggtcaagatagaggagttctcatcgagttctatgctccttggtgtggacactgtaagaagctagctcctgagtacgagaagctcggggcaacttttaagaaggctaaatccgtcttgattggaaaggtggattgtgatgaacataagagtttatgcagcaaatatggtgttcaaggctacccaactgttcagtggtttcctaaaggctctttggaacctaaaaagtatgaaggaccacgcacagctgaagcacttgctgaatttgttaacactgaaggagggactaatgtgaagatagccactttgccattcaatgttgcagtgctaaatgcggataattttgatgag

SEQ ID NO: 12765 - DNA, 542 bp, Gossypium hirsutum
  Clone ID: uC-gsflmaxxa041f10b1
ttcacgcgtccgaaaagaggttatagaatctttgttacttaaacggtgccctcatctttcagaaatccaaagtattgtacttactgaaatagaaagcactggttacttagtattggcaagtgtggatgcttatggtcatcttattgtctctaaactggatgccagtggtaaagatgctgacaagattacttattcagtgttacctcgggattttggtgttggagaaggtagttggtctgggatgtgcttcagtccaactcaatggtccatggcagctgtggcacgaagcttctgcaaaagtgttgatgtttatgaccaggatatccatcttcggactttgcgtacactttggtatccatcttcgctaagcttcatgcggaatttaggtcatgggaatgagagttctatattagccgtaactgaaggctgccagttgtctgtatgggacttgagaataaaagaaaatggtggctgtctaaatcgtatttgtggttctgctggagatatcttttatgctgtctgcagtcttcaactggtaatat

SEQ ID NO: 12766 - DNA, 498 bp, Gossypium hirsutum
  Clone ID: uC-gsflmaxxa042c03b1
gtcttgacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatccccccagaccagcaacgtctcatctttgccggaaaacaactcgaagacggccgtaccttggccgactacaacatccagaaggagtcaactctccaccttgtccttcgtttgcgcggcgggatgcaaatcttcgttaagacgcttaccggaaagacgatcactctcgaggtcgagagctctgacacgatc

SEQ ID NO: 12767 - DNA, 481 bp, Gossypium hirsutum
  unsure (1)..(481): unsure at all n locations
  Clone ID: uC-gsflmaxxa042e06b1
ttttctcgtccgcccacgcgtccgctttaccttccaccatttcttttcccattaccccttgtctttctcttctcattttagtccctaaccagacacatccaaagccacgttggaagaaccaatgtcaacagtaccatattccctatggtcttccattntaagctggtttaccccaactgtgttctttgtcttccttaaccttacaataggtaccatctatttcacttccactttgagttccagcaagcctagtagtgacgcacataggcagtaccacccagatgatgaaacatacccaagtttgttagatctccatctatgttgcagaggctgaaatctatcaacttgtctgcttacagatctcaagaacctgttgttgctagtgctaccactgcctatgacagtgtctctgatgtgggtgatttccatttctcttttcaacaacaaacccctcaacacagcgccagccttncttgagaga

SEQ ID NO: 12768 - DNA, 443 bp, Gossypium hirsutum
  Clone ID: uC-gsflmaxxa042f07b1
ttcttttgaaagagggcaggcaaattataagaggaggatgaaattaacctcctcttttctttttcttattgtgcctcctctcagatcttagctttttttttttggccagatttggcacttgggttttcttttgattattgggtcattgctgaatctggatttttcccagaaaaattttaaagctgtatcgattgatcatctatctgggtagcttattattattattttttggctttttgggattcttttcgtttacatttctgaattccaggtgaagctaaattctgggttttgttcggttgattgatcgtggaaagatctgttcgtttccaaattttgaatcagagagaaaaaaatcatttttgtataaaataaaggaaaaaaaagatgtttgagaatggaaagctatttattggcgggatatcttgggacaccaatgaagg

SEQ ID NO: 12769 - DNA, 489 bp, Gossypium hirsutum
  unsure (1)..(489): unsure at all n locations
  Clone ID: uC-gsflmaxxa042h01b1
tgtattttgctttgcctaatttgtaagctttgaggttgactgaaaaaactatggcggaagagggacaagtaatcgcctgccacactgttgattcatggaaccagcagctcgagatgggaaaccagtccaagaaactggtggtggtggatttcacagcatcatggtgcgggccatgccgttttatatcaccaatcctggtggatcttgctaagaagctgcccaacgtcatattcttgaaggtggacgtggatgaactgaatactgtggctcaggagtgggctattgaggcgatgccaacttttgtgtttctgaaagaaggcaccataattgacatggttgtgggtgcaaggaaagaagactngcagcagaaaattgcctttcattcatctaaaccggtgcagacagcatgaatcaacatttaaatgtacttgatgtctggagttgtttatgaaactaggatcttatgaatgtctgacagacagaccctaa

SEQ ID NO: 12770 - DNA, 430 bp, Gossypium hirsutum
  Clone ID: uC-gsflmaxxa043c10b1
tccacgcgtccgctcattatgggggtttaaatgctgcattcctggaggaaaagaaatcagtgtgggtgatgaatgtggtgcctgttacgtcacgtaatatgctacctcttattcttgaccgaggtttttccggtgttttgcatgactggtgtgaacccttcccaacatatcctcgaacatatgacatgcttcatgcaaatgggctcctctcgcacctctcttcagagaggtgcagtttgatggacttgtttgtagagatggaccgaatcctgcgtcctgagggttgggttgtgctttatgataaattaggagctatagagttggcacgtgcgcatgctacacagatacgatggggtgcaagaatgatcgacattcaaatggtagtgatcagaggctactgatttgtcagaaaccatttttgacaaaatga

SEQ ID NO: 12771 - DNA, 460 bp, Gossypium hirsutum
  unsure (1)..(460): unsure at all n locations
  Clone ID: uC-gsflmaxxa043f10b1
tttgagatgaggaaaatcatgggtgccaaaggtctcttcttctttgctttgctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgcgataatccttgttctgtctgctagagaaggcatcgnttcgttgggaggcccttacattcctctcaaaactg

SEQ ID NO: 12772 - DNA, 340 bp, Gossypium hirsutum
  Clone ID: uC-gsflmaxxa043h04b1
gttaggcctacgggaaacacaggcatgattggggggacttttaagtgcggtggcgtttcgtatcaatgctcatgccagaaaagaaccgcgaggagatatgaaagtatctgtttcaaagagggcgtttgatacgccaaaatagattacagcttggcgaaacacccagaactcgatgttccaaatctttaagcattaaagctgatgcatagctttaaaaccaaggagtacgttcgtgaaactactgcttggatgcattataactgggaccttaccaacgatggtattgaacttctaaggaccgaccttaatctaccctctgagatttgtactgctcctttga

SEQ ID NO: 12773 - DNA, 266 bp, Gossypium hirsutum
  Clone ID: uC-gsflmaxxa045b07b1
ttgtttgatccaaactcccacagcagacaatgggtcttctaggcgacgacggacgcggcatacgacctacctgggcatgctagaagcatgctgagtctggagagaatggctcggagagtccacctacgcctgtaacgcccattttctgacaacttcatagggttgggaatccttcatgcgagctgacgactctaagtatagggctgaaatccatctccagctcagatgtcacgccctctagattgacaaagccaccgtatgatgtc

SEQ ID NO: 12774 - DNA, 244 bp, Gossypium hirsutum
  Clone ID: uC-gsflmaxxa045d01b1
gtctttcacgcgtccgccacgcgtccgaaaaataggttaactgtgccctattctgacggccagatgtgacatgaaaggcgagcacctgaaagtgctaatgagcattcggccaactatggggaatggcctctttacaatggatgatcactggcatttcagggctcatacggttgcaaatatcatgatatataatttgtcttaaaactctaactaaattgtctaagctgtatttttggtgaagggt

SEQ ID NO: 12775 - DNA, 338 bp, Gossypium hirsutum
  Clone ID: uC-gsflmaxxa045g01b1
gctggtgcgcctgctggtgccgccgcggcggaactgccgggaccgacgccgcctgtttcttgacgtgcattggcgagtctgagaggtagcatgtttgaggcttactggacatgctggctcattgcgctgcaagcgttggggatatcgcctgagcacgtattagagagtggctatcgacagcatacagggaagactcccctggtttagtgactaattggccaagcgcaggcctaatacgtgagacctgacgctagggtaccgcttgcttgaacttgcggggggaaatgcatactggcggtgttgtcatgacgcaatgccggtgacctgccaggatactg

SEQ ID NO: 12776 - DNA, 522 bp, Gossypium hirsutum
  Clone ID: uC-gsflmaxxa045h07b1
tgctagcccccgctggtgccgccgcgccggaaccggcgggacccacgcgtcctccgttcaccctgccggagtcagcgcaagcgctaagattactactactactcctgccaaggagtactatgcttctagcaacgcggagcagactgctacctggcttgcaatagccatggaggctcacagagccgctccagcaccccataagagcaccattgataggctcaaaaccacgctcaaagaaactttctttcctgatgatgctgtgcaccaatccaaaggacaacctaccgggaagaaatggattcttgcagctcaatacatcttccctattctacaatggggtcctcattatagaccagggctcttcaaatatgatattgcagccggacttaccattgctagcttagccatcccccagggaatcagttatgctaagcttgataatctaccgacacttgttggactctatagcagcttgtgcctcgtcttgttatagctgactggcaagctccagggaccttgcag

SEQ ID NO: 12777 - DNA, 524 bp, Gossypium hirsutum
  Clone ID: uC-gsflmaxxa046a02b1
cccatttgttcgcccacgcgtccgctttcgccaaacaaacgcaagatttgtagattcatttctattgtatctccgtctccgaatcaatggctttgccgaaccagcacacagttgattatccgagcttcaagctcgttatcgtcggcgatggtggaactggcaaaactaccttcgtgaagaggcatctaactggagagtttgaaaagaaatacgagccaaccattggtgtggaggttcatcccttggacttcttcactaactgtggcaaaatccgtttctactgctgggatactgctggacaggagaagttcggcggtctcagagatggttactatatccatgggcaatgtgccataatcatgtttgatgatactgcccggatgacatacaagaatgttcctacatggcatcgggatctatgcagagtgcgtgagaatatagctattgttttatgtggaaacacggttgatgcacagaacaggcaggttaaggcaaagcaggtcacattccacaggaagaagaat

SEQ ID NO: 12778 - DNA, 476 bp, Gossypium hirsutum
  Clone ID: uC-gsflmaxxa046a03b1
gattgttccacgcccaccctcatacaataagtccatctcaaatactttgggctttaattgtaagaaccagaaactgtaaggcggatattgtaacagtgtttacaaacaacaaggtttcatttcatatcttaatattacccaaaacaagacaattccatccttaacctaaaaaccctcgtaaactcgtgaacaaaacagcccatttttgcagacagaaacaaagccgagaaagtaaagcaaaataaatggaggatttgaagaagagaaagatggaagagatgggaaacaacgaccagttatcaactcaagaagagctacgttctttgcttgaccctcttgctaaatcccagctcgtcgatcttctttctagactagggtcccaatatccttcgattgctgaagaaattaaaagtattgccagttcagatcctgtacatcgaaagctttttgttcgtggcttagcctggaataccact

SEQ ID NO: 12779 - DNA, 475 bp, Gossypium hirsutum
  unsure (1)..(475): unsure at all n locations
  Clone ID: uC-gsflmaxxa046a05b1
tttataatgaaaaaaagagagatggcgtctgtaataaaatctgcaatcttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggttttggttttgaaggtggtcctgataaatgttgatcttctggatgttccggtaattgcaatcctggtggtttcgttctaccatttcctcaaattccagaaatcccaagaattccagaaatcccacaaatcccacagagcccacaaattccacagattccactaatcccacagatcccacangtcccacagatcccacaagttccaaaaatcccactaatgtcaggacagt

SEQ ID NO: 12780 - DNA, 444 bp, Gossypium hirsutum
  Clone ID: uC-gsflmaxxa046b01b1
aatttataataaggtttggccctggcttcctgatgtgcagaggatagattggttccattgcggtggagtgcatttctgggatttcgggatgacataaatttgtatatactcttaaaattttctcatgagtttcaattatttgttcttctttacattttttattagaaaggttctgctcatggtctaaaaaaaaaaaaaaaaaaaaaaaaaggaaaataataaaaaaataattaaacaatataaaatcaatataactaatagcaacaccctgttgtctaccaaatgtattgctaagtacaggcgacctacttaatattcaagttcttagtctagttccggctgacttaaaaaattgtgtatttgaatactattaataattatctacctcttttgtttttaaattttactatttttataagtgtagcttttataaactgatttttt

SEQ ID NO: 12781 - DNA, 428 bp, Gossypium hirsutum
  unsure (1)..(428): unsure at all n locations
  Clone ID: uC-gsflmaxxa046b07b1
cccacgcgtccgatatttcttggaagaaaatgggagtggagaagaggatcatggtgttgtggatttgtgcaatggtgataagctcaatggtgatggaagagggtgcaaatgcgacaccaattagctacccaggactgggaaaaaatcgtcaagttccatgcaaaattggaggtggtcattgcctcccaccaccatccaacgattatgacagaagatgttcacccctaaaaagatgtcgaagtcatcatataatgcccatccttcattgaccacaactagaaaatgcacttcattaactactcttttttttctatcaaattatacaaaaaaaagagcaattaatcatttcatatgtttattcattccttattatntgaacccacgaattccagaaatatatacttcaacaattttttaaaaaaaaaaga

SEQ ID NO: 12782 - DNA, 460 bp, Gossypium hirsutum
  Clone ID: uC-gsflmaxxa046b12b1
agtaaacaatatttggccaatgtggcattgaaaattaatgtaaaggttgggggaagaaatactgttcttgttgatgcaatatcacgaaggatacctcttgtcagtgaccgtccaactataatttttggcgctgatgttacccatcctcaccctggggaggattcaagcccttctattgcagctgttgttgcctctcaagattggccagaggttacaaagtatgctggcctggtttgtgctcaagctcatcgtcaggagctcatccaagatttattcaagacatggcaggatcccgtaagggggactgtttctggtggcatgattaaggagctcctaatatctttccgacgagccactggacagaagccacagcgcattatattctacaaggatggtgtcagcgaaggccagttctatcaagttctgatatatgaacttgatgctattcgtaaggcatgtg

SEQ ID NO: 12783 - DNA, 525 bp, Gossypium hirsutum
  Clone ID: uC-gsflmaxxa046c09b1
tttttattggtcagtacctatttactgggagtgaaaccacatctgtatggctggaggttagtgaggtacaaggaaatgatgtggtttgtgtgataaagaacactgcaacattaactggtgcgttgttcactttgcatgcttctcaaattcgtattgagttgcctaccctctctgataaagacaaggaggttataagctcttgtggagttaaaaacaaaatcgacttcctctctctatcatacacgcgacatgcagaagatgttcgtcatgctcgtgagttcctttcgaagcagggtgacctctaccagacacaaatttttgccaagattgagaacatagagggtttaaaccattttgatgagatcctacaagaagcagatggtatcatcctttctcgtggaaatttgggcattgatctcccacctgagacggagttcttatttcaaaaggcttgcctctacaagtgtaacgtggctggcaagcctgcagtggtcactcgtgttgtggacagtatgactgacaact

SEQ ID NO: 12784 - DNA, 365 bp, Gossypium hirsutum
  Clone ID: uC-gsflmaxxa046c11b1
atctaggtctctctctctgtctcgacgtttccatccatcatggaagggctaaggcaagagggagtgaaaatggttgagaaagcatgaggcacaacggaagaggcggtgaccagagagtacaccatcaaccgttacaagcgcctccatggttgcacattcaagaagaaggctcccaaggctataacggacattaggaagtttgtataaaaagcaatggggacaaaggatgtgagagttgctgtctagctgaacatacatatctggagccgatggatccgaagagttcctagaaggattagggtccgtattgcccgcaagagaaatgatgatgacgactccaaggaagagctctactctctagtaac

SEQ ID NO: 12785 - DNA, 540 bp, Gossypium hirsutum
  Clone ID: uC-gsflmaxxa046d03b1
gccaattcaaactccattattgaatcccaaatgccgctcctctccgataattccacttcctcggcacggttatcggccgagaacgccgaggctgagcggcgccttcgtgaggcggaggagcgtttaagggaagccatggaagagcttcatagacgtcaaaggaaggccgcttgtggcgattccccgccgtgtgaccatgctgatgactcttgtgtggccaatgccattggcaatctttgtcaaagctttctcctttcttatggtgttagagtaggtatcgggattcttcttcgtggtttcaaactcgctagaggaaagtcttattcttcgctgcttgatctcaagcaacttgtctcagagaaagatttgattgtgagagaggaagcatgccgcattggtttactttttggtggctttactggttcataccatgcgctccgatgtttactgagaaaacggagaaagaaagagacaccattgaatgcaattttagcaggttgcattgcaggattgtcgatttagctctagatgatcccaatc

SEQ ID NO: 12786 - DNA, 501 bp, Gossypium hirsutum
  Clone ID: uC-gsflmaxxa046d08b1
ctaccttctctcaacccaaacacatatttcccaggaaaaagaaaaagcttgagccaaaagaaaatggccgatcagcttaccgacgatcagatctctgaattcaaggaggcctttagcctgttcgacaaggacggagatggttgcattactaccaaggagttgggaactgtgatgcgatcacttgggcagaaccccactgaggcagaactgcaagatatgattaatgaagtcgatgctgatggaaatgggaccattgattttcctgaattccttaacctgatggcaagaaaaatgaaggatacagactctgaggaggagcttaaagaggcattcagggtgtttgacaaggatcagaatgggttcatatctgcagccgagctgcgccatgtcatgacaaaccttggtgaaaagcttacagatgagggagtcgacgagatgatccgcgaagctgatgttgatggtgatgggcaatcaactacgaggagttcgcaaagtcatgat

SEQ ID NO: 12787 - DNA, 463 bp, Gossypium hirsutum
  Clone ID: uC-gsflmaxxa046d12b1
aaaataatgagggatgtgcattttagcagagagaaggcaggaaaaggagtggtgctattttttttctggatgctgagtttgatctcgctatcttgcgcggctaggctaagtgtgtcgagacagaagctccaagtgcaaaaccacttgaaccgtttgaacaaaccggctgttaaaaccatccagagtccggatggggatattatagactgtgttcacctctctcgtcagccagcttttgatcatccttttctcaaagaccacaaaattcagatgaggcctagttaccacccagagggtctttttgacgagaacaaggtctctgacactgagaaacccaaaaagggctcgaaccccattactcagttgtggcacatgaatggtaaatgtcctgatggaaccattcccatcagaagaactaaggaagaagatgttttgagggcaagctcagttaatagatatggta

SEQ ID NO: 12788 - DNA, 460 bp, Gossypium hirsutum
  Clone ID: uC-gsflmaxxa046e03b1
aaactgtcctcaaggtcatatgtttgaaccgggtgcttttaccttaatcaaccgtttcgggacttttgtctataaaggaactgtgtttgctgctgttggactggctgctggacttgtcgggactgcaatctcaaacgggttgatcacgatgaggaaaaaaatggatcccacctttgaaacacccaacaagcctcctcctaccttgttgaatgccatcacctgggccattcacatgggtgttagcagcaattttaggtatcaaaccttgaatgggatcgagtttgtgttggaaaagggacttcccccccttgcatttaagtcatcagtggtggtcctgagatgcttaaataacgtaattggaggaatgtcatttgtaatactagcaaggatgactgggtctcagagtgttgaacagaagccagcaaacatagacaaggagaaggagatgttgatggatggg

SEQ ID NO: 12789 - DNA, 560 bp, Gossypium hirsutum
  unsure (1)..(560): unsure at all n locations
  Clone ID: uC-gsflmaxxa046f01b1
gaaattttcgttattaatcggcggaagcagatagcctgtagccatgactttcaagcgtaggaatggtggccgcaacaagcatggccgtggccatgtcaaattcatccgctgttctaactgtggcaaatgctgccccaaggatgtcaattaagaggtttcttgtgaggaacattgtggaacaagctgctgttagagatgtccaagaagcctgcgtttatgacacttatactttgcctaagctgtatgttaagatgcaatactgtgtctcgtgtgcgatccactcccacgttgtgagagtccgatcccgcaccgataggaggaaacgtgatccacccgcccgcttcatcagacgcaaggatgatatgccaaagcctggtcagcctggtcaagcaccacgtccaggtgttgcagttcctgctcgtgcttaaggcctgtgaaagcttttaagataaattttctatattcttaatttggttttaaatggttgcattaatttaagaacatggagacttgtggaggttttgaangcttcaaagttaaacctttgaaccttttaatgt

SEQ ID NO: 12790 - DNA, 451 bp, Gossypium hirsutum
  Clone ID: uC-gsflmaxxa046f02b1
aaacagttgaaaatatctctctcttcactttcttctcttttcaacgcagggtgaaaggcggggaggccgtagacaatctctcttgcgctcttctcgtagaatggatcagattcaacatccaactgtcatgcagaaggtagctggccagctcctttcttctagcatttcccgagattttcaagggtatgatgaccctatctctgaatatcagaccattcctctgaataagattgaagactttggtgtgcattgtaaacagtattatgcattggacatcacttatttcaaatcctcacttgattgtcacctcctggatctgttatggaataagtactgggtaaacaccctttcttcttcacctctcttgggtaatggagattatgttgcaggacaaatttcagatttagctgaaaagctggagcaagcagagaaccaattggctcactctcgc

SEQ ID NO: 12791 - DNA, 552 bp, Gossypium hirsutum
  Clone ID: uC-gsflmaxxa046f05b1
cccactcgtccgcggacgcgtgggggaaaatccaaaatgagtgaggtgttcgaaggttatgaacgccaatactgcgagctctccgacaatttgacccgcagctgcacctccgccagcgttcttcatggagagctgaagaagcagaaactttctgaaataaaagagggactggatgaagctgatgctttgattcggaaaatggaccttgaagcaaggagtttgcagccaagcataaaggccacacttcttgctaaattaagggaatataaacattatctgaacaacttgaagactgatgttaaaagaattacttcaaccgatacaaatcaggccgcccgagacgagttgttggagtcaggaatcgatggaacaatgacggtctctgctgatcaaaaaggcagattattgatgtcaacagagagattaaaccagtctactgatagaattaaggaaagcagaagaacaatgctgggaactgaagaagctggtgtttcatcctacaggatttgcataacaacgccaattcttcttcatgcgcatacacgctccatg

SEQ ID NO: 12792 - DNA, 447 bp, Gossypium hirsutum
  unsure (1)..(447): unsure at all n locations
  Clone ID: uC-gsflmaxxa046f08b1
cagttttaaaagatacctatcttaatttccttttgattttcaatggcgggtatgctagctggtgttgaatgtgctcgaagaagacggttccatcaaagcggtggttcatctgattcggttcttgggttcacgaggagaccctctttttgtttgtatacaagcaaccatgaatcccttcatagctctgttttttctcaggtaattcggtttcttttttttgttttatttcccagatttttatagtgattttaaactttgggtttatttggggaaattaattgaagcagaggagggtactaattgaagggtatgaagatgatgatgagaagcttggtgaagtagcaagagaagctaaggaaagattagatgaaaggttgagatcacaaagaaaatcagaacccaaaaggtactaaaatgggcaagacctgattggaatattngatagag

SEQ ID NO: 12793 - DNA, 505 bp, Gossypium hirsutum
  Clone ID: uC-gsflmaxxa046f11b1
cggacgcgtgggctttaccctttttataaccaaacagctgtttcagtttcagttccaccacctccattaactcctcctgcaataactccaggaaaaagcaagaagacattgccaataattattgcaattattgctccaattgctgtctctgttcttctcttgttattgggttgttgtttactaaaaaggagagcaaggaggaagtacaaagctgtagaagaagaaaatgcaaaagatgatatatccacaattgagtccttgcaatatgattttagcactatagaagttgccacaaacaacttctcaaatagcaacaagctaggtgaaggtggtttcggagaagtatacaagggtacacttcctaatggacaagaaatagctgttaaaaggctatcaagaagttcagggcagggtattgaagaatttaaaaatgaagctctattagttgccaagcttcaacatagaaatctagtgcgactattgggattttgcttggcaagagaag

SEQ ID NO: 12794 - DNA, 488 bp, Gossypium hirsutum
  unsure (1)..(488): unsure at all n locations
  Clone ID: uC-gsflmaxxa046g02b1
aaggaatttaaagatgtcaacagcttcttcattttgttcatcaactcaagttaatggctttggagggggacttaggcttctaagaacccatcttcctcaacccaagtccttttcttttactaggaggagaactgctacagtagtgaaggcaactgctcgagtcgataaattttcgaaaagcgatatcattgtttccccatctatactctctgctaatttcgctaagttgggggagcaggtgaaagccgtagaagtggcaggctgtgattggatccatgttgatgtaatggatggccgatttgttccaaacattacgattggacctcttgtggttgatgccttacgacctgtgacagatcttccactagatgtgcatttgatgattgtggaaccagagcagcgagttccagattttattaaggctggagcagacatagtcagtgttcactgtgagcaatcatcaaccattcattngcatcgtacactta

SEQ ID NO: 12795 - DNA, 517 bp, Gossypium hirsutum
  Clone ID: uC-gsflmaxxa046g09b1
aaaagggtctccttatcctcccttattaatctcccctaaagggtttttcattttctagtggtcgatgggtgttgaagttgtgggatcagaaatggctaaagtctctgttgacaaagcaactgaagttgagaaatcacttgttcatgataaggaaaatgggaaacttgacaaggatccggttcatagcgagcccattaaattcggttccaatgttgaggaatcaaataagggagaagagaaaaatgcatctgatgccaactttccgagcgatgcagttgttgagtggcctgcgcctaagcagatccactctttttattttgttaggtatcgcccttatgatgatccgaagataaaggccaaaattgatcaggctgataaggaggtgcaaaagtggaataaagccaggtttcagcttactgatgaaattaaagcgtacaagtcggatcgagcagagttgctttctcaagtgaaagccctaaatattgatttgagcaattaagacaatgtaggtgagaaa

SEQ ID NO: 12796 - DNA, 382 bp, Gossypium hirsutum
  Clone ID: uC-gsflmaxxa046g11b1
atgcattgcaaatatcattacatatatatataacaagtcaatacaaaaaacaaaacgtgaacaaatcgaacaagatgttcaactttaatgatcagatgatctatcaccctttcaaacaatatcaaaagtaaaataaaaaaattaaaaaatacaactctaaaaaaaaaaaaaaaaaaaaaaaaaaaaaaaaaaaaaaaaaaaaaaccccaaaaaaaaaaaaaaaaaaaaaaaaaaaaaaaaaaaaaaaaaaaaaaaaaaaaaaaaaaaaatttaaaaaaaaaaatataaaaaaaaaaaaggggggggcctttttaagggacccaatttttcccccccatggttggaactttaaatttttttttttggggccccaaaataaaat

SEQ ID NO: 12797 - DNA, 491 bp, Gossypium hirsutum
  unsure (1)..(491): unsure at all n locations
  Clone ID: uC-gsflmaxxa046h03b1
cccacgtgtccgcccacgcgtccgcccacgcgtccgcccacgcgtccgcccacgcgtccgcccacgcgtccgctcaaaatttgcccccaaattctttttccttttcatttcactgcaatgaattcacccacatagctactccttttctctcgatctgttagggatttagagaaacaaatggaagtcgaagagaaggagaacgaggaagaagaagaagaggaagagaagaggggggaggaggaagaaaaagagagtgaagatgaagggactaaaaaggtcaaaggtagtagtagaaaggggagttctaggaaatctggtcgagattcggctgagaagaaagagccagtgacgcctagcagtgatagacctacaagggagaggaaagtcgtagaaaggtattcagctccttctgttgcaggtcttccctcgttaaaactgtcaattgaaaaggtatgctctcttttctggngtaaggcatgggttcatcgact

SEQ ID NO: 12798 - DNA, 461 bp, Gossypium hirsutum
  Clone ID: uC-gsflmaxxa046h07b1
cgagcgtgttccagaattgtttgatcattgtgaggaagccaggtgagaaccaacacaacatgattacagcacctggaaggcaatatatagccactgactcagcccttgtacttcaaaactgtaccatcacgggtgcccctgattaccttccggtgaaggacaagagtaagacgtaccttggtcgtccctggaaacccttggcgagagccatcataatgcaatctacaatcgaagacatcattacaccagagggttatgcccccatggacggcaccaaaggattggacactgcctactttgctgagtttgaaaacaagggacctggtgccaaaactgaaggtagggtcacatggccagctatcaagaaaattgatacaaatgaagccaagaaatggacccctggcgtctttcttggatctgaccatgggttccacaagccggcattccttattatactgaca

SEQ ID NO: 12799 - DNA, 381 bp, Gossypium hirsutum
  Clone ID: uC-gsflmaxxa046h12b1
attttattcattatcatcaacatctaaaaaacagtttacgacaatgtgccctggaggttacacggatggcactactagcttatctggaaaagctcctcgaaaggatcttcgtgactatgccgggtactggggagcactggtgcatattgagattattagacgtggggcatatgcatgtacagtttgtgtgacattaaaagatgcctatgccatggagactggtggatgactcactgtagctacaagtgctgatcactgcgtatgcatgtcaacttggagcacgtatggaggggatctatatcttagcgatagatgtacgtggaagactgatgaggatactaactcatcgcgtactaagatgcacccatatgtttatagttc

SEQ ID NO: 12800 - DNA, 484 bp, Gossypium hirsutum
  Clone ID: uC-gsflmaxxa047c03b1
gtatgaatagcattctttgcctcaccctctgaattgccattcagagcacggtaggaatgctgagagattaccttttttttttttcatttttaccctcatttttcatcgtcatcctttctgcagtttcaactacagcctctacgttcattaccttctccatttataaagccctaaacaccattgccccttgccaattttttcaatcttttcttcgtaggaatcagatcgtagaaatttctcaattaagggcaaagtcttcagcaaggaaaaaaatccagattcaattgaaaaacacattagcttctggttttgatttcaaagcgattcaagacaaggtttctcttcatttaagaccttggcatcgttcatttcaattctgggttcgagctgttgatatttatacgcgctataagttcccttctttatcttcttcttcttggtggtaatttgatagttttgactgttgggtaattgttgaaatgat

SEQ ID NO: 12801 - DNA, 166 bp, Gossypium hirsutum
  Clone ID: uC-gsflmaxxa047d09b1
gttatatatcgcgagcgccgcccttttttttatttggggggtttttttaaatcttttttggggtttttacccttagcttcctgtgttaggttgctacaggaaccattataattatgacccttacatacaaggacccctatccccccaatgatgcactcaaccctac

SEQ ID NO: 12802 - DNA, 414 bp, Gossypium hirsutum
  Clone ID: uC-gsflmaxxa048a10b1
ttcacgcgtccgcggacgcgtgggcggacgcgtggggtgaaggcgaggatgagcatgatgttgtctggttttggctggagaaaggcaaaccacatgagtgtccagtttgctcacagtattttgtgctggaagttgtgggacctggaggacctccagacggacatggcgatgatgatcatcattaattgcaactttgaatttttttttcctgttggaataaaattgcagaagacgattaaatgatgttccaatatacaatgcaccttcaaatgttcaaaagctgttatctgtcgtttggttctgagatggtattctctgtttctttatggtactttagactgatacacaggtatgggaatttttttggtaaacttaaaatgcatcgccaaataaataaatcttttccattcattc

SEQ ID NO: 12803 - DNA, 150 bp, Gossypium hirsutum
  Clone ID: uC-gsflmaxxa048b07b1
gcctttctttggacgcgtggggtgtatgtgatatatacataggataaaaggtttattggatatggtggaattgcagcagaaagaactaagaaaatggggttccaagaaaggtggaaattgatcttatagcaaatggcatccttagttact

SEQ ID NO: 12804 - DNA, 106 bp, Gossypium hirsutum
  Clone ID: uC-gsflmaxxa048d01b1
tttatttggggcctgctattatatattataaacaaaactcctattatggggacatcctcgggtgcatgagccacacaaatcaactccagctcagaagaagcattaa

SEQ ID NO: 12805 - DNA, 341 bp, Gossypium hirsutum
  Clone ID: uC-gsflmaxxa049a04b1
tatgtctacaatggaatcatccggaaacaacggtcaggaatgcatctgttgaagattttttagcattattaaaggaatgggtacggctgggtgcttcattttcatagtctagagaggagaatttggagaggcagtcattcaattcaagtgtaaatgaagattttgtaaatgatggacaggaagtggaagatgaaaatgaagatggtgatggtgaagtgtttgaagatagagaaattctttgcttgatgtgacggtgatcctaatgagaaaggtgaacgtgtgttgtacttaagggttcgatggttgcaaggtggtccagaagaagatacatgggaaccttt

SEQ ID NO: 12806 - DNA, 330 bp, Gossypium hirsutum
  Clone ID: uC-gsflmaxxa049b10b1
tctttcacgcgttcgcggacgcgtgggtccgcttcctttttttaacctatacacatattttccaggaaaaagataaagcttgtgctaaaagaaaatggtccttcagcttaccgatcgtcagttctctgatttaaatgatgctcttattctgttcgacatggactgatatggttgcattactactcaaggagttgggatctgtgatgcgatcacttgggcagaaccccactgaggcagaactgcttgtattgattaatgaagtctttgctgatggaaatggtaccattgttattccttaattctttaacctgatggtaagaaaaatgatat

SEQ ID NO: 12807 - DNA, 346 bp, Gossypium hirsutum
  Clone ID: uC-gsflmaxxa049f07b1
tcggaaaagaaaaaatggctttgaattttaatcccatcgcctcgaaatctcagaagctcccttgctttgctcttccacgaaaggccaccctcagatctcccaagttttccatgatctccaccattccttctggctccaaagaggttgggaatctgaaaaagcctttcacgcctccaaaggaggtgcctgttcagatcacccactccatgccgcctcacaagattgagatctttaaatctttggagggctgggctgagaacaacattctgactcacctcaaaccagttgagaaatgttggcaacccgccgactttcttccagatcctaattctgacggatttcatgt

SEQ ID NO: 12808 - DNA, 273 bp, Gossypium hirsutum
  Clone ID: uC-gsflmaxxa049g04b1
tttttgccgactgccaaaaaatgaggttccacttgggaatcccaaatctatcaatgtttctcagaggaagcgagagatggcttccttcgctgcccacggcaagcacggcagatgaggtacatgcaggtgcagtacctaataaccatcctttcaatgctaacgacgacaaagagctatcccaaggacggcttcttactctatcttctccgacaatcagcaagtgccggcccgacggtggtgatcctgcggtggatacacttggcttgttccttc

SEQ ID NO: 12809 - DNA, 331 bp, Gossypium hirsutum
  Clone ID: uC-gsflmaxxa049h01b1
tttcattcgtccgcgagctttacaacagaaacgatatcaataggattttgggtcctaaagcttcttgcatctctttcaaggactctgcttgtcggtgctttggatacatgatttccaagaagaagtacatctataccattgacgacaattgtttcgttgctaaagatccatctggaaaagacattaatgcattggagcagcacataaagaaccttctgagtccctctactccgtttttcttcaacaccctttacgatccataccgagctggtgccgattttgttcgcgggtacccatttagtctccgggagggtgttcccaccgtcgtgtc

SEQ ID NO: 12810 - DNA, 80 bp, Gossypium hirsutum
  Clone ID: uC-gsflmaxxa051c02b1
tcgtaatctcctctacttcaactttaaaattctaaccacatgtatactatagtgagaaatatgtctgttttaaccattat

SEQ ID NO: 12811 - DNA, 71 bp, Gossypium hirsutum
  Clone ID: uC-gsflmaxxa051d08b1
atactctttcccttgcgccgattatataccatcttcttttatcattcaggagctttctttattcgcacaca

SEQ ID NO: 12812 - DNA, 79 bp, Gossypium hirsutum
  Clone ID: uC-gsflmaxxa052g11b1
tttttcacgcgtgcgaaaaaaaaccatttatttttcttcagttataagcgacatcaacaattggcttccttcaagaaag

SEQ ID NO: 12813 - DNA, 315 bp, Gossypium hirsutum
  Clone ID: uC-gsflmaxxa052h08b1
tgtaaatatcgaaccaaacccttcctcgaatgcaagccaatggcctaaatttaaaaaaattctcgccatttcatttattgcacatcgttatcatcgtctcgctttcacttgtctttgcgttctgcaatggccgctctctcgggcctctgctcttcttccccttctttgaagcctaagcatgaccgagtcgtcattccattggttcgcaagtactcgcttgcattccctactcggtccaattcttgctccaagctctccgtttctggtgaagtgtccgcccatttgtccaaaacgaacagcgtgggcgttttgaag

SEQ ID NO: 12814 - DNA, 126 bp, Gossypium hirsutum
  Clone ID: uC-gsflmaxxa054c04b1
cctacttttacgtccacacgcctatccacctgtacgcggggtctaggcacctaacggaggaggccatctctgtccaccctctacggaatcatctatcaatggcttccaccattgccaaacactgta

SEQ ID NO: 12815 - DNA, 177 bp, Gossypium hirsutum
  Clone ID: uC-gsflmaxxa054f04b1
ataaaaaatacaaagcctcaaaccacaacgaaatgccctctaaaactccaacaaactcaaacatacactttccgaacaacaaacccaccaccaatacattccacttacacacacaacttacccactgtaaacattccactactgctcccacaacccacaaactcaccccaacatcac

SEQ ID NO: 12816 - DNA, 363 bp, Gossypium hirsutum
  Clone ID: uC-gsflmaxxa054g10b1
ttttctacgcgtccggtaagaattaacaatgggggcgggtcttcttacaacaatgcttttgtcttctttccttgttgtttcatcagctgaaatctcgagcaagattgctataaactacggtcgaataggaaacaatttgccatcaccatatcgaaccatcgagaccatgaaatcgatgaatgccgggcgtattaagctctatgattccgaccctgaaatactgaaacttttatcaggtaccaacattcatgtatctgttatggtacaaaacaatgacataatccgtatcgcttccagccaagctgttgcccaacaaatgggtacaagacaaattctttgcttattacccctacaccatgattc

SEQ ID NO: 12817 - DNA, 336 bp, Gossypium hirsutum
  Clone ID: uC-gsflmaxxa055a09b1
tgaagtcatctggccatcttctctgatcttaaagtggtggatgaagagggcaaaacattcttgaatatttcttgtctcatgaatgcagcttatatcttaattaccaatcaacattggtggaaagagttgctcaatgaaagatttggaatatgtggcacgcctgctacaagagttatttgccttcttttcttcatgcttttggtattaattcagttttataagtgatatgcagcaccaaacttttcccaagcgatctcactgtgaagaaagttgcctacaaaacttgctagtttttgctgcccaaaatggaaggcctttttgtacatattatctttc

SEQ ID NO: 12818 - DNA, 414 bp, Gossypium hirsutum
  Clone ID: uC-gsflmaxxa055c12b1
cggcggcgttgctccacgaggtggcaccgatgggtggaacaaaacaagctatagctcagatcatacgtgtcagcctgtgttcattgatgcagaagggaggcggaagccgatcacgtgttacactggtccgcacggtagcaccgagtattacgttacaaaaaccgagatcatcgaggttccatatatggccgaatacaagcaaagggctcctgttagagttgaggtggtgagggactatggtgagggtaagcttgttactaggctcttaagtcccgggaaacggggggagagtttaagtccttgtttgggattatactgaagagaaatggaataaggctttctagccccggtcaatttgacgtcaaagagaaatgggataagccatttagcctctgttcggttcctgcttaagag

SEQ ID NO: 12819 - DNA, 470 bp, Gossypium hirsutum
  Clone ID: uC-gsflmaxxa055e06b1
tgattcaatccgacgatcaaattagggggaaaaatgggagggggagagcatgggcatggagttcaggatttcagggcgaaggtgtggagcatgtcgggggtccgtactgccggcccaagcactggcgtcgcaacactgccattgccatgttcggcgttttcctcatttgcatccccattgccatgaaatcagccgagctcgagcaacgacctcatcagcctgtccgtccgattccttcacagctttggtgcaagaacttcggaaacaaagattattgaagtctgcctggggctgttgatggagtaccgatggcatatcagagcagcctatgatctgtatttgagaccctttcaccgatttagctttcttcgtgaacaataagttgtgcttgttttgccttcactgtgttattgacaaattttgaagttgtttttttttcaaactgaatcaacttaattctgttattcatc

SEQ ID NO: 12820 - DNA, 341 bp, Gossypium hirsutum
  Clone ID: uC-gsflmaxxa055f12b1
ttgaggctcacttcaggggtttgcacaaagatactattggacttgttagctgggatattggcatgggcttatcacgctatgcagccgccaatacctaagacatgtggctatactgatggttcaccggtcaccgaatcgcgaataaagctcaaggacggaaggcatttgacctacaaagagcatggggttctccgagacgcatgaacatttaaaattgtgtatgtccaatggcatggattcttgtagacatgatgcggttgttggacaatctctgtctccggcaattgttgcagccttttgaggtctatatcgtggcttttgacacaccaggtttttgagag

SEQ ID NO: 12821 - DNA, 512 bp, Gossypium hirsutum
  Clone ID: uC-gsflmaxxa057h09b1
tcgactttgtcttcggtcagtctggtgctggcgacaactgggccaagggtcattataccgagggagctgagctcattgattctgttctagacgttgtcagaaaagaggcggagaattgtgattgtttgcagagttctgatgggatccggtgcattagtgctggtatgatcggacccatcaattcttgcgaattctatttatataaaggctacccctgatcgcgcttgagcctcgaatttgaatttaaatacgaccaaataacgtttcgagtgatttattccgtaaataactaattagttaaacgatgagatataaaaaaatagaaaaaaaatttaatgagatataaaattggaagggtgcaacacgaggacttcccaggaggtcacccatcctagtactactctcgcccaagcacgcttaactgcggagttctgatgggatcccgtgcattaagactggtatgatcgcacccatcaatttctacgcattctatttttataaggctacccctg

SEQ ID NO: 12822 - DNA, 382 bp, Gossypium hirsutum
  Clone ID: uC-gsflmaxxa058a06b1
agatttttattatggtatgccatctttcacttatatgcatgatgtagagggagagaaatatgtttttggttgagacagtaagacttcttttcctgtctgtgtattgatgaagagaatctaagttgctacatctttctatcgtcatgtctcggtctgtcaacaactgaagctgctgaagaaaaggattaaggacatgttatcttttgaattgttgaaatttatatcaaatgatataaatttcaagcattaaaggtttctacaaccatcagtattatgatttgataccgagcatgtgaggtactgtgcttttctttgagcctatcaagccaaaccatttgtgaagcttaatttaagcataatgggcggaaaattttgaactttt

SEQ ID NO: 12823 - DNA, 522 bp, Gossypium hirsutum
  Clone ID: uC-gsflmaxxa058e12b1
tcgtctctttcttcctcttgcaataatcaaacaatttttgccttgatttcagtttgaaccatcaatggcggaagcagttgtgttggacttggcctattcgatcataggcaaattcagctcccttactctccctgaaactgaaccgtggttgaatgtcaaagatgacctcgacgacatcagaaacgccgtctctgcaatcaaagctaagcttctggacgccttagtgcgatctgcgaccagcaatttcacagcttggcttaaaaagctggaagatgcactttgcgatgccaggaacttgctcgaggagttatctttcgaagtttggagggaaaaccttttctgttccggttggccaatcagttttgctattgccgatatgtgcgctcgaattcaggccattaagaagaggttaacttctcttgaaagtgagttcaaaatccctttcatggctggaacgaggcaacaagggaacttttttgtgcataaagatgaagagcaatccgtgaacgatttccgaggaca

SEQ ID NO: 12824 - DNA, 514 bp, Gossypium hirsutum
  Clone ID: uC-gsflmaxxa058f09b1
tcgcttacgcgtgggtggctatcggcggtctgatttccaaccggagtttcggttcttttatcggttcaggtaaagtatgtcaaggggaacaagccattttgcttcacaagggagagagatcaggcattgctgttctgcatggtaacatgttttaccgaaagctttggagggatgtgatgttgtcatcattccagctggggtgcctagaaagcccggtatgactcgtgatgatcttttcaacattaatgccggaatcgtcaagggtctatgttctgcaattgctaagtattgccccaatgcacttgtcaatatgatcagcaaccctgtcaattcaactgttcctatcgcagctgaggtttttaagaaggcaaggacatatgatgagagaaagttgtttggcgtaaccacccttgatgtgggtcgggctaagactttctatgctgggaaggctaaagtaaatgttgcagatgtttatgtccctgttgtcggtggtcatgcttgaattaccattctt

SEQ ID NO: 12825 - DNA, 101 bp, Gossypium hirsutum
  Clone ID: uC-gsflmaxxa060a05b1
ttttgttttccttcatgccactaaatagaaaagccattggaaatccaacttcttatattaaaagcattttgggaaaccttaattggtgggagaatcatcct

SEQ ID NO: 12826 - DNA, 230 bp, Gossypium hirsutum
  Clone ID: uC-gsflmaxxa060c08b1
tccacgcgtccgaaccccttttactctaaaatctacctcttccattactcttcctctccctctccctctcactcgctcttcccgcttccgctctactcacgcgccgtctcctaggcccatcgtcgtttccttctccgccgcagaatctaccacctacaccgacggtcttggcaactccaagacgcctcttctcgaagtcaaaggcaaaaccgacgtgattactcgaaacc

SEQ ID NO: 12827 - DNA, 461 bp, Gossypium hirsutum
  Clone ID: uC-gsflmaxxa060e11b1
taaagtttaagggacttttaagggttcaattcagctccaactttctccttcgctgcttttggtttatggttgtcgataccgctgcttgaaatctaaccaccctacactgcacgaggggtgcttaggatatcggagcattagaccatacagaaaacaggaaaatagtttgggtttttagcaaaaaaaaaaaaaatgagggatgtgcattttagcagagagaaggcaggaaaaggagtggtgctattttttttctggatgctgagtttgatctcgctatcttgcgcggctaggctaagtgtgtcgagacagaagctccaagtgcaaaaccacttgaaccgtttgaacaaaccggctgttaaaaccatccagagtccggatggggatattatagactgtgttcacctctctcgtcagccagcttttgatcatccttttctcaaagaccacaaaattcagatgag

SEQ ID NO: 12828 - DNA, 481 bp, Gossypium hirsutum
  Clone ID: uC-gsflmaxxa061d08b1
tcccacgcgtccgctcctctgctcttcttaaccccccccccctctctctcctttctctccttcgcaattctccaacaacagatatgtctactgtaatgagacctgtgtctctggttgactcaacttgccttgtttctttgccttcactcttcaccacttcttccaagcttccatctcttctctcacttccttcaaagcccatcaaccttgtcctcttatcttcctccactcagccaaccttatcctccctcaaaacaaaaacccatttcccttccctcgttgcctttttggcccagacgtcagattgggctcaacaagaggaggaaaacgacaccaccctaaccattgatgaccaaggaactgaaagtgaaggaggggaatcaacatgggaaaatgaggagagtgatggggctgaagcaagtttgtctgattgggaacctcaaggtgaggttactggtagtggttcagcagatgaggatgc

SEQ ID NO: 12829 - DNA, 523 bp, Gossypium hirsutum
  Clone ID: uC-gsflmaxxa061e05b1
cccacgcgtccgctccaacaaagaagctaagagatctcaccgtactggaaaaatgggattagggttgttagcttcaagaacccttaagacctccagggttctctcttctcagtactctcgattccgacccatcgtcaccaaacctggcctccaatcccccgatgcatcagctgccgcaccagcaacgcagccggagcccactccgcctctgcctaagaaacctgtgggcggtgcccgggtccacttcaccaacccagatgatgctctcgaggtgttcgttgatggataccctgtgaaaatccctaagggcatgactgttcttcaggcctgcgagatcgctggagttgacattcctaggttttgttatcatagccgactttcgatcgcgggaaactgccgtatgtgccttgttgaggttgaaaaatcccccatgcccgtcgcctcttgcgccatgcctgcccttcctggaatgaagattaagacagatacgccattggcaatgaagcacgtgaggagtgatgag

SEQ ID NO: 12830 - DNA, 396 bp, Gossypium hirsutum
  Clone ID: uC-gsflmaxxa064b07b1
tttgtattttcaattgagggttcgttcttcccacgaagccttaatcttctttcttttctgaactccaattctcaatttcccaaaacccacaactctaaaagaaggaaaccctaaagaggaagatggatggtattgaaccctactcttttaatcgccatccgcaataccctcgttcaaccagaactcgccatgtatacagttacggaccagacgaagagctcgacgatgaagaagaaatggaactagataacgaagatgtagatgacgataacgacgacgacccagatgtttattaccaccgcgtcaaagaaagcgagcgttttgaaaggtacccaaagcgtcaaaaggagatttatgttctgttagaggtttgggggaataggtttttgcaattag

SEQ ID NO: 12831 - DNA, 486 bp, Gossypium hirsutum
  Clone ID: uC-gsflmaxxa064c04b1
ctcagacaagatgggtcctcagggatctgtttatagcaagctgcccgtattctccccaacaaaacgacataccacttttaacatacttaacaaaagcttaataaaggatctaataacttaaactggcctcacatacaaaataccaatgatatcacaaaaaatgccgagcaatcaaaactagattccgaataatctacacttgaaatccctaaggagaggaatctccttcacggcactcagaaatggagcctcctcgaatgaactttgagaggctcggttttgcctttgcgctccttgatccctgctgcaacgagatgccccttttggctaatgaaagccacccaaaaggtgtgacttttaaccaaattaggctccttatggaaatacgcctgcacaaggtactgccaatcaaactgcttcacgcaagggcaggcttaacaaggctcgctataagaagcaccttggaagaggatgtagctaacacac

SEQ ID NO: 12832 - DNA, 476 bp, Gossypium hirsutum
  Clone ID: uC-gsflmaxxa064e07b1
ttggttttgtatttcatactcatttagcccctttcattagcatcgaaatcactccagttttctttatcactgaaaaatgtcttgctgcggtggaaactgtggctgcggttctggctgcaagtgtggcagcggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgtttcgctgcttatgtgtttttagaataaagtagccatggcttgccgttggctttgcctgctgccgccacggctacttgccgcttgcccatagatcgagtga

SEQ ID NO: 12833 - DNA, 476 bp, Gossypium hirsutum
  Clone ID: uC-gsflmaxxa067c03b1
ctctttacaaaatatctgctcctcttagtttccctttgtgtcccttgtttatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcataagtggaggcggtggcggaggatctggaggaggaaacggtggttacagccgcggtggaggcggcggcggatatggtggtcgccaaggaggatatggtggcggacgccgtgaaggtggatacggaaacggtggggggtatggtgga

SEQ ID NO: 12834 - DNA, 490 bp, Gossypium hirsutum
  Clone ID: uC-gsflmaxxa067d08b1
tttatatatatattgcattgcagaatttcacaaatgctttcacacatcttcctttttctctcattattatcctacccaaatgagaaactttggcaactctccggcctttgtaatcctcggagtttttatcctctcttgtgtttcccatgttagatccgacgcctccgaccaccgttacaaagaaggtgaccctgtccctctctacgccaacaaggtcggccctttccacaaccccagtgaaacctatcgctactttgatctgcccttctgttctccagatcatgtaaaggagaagaaagaagcattaggtgaggtattgaatggagatcgactcgtcagtgctccttataaactgaattttaaagaggaaaaagattcttccgttgtttgtaagaagaaactttcaaaggatgaggttgtctttttccgaaaggcggtcgaaaaagattattattttcaaatgtactatgatgatctgcctatctggggt

SEQ ID NO: 12835 - DNA, 484 bp, Gossypium hirsutum
  Clone ID: uC-gsflmaxxa067d11b1
tttaacgcaaatagttcgagtttcgtaatcaatggctttaccgaaccaacagactgttgattatccgagctttaagctcgttatcgtcggcgatggaggcactggaaagaccacatttgtgaagaggcatctgactggagagtttgaaaagaaatatgagccaacgatcggtgtggaggttcaccctttggacttcttcactaactgtgggaaaatccgattctactgctgggatactgctggacaggaaaagtttggtggtcttcgagatggttactatatccatgggcaatgtgctataattatgtttgacgttactgcccgtttgacatacaagaatgttcctacctggcaccgtgatctttgcagggtgtgcgagaatattcctattgttctatgtggtaacacggttgatgttaagaacaggcaggttaaggcaaagcaggttacattccacaggaagaagaatctgcaatactatgaa

SEQ ID NO: 12836 - DNA, 516 bp, Gossypium hirsutum
  Clone ID: uC-gsflmaxxa067e03b1
acccacgacgcgcggccattttatgcttccatctacaagtactcaatcaggggaatcctcaatgactactatctattgtgattggctaacatgccaaatgtctggctggaacataaaccttactattcgtcctccttggaactctctgttcctttatctactctttcagctcaccaaaccgtaacaaaaatggccggaaacttccacccgggcctgcccctcttcccatcataggtaacatgcacatgctagggaacctgccacaccatagatttcactagctcgccgaaaaatatggacccatcatgtcgagagtgctaggcaaagtaccaaccatcgtggtatcatcacccgaagcacgctgaactgttcctcaaggtccatgacgtggtttgtgcttgcaggcctaacgtacaatgcgcgaaatacttggcatatggcggacaggtcgttggttttacccagtacggatcttactggcgaactgtacggataaggtgtatcttgcatttcctc

SEQ ID NO: 12837 - DNA, 209 bp, Gossypium hirsutum
  Clone ID: uC-gsflmaxxa067g05b1
agctggttgcatcccacctggaactgacccttctggggcagttgtcaatgggttattctatagtcagcacgatgatgaagtactgtaaattgattcaccattatgtgatagagtgaaacagactcattgatcttgactatagctgattttttgacaaaacattaatgcgaatggataggatgaatcataatataattactttttcgttc

SEQ ID NO: 12838 - DNA, 499 bp, Gossypium hirsutum
  Clone ID: uC-gsflmaxxa067h02b1
tcactatttgtgctgctgctcctcctggggccgccgcggacttattgctgcgaccgacgcaggccgcccactttttctggttctattgaaagagggcacgacacgggggacatctgaaagggtttgttctgtgaaaaggccaactgataagacgcagatttcggaggaccccaataattattagaccttgtctgaagccaggaacagaccaagtataagggagccgattcaagaggcatattggcgatggcagttgcagatgtgcattcttgattaccatgattattcctcagaagatgggaatgtgatctgccttatgctgggagtgcagactagggtggataactgtgggcttgaataatttgtttggaataatattgctgagatttgaccatgcctggttcctgataagcgtgtggaggttcatactatggtgagactcggaaactaggttgctggacaaccctactgtgccaacagaaaatagctgatacggttg

SEQ ID NO: 12839 - DNA, 479 bp, Gossypium hirsutum
  Clone ID: uC-gsflmaxxa067h05b1
gcatttttaccatagccttgaaattattgttaatttggggcaacttatgaggagtatgaggctaagtccacccctccatggccaaactgacgttcaactcttgaaagagaatgcacctcattgatactcatgataatagcaagctttacattgatgggctttctaatgcggagccattaaatgtccctctcattgaactcggcgttgaatattatcaatgtgatggatgggtaaacgaagccaaaggagatgtacaatgattgggctagtatacaaaagtttcatgttaatgacactcttggtacaagcatgagaaaggattagacttggtcttggaaggacacatagaggattccttcaagggcaacatggaatgtcctctaaagaaaatgattagtgggagctctgagtttcggctatctaaatagggtgccttctttctcatcagtgagaaagatgggcattgtccaatgggtcag

SEQ ID NO: 12840 - DNA, 462 bp, Gossypium hirsutum
  unsure (1)..(462): unsure at all n locations
  Clone ID: uC-gsflmaxxa067h09b1
ggtccaaaggcgtgttcacagttgagttcgcagcgatgtcgaacgagttcgccgataagggggacaagattatctatgaaaccgaagccaaagggttcaacccgggattgattgtattgctggttattggtggactactgataacattccttggggggaactacatactttactcgtacgcgcagaagactcttcctcctaggaaaaagaagcccgtatccaagaagaagatgaaacgagagaggctgaagcaaggagtctcagcaccaggggaataggaattcaaggtccgacttttctcttttttcgacattgttaaaaactgttttgttcacaatttctgtccagtttcgagagttaaaaacttcaacatctgaattataagtaaaccccatactncggtaagactagagagtaaaatactgttcctttgttcgtcggatggcagttatgtgtcacatt

SEQ ID NO: 12841 - DNA, 487 bp, Gossypium hirsutum
  Clone ID: uC-gsflmaxxa067h11b1
gaatttagccatccatttctttcagttgctgctggggttctttctctcctttttgttttttatttttgggttctaagaattgtaaataattcaagaaaaatccaaatttgacaatcattttcgaaccccccccttgcatttcgccttaatctttccttcttaatacccacattttctctgattctctcactctattttgggttttcttttttctttttgtttctttcgtttcctattacgaggggtttttgttttttccttttgaatttgagaagctataataataataataaacagaaaaaagaagcagaggaaaatggcgtctaatataggaatgatgcatagtgcttacttcgttggaaggaatgagattttaacatggatcaataacaggcttcagcttaatctctctcgtattgaagaagctgcatctggtgctgtacaatgtcagatgatagatatgacctatcgggagcagtgccaatgc

SEQ ID NO: 12842 - DNA, 493 bp, Gossypium hirsutum
  Clone ID: uC-gsflmaxxa067h12b1
ctctgccacagccagtccggtctttgcaaagcataccgctctctacatctttggtagatggattgttaaaaagcacaagcccagttagcatttatttttctattttgccttttaattttctactttcctactcttattaaacattcccaccgattccttgcttttttcaaccattcattcaatcccctctctctttctctccgtgtgtgtctcagttctattgctgataaaccctgtggaaattaatagagaattgcattttctgaatatcaggcggttttatattttcatttactaaatccggaagatcccaaaaattttgttatactgttttagtttctcagtttaaacccacagggagcattagggtttcttagcggaattctgatgatcagcttttggctctttggttttggaggattaaagatagagttgtgatgggagtaaaaggtcgcccccctgcaatttattgtctttagtgcttcttttgcag

SEQ ID NO: 12843 - DNA, 172 bp, Gossypium hirsutum
  Clone ID: uC-gsflmaxxa069a05b1
aattagttgaagcagaaaaagctcaaaaccctaaatgtgagagttgttagttgacgaatgttcttttttctttaaatttttggcgagaaaagaagaaaagaagaagatgaggccgattttgatgacatggcttcaatcggctttccctttctcttgccaccctcttttcttt

SEQ ID NO: 12844 - DNA, 482 bp, Gossypium hirsutum
  unsure (1)..(482): unsure at all n locations
  Clone ID: uC-gsflmaxxa069a06b1
cccacgcgtccggtggttgaaggcttaaacatcaggtgaagaactgatactttttctgtgtccaagctttgcttttgtgccgtatttcctcaaaatttctagcgatgattccaattgggtttctgggtttactgtttttgctgctcgctctatactgtgtccctttttctcttttcctttntcttctttcttcccttttttcttttcttttttctttttttttcttcctttttttcctctctctctttcttttcttttctttttttccttctccctcttttttctttctctttctttttccccttctcttttccttcttttttctttcttcctttttttccttctttcttttctctcccttccttcttccttcttttgttttcttttttcttctctcctttgtttccagtcaaaaatagtcttttttttttcggtttagtttgggaggggtaaactctcgttttttctgttcccccccctct

SEQ ID NO: 12845 - DNA, 137 bp, Gossypium hirsutum
  Clone ID: uC-gsflmaxxa069a08b1
aatggtagttgctacaggtgtggtttcagatgagtggggatagatcaaggaagttcggcggagatggagtgatattgataagctggatcttatccttacacttggtggcaccggattcactccaagagatgtgaccc

SEQ ID NO: 12846 - DNA, 269 bp, Gossypium hirsutum
  Clone ID: uC-gsflmaxxa069b01b1
cgtctgttccaggttttttcaaccatgctgttctggtggtctccttttaccagtttttgattatcgaatcggtgaaggaagcttcttttgtttttgatcgtcgactgagtttgtgcgttcttagaatctaaaacattctgaccccaaaaatgttgaagctcttttctttctttctgtcgtcttctccactcatctttactctccctctgctcgactctttttcctttctcctctctttctttcttctttcccatctctttccctttttc

SEQ ID NO: 12847 - DNA, 266 bp, Gossypium hirsutum
  Clone ID: uC-gsflmaxxa069b05b1
cactcttttatcacacaagataaaacagtactttagttttgatctcacaaaactgaaagatctctacattttttatcaaatgttctagacaacgatgggatctgaatctcaagttgtttgtgttactggtgcctctggtttcattggatcatggttccatctttttctctcctcttcttactttcaattctcttatctcttttcttctcttctttcctctttttctttctttctcactttttttatctttctccatccactctctt

SEQ ID NO: 12848 - DNA, 456 bp, Gossypium hirsutum
  Clone ID: uC-gsflmaxxa069b06b1
aaatttagagggaaaattttcgcttgagattttttttttggcttaagatgaagttgacggaagaggagacggcgctcgaagaggaaaatgaaatcaaggctatgaaagaggaagaagaggtcgtcccctaacattctcttcctccctttttctatctctctctccctctttctccttcctctctttcctttctctcttcccctcccccttctttctcccttacttcaccttcttcttttcctctactctctccctccttccttttcttctttctttcccctcccttttctcgctctcctttcctcctcttccttatctctccttctcctccttcctctctcttcacctccctccctttctacttctttcctctttctccctcaccctcttttctttcctttcaccttcttacttctctcttttccttttccccctcttcccccctttatcttctct

SEQ ID NO: 12849 - DNA, 169 bp, Gossypium hirsutum
  Clone ID: uC-gsflmaxxa069b07b1
ccctctcgtccgttacgtcccgcctgggaggtggggagtgctgtaatgatgtttttggtggacagtgcaagaacaatggtattgtttttcgtatcgatggcatgcttgttgctccatcggattataaggttattggaagtaccggatactggcttttcttttagcattg

SEQ ID NO: 12850 - DNA, 149 bp, Gossypium hirsutum
  Clone ID: uC-gsflmaxxa069b08b1
gactggagcatagtgtgccacttccaatgtcagcacgggcactttgcagaacaggcatgcattgcaccatcgcccttacctgtgactgttattcagaagttgcaagcaatccttggtaggctgattgctaataatagacttgagaagtg

SEQ ID NO: 12851 - DNA, 181 bp, Gossypium hirsutum
  Clone ID: uC-gsflmaxxa069b12b1
ccttttcgtccggtcccatctttttttcagctttaggcatcttttaagctttctggcgggttctatatactccaagcttcatggatttagcacataagctcctattcacagctttgcctcatcttcgctccatccattgttgggacaccttcttttcccctcttcttccttctcctttctc

SEQ ID NO: 12852 - DNA, 153 bp, Gossypium hirsutum
  Clone ID: uC-gsflmaxxa069c01b1
tatttgtttaactaaacgacacataagcttacctagtgggcattctataacttgaagagggatttgctctaacgaagcaacattttaacacttaggaggatatgcaccttcacacgagctagctacctttggaatgttgggattgttcatata

SEQ ID NO: 12853 - DNA, 426 bp, Gossypium hirsutum
  Clone ID: uC-gsflmaxxa069c05b1
gaagttttcaacaaagataagactctagtcttccaggtgttctgttaagcatgagcacaagcttgattgtggtggtggctacatgaagttgctcagcggtgacattgaccagaagaaatttggtggtgataccttatacagtactttgtttgtctctcctttctctttatttttatcttttttctttcttctctcttttctcattcttttttttcatcattttcttctctctttttttacctttttttctcattcttttttttctattgtcttctttttttttattctctttcttctttattttcattatcttattttttcttttcttctcttatttcctccctctattttcctctctatttcttatcttcctacttatatttttcttctctttctatcatactcattttcctcccctctctattt

SEQ ID NO: 12854 - DNA, 159 bp, Gossypium hirsutum
  Clone ID: uC-gsflmaxxa069c07b1
ctcaattctttcatcccttgttttccttcaaccgaagcaaatctaaaactttttgaggcattggcaccaaaagctgaaaaaaagccagccgagaagaagccagccgaggagaagaaagccggagctgagaaagccccggcagagaagaagcctaaggct

SEQ ID NO: 12855 - DNA, 132 bp, Gossypium hirsutum
  Clone ID: uC-gsflmaxxa069c10b1
atttttgcctctccaatggatgatacccataggagcagtgacgaataccatcaacctttactaacagaaccaagttcaaatgatgaagcaactatattgagagatgaagatggtgaagaaggaaaggactta

SEQ ID NO: 12856 - DNA, 301 bp, Gossypium hirsutum
  Clone ID: uC-gsflmaxxa069c12b1
gttttgtcaccaattccacaaggaggatgttgaaggggcgtattggaggtccttgtgaagcaaccaaccctatcgaccaatgctggcgatgtgaccgcaactgggaaaagaacaggaaaaagttggttgattgcgcacttgtatttttcttttcacttcttctctttacactttatctttttatctttctcttttattaatctttctcctattactatattttttatttatttttttttatttttattatttatctttctatcaattttttttacctatttattttatatatttatttcat

SEQ ID NO: 12857 - DNA, 144 bp, Gossypium hirsutum
  Clone ID: uC-gsflmaxxa069d03b1
cccactcgtccgcccacgcgtccgcccacacgtcgtgaacatttgtagcaatagggagctcaaagaaaaaaaccgaacatcaaagatgaacacagacataacagcttcggccaaacctgagtacccagttatagaccgaaaccc

SEQ ID NO: 12858 - DNA, 127 bp, Gossypium hirsutum
  Clone ID: uC-gsflmaxxa069d04b1
ccctctctgttcgcccacgcgtccggcacgattctggaagtttgttctgacgctccatctctacatcacaggaatggcgacagaagttgcaccccccgccaccaccgcacccaaagacccctcccaa

SEQ ID NO: 12859 - DNA, 377 bp, Gossypium hirsutum
  Clone ID: uC-gsflmaxxa069d05b1
ccctctttttcgtccacgcgtacgcccacgcgttgggaaacagtgcctgcaatagggaaaacaaagaaaaaaaccgtacatcaaagatgaacacagacataacagctttggcctaaccagagttcctattttttgattgttattctctttttgttttttattacttttctatcgcattcttattacgttgttttttctttaattactttcctctcatttattattatttttttttatattatttctttcttttttatctatgttctttcctttttcttttattttttatcttattttttattttttcgtttttatatctttatatttcttttttcctgtattgttatgattttttatttattttttaatcttttctt

SEQ ID NO: 12860 - DNA, 134 bp, Gossypium hirsutum
  Clone ID: uC-gsflmaxxa069d07b1
gctttggggatgatgaggctttccaaatgctcggtgtcgctgtagaatcttgtggcgtctgtccgtattcacccatggattcgtgatgtcgcctcgcactttgcttaaccgcttctcttaaaacagcctctatt

SEQ ID NO: 12861 - DNA, 141 bp, Gossypium hirsutum
  Clone ID: uC-gsflmaxxa069d08b1
ccctcttcgtccggttttatttattgattctctggggtgttgttttcatcggagaacggcgtaaagaagaaaagtcaaaaacaaaaatttcatggctcggaaatccttcgtcggcggcaactggaaatgcaatgggacatc

SEQ ID NO: 12862 - DNA, 222 bp, Gossypium hirsutum
  Clone ID: uC-gsflmaxxa069d10b1
ctttctcgtccgcccacgcgtccggttatctgtgggggtgttttaataaacgccttcgatttactttcggtttccatttacttctttatttctacgtttttgaatttttagtaagcgatattgagagagtgcatttcatttactattttatattcttatctattttcttttcttttttttttttttattttattctgttctacttccccttttttttttatt

SEQ ID NO: 12863 - DNA, 148 bp, Gossypium hirsutum
  Clone ID: uC-gsflmaxxa069e02b1
cccatctgtctgactcttctgcagagagtttttcagagaggaaatttgtaaaaacagaaagggactcacttagagactcactctgaggagacaacttaaaaaacatgctactccaaatctcaaccttatctacacttttattatcaac

SEQ ID NO: 12864 - DNA, 184 bp, Gossypium hirsutum
  Clone ID: uC-gsflmaxxa069e03b1
ccctctcgtccggacaaggtgagggaaaaaacaaggggatctgatgtacttgcctgtggatcttaattatagacaagatcatgatggcccttgaaaataaagaaacaatgcagaactgtgaggcaaccttaaaatgcctccagacaaaggggttcccgtacaacctgcaatgtaacaggaattc

SEQ ID NO: 12865 - DNA, 149 bp, Gossypium hirsutum
  Clone ID: uC-gsflmaxxa069e04b1
cccacttcgtccggcggtggttactgttccagcttacgtgaatgttgcaccaaaggcaggccacaaaggatgctggcattattgccgggctcaatgttgctagaattatcaatgaaccaactgcagctgccattgcctatggtttggac

SEQ ID NO: 12866 - DNA, 184 bp, Gossypium hirsutum
  Clone ID: uC-gsflmaxxa069e06b1
gcaataacgaatctcatttgtttaatgaacttcccaatcaaagctcaaatgtgggtagctataacattgatatgggctccacaactaacaatgcttttgccaaagcagcagttgataagaataagtcagctgcatcatccacctgtcagatctttgcactcatcctcctttctctcctttattc

SEQ ID NO: 12867 - DNA, 342 bp, Gossypium hirsutum
  Clone ID: uC-gsflmaxxa069e07b1
ccctctcgtccgcggacgcgtggggcgagactgggaccaaccttaacctccccgagggctgctttaccgcttttgccctccgcccatattgcgcctaaacccacgcttcatttcatcaaagcctccacttccgatctccccaaaacctctccattaccaccgtcgacgaagcctcaactcccattcctcaaggcccatcacaacactcgtgaaaaagctctgtttcacaacggccgccccgtgaccacccaccaccccccgtttttccggtaaatacgttccgttcaccttcattaccggaaacctccttcctccgaccgaaatcctactctctcgaccaag

SEQ ID NO: 12868 - DNA, 123 bp, Gossypium hirsutum
  Clone ID: uC-gsflmaxxa069e10b1
catgtcttctattcagttttgtaagagctatggctgaggactttgaggttggtggcgagttccagaccaaggactaccatgattctccacccgctcctacgaacaacctttccttgtgaggcc

SEQ ID NO: 12869 - DNA, 434 bp, Gossypium hirsutum
  Clone ID: uC-gsflmaxxa069e11b1
atcctggacaaggaaggtatccctccagaccaacgggggtttattttcgcgggtaggcagcttgaggatggcaggacacttgcagactacaacattcaaaaggagtcgaccctccatttggttctttgactttgtggtggtatgtatattttcttcatcctttatctttttattatttttatttttgttttttttctattttttcttttttattctttttttttttttctatctttatatctacttcactctttttttttatttttttcttatttctctttcttttttttttacttaatcttcttttactttattttttattttctttttttatcttttcttttcttacttatccttttttttttctttttattttcattctctttttctattttttgtatttctattttcttcttttttcatatatttctttt

SEQ ID NO: 12870 - DNA, 527 bp, Gossypium hirsutum
  Clone ID: uC-gsflmaxxa069f02b1
attgcttttccttccttccatcgctagaatcacctggggccacctgttatcggaagcccttatcaatggcgcccttgcttcagccacgaacgcatcaaccacatcattgaaaagataagttgctgctcctatatagtctcctttgtgatctttggcaataatcgcagatgtagaagtcctagtatcactctgaaaagtagcattaaaatttatttttaataataacacccaaatctggaggactctatagtataaccgataacgatctgtagacaactcccatctttttcttgatactgatttaattccttaatatatccacgggaaaaacctaaaagatcctatagagaaaacttcagaccctcattaatcaatttatttcttctgttccacaaagcttatatagaaatagcaattaaatgtttgctttgggcatctactgcacaaaaagtattaacgaaaaaggacttgtaattcataatactatcaagtgaaacagaccggatttgaagagacgcccaaatatt

SEQ ID NO: 12871 - DNA, 199 bp, Gossypium hirsutum
  Clone ID: uC-gsflmaxxa069f03b1
cggacgcgtgggggaattcaagaggaactttgctttgtacttgcagatggttgcctttgatctcttctccgaaggctcttgttttcctttgccatgggtatggcatggagtgcagtggattcatgagagaatgcggaaccaggctagccgcagctggatatggtgtgtttgggattgattacgaaggacatggtaggtc

SEQ ID NO: 12872 - DNA, 258 bp, Gossypium hirsutum
  Clone ID: uC-gsflmaxxa069f05b1
cggacgcgtgggtgtttttcgccttggtttttcttcttgattttctcctttcctcgatcaaaaacctcagctctcttaccgccaaaggaggatcatcttttcaggttttgcgatggcatcgaagcggatcttgaaggatctgtaggatttacagaaggatccttctctctttctcgcattcttttcttctttcactttatcttttacttttctctcttttttttcctattttcttttatcattttctttttttatctc

SEQ ID NO: 12873 - DNA, 571 bp, Gossypium hirsutum
  unsure (1)..(571): unsure at all n locations
  Clone ID: uC-gsflmaxxa069f07b1
gtgtttagcagcgaaagggacttttgtggagttgnagaatgcctataagagtgaggcgctcttagaaacctatgcagaatggtgagattcatccacttacacgttatgtgatgaattatgtcaaactgcttgtcgattatagcacgactttgaatttgttattggagagtgatgaggatgtttatcttccctttctgtttgctcatatcactctcttttctctatatgtatcttttatttttctctcttctcttttcttcttttttactttttcttctattttttttatttatattttttctcttttctttattcttttcctctctttctctcttcttctttattatattattttctatcctttatacttttttcttcctattttttctcattttttctcttttatttccttcatctattttacttttcttccttttttctttaatttcctttcattactttttcttttttccctttattcctcctaattctttcttctcttatttttcttcactcctttttttccttttttttctcctttttccttttatcgttttttctcttttttctt

SEQ ID NO: 12874 - DNA, 518 bp, Gossypium hirsutum
  Clone ID: uC-gsflmaxxa069f10b1
agctataactaagttaaaaggtttttttctttttggttgcactttttctcaaacttctcaaacttaaaaagagaggcagccaggcatggtttgagagattcagagaaagtctaaactaaagcctccaaaagcattacagtttctgagttggggcttggtggccccactactacacttgatcttgttccattcctcttcccctccccttcctttcttttttttttctccttcattttacatctacttaatcttcttcacatttctttctcttattcttatcattctgttccttttttccatcactattccccttcttctcttcctattttcctcttcttctctcttcctttttttttccttttacccttttatcttcttcttatccctcctctcacttctcctcactttaactttcttcctcctatattcttattttatctttttctccctttcttcttccttcttcctcctttttttccttttactttatattttctcttctatttcttcttctcttt

SEQ ID NO: 12875 - DNA, 157 bp, Gossypium hirsutum
  Clone ID: uC-gsflmaxxa069f12b1
gcctttttcgatcctttgcccccccccccaaaaaagtgggtgccgaagttgaagttagaagatgaagaatcaatcaccaaattgtccacaaaatcaagattcagatacaattccccacttgttcaaagtctcccttataggcctagtatgttttttg

SEQ ID NO: 12876 - DNA, 138 bp, Gossypium hirsutum
  unsure (1)..(138): unsure at all n locations
  Clone ID: uC-gsflmaxxa069g01b1
ccctcttttccgcagagttgttgtggcttcaacctntgtngctcttagattggtgggcccgttttaagactaatgtttttgcagataatgaaagcttcaatttaatgggtaaggaacacgcccttcttttacccaatc

SEQ ID NO: 12877 - DNA, 554 bp, Gossypium hirsutum
  Clone ID: uC-gsflmaxxa069g02b1
ccaggttatccagccataactctgtttcccggcgcggagactatttttactaaattctttttgattggaacgtgctgacagactatagttttatttttggttctgttatgtgtattattataactggcaattctctgattggaccggtacatactagtgtatgacagttggataacagagcctctccgatctccatatttagggttctgatgcacttgttttccctttgatgcctatccatttccattaaaacagctgagatttaccaagcctgaagcccgcctagtgcctactttgatgaagtcttgcctaaaccggatgaccagatgaaccagggtccaccttgctgcttcttcctagaaggaccaaatatatgtggagatattactattctctttgtaatctgccatgtgcatgccaccaaaataccaagcttttataatttgtgctcccaagaaccctgttagccgaaaatgctgttgctgccttacagtcctttttcgttgaggtcggttctgttaattattttgcatttgtttgtcgttaaaacctgt

SEQ ID NO: 12878 - DNA, 425 bp, Gossypium hirsutum
  Clone ID: uC-gsflmaxxa069g03b1
acagtgtgctttttgcagtgttttatttattgattctcttagttctcgttttcatcggagaaaaaaaaagaagaaaagtcaaaaacaaaaatttcatggctcggaaattcttcgtcggtggcaactggaaatgcaatgggacaactgaggaggttaaaaagatcgttacaacattgaatgaagctgaagttccttctgaggatgttgtggaggttgttgcgagccctccatttgtttttcttacctttgtgaaaagtctgttgcggtctgatttccatgttgctgctcagaactgttgggttcgcaaaggtggtgcttttaccggagaaattagcgctgagacgcttgctaatctgagcattccatgggttattcatctggccctcttaaagaagggcctctcctgaatgagcccaacgagtttg

SEQ ID NO: 12879 - DNA, 219 bp, Gossypium hirsutum
  Clone ID: uC-gsflmaxxa069g07b1
cttgacaaagaaagacaacctacacaagtgggctacttagactgctttacgggttggtaaccgcgaacttgctgaggagttgcttgcttactccattgagcagggcaagaaggaatgtttcgccagcgtgcctctctgcgcgtcatgacctaaattcgaccagatgttagctcttgacccggcccgaggtaacacctttgatagattcccaccacttcc

SEQ ID NO: 12880 - DNA, 160 bp, Gossypium hirsutum
  Clone ID: uC-gsflmaxxa069g09b1
cttcaccatctgaagcataaagagggagaaattttaaacattatgcgtcgcacactccaaccatactattgtctccggaaaatgggtttctttgacggactgctgcgcggtccccttcgccggccttgctacctgtcgcctacttcgaacggcctgagaa

SEQ ID NO: 12881 - DNA, 165 bp, Gossypium hirsutum
  Clone ID: uC-gsflmaxxa069h04b1
ggctctctcaaattttgctggaggatcgttttactgggggttgttttatagaggaatgcgcggattgggcttactacagcaattgtaaatctgatgttggctgctcaaatgtcgaggatttttgctcatcagagttctagcctttttatcttcttatttttctac

SEQ ID NO: 12882 - DNA, 89 bp, Gossypium hirsutum
  Clone ID: uC-gsflmaxxa069h06b1
cccactcgtccggcaacagtaaacaatttgattgggggcaccgtctaaaggatattggccctcttctcccacgcgacaatgtccgctct

SEQ ID NO: 12883 - DNA, 341 bp, Gossypium hirsutum
  Clone ID: uC-gsflmaxxa070a01b1
catccaaacagcttcatttatcggtagactcatcgaagctaattagacaaaagaagaagaagaagaaaatgactggcattgatatattgaccagagtagatgtgatctgtaagaagtacgacaaatacgacgtcgaaaagcagcgagaccaaaatatctccggcgacgatgcctttgctcgccaatacgctgctattgaagccgacattgaatccgctcttcaaaaagcggagcttgtttccaaggagaaaagtaaggcatctgctgttgcggtgaatgctgagattcgtcgaaccaaggctagattgcttgaggaggtccctaaactgcagaggttggct

SEQ ID NO: 12884 - DNA, 559 bp, Gossypium hirsutum
  Clone ID: uC-gsflmaxxa070a03b1
aagggtctaagctctctccttctcctactctctgttctttgagctagcatcgaacatgtatcatcctagtgcaagatccaagaccttgcttgttcttttacccatttcagcacttgtattggtcttgctttcgttcgtagctcttctaacaaacagccccagagccacacaactccagcatttacacgtccacaatcacctccaaattgctcactcagcatgtgaagggaccttataccccgacctttgcgtctccaccatctctgttcttccagatctcgcttccaaatcactgccggagctcatccaagcaactctaaaccaaacaatgtacgaggtccgtctctcctctgccaactgcaccggcattgaaaagcggatcaaaagttacagcaaacgggaagaggcagcgataaacgattgcctagagctctttgatgacaccctggaggagctgaaagttttccttgctgatctcgcccctagaaattagcagtcctccagaactaccacgacttgcagacatttctaagcgccgcgatgaccaaccagtatacgt

SEQ ID NO: 12885 - DNA, 202 bp, Gossypium hirsutum
  Clone ID: uC-gsflmaxxa070a05b1
cccacttttctcgttcaaaaccaaataaaaacatggcacggcgcgttaatattgttccttccatgtttgtgcttctattatccttgatgctcacctctaaagttgaaacaggcccatatgtctcttcttctcaggccaggcccagaagctgactggaaagctggtctgaatgggcggttcttggatgcttggaaagaaggat

SEQ ID NO: 12886 - DNA, 389 bp, Gossypium hirsutum
  Clone ID: uC-gsflmaxxa070a07b1
cccactcgtccgcaagaaaactatgtgtatggccatgcggaatgaagattaccatcatcatcatcatcattatcaaggatctaaagcaacaactaattggtccatggctactgcttcttcatcaccaaaatcctgtgtaacaacaagtttcaacagcaacatgttggatttttcaagcaacatcaaagctgataccgctacaaggcaacacccaccattaatggatccatcacctgagtgtaatagctgcactgcaagtggtggggcattgaagaaaactagggttcaaccttctgcaactcaatctactttcaaggtgaggaaagaaaaattaggagacagaattacagcacttcaccagcttgtttcaccatttgggaagactgaca

SEQ ID NO: 12887 - DNA, 437 bp, Gossypium hirsutum
  Clone ID: uC-gsflmaxxa070a09b1
ggaaaaaattggattcgttgagcctggaaaaacaatggtgataacaatcacaattcgggaacttctatttccagtttcatttctcttgcttcttccatgtgaagcagttgctgcaacacttggaatctgctatggccgtgttgccaacaacctcccaccaaccttggaagtgatcaacattctcaaaaccaatggcatttcgaatgtccgaatcttcgatcctgatccgtttactttacagtcattttcaggcaccgggatcaatctcatgaccggtgtccctaatgaagccctcccttcacttgcctcaggcacaccagcctctgcactccaatggctccaaaccaacatattcgcgcatattgttccgagccaaatccgatatattgcggttgggaatgaggtactccttaaagactcattctattctccctata

SEQ ID NO: 12888 - DNA, 526 bp, Gossypium hirsutum
  Clone ID: uC-gsflmaxxa070a11b1
cggacgcgtgggaaagcattaagtacaatgtttgggcgagcacaccaaatggtaacaaaaagcttgatgcagcttaccaggaagctcagcagaaatctggtcactgccctatatttctcttcttctcggtcaatacaagtgggcaatttgtcggcattgccgagatggtaggggcagttgattttcaaaagaatgtggagttctggcaacaagacaaatggactggctgtttcccagtaagatggctcattattaaggatgtacctaataattccttgaagcacattaccttagagaacaatgagaataagcccgtcacaaatagcagggatacgcaagagatcaagcttgatcaaggccttaagttgctcaaaatcttcaaggaccattccagcaaaacttgcattttagacgatttcgaattttacgagattcgccagaaagcaattcaggagaaaaaggctaaacatcagttgcaaaagcaggtatgggaagaaaagcctggagatgaaaagaagatatagca

SEQ ID NO: 12889 - DNA, 437 bp, Gossypium hirsutum
  Clone ID: uC-gsflmaxxa070b05b1
cggactcttgggaatgcctgttatcaaggtgggaagaggggctgtgttatttgcgaagccgagatcggacccattcgaggaaaagaatggagtgaagctgccaagttatagaggagataatgtcaaccgtgattccttcgatgaaaagtctaggatccctgatccccaaagaatgattagagcttactgtcaatcagcagctactttgaatcttttgagagcctttgctactggaggttatgctgctatgcaaagggttactcagtggaatttggatttcaccgaacacagtgagcagggggataggtaccgtgaactagctagtcgtgtggatgaggcccttggattcatggcttgagttggccttacagttgaacatcctttcatgacaacaactgaattctggacttccatgagtgcttgctttaccttacgaa

SEQ ID NO: 12890 - DNA, 329 bp, Gossypium hirsutum
  Clone ID: uC-gsflmaxxa070b07b1
cggaggattaggttcatttcaaatgcctggtgaaaacagcttagggagtatagagttggtttctgaagattaaacggagttaacattttccttgtggtggtttgtttaaccttttagttatggatctcttttttttatttgctcttgttttaggttgaactctctgtattttcagaggtttgacttttcaaagacaaagctatgtactacttattttttgagttgaagaaggattttactgttccaatcttggactgtccttattgtttggtaccagtattggctaatctgatttacagggaagcatctagatgattgttgatggtgat

SEQ ID NO: 12891 - DNA, 490 bp, Gossypium hirsutum
  Clone ID: uC-gsflmaxxa070b08b1
gcggttggtttcggcccgatattactgatacggtcatggcaccgttgttaagattcttgaatggaaccaaatcgttctttttcattgatgtttatccttatttagcatggtcagctaatccgaaaaacatcagtttagattttgctctctttagaagcagggtgaaccaaactgaccatggaagtcacttggtttacaccaatctattagaccaaatgctcgattcggtcattttcgcaatgagaaaactcggataccccgatatccgacttgctatagccgaaaccgggtggccaaccataggtgatatcgatcaagtaggtgctaatatcaacaatgcagccacttataaccgaaaactagtccaaaaaatgactgctaaaccaccattagggacaccagctagacctgggtcagtcacaccaacatttattttctccttatatgatgaaaaccaaaagacaggtccaacaccgaaagacatggggct

SEQ ID NO: 12892 - DNA, 124 bp, Gossypium hirsutum
  Clone ID: uC-gsflmaxxa070b11b1
tgctttaccggcaccaccgtcatctaaaaacatagtagacacttttaaatgatccgttcgcttcgtctctgacggaggagccgccttcgtatgtgcaaatgtcagacatagagaagaagcacaa

SEQ ID NO: 12893 - DNA, 275 bp, Gossypium hirsutum
  Clone ID: uC-gsflmaxxa070c03b1
caactttttccttttggcagttaagtgaaacgatgccgtaggactttaggggtggcgaagatgactttgacaagttcgacgaattcgatccgacgccttacggtggtggatacaatctctaactaacttatgagtcgtcctttggaatccctctgatgagacttgttacccttccgatacaccctcagatggcgactttgattacgcacgcctcgatttctcctttggttactcgcacttagtttatgtcgactaaagccactctaaactgtata

SEQ ID NO: 12894 - DNA, 352 bp, Gossypium hirsutum
  Clone ID: uC-gsflmaxxa070c04b1
caaaattgtatgacaatcctaaactcttagatttcattgagaaactagaggcagcttgtattgcaactgtggaatctggaaagatgaccaaagatcttgcactaatcattcacggctctaagcttgctagggacacgtacctgaatactgaggagttcattgatgctgttgcagcagatctaaaagcaagactttgttaagtataaatttgaacatggctgaaaatggaaggggatgggtttgtggtctcgcaggcaatatctttataatccatagcccggacgcggcggcgacggcaacctataggagtccttaaacctctccggtgcctcgggaaggagtatcttttcct

SEQ ID NO: 12895 - DNA, 489 bp, Gossypium hirsutum
  Clone ID: uC-gsflmaxxa070c05b1
ttaacgctttcttcatctcactgcatttgcttctctgcaaacgcttaaaaaaaagtcatctgattaacgctttatctgatgattgatttgctatggattttcattcctgctgctagctttgatacggatctgctgtgctctcagtttcacgagatctcctcactgttaaactcgctttgattgccaatggcgttgaagcgggggctatccagtgttggcgtccacaggaacagaagttctgaatctcgattccctatcgtgattctcgttctcttctcagttctcgctccgcttgttttctttgtcggtcgtggactgtatatatctgatcaaaataatgttcaaagtggctataccaagcagaatgttgactgcagggaaaggctggcattgcaatctatcaaaaaccttttcactaaagaggttattgatgttgtaactacaagcacaggtgatctggggccgctaaggctagattctttcagaaaa

SEQ ID NO: 12896 - DNA, 382 bp, Gossypium hirsutum
  Clone ID: uC-gsflmaxxa070c06b1
aagcctttattgacatagcttacaggatgccagaagacggggggtactttttgttttatagggaatctttcatggccaacctcagataggggcctaaaggatgcatttgagaagtttggaaatcttatcgaggctaaggttgctgtcgacaagatttctggacgttctcgtggatttggatttatctcttttgatgagaaagcggccatggaagaagctattgaagcaatgaatggaatggacttggatgggcggaatataacagttgatagagctaaccctcaacatgggtctgggagagattatgatggtgaccgtaaccggggacgtgatcgtgaccatgaccgtaaccggggctatgatggcgggcgtggatctaatg

SEQ ID NO: 12897 - DNA, 505 bp, Gossypium hirsutum
  Clone ID: uC-gsflmaxxa070c07b1
ctaagtttgaatgtgttaaagtttttgcggataatgaagagctttgtagcaatctttttcgccatcctgctgtttttggcaaccatggaagctgatggaaaacgaatgaccctggagaaggagcgcgagccaagtaatcatcagctgggtcgaaaggccgacatcggagctaaagacgatatagatctaacgggagaagatggttctgctatagaattgatcgcttccaagaatagacttatcgattcacgtcaccatatctacatgaacgataccagccctatcccccgcaagcatccgtgacactgataagcttgctagttgtttacagcttggtttgagctttacggaatatggtgtgcctaagaataaaactggaaattaacatgttagtaaaaccctaagcatatatatacacatatatgcatatgaagttatgaacatgttaagtttccatttccataacataatcagtgtgttcagtttagttatataaacaatatct

SEQ ID NO: 12898 - DNA, 347 bp, Gossypium hirsutum
  Clone ID: uC-gsflmaxxa070d07b1
atttaattttcatttagtctttaatttcaaccttttggtctattttcattttctttctcttccttggttcccgatcctcatcctggatcgccagtctttgatccctcgaagaatcgattaattggcggcggcggcggtggttacacttgtggtggcggatttgaagttggtctttgttggtggaaaacaaaagagagacacattaataaaattcgctcacttttattcatattatttcattttggggaggttaaggtttttgactaataactggaccaatacaaccttttgtcctttgaattatcttctagatagttaccaaagcgttgctggtctcttaggctcgc

SEQ ID NO: 12899 - DNA, 126 bp, Gossypium hirsutum
  Clone ID: uC-gsflmaxxa070e02b1
cccactctttcgctctctcctgcttcctttcacagttggacaactgttgactctctttctcacatttttgcttcaatcattaccgctcctcatcatgaagctcgtcaggtttttgatgaagtttaa

SEQ ID NO: 12900 - DNA, 424 bp, Gossypium hirsutum
  Clone ID: uC-gsflmaxxa070e03b1
agagatcattagcaaatgatgtcttttcttgctaaggccatgcaaagtccaggtttcttaagccagcttgtacagcaacagaatgaaagcaacagacaccttactggtggaaacaaaaagaggagactctcagactggatgaagaaaatttaaccggtgaacatggtaccatatttcctaatagacggattgtaaaatttcagccttcattgaatgaggcagcgaaagcaatgttgcaccagatattgaagatgaacacatcacctaggttggaaccttcgatagataaccccgatactttcatgattgatggtattcctccttccaatgcattagacagcaggagctgcttcagtcgaatttctggagtgacacttgtagaagttccaccagtttctggacagtcttatttgcaagcagaatc

SEQ ID NO: 12901 - DNA, 511 bp, Gossypium hirsutum
  Clone ID: uC-gsflmaxxa070e05b1
tgctgatgtgataaccatccagaactcaccttcagatggggagcttcttacagtattccgggaaggagtgaagtatggagctggaatcggccctggtgtgtatgacatccactctcccataataccatcaaccgaagagattgctgaccgaattaacaagatgcttgctgtgcttgagaccaacatcttgtgggttaacccagactgtggtctcaagactcgcaagtatgccgaggtgaagccagccctgaacaacatggttgcagcggccaagctgctccgcacccaacttgcgagtgccaagcgagaggcatatctgaggtcggacatcatcctttatatcgaagatggtccagaggaaatttgtcttaaatcatttgaataactgtgtgttgggagtatttgttaggcgtatcatatgcccctcttttaggccaattggtttcctttctcttttttgggtatttaccctctaaattttgtattttcgggatatatgaattgccttcaa

SEQ ID NO: 12902 - DNA, 374 bp, Gossypium hirsutum
  Clone ID: uC-gsflmaxxa070e07b1
gttctttgtgcctcttggcggatcgtttcctccatggagcagaaagaggaaggacgtggcaacgccgaccacgtctctgtcatccgtgagtacagggccaagatcgaggccgaattgtccgagatttgcgcccgaattttgaagcttctcgacgagaagctcgttccggccgccgggaccggtgattccaaggtcttttacctgaagatgaagggagattaccataggtacttggctgagttcaagactggcgatgacaggaaagcggctgccgagaatacgctcactgcgtataaatctgctcaggacattgcgaatgctgagctggtcccaacttattctatttgattaggattggctctatcttttctgtc

SEQ ID NO: 12903 - DNA, 453 bp, Gossypium hirsutum
  Clone ID: uC-gsflmaxxa070e08b1
cttttcctcgtcgtgctttccaacagatttttcccttggtttttactcttttttttttttttttttttgcctttattcctgcaacacgcgtacgacaaattataactataagtcccaccgccatgaaatcacgccgcttgctaagcttcctccttaaccatctcatttcccccgattaaactaatctattaagctggtttttttttctttgctttgtaagaaaaactgaaggcgcttcttgtttcacacacactcccttcttcattgctttaacaacaaagtcaatgctcctcactgctttggttttctctttggatctgagtttctgcacttttactttcagttttctacaagagctgaacaagtggttgctgttggctgtttcggccaatctttgaatctgattaaaatatcaaaagcctaatatgccttaagacaggctaagaacaattg

SEQ ID NO: 12904 - DNA, 372 bp, Gossypium hirsutum
  Clone ID: uC-gsflmaxxa070e10b1
atttttccaaacccgagtcaggagagggacagcagggatgagttaagttcatatgatatgtactctgtaatttatgttgcaggttgtacttttacgtacatgcaacgtgggctggtgtagaaggttccttttattttattttttttttatttttacatttatcagtacttggagttgaaattttacattccaatattattatcattcggacatgaatttggttttgtttggtttggtttcaatgttgtaatgctaaattcgagtttattgaatgttaattcagtcctgttttgaacttcttgtcatttgccaaatgaatctgaaggtacttaaagctccaatttaaaaaatcttatcagatatctatttctt

SEQ ID NO: 12905 - DNA, 350 bp, Gossypium hirsutum
  Clone ID: uC-gsflmaxxa070e11b1
ctggtctcgtgggcggacgcgtggggacgtgttggggggcttattacacatcggcataggtagcagcgccaaagacacttgctgccctgtactacaagggctgatggatttagactccaccatcttgcttctgtactactatcatggccatacttttgaatatcaacattataatccccatagctgttaccgtcctgatcgactgtgcctaaactccaccttcagggtttcaatgtccagcacactgatgactatcattaaaaccccctgctttttttccttcgatatcacaaagtattatcattgccttaattatatgtctctctttcatcttttattgtttttctcct

SEQ ID NO: 12906 - DNA, 426 bp, Gossypium hirsutum
  Clone ID: uC-gsflmaxxa070g02b1
gcccacgcgtccggtagaaaattagaagtggataattttctctttcatttccccaatcttatataacccccctggccagtgtccgctctcttcttatcacaaaacatataacaagatcaagattaagaaaaacgctgcttgcaggtatgtcatcatccgataagccagaattagttgaaagggatgttaaggacaaggtggatgacaaagaagacaacagtggatttatagacaaggtcaagggtttcattcatgacattggtgagaagatcgaggaaacaatcggcttggcaagcctactgcagatgtagctgagattcacctcccttgtatcaatcttgagaaagcagaaactgtcgctgatgtcctcataaagaacccaaaccctgttccaatccccctcgtcgacatttgactacctcattg

SEQ ID NO: 12907 - DNA, 532 bp, Gossypium hirsutum
  Clone ID: uC-gsflmaxxa070g03b1
caagatctttattctcaaattgtagcgcccttttatatgggcaatttttctggtcttgcatgctggaaaaacaaacaaaaatgcctttaaggcactcattgctgcagaatatagtggtgcgcaagtcaaaatttttgacaattttgagatgggtgtgtcaaataagactcctgagttcatcaagatgaaccctttggggaaggttcctgtgttggaaacacctgagggtcctgcatttgagagcaatgccattgctcattatgttgctcgctcaaaggttaacaaccctatatgtggccctacattgattgattatggtcatatcgagcaatggattgattttcgaagccatggaaattgatgctattatgccaaatggttggttccaagacttggttacgggtgttacctttctccactgaagaagctgctttggttcattgaaagagcccttggtgctttgaacactatttgtttcaacacatttttgttgacattttgccacccttgctgccttatcatgacatgtaac

SEQ ID NO: 12908 - DNA, 364 bp, Gossypium hirsutum
  Clone ID: uC-gsflmaxxa070g04b1
ggatcttcttgaatggggccaacatttggagcaacgatgagggtcattgcaaaaggcagcccatcttgccctgaaatcattaggattgcctaatgcaattgatggaacatatgtgggaagcattcactcggagctgatcttggccgctgcagattccgccgagaccgctgacgcttagttgcaagggtcatagttgctaaactgctatggagataggaggaattggaataatgcgcagtcattggtaggatttggaataatctcctgtaacttagtagcaaaaccttagcattttgtagcttgctgttcttctccttgcatgccttttaattttgagttctgttctctttattctttggcttct

SEQ ID NO: 12909 - DNA, 335 bp, Gossypium hirsutum
  Clone ID: uC-gsflmaxxa070g07b1
cttatttctttctcccgatgaacaaacgctcctttgtgggtagatttagagtttattgccactcaactcaccactatttgatctgaccttggttatttctgcttcatttttttctcttttaaatattctttgtatttttctttgaagcttctttccaacggagaaatagatagaagagagagggagagccagagagagtcgactgagaaagttttgctgtatgtcagttgattgtattgagacttactgcggtggatttggctagcttgtaaaccctttttcatggccttagcttataaaatgacctctcttcatttctttttatttcttttccc

SEQ ID NO: 12910 - DNA, 500 bp, Gossypium hirsutum
  Clone ID: uC-gsflmaxxa070g10b1
gttggtttttgtttttatacagtagaagcaccatttgggcaatcatagcaagagagagtgttttttggttagaagaaaaagagaggaaagacaatgtcaggtcctcagtgctgttcgaacccgccaatatttggaccctgcaagtggagctggtcatgttgagaaacttgctggcttcaacacttatgtttctggttctattcaatccaaccttactattcttcttgtctctgatatttacggatatgaggctccaaacttgagaaagctcgcagacaaggttgcagctgctgggttctatgtggtggctcctgacttcttttatggagaaccctttgtccgtgataaacctgatagaccttttcctgcttggataaaggatcatggaccggataaaggctttgaggatgcaaagctcataattgatgcctttgaaagtaaaggggtttcatcaattgagctgctgggttctgcttgggtgctaaagttgtggttgaact

SEQ ID NO: 12911 - DNA, 226 bp, Gossypium hirsutum
  Clone ID: uC-gsflmaxxa070h02b1
gcaaatccttacaattccattttgaagactttggagaagccgcaggtttttgaattcggcaaaccactattctccacctgctctcaatgatccaaggatcgataaacttccttactctattaaaatactttttgaattcccaatccgtaactgcgatgagtttcaagttaagagtgaggatgttgagaacatcattctattgggagaacacatctccctaaacaag

SEQ ID NO: 12912 - DNA, 324 bp, Gossypium hirsutum
  Clone ID: uC-gsflmaxxa070h05b1
gcttattcttggcttatcagctctggtcactggcggtgcttgcggtattggtaaagctttgtgcttagctctggctgcgaaagggatatttgtgacaattgtagatttctcggaagagaaagggaaggaagttgcttctttagctgagatagagaattccaaattccatcaaaatttaggctttccttctgctatttttgttaaatgcgacgttactagcttaagagatttaaatctagcatttgagaagcctgcctccacatactggtggactggatatctgcatcaataactgcttgcattgtttatcacgcacttttctgg

SEQ ID NO: 12913 - DNA, 167 bp, Gossypium hirsutum
  Clone ID: uC-gsflmaxxa070h08b1
cttaatatctcaaacccagatttgttctctctctgtgtgtctctcttcaatcaattaattcctccattggaggagcttagggtttgttggtgctctgatctttgctctgcctgaaaaataaacataattataccccaccaccaactccatgtcaagatcctaagagg

SEQ ID NO: 12914 - DNA, 365 bp, Gossypium hirsutum
  unsure (1)..(365): unsure at all n locations
  Clone ID: uC-gsflmaxxa070h09b1
tttactcttccgcccacgcgtccgcaggatttaagcgggggattattaccgaaggaaggcaccttcaggcaggtcagctagcacagggagataccggtcttggaatcaatcagcgaccttttttcaaccaangcagttcatttgacatcccggagttcttgaagaagaaaggacgttcacgctatccgagagcttaaatacttctctgcatagcgtctcggttcctgcttggttcccttgtggttctcttttacgtttcttccgttctgggctattaacgtgtacagaatatagcatgttagtaagtgggtccataacaactattcgttgccttctttcaataagttgggagtacaatttcttga

SEQ ID NO: 12915 - DNA, 503 bp, Gossypium hirsutum
  Clone ID: uC-gsflmaxxa070h11b1
aatcattgttggcagctacaaacccaacagaggagcatgtgcactccacttttgcttctagatatgttcgcgctcctgttccaaggttcaagatgccggagaagtcgattccaaaggacgcggcgtatcaagtaatacatgatgagcttatgctggatggaaatccgaggttgaacttggcttcatttgttacaacatggatggaacctgagtgtgataagcttatgatggctgcaattaataagaactatgttgacatggatgaataccctgtcaccactgaactccagaatcgatgtgtaaacatgattgcaaacctgttccatgctccggtcggggaagaagagacagcagtaggtgtgggaacagctggttcctctgaggctataatgctggctggattagctcttaaaaggaggtggcaacataagagaaaaacagagggaaagcccactgataatcccaacatagtcacgggagctaacgtgcaggtttgctgggag

SEQ ID NO: 12916 - DNA, 470 bp, Gossypium hirsutum
  Clone ID: uC-gsflmaxxa076a02b1
tatgtattcaggtattctacttcaaggcccgatgaacgtgttgatgtaatgtttggaaacatcaagcatgccttcttccagccagcagagcgagaaatgatcactctggtgcactttcatttacataatcacatcatggttggtaataagaaaaccaaggatgtgcagttttatatagaggtgatggatatagttcagacattgggcggtgggaagagatctgcctatgaccctgatgagattgaggaagagcaacgcgagcgtgaccgaaagaataaaattaacacggacttccagaactttgtgaatcgggttaatgatttgtggggacagcctcaatttaaagcatttgaccttgaatttgatcagcccatgagagagcttggcttccatgggggttccccataaagcctttgctttcattgtgccaacattaaactgcctggttgagctaatagagacctcctttt

SEQ ID NO: 12917 - DNA, 609 bp, Gossypium hirsutum
  Clone ID: uC-gsflmaxxa076a05b1
attttccagtctttcaattctataacatggctccagtgcctagtttaccaattaaagttggacatattgatgatgtccaagaactaagaaaagctaaaccagccacggttcctgaaagatttatcagagacatggctgataggccaaaagttgttccaaatctatcatcatctcttgacattcccatcattgatctttctaagctcatgaaaacagacaaagatgaagttatgcagctcaaaactgcctgtgaagaatggggatttttccaggtactgaaccatgggattgatctgaatgttgttgaagacatcgaaaaagtagccgaggatttcttcatgttacctttacaggagaaacaaaagtatccaatggctccagggacagttcagggctatggtcaagcttttgtgttctcagagaaccaaaagttggattggtgcaatatgtttgctcttggtgttgagccaccttgtataaggaacccaaaactctggccatcaaaacccgttaacttagagaagcttagaaattattcagagagtgaggaaacttgcagacactctgagtattagcatgagcctggactaaaggatgtttgagaatgtc

SEQ ID NO: 12918 - DNA, 520 bp, Gossypium hirsutum
  Clone ID: uC-gsflmaxxa076a06b1
catttagctatcatggctgttggagcatcaaagccaactgttgtagctgatgctgagggattcttcagcgtgaaaaacaaaatgctggtgagtcccgtttctattatggagccaattacaatcccttgtagataaagctttcgttcgaactttatagaaaatttatgagataggataaattattacaaatctatcatgaaccaatatactcatttattgttaatgctttaaggtatcatgtagtgactgaaagcagactacatttatgatttttactaatataacagtaaaaagatgccgggatctgaggctatctaaaaaaagtacaatttaggtacaagctatgttactcgaactcttcactatttttcaagtacctgttgtctggcacatgaatatagacgaactccaataatcccccaaatacatggaaaaacttagaaaagactaaccttacttgtgtcgagtacatacttgtatctaacactcatacctgagtccaagcacatagggcacaagt

SEQ ID NO: 12919 - DNA, 594 bp, Gossypium hirsutum
  unsure (1)..(594): unsure at all n locations
  Clone ID: uC-gsflmaxxa076b01b1
ctgtgatcaggaaattgcacctgaccacacagtaaagttagatcgtgtgggagctgatatacaaattgttcgaaggcatggaagcagctttcgtcgtttgacgctgattggctctgacggctctcaaaggcatttcattgtccagacatctttgactcctaatgctagaagtgatgagcggatattgcagctcttccgtgtaatgaaccagatgtttgataagcacaaggagtcccgacgtcgtcatatatgcatccacacacccattataattcctgtttggtcgcaggtgcgcatggttgaagacgatttgatgtacagcacattccttgaggtgtatgaaaatcattgtgcaagaaatgaccgagaggagatcgtccaatcacctacttcaaggagcaattaaaccaggctatattggggcaaatctcccctgaagcttggtagatctncgcttacatgcatataatgatataacaaaaaatcttgtacagatgtatcttttccagtacatgtacaagaccctgccagtggcaatatatatggcttcaaaagcatttgcatccagtagctctgcgagttcatgctttatgt

SEQ ID NO: 12920 - DNA, 531 bp, Gossypium hirsutum
  Clone ID: uC-gsflmaxxa076b02b1
tttttgatgtctctcttcttaccattgaagagggtatatttgaagtgaaagccactgctggtgacactcatcttggaggtgaagattttgataacagaatggtgaaccactttgtgcaagagtttaaaagaaagaacaagaaggacattagtggtaatcccagggctcttaggaggttgaggactgcttgtgaaagggcgaagagaactttatcatccactgctcaaacaaccatcgaaattgactccttgtatgagggtatcgatttttactctaccattacccgtgccaggtttgaagaacttaacatggatctattcaggaagtgtatggaaccagttgagaaatgtttgagggatgctaagatggacaagagcactgtcatgatgttgttcttgttggtggttccactagaattccaaaggtccaacaactttacaagatttcttcaatgggaaggagctttgcatgagcatcaaccctgatgaggccgtgatacggtgctgcagtccagctgctatatgagtggga

SEQ ID NO: 12921 - DNA, 500 bp, Gossypium hirsutum
  Clone ID: uC-gsflmaxxa076b05b1
cggacgcgtgggagaaaaacaaagttagctactgaaatgcctgcaggttaaacttttacctctccaccattagttttaaactatgcacagttaaaacacagtttaaacacataaagttgtaaattctgaatctgataggtgctgtgtggagctgggaaaaggctaataatttttgcatttactaggacaaaggtacatcatgttgatagttttcatgcatgcaaactgatacaatgatgttttgtaatctgtctcctctctatatatacacccaaagagcataaccaaaaaggtaaaaaagaccttccttactattggaagaacgatctttgcttacagtacatggggttttcatttgttacttttttcagtctggatcttccactgtaagtgtatagtactgagaaccgtaaacgagtttgagaggtccaaaattttggttcctgcttggttccgtttgaaggcacaatttgagagttccatcttcggatgatgccttg

SEQ ID NO: 12922 - DNA, 523 bp, Gossypium hirsutum
  Clone ID: uC-gsflmaxxa076b06b1
ctatcttctctgttggcttggtctcacttgtaaggtgttgtttgtttccatattgcagagaagaacttgaagaagaaaaagtatggcctttactacccttagactccctccttatccaaagcttgttaccaacaacaggtttagcggcatctttgcttctcaatttcattcttccgctttaccatcaagattggtgcttggtagttcctcttcctgtgtgggaactcttagcttaagcatcaatcatcatagctcacgatggtcctctactactttcacatgcttttctcagacatcagagctctccgtttcagttgatacatatggcaataacattattggtggaggcggaagagaacacgctctttgctatgcattgcagcggtcgccgtcttgcgatgctgtcttctgtgcaccaggcaacgcggggatttccacctcggggaatgcaacctgtattcctgaccttgacatctttgatagcttagctgtgatttcttttgcagcaatggggtgttgttgg

SEQ ID NO: 12923 - DNA, 514 bp, Gossypium hirsutum
  unsure (1)..(514): unsure at all n locations
  Clone ID: uC-gsflmaxxa076b07b1
ttcacgcgtccgagaagctgaaatagtgtgctgcccctttgctaccacttcgcctccgctactctgccatccaactggtacatgaagcaaccttttttccagtgctcaaccattgttagctaaagctgctaaaggtgtctttgattacggatattagatatgtttaacattgcaacgaccttctgcaaaaggataagcgtgaaggagctagttaccagcgctcctgtgtttggcacaatcacggatggatcttcttctggcttaagtttgatgcttaggcggtgggctagtaaaaaaactgctggatcaactaagaatggaagagattcaaaacccaagaatcttgggtgaaagaagtcttggtggcgagagggtgattcctggaaacattataggttcgtcaacgaggaaacacgtttccatcctggaaactatgtnnggatgggaaaaagatcatactctctatgccctaaaggaggctgtgtgaaatttgagacgcatagcttagcggcgc

SEQ ID NO: 12924 - DNA, 451 bp, Gossypium hirsutum
  Clone ID: uC-gsflmaxxa076b12b1
tattccgttgcaagacaatcctgcatactcagttgttaagcaatattttgtccatgtagatgacaccgttcctcaaaagattgttgttcacaagaatagtccaagaggagtacatttccgacgggctggaccacgtcaaaagatatttttcgactctgatgacgttcatgcctgtattgtaacgtgtggtggtctttgccctggactcaacaccgtgattagagagatagtatgcggcttgttccacatgtatggtgtgaggaaagtttcggggatagatggaggataccggggcttttatgctaaaaatactgtgcatttagatcccaaggttgtcaatgatatccataaacgtggtggaactattcttggcacatcacgaggtggccatgatacctttaagattgttgacagcattcaggatcggggaattaatcaggtttacattatt

SEQ ID NO: 12925 - DNA, 483 bp, Gossypium hirsutum
  unsure (1)..(483): unsure at all n locations
  Clone ID: uC-gsflmaxxa076c12b1
tataaagaagatcagctaccggaaaatgtctacgtcaccgtccgtcaccgaactccaggtggagaactttacgttccctccgacggtgaagcctcctggttccaccaaaactctgttccttggtggcgcaggggagagaggattggaaatccaagggaagttcataaagttcaccgcaattggagtttacctggaagatagcgccgtgaattgcctcggcgttaagtggaagggtaagagcgcggtggagttaacggaatccgttgagtttttcagagacgtcgttacaggtgattttgagaagttcgtacgggtgacaatgatattgccattaacgggtcaacaatactctgagaaagtatcagagaattgcgttgctatttggaaatctcttggaatctacactgatgcagaagcaaaagccattgaacaattattgaagtcttaaggatgaaaacttncacctggctcttccattctttt

SEQ ID NO: 12926 - DNA, 612 bp, Gossypium hirsutum
  Clone ID: uC-gsflmaxxa076d02b1
tgtacgcgtccgcccacgcgtccgtccccatctacagggtttacaaagggattgagacagctgtaaccaatggctcccaaggttgagaagaaggcagatgcaaaagcacaggccttgaaggctgcgaaagcagtgaaatctggagccacttttaagaagaaggccaagaagatccgaacaaaggttacgtttcacaggccaaggaccttgaagaaagataggaacccgaagtatccgcgcattagtgccccaccgaggaacaagcttgaccattaccagattctcaagtttcccctcacaactgagtcagccatgaagaagattgaggacaataacactttagtatttattgttgacattccgtgcagacaagaagaagatcaaagatgctgtgaagaagatgtatgatattcaggccaagaaagtgaacaccttgatcaggcccgatggcacaaagaaagcatatgttaggttgacgccggattacgatgcttggatgttgcaacaaaatcggaatatctagcagttggcgatacctgtttgaagcttattttttggtttgtgcagggagactgtattcagatcagctgaaattagctagttttggtttta

SEQ ID NO: 12927 - DNA, 504 bp, Gossypium hirsutum
  Clone ID: uC-gsflmaxxa076d04b1
ttctctctttttcttggtttttctttccacctgtttcttacttatcaaaaacaaaaatttataaagaacaaaacaagaaatcacctccttttaaagctttgaaagatgattttttggtaggaaacagattgtaaatacccaaaaaaaaaaagggaagaaatgaatggggataggttcaaaaactgttttcttccgacgccggcgggttcttcatcaacggcgatcaagcttttgatgattacagttccattgattcttgtttcgttcgtcattttcgttttggttccaaggaattcaaggtattgggtcttctgtttctccttctggaaatagcagtactgggaatttcggtgcagttagtgaaagaagtatcaacggcggcggaagcggtggctgtgtcgggtgaggcgacgcttaatcggtcaactaataagtcacttgatgttgaagctcaagtcatggaaattcacgaatttgatgaaacaaggaagctagcttaaatta

SEQ ID NO: 12928 - DNA, 558 bp, Gossypium hirsutum
  Clone ID: uC-gsflmaxxa076d05b1
ttcacgcgtccgcccacgcgtccgcccacgcgtccgatcgaatcgaaacccctcaagttttgttccaatttgtctaaatcggtgaaaaagattaacaatgcctgcaattgccgatcgcagttcgtctcctttcaaggcaatgttggcagccaagagctgcgagctggctggatccggcggctgctgcactcctcagaaacggaggttaaggtccgatacggcattggcggccaaagagagtccggtttcaacgcctatgaaactcaaatcgccacgacgtcgtctagattcaagtccaagcagccctgcaaataggattaagaaagatccgagtgaaaaaacattgaagaaatgttggaatccgagagatgttgagcaaatgagggatgtgaaggaggctgtacatgtttcaacagctccatcaactgttgtgtgccgagaagatgagcaaaaagggttttggatttttgcaaggcatgtgtccaacagagaagctggagctgttgtatgggatgcctggactgggaatcatatcatggagtgtaaacagagtatgat

SEQ ID NO: 12929 - DNA, 742 bp, Gossypium hirsutum
  Clone ID: uC-gsflmaxxa076d08b1
cccacgcgtccgatagaataaaaaaagttaatttataaattatatagtaacataataaataatgacgtcgttgttttggagaggtcttattatattacctcttctttttgtatatgtcaacggcgagcattttttgtaccctaaacgtcatactggcaaagccgagttagccggttacaaggggccagactctcttgccgtcgacggtggtggtttctatagcggccccttgattgccgatgacgatggatctactgctgacggcaatcctggtggaactaccgtggcgaaggttgaaaaccttggattgctccactgctttttattacttatgtttgcgcgaatttgtgcttttatctatttaggtttcttgcttccttgttcttgtccttttttatatttttagctgtttatctcttacttttaaaggatatttttctctttctgatgttcccttatttttcttttcttttttttttatctcttctctctattctctttttctttttattccttatccctttttttttctttttattcttatttttcctctctattatctttttttcctattcttcttcctttttttttatcttctctttcttactttcttctttttcattcttttccccttttcttctttcctttttttcctttcttttctttctttcttttcttcctttctcttttttcctcttttctctatctttcttcttttttttcatctttttcttttctctct

SEQ ID NO: 12930 - DNA, 464 bp, Gossypium hirsutum
  Clone ID: uC-gsflmaxxa076d10b1
cttcctctccgcgatgtcagccgcttggtagacaggagaaacatgaagaccattctttcttccgagacgatggacatccccgatggggttagcgtcaaaataaaagccaaggttatcgaagttgagggtcccaggggtaagcttatccgcgacttcaagcacctcaacctcgacttccatctcattaaggacgaggagaccggcaagcgtaagctcaggattgaggcttggttcggctccaggaagactagcgccgccatccgcaccgctctcagccacgtcgagaacctcatcaccggcgtcaccaaaggataccgtcacaaaatgaggttcgtctatgctcactttcccatcaacgcctccatcactaacgccaacaagtccatcgagatccgtaatttccttggcgagaagaaggtgcgcaaggtggatatgttggaaggggtttcctagttcgatctgag

SEQ ID NO: 12931 - DNA, 595 bp, Gossypium hirsutum
  Clone ID: uC-gsflmaxxa076e03b1
ccctcgcgtccgcccacgcgtccgcggacgcgtgggtttccattgaagcatttcctctataggtttttactttttaatcccttttcctcatttttgcaacaactttttttttccattgcacatataatttaagaggaaaatgactttcagtggaacaacagagaaatgcaaggcttgtgataagactgttcatgttattgatttattaacagctgatggcatttcttatcataagacttgcttcaaatgtagtcattgccatggtgtgtctgctgactgggaaactattgctcaatggatagtgtcctgtattgcaagccacactttgagcaacttttcaaggaaactggcacttaccaaaataagaatgcaaaaccctcctctgaaaattcgaatggaacgggaaaggctcctagcaaatttgcatcattcttctctggtacacagacaaatgtggtgcctgtaagaaaactgcataccccttaaagaggtgactattgaagagaaaactacataaatcatgcttaggtgttcacatgagttttgtgctacaccataacatatgctgattgaagattcttacttgagcatactt

SEQ ID NO: 12932 - DNA, 586 bp, Gossypium hirsutum
  Clone ID: uC-gsflmaxxa076e05b1
ttttccttgaaaagcttttcattgtgcttatatagtaaaaggttccaattggggtttgtttcacttatcaaaaacgtggctagccaaatgtctgcctaagatctctcttgcaaagttgaaacccatgtggaatttttgttttggataagccaagacctacaattgagtggaaaatagcagtgaatatctgtcattggcttagttaactatacatgaggaaataattcactgccataacagttttttgtttagactgctaagtgaatccgtagagctctcggcagagcagaaacatttcggatcattacatgtcatgcaagtaaccaccagctttagatacatcaactcattgattcctttttgtttgcgtatatatatatgtgtgtacaaactcattggtgtctcatccaaatctattctcttctgaaaatatcctattcctttggaactctctctctctctcccacatttttctcctcctttcttccctcttctctcattcatttctctacttctctccgccatggtttcgcaccttgtcaccactatccgaatgtagttggaatcacaaggaatgaatctccct

SEQ ID NO: 12933 - DNA, 585 bp, Gossypium hirsutum
  Clone ID: uC-gsflmaxxa076e06b1
ttattgaaaggtccaccaaccttgattggtacaagggtccaactcttctcgaggctcttgaccagatcaatgagcccaagagaccctctgacaagccactccgtcttccacttcaggatgtgtacaagattggaggtattggaactgtcccagtgggtcgtgttgaaactggtatcctcaagcctggtatggttgtaacctttggtccctctggattgaccaccgaagttaagtctgttgagatgcaccatgagtctcttcctgaggctcttccaggtgacaatgttggcttcaatgtcaagaatgttgctgtgaaggatctgaagcgaggatatgttgcttcgaactcaaaggatgatcctgccaaggaggcagctaatttcacttcccaagtcatcatcatgaaccacccagggcagattggaaatggatatgcgcctgtccttgattgccacacgtcccacattgcggtcaagtttgcagagttggtgaccaagatgcaggcgtcttaggagttgagaggaaccccgttcttgagatgggatcagattgtagagatccaccaaccatgtgtgaacctcttga

SEQ ID NO: 12934 - DNA, 504 bp, Gossypium hirsutum
  Clone ID: uC-gsflmaxxa076e07b1
ttttcttgatacacgcccccatttattttatttttcaaacaaattttcccttcaattttcgtataatttcctaggaaaagaaatatgagagagtgcatttcagttcacatcggtcaggccggtattcaggtcggaaatgcttgctgggaactttactgtctcgagcatggcattcagcctgatggccaaatgccaagtgataagactgttggtggaggagacgatgctttcaacacctttttcagcgaaactggtgccgggaagcacgtccctcgcgccatctttgttgatctggagcctactgttatcgatgaagtgaggactggtacgtaccgccagttattccaccctgagcaactcatcagtggcaaagaagatgctgccaacaatttcgctcgtggccattatacaattggcaaagagattgttgatctctgcttggatcgtatccgaaagcttgctgataactgtactgggctccaaggcttcttggttttcaatgct

SEQ ID NO: 12935 - DNA, 789 bp, Gossypium hirsutum
  unsure (1)..(789): unsure at all n locations
  Clone ID: uC-gsflmaxxa076e10b1
tccacgcgtccgatttttatgtttttggtcattttctgtctgggatttccagcttttaagtgcagtctcggtttaattatgaaaactcaaacgaagaaaggaaaaatagggactttgattaattagaaaacgcatcttcttccccttcgctttcgactttcttttaggggttttaaacgaagaacacgagaatccacacggcaaattatggttgacagaagctatcaatgcaaaggtgtgctaatcttagcttatcagagttttggtgtactctttggtgacctaagtatttcaccactttatgtctttaaaagcacattctctgggaatttgagtaattatcaatctgaagatgtcattctttggggccctatctttgattttttggactttgacacttctttccttgttcaaacatgtcattattttgttaaatgccgatgattatggtgaagggggaatttttgttttgtattagttcctttgatggttctccagttttttttgttcctacattaaacattcatttagtgacttttattttaaaatttccctctttaccctatctcctattctgccagccatgcgcctcttactacacggtaaactcctnctttcttcttctcttcttcccctttcccttcttttcctccttccttttcgttttttttttattactcatatgtatttttataattagttattatattatatttccatnaacncgccccaccccccctaccacccccttcttttttctttattattttttcaatctttttttatttt

SEQ ID NO: 12936 - DNA, 626 bp, Gossypium hirsutum
  unsure (1)..(626): unsure at all n locations
  Clone ID: uC-gsflmaxxa076e11b1
tgttatagttcgcacaattccaactggtggcagaattcgaatcagctcaacgttgccaaataggctggggaagatgctttcaccattgcactggcatgattacaagaaaaagtacggaaaactggatgactttgtagctagccaccctacgttatttgtaattgagggtgactatatttggcttcaagagggagcacaggagatgatagcagcaactgcagctattgctaaagttgctgcagctgctgaagctccatcttcatactcctttttgccttctgtttctgttacaccgattgcacagcgtaatcggctaaagaaggcgcttcgatcaattgattcctatcatgtgagagagaatgcccttttcaaggagcatgcaggcatcactaaaaatgcttctaatggacagcagttagtaatgcaaaatcaacatcccaatggatttgtgtcgatgtgccagaggtttctccaatgtaaaaatattgagccaattaaagatccngtgtgactagtgttgaagcatggcatctggactggaagtctattaaatgtgtcggacagcgagcaggacaacgagctgatatctcagagataggaggcttacctactgttatgccactgat

SEQ ID NO: 12937 - DNA, 422 bp, Gossypium hirsutum
  Clone ID: uC-gsflmaxxa076f01b1
ttttcctagagtctccctcaacttccacgcccttcaggccgagttggaatcccagatctagtgcctgataacacaccaacacctcggccgcaaaagcagacgccgcgtcaaaatttatcctcagtcatagccctgatggagcaacccatctggttgtatggattcttttgtcagatcaagaacaaagaaaatcgaacttagatcgagggaagtccaaaatagttgaatagtcgactcgtttccatctgaaattcgtacgagttatcttagctactcaaggctcggggatagtcgaagattgtcaccatactatcgaactcattttggtacttttgaaagtgtaaatatttttaagtatagcatgtataggatagaatgtctatttttttaagttttgatatgtttatatggtatgccatgga

SEQ ID NO: 12938 - DNA, 479 bp, Gossypium hirsutum
  Clone ID: uC-gsflmaxxa076f05b1
cctacgcgtccgccaaaatagcttcgattttttcttcttattttctgagaaaaatctccggaagaaaatgaaaccgacccgaacgaccgattttatcttgattcggactctctgtaaaccgacacatcaccctctcctccacctccgagtcgtcttcttgtttgttcccacctaaacacgaaagtacccacccgaaaagattgttgttttaaggtatttttttaacaaattttctttgttgctgaaacccaaaatgttgtcgtttcaatcgagcaagaacgtccttagcttaacagaagatctacttgtccggatctacgaattgctggccgctgagtcggatcggaaatcgtttcggctcgtttgcagagagttccgtcgaattgactcactgactcggaggcatcttcgggtaatacgaatcgagttcttgccgattcttcccgtaagtaccctcggttacaatccctcgacctctc

SEQ ID NO: 12939 - DNA, 587 bp, Gossypium hirsutum
  Clone ID: uC-gsflmaxxa076f11b1
tgtggaggttgcagcccacgaggcagatgcaaccgtactcgtaatggggcttgaccaatctatagaagcagaattcagggacagggtagggctgctcttgcctggacgccagcaagagcttgtttcccgagtggctcgagcttctagaggtccaaccgtgctggtcttgatgtcaggtggtcctatcgatgtctcattcgctaagaatgatcctcgagttagtgccattatatgggctggttatccaggccaagctggaggaactgcaattgcggatgttttattcggaacaaccaatccaggagggaagctgccaatgacatggtatcctcaagattatgtagctaaagtcccaatgacaaacatgggaatgaggccatcaagaggctaccctggaagaacctacagattctataaaggtccagtagtgttccctttcggacatggcctgagttatacaagttttaaacactctttagccttagctccaactgaactctaagacttttgacaccattttttgccaccaaaactactcacattgcagcatgccataggggaacatgccaaaggatcactttctcctt

SEQ ID NO: 12940 - DNA, 495 bp, Gossypium hirsutum
  Clone ID: uC-gsflmaxxa076g02b1
tatttctgcttcatcaaggtcaaattcccattaacgtccttctccctgttaaccgcctctgataacggccttccacttccttcctccgccgccaccccatcatccctcctcttctccccttccaattccttaagtacccattcttcctcccaccccaacccagagcttgaatcccactccgaacccgacttcgccaccatttttgcctcgcagcgcttctttttcacttctccgggcagctccaactccatcattgaatcaacaccgacgtcaaccgccgcgaatcaaacatcaaacaaagggcaccaccacacaaggtcgaccgttaaagacggtgtagcggtcccaactttgtcttcgaacccatatatggatttcaggcaatccatgcaggaaatggcggaggcacgtggcttaatggacgtcaaggccaactgggacaacttgcatgaactccttttgtgctaccttgctttgaaccccaaaagcactcac

SEQ ID NO: 12941 - DNA, 442 bp, Gossypium hirsutum
  Clone ID: uC-gsflmaxxa076h11b1
tacttttaaaaaccctaacccctcttccttttcccctcgctctcttttccttgccaccaaaaaacatctttctgttcaattcaatcctcctttttctattcaaccataatgtcttgcttcattagcaaatacgccgatgagttggctaaaaacgctgcttacattggcacccctggaaagggtatccttgctgctgatgaatccaccggcaccatcggcaagcgtctttcaagcattaatgtagtaaatattgaagaaaacaggcgtgctctccgtgagctcctcttcactgctccaggagctcttcagtacctcagtggtgttattctcttcgaggaaaccctttatcaaaaaaccgctttcgggcaagcccttcgttgatgttttgaggaaggtggtgtccttcctggcatcaaggcctccaaggttcccctgagcttaa

SEQ ID NO: 12942 - DNA, 415 bp, Gossypium hirsutum
  Clone ID: uC-gsflmaxxa088a01b1
ctttttcgtgcgcttgaacccctatatattgtagggggggatcttataatggaatattttgttgaccctatattatttatcttctccatgttctacgttgcaatgcctaataacctgactatgatcccagagcaaataacattgccacatccactttgcaggtcccaaatcgcgctggtgaactttgcatgtgcgatggtgcctgcacttccgatgccacaaccccctcctacgccggctgatgggaatgggcatagacaccggcgccggcgtggacacaggcacaggcatagacatgggagtcatgagacacctgaacagctgtactgctgagaatggttgaggcaaatggacacgtgatgtgtgtgcgagatactatatcacttaccgcctttcctttggaagcctaattata

SEQ ID NO: 12943 - DNA, 521 bp, Gossypium hirsutum
  Clone ID: uC-gsflmaxxa088a07b1
ggattgacccgctatgagtatgtttcttggattgttatgttttagtcacaatattactcatagtgataactatgtatatgatcctcaaactttagatcatcattgtcccaacatcatgagtcatattttgatacagtcaaaacatctaccgtagcaggttgcactataaagactaatgttggatatacgacaatccatgtagtcggatatagttgatcaatataggatttatctatgacaccccaaacccgactgagacggattagcctgaatctgaaacgacacaatagccaccaaagtgactctccaactcaagaccacccaaaatacgccccaaccttataacacctcaattctaactaattaactatctaatattaatgtggaagcgattttgtgaacccatttaaactaattctaattatttaaccctaaagttattttggttattttaccatctaaggttaaacaatcatgtttttagttctaaatgattaccaaccttctttagtcaatttata

SEQ ID NO: 12944 - DNA, 575 bp, Gossypium hirsutum
  unsure (1)..(575): unsure at all n locations
  Clone ID: uC-gsflmaxxa088a10b1
gccaacttcacctctcaggttatcatcatgaaccaccctggccaaattggaaatggttatgccccagtcctcgactgccacacctctcacattgctgtcaaattttccgaactgttgaccaagattgacagacgatctggcaaggaactcgagaaggaacccaagttcttgaagaacggtgatgcaggtatggtaaagatgattcccaccaaacccatggttgttgagactttctctgaatacccaccacttggacgttttgctgtccgtgacatgcgccagactgttgccgtcggtgtcatcaagagtgttgagaagaaggacccaactggtgctaaggtcaccaaatctgctgccaagaagaaatgagagattatttgagagagaattatatcagttttcattacagctttggacaattatcttaaatttggactttagaatttactttttgtgagactttntgatttgctttttaaacaaatcctangtttatatttcaatgttttccatttctgangtgttatatattatatcgatggcttccatagcgacagataattcacagcctttat

SEQ ID NO: 12945 - DNA, 365 bp, Gossypium hirsutum
  unsure (1)..(365): unsure at all n locations
  Clone ID: uC-gsflmaxxa088a11b1
tccacgcgtccgcaaaggatgctctaaagagtggggatgaggaagacatatacttgcccgacaccatagatgttgggagcagcagcagccaaccaaggtcaagcggatgcgaatgttgaaagatatcatgcatgttcattattttttcctgttccgccaataagtacggttaaaatgtttcgaatgatttggtgtttcccaaccattttatgggattcatggtgttggtgtgagagaaaaaaaaggtctgttaatgcttttggtttggctggatttagttctgtaatgttctcatttgtcaacattgttttttgttctgcactgcctacgcattgtttttaaagtacattctatggnaaaaaaaa

SEQ ID NO: 12946 - DNA, 412 bp, Gossypium hirsutum
  Clone ID: uC-gsflmaxxa088a12b1
gtgctcggaaggccctacaggatgatatgagccatttttcaagaaatttgaatggacaaagttcagatattgtgtggtcaggctctgcatggacatgtggtaaacacctcaaacatttcccagcattttgccgcagtgggaccacaatagcggttcaatcttttgtctttgtcatggctaaaggagagaatcactatcttgcttacttggaggatatgtacgaggacaaacgtgggcagaagaaggtcaaagtgaggtggtttcaccatactaaagaggttaagggtgtcattcctgtaaggaatcctcatccaaaagaagttttcatcactccttattcgcaggtcattagtgcagagtgtgttgatggtcttgcaagtgtcttaactcgagagcactatgagaaatgctt

SEQ ID NO: 12947 - DNA, 324 bp, Gossypium hirsutum
  Clone ID: uC-gsflmaxxa088b01b1
cggactcgtgggcaagctcaaggatgcattccatgcggattattgcgatccaaaaatctcatcttgtggaaggcctttcttggtttatccagctcctcctcctttctaaactctatgctttttaatttcatacgataaatagaaataatgggtgggattgtttgtctctttgatgggggattaccaaactttaattctattgttgctttgtactgcggtatgatgcttatattataataaagatatgctattaatctcaaaaaaaaaaaaaaaagaaaaaaaaaaaaaaaaaaataaaaaaaaaaatacggtgttaccaagaat

SEQ ID NO: 12948 - DNA, 541 bp, Gossypium hirsutum
  unsure (1)..(541): unsure at all n locations
  Clone ID: uC-gsflmaxxa088b03b1
aagaattttgctcctttccttcaaacggtgattcatgcggtacttgtccgttgaaagaccctaaacccatatcaccattccggaaaggcaattaagcaaccctccttacctactctaagtaacctttttgtctaattaacctttttgtctttttcacttcatttccaaactcacggtgttgcagtagtggagcaatggaaggcgaaggatttgttgccgcaagcaaagtgaacatctatgaaggccgtgtcaccgccttcgtcatctgcacttgcctcattgctgccagtggtggtctgctcttcggctatgacctgggtatctcaggtggggtcacatcaatggagccttttctgaacaagttcttccctagtgttttggaacaacagagtaaggcatcccaaaccgagaaccagtactgcaaattcgatagccaactactcactcttttcacttcttccctttaccttgctgctttggtcgccttcttctttgcctncattgttaccaggatctttggccgcataatttcatgttagct

SEQ ID NO: 12949 - DNA, 478 bp, Gossypium hirsutum
  Clone ID: uC-gsflmaxxa088b05b1
ctttattttccttttctctctgttcttttgtccctgggctttacttctttttgcttccatgtcgtttagaggattcagtcggccaaatgctacatcaggcatgggcgttgctgatcagaccaaggatactttcttggagctgaaaaggaagaaagtttatcggtatgtgatatataggatcgatgagaagaaaagggaggttgtggttgagaaaactggtgcccctgctgagacctatgatgacttcgctgcatctctgcctgaaactgattgccgatatgccgtctacgactttgattttgttacttctgagaattgtcaaaagagcaagattttcttcattgcatggtgcccttcatcctctcgaatccgtgcaaagatgctttatgccacatcgaaagacaggcttagaagggaactggacggtattcattacgagattcaggctactgaccctacaaagatggatcttgaagtg

SEQ ID NO: 12950 - DNA, 499 bp, Gossypium hirsutum
  Clone ID: uC-gsflmaxxa088b09b1
tttttcgcgtggtgcggtgcaagcggttatggaggccatacattacaaagatgcttgcgagaagagccttgcgtcatctaattccaccgacactaaggagttgataaggacgagtttccaagcagcgatagaggaagtaaggaaagtgttggcgaattcaacgacgatacaagacttaaataaagatgacaacaacagagaggcgcttaaggtttgtcaagaagtgttggatttatcgattgatgacttgcaattgtcgtttgataagatgggggaatacgatatgagtaagatcgatgattacttactgaacctgagagtgtggttaagcggtgccttaactacccaacaaacatgtgtagacacattcgcggaggtaagtaatgaacaagcggagaagatgaaattagtgctgaagacttccatggagcttaccgcttatgctttaaccatggtcactaagttatccaccgtcctgaaagaccttaacattccaggc

SEQ ID NO: 12951 - DNA, 430 bp, Gossypium hirsutum
  Clone ID: uC-gsflmaxxa088c02b1
cccactcgtccgcccacgcgtccgtaaaaggtttattggatatgttgtaattgcagcagaaagaattaagaaaatggggttccgagaaaggtggaaattgatcgtatagcaaatgtcatttttagttactaaagtcggacagtcatcctttgtttaatctgcaaaattacattagcttgcatttgcattttcatgctttggagttttaactagttggatttatagctcttagctcagagaggatttttactacttaaccagaagtcaacattgaataaataaaatggggctacatgaccgagggaggacctgaaaaggctaaaggactctagcttttagcttcatttttattcgtttggttgcagctgacagtttttccagattcctctgttgaaaaatagaagacaatcaagctagttcgttgtctgtc

SEQ ID NO: 12952 - DNA, 377 bp, Gossypium hirsutum
  Clone ID: uC-gsflmaxxa088c03b1
cccacgcgtccggcggctactaccttctctccttccttctccactccctcggtcaattcttcctccagagcccacaaaactttaaccaaccctaatctaggctttttggcctcagtttcgagatccttgaggtctctcaaagcaaccaggctgactactgataatgcttgtggctcagctatggcctctcgtatggtctccgttcctgccgtccagacacacatatctctcgattttgagacctttgtcttcaagaaggagaaagtctccctcgctggtcaggacgagtacattgtgagaggaggaagagatttgtttaagttgctgcctgacgctctaaagggattagcagattggtgttattggtcggggttcgc

SEQ ID NO: 12953 - DNA, 521 bp, Gossypium hirsutum
  unsure (1)..(521): unsure at all n locations
  Clone ID: uC-gsflmaxxa088c09b1
atcaaaatctctctttctcgtcaatatggcagcgaatggcgttgtttctgacaagagcttgatcgtcagcttcggtgagatgctgatcgattttgtccccactgtctccggtgtttctctagccgaagctcccggcttcctcaaagcccctggcggtgctccggctaacgtggccattgctgttgctagactcggaggcaaagcgtcatttgtcggaaaacttggagacgacgagtttggtcacatgctggccgatattctcaagcaaaacggtgtctccggtgacgggatcttgtttgaccaaggcgctagaactgctcttgccttcgttacgttacgcgccgacggagagcgtgagttcatgttctataggaatcctagcgccgatatgctgttgaagccggaggagtngaaccttgatcttatcagatctttcaggtatttcactatggatcaatangtttgatcgtggagccatgcagatcagctcatttaaaggcaatggaagtagccaaaggagc

SEQ ID NO: 12954 - DNA, 497 bp, Gossypium hirsutum
  Clone ID: uC-gsflmaxxa088c12b1
cccacgcgtccgcggacgcgtggggcatttttgtttctcaacaatcacttttctctctctaaatcttgtacggtttacgaagcgaggaagtaaccggcggcagagatcagtggcggagctgagctgagtcgtcagtggaagagatagttcaggcaatgggaagtttgcgtggcatttcgattgccatttttgtagttcaagctctgttagcttcagtagctttggtttcagctcaaggatctgctactccttctcgttggcagactttaagcggggaagcacccgttgtcatagctcgtggtggattttcaggaatattttcagactccagttttggagcttatagtttggctttagaaacgggtccttctgatgtgatcttgtggtgtgatgtgcaattaacaaaagatggagccgggatttgctttcctgatcttaagctagataacaattctaacattgcaactattttcagtgataagccggtgacttacctt

SEQ ID NO: 12955 - DNA, 440 bp, Gossypium hirsutum
  Clone ID: uC-gsflmaxxa088d03b1
agatgttgttcagctgttttaccataggtcagtgtggatctcatggaacctcgggcagggagctgttgagcgaaagcaagctcaaggatctacttcatggatcagaatatgttcttacttacgaggataaagatggtgactggatgcttgtgggtgatgttccatgggagatgttcactgacacctgcaaaaggttgaggatcatgaaaagctctgatgccattggactcgctccgagggccatggaaaaatgcaggaaccggaactagctaccatcatacatgatcttttcccacacaccgaagattattatttctgaaagagatgacatgatgctggagtgggtaggagatcatcatgtaagcctgtttttgttctactgaaaaaagtcgtatccagtgcgtaaggctaccgctataagcaagaactagaaattccca

SEQ ID NO: 12956 - DNA, 510 bp, Gossypium hirsutum
  Clone ID: uC-gsflmaxxa088d04b1
tgttcttaagatccaaccaaaagcaaacagcaaaagggagaggtttgaggcggttaccgcatttaacgcttatccccttctaatttagaaaagaaatggagactttcaacatcccggcgacgccgttattgatgaaggagttcctccgccagatgggaggcaccgctgttatcgatggtggactggcgaccgagctggaactccacggtgctgacctaaacgatcccctctggagtgccaaatgcctcctcacttctcctcaccttattcgctccgtacaccttgattaccttgaagctggcgcagatattattatcacagtattctatcaggccacaattcaggggtttgaagcaaaaggcttttctagagaacaaagtgaaaacttgcttaaaaaaagtgtggatattgccctagaggcaaggcgtatgtattatgatagatggagtaaaagttctagtggtggaactggagatgataggatactaaaaaatcgtccaatcttggttg

SEQ ID NO: 12957 - DNA, 504 bp, Gossypium hirsutum
  unsure (1)..(504): unsure at all n locations
  Clone ID: uC-gsflmaxxa088d05b1
catactcacccctcccttcctctctgcttttactttgctaagtccaagctttcgacaatggccgaaccctctaccatttcaccagctcccctcttgaaagatgagctcgacatagtcattccaaccattcggaacttggactttttggagatgtggaggccctttttccagccttaccatctcatcattgttcaagatggcgatccttccaaaaccatcaaggttccggagggcttcgactatgagctttacaataggaacgatatcaacaggattttgggtcctaagtcttcttgtatctctttcaaggattctgcttgtcgctgctttggttacatggtttccaagaagaagtacatttataccattgatgatgactgctttgttgcgaaagatccatccggcaaagacattaacgcactggagcagcacataaagaaccttctttggccatctactncgtttttcttcaacactctctatgaccngtaccgagctggtgca

SEQ ID NO: 12958 - DNA, 469 bp, Gossypium hirsutum
  Clone ID: uC-gsflmaxxa088d08b1
cccacgcgtccggagagttccgtgtacaggctgagtcttaccataccacatataaggcctctggtcagcattctcgtttaatggcttctgcagcaattgagacaagaagtaatttttcgacacagtctctttctaccaatgatccggttgtttctgttgattggcttcatgctaatttaagggagcctgatttgaaggtattggatgcatcatggtacatgccagatgagcagaggaatccaattcaagagtaccaggttgctcacattcctggtgctcttttctttgatgttgatggaatatctgatcgaactacaaagttgccgcatatgctgccatccgaggaaggttttgcggttgctgtgtctgctcttggcatccataataaagatgggctggttgtttatgatgggaagggaatttttagtgcagcacgtgtctggtggatgttccgagtctttgggcatga

SEQ ID NO: 12959 - DNA, 527 bp, Gossypium hirsutum
  Clone ID: uC-gsflmaxxa088d09b1
cctacgcgtccggccgaaaaaaaaaaaaaacagaggttcatgggttctccgacttgcgatcccattggatatgctgatggaaatttggggaacaatggtgtaaccaacttgagttcccctgcaaggaatggtgattcagggggcagggttgttgagagagttgaaaatggtgttgctgacactgaacaggcaaatgaggattcaccatatagcgggaatgttttgttggttgaaaataggccttctgtgggtgatgaggacttggactctgcagcagcaccattgccttcagtatcaaaatctaacattggacacagatggagtgacataacttcgtacggtaccaaaaagaaggttcagtgttggtttcaacatccaaatgggaattgggagctggggagagtaatatcaacttcaggaacggagtctgttatatcacttcctgatgggaaagttttaaaggtgaactctgatagtttgatacctgcaaatcctgatatccttgacggggtggtgatctcatgcaa

SEQ ID NO: 12960 - DNA, 516 bp, Gossypium hirsutum
  Clone ID: uC-gsflmaxxa088e02b1
cttctacactcttctctggtaagttcatcgaaagatcaaatcaagatccctgccaaaatgaacgacgctgatgtatccaagcagatccagcagatggtgagattcatccgccaggaagcggaggaaaaggctaacgagatctctgtttccgctgaagaggagttcaacatcgagaagcttcaattggtggaagcggagaagaagaagattaggcaggagtacgagaagaaggagaagcaagttgaaatccgaaagaaaattgagtattcgatgcagcttaatgcatctaggatcaaggtcctttaggctcaagatggtgtggttaatgcaatgaaagaatcagcatccaaggaccttctcaatgtgagccatgatcaccatgtttacaaaaggcttttgaaagatctaattgttcagagtttagttagactgaaagagcctggagtcctactccgctgtcgcaaagaaaaattgcatttggtggaggctgttctggattcatcaaaggaggaattg

SEQ ID NO: 12961 - DNA, 543 bp, Gossypium hirsutum
  Clone ID: uC-gsflmaxxa088e06b1
cctgattcaacgtaagaattagggttgtgtttagaaagggcggtggcagcgcgcttcagatccactctccctatctttcacaggcttttgagatccgattccctgccttctcacactcccagagctactcttcaccgaactctactttgccccgagctgtcgaggaaatattctacttctctgaagaaggacgagaatgttaaggtgcctttggctttgtttggtggatctggaaactatgcatctgcactgtaccttgcagccgtaaaaggaaatgctctggacaaggttgagtctgaacttcttgaccttgttcaggcatcaaaaaacagtcaattgttttctcaattcactaaggacttgtcagtacctgcagagacacgggtcaaagccattaatgagatatgtgggcaagctaaattttcagatcttacaaagaactttttagttatactagctgagaatggaaggctaagacatatagaaagcattgcaaagagatttgtggagttgaccatggctcataagggagaagtgaagcta

SEQ ID NO: 12962 - DNA, 437 bp, Gossypium hirsutum
  Clone ID: uC-gsflmaxxa088e08b1
tttttgtcgcgtgggcagctgcaaaagtcgttgggtgggttggccgacgaggtacattgattataccggatgcagccgagggactttcatatttgcatcatgattgtctgcctccgattgtgcatagagatgtcaagtccaataatatcttattggatggtgactttggcgctagagtggcggatttcggagttgccaaggtggttgatgctgctggaaaggtcgctaagtctatgtctgtcattgccggatcttgtggttacattgctccagagtatgcgtatacgctacgggtgaacgagaagagtgacatatacagctttggagtcgtaatacttgagttagtcacaggcagactcccaattgacctggagtttggcgagaaggaccttctaaagggggtttgcactactttagatcaaaaggtgtggacttat

SEQ ID NO: 12963 - DNA, 431 bp, Gossypium hirsutum
  Clone ID: uC-gsflmaxxa088e12b1
ctttgtagaaaaggtgtgatcttcaatttagcggtaagatttctaaaattcgaaaccatagtcacccattggattcaagattttctattttgttttcttctttttttccccgaagttttggtttaaattctagggttttcgatagtcacccatgggtgaacgcatagtggaggatatgtcgttgtcagctctcttcgaacaagctcgtaagatccatcttacggtcacggagtccggtgctgatcaggatctggtatagaaaggatgcgtggtgctggtgttgtgctaggacatgattagcatgctagggctttttttattcattgtgacctaagttgattttcagttccaacattctctagttccttttggttctgttttatcttgcatttcttgcggaaattcttgtgcatgaggtaaggatttatttt

SEQ ID NO: 12964 - DNA, 210 bp, Gossypium hirsutum
  Clone ID: uC-gsflmaxxa088f03b1
ctattattaatgctgctgcccctcctgctggtactccggacattaccgccgggtcgcacccgtccggtgttatcctgcacttggaagaagaagccgacaaaggaataaatatagtgataatttgattcttcgctgcctgagaaaaataggagagatgatccttttcttcgactttacataaaaaaaaaaaaatgggtgtactattactga

SEQ ID NO: 12965 - DNA, 610 bp, Gossypium hirsutum
  Clone ID: uC-gsflmaxxa088f08b1
ctcttcaagaccattcgacaatggtgacaatccctttctttgtcctaatcatcctccttttcctctccagctccgcggccacaccaaagagcggtgcaggtcacgacctggtccgttcatcatgtgtccacgccagctatccaagcctctgttttagcaccctttcttcctactccggcccagccaacaccccacgtgagttagcccaagccgccgtaaaagtcagcctgtcccgtgcccggaaagtgtcgaactacttgtcgacgagtgtgacggggtacaacaagagggaacgagtcgcactgagtgactgcgtggagcaaatagatgagtcgatggaggagttgagcaagacactaggggagttgaagcacttgagaggggagacgttcgagtttcagatgagtaatgcgcagacatgggtgagtgcggcgctgacgaatgaggacacgtgtcttgatgggttcgaaggagttgacggctaggttaaatctgatgtgaagaggaagatcacgaatgtggctaaagttaccagtaatgctctgtacatgatcaataggctcaatgaaggtcgtggtaggcacccgtgatctttgatgatgatgaatat

SEQ ID NO: 12966 - DNA, 474 bp, Gossypium hirsutum
  unsure (1)..(474): unsure at all n locations
  Clone ID: uC-gsflmaxxa088f09b1
ctttttctgaatcttctcttttcaccaacaaataattaaaaagttattgggtgtttcgaaaatctccctaaaaaatatatgtttttgtcccttcacttttcattttagcaggattttagcaatgggtgttctcttactgaattcgctcccattagggttccggttccgaccgactgacgaggaactgatccatttttatttacggtctaagataaacggaaatagaaacgatgagattgaaattattcgtgaaattgatgtttgcaaatgcgagccctgggatttgcctgacttgtctgctataaaaacccaagatccgtagtggttcttcttttgcccactcgaccggaagtacccaaccggcaacaggctgaatagggctaccgaggctggttactggaaagctacgggtaaggaccgcatgatcaagtctggctccaccttngatcgcatgaagaaaactctggtgtttta

SEQ ID NO: 12967 - DNA, 570 bp, Gossypium hirsutum
  unsure (1)..(570): unsure at all n locations
  Clone ID: uC-gsflmaxxa088f11b1
aaaaaacagaatctgaaaccccccccctgattatttgatcactctctaaaaccccagccaaacgagtctttccaaacccaatggattctgtgtttgcctccattgttcaagctcctgaagatcccattcttggggtgacagttgcttataacaaggatccaagcccaaacaagttgaatttaggtgttggtgcttacagaactgaggaaggaaaacctctagttctaaatgttgttcgaaaagcagaacagcttcttgttaatgacctgtcgagagtcaaggagtatcttcctattcttggtctcgcagagttcaataaattgagtgctaagctcattcttggtgatgacagtcctgctattcaagagaacagagtggctactgctcagtgcttgtctggtactggttccttgagggttggagctgagtttttagcaaagcattaccaccaacgtactatatacattccacagccatcatggggaaaccatgtgaagttttcacgatggcagggttgtcggtgaagaattaccgctactatgatccaancactcgtgggctttaatttca

SEQ ID NO: 12968 - DNA, 480 bp, Gossypium hirsutum
  unsure (1)..(480): unsure at all n locations
  Clone ID: uC-gsflmaxxa088f12b1
ttcctacgcgtccggtgagggtgagcgttttgaatgatgcactcaagagcatgtacaatgcagagaagaggggcaaacgacaggtcatgatccgaccgtcctcgaaggtgatcattaagttccttttggtcatgcagaaacatggttatattggggagtttgagtatgttgatgatcatagatctggtaaaattgtggttgaattgaatgggaggctgaacaagtgtggggtgatcagtcctcgttttgatgtcggtgttaaggagattgagggttggactgctcggttgcttccttcaagacagtttggttatattgtgctcacaacatcagctggaattatggaccatgaagaagccagaagaaagaatgttggtgggaaagtacttggcttcttctactgagaaatttgnctttttcattttgaatcgaactcatattattaagatggcatctttttgtagttcacaattaaggttt

SEQ ID NO: 12969 - DNA, 463 bp, Gossypium hirsutum
  Clone ID: uC-gsflmaxxa088g05b1
gaccatgcgagcaggtttctgtgttgtatgaaggcttcggagtcggagatgcctccaactatgactctgttaaaagctttgctcaacttatgtggcctaatggtcacccacgctttactgagaccatacataccctaacgacgcaaatggaggagctgaacaagttaatttggttaatgctaactgatagttacggattacgggaggattcactgaaaatgaactacacaacgttggtgcggatgatgaaatacctggcccctccaccaggggaaaataagagaggactctttgctcatactgataaaccagttagcacacttatttgtgaggacaaaatttcagggttggaaattgaggtcagtgatggccaatggatcaagttgactaatttatctccttcttcctttggtttttttggtggagatcctctcaggcattgagtaatgggagattggaatca

SEQ ID NO: 12970 - DNA, 274 bp, Gossypium hirsutum
  Clone ID: uC-gsflmaxxa088g09b1
tttctgagaaaggaatgcagcgaaatgggtgaagaagttaaggtttttggatattgggcaagcccttacagctacagggcagagcttgctttgaagttgaaaggctcctttgataaattcctgatcctggatataactagcttacttgcaagttttaattctgatacacaatagatcatatgaaacattcccaggtcttcatttacatgaccatttaaattgccttagcggttctttcctctgccattccttgaatcaaatgttaggtttgggc

SEQ ID NO: 12971 - DNA, 397 bp, Gossypium hirsutum
  Clone ID: uC-gsflmaxxa088g11b1
gatattccctactctggtgttatccggtttcctttaggtctcaaaacatttcaaaagggaaagatagctggttttagggattgggttctcattgatttttagtgaaaaacttcttatactacattatgggaggaggtggggtcgaacttaagaggattgaaaacaagatcaacaggcatgttacttttgcaaagagatgaaatggtcttttgaagaaagcttatgagctttctgtcttttgtgatgctgaagttgctctcatcatcttctccaatagaggaaagttgcacgaattttgcagcagctcaagcatgatcaaaacattggagaggtaccaaaaatgctactatggaactcctgagccaaatgagtcatctagggaggctgctttggaatt

SEQ ID NO: 12972 - DNA, 530 bp, Gossypium hirsutum
  unsure (1)..(530): unsure at all n locations
  Clone ID: uC-gsflmaxxa088h04b1
cccacgcgtccgagcaaaaccaatggatttgaagcctaacgttgtagttgctaaagatggtagcgggaaatatgatactattaacaaggcattggctgaagtccccgtgaaaagtcccgatcgatttgttattcacattaaggctggtacttacaaggaaaaaatcaacgtgaccaagcagatgactaatgttgtattcatcggtgatggcccaaccaagaccatcatcacaaatgacattagtgtcgctaagaatccaccggttagaacataccgtactgcaactgttggtgtggatggggctagtttcatggctaaggacattggattcgataactcagcaggacccgaaggtcatcaagcagtggcctttagggccactgctgataaggtcatcatgttcaactgccatttcactgggtaccaagacactctttacgctcacagagagagacaattatataccaactgtctcattaccggaacggtggatttcatctttcgngatgcgacgagcattttccagaact

SEQ ID NO: 12973 - DNA, 495 bp, Gossypium hirsutum
  Clone ID: uC-gsflmaxxa088h06b1
gcctgccatataatcatataaccaggctccgtcggggtactctttggccaccacaatgccgaaaatcgccttgggaacaagccaagaggctgctcagcctgactgcatcaaagcccttgtggtcgagtttatcaccactttcctcttcgtattcgttggagtaggagctgccatggccgccgatgagtcgggggcaaatgcgctggtgggattgtttgctgtggcggtggctcatgcccttgtcgtcggcgttatgatatcggccggacacatatcaggcggccatcttaacccagccgtcacgcttgggttgctattcggtggtcacatcacggtggtccgtgcgatcctctactggatcgatcaagatgtggcatcttcagctgcttgtatacttctcaagtatctcaccggaggattgaacactccggttcacacattagcaagtggaatggggttccttcagggtgtatatgggagattattctcacattc

SEQ ID NO: 12974 - DNA, 325 bp, Gossypium hirsutum
  Clone ID: uC-gsflmaxxa088h09b1
cgcgtgggcacaaagatggcaggcgcggcgggattgttttaccataaccttactgttttcagcatgtttatcggcgtcctatggtaagaggaccggaatcttcaccatggctgacggagccgatgggtttcaaccaagcaacggttttccgcatgaagctgatcctgattcttcaacctctatcgatcctgatcctaccggattcggtgctggcatatgtataggttatgaaagaagcccttactgtatcgactgcgacgatgtggatatcatgggcggaagcttttgcggcacctgcaattacggatgcccttaccgcaagttc

SEQ ID NO: 12975 - DNA, 563 bp, Gossypium hirsutum
  unsure (1)..(563): unsure at all n locations
  Clone ID: uC-gsflmaxxa088h10b1
ttttcaaatcatcaatggcgtatttgaaagtggctttaggcttcctagtaacagctttcctgtcagccacagtttctctggctcaccctggtttgggtttcggctggggaggtgttggtgcgccaggtggtcaatctggtgcaccttcatatggccttttcccacagttctatcagttttcatgccctcaagctgaggacatcgtcatttcagttctagagatggccatagcaaaagagcctaggatggctgcctctttgctaaggcttcatttccacgattgtttcgtgcagggctgtgatgcatccatattgttggacaacagtgcgaccatcgttagtgaaaagaattcactaccaaacaggaactccgttagaggctttgaagtgattgatgagatcaaagctaaactagaagaagcatgtccccaaactgtttcttgtgctgacatactcgcaatggctgctcgtggttccactgtcttgagcggcggaccatcttgggagcttccacttngaagaagggattcaaagacagtgagcctgagcatttaaacaacaaca

SEQ ID NO: 12976 - DNA, 530 bp, Gossypium hirsutum
  unsure (1)..(530): unsure at all n locations
  Clone ID: uC-gsflmaxxa088h12b1
gttgaagagaatcagagccgcagctgccgccatcgccatggtgaagtttcttaaaccgaacaaggcagttatcgtcctccagggtcgatacgccggccgcaaagccgtcattgtcagatctttcgacgatggcacacgtgaccgcgcctatggccattgtttggttgcagggataaagaagtatccgagcaaggttatccgcaaggactccgcgaagaaaaccgccaagaagtcacgcgtcaagtgcttcatcaagctcgtcaattaccagcacctgatgcccacgcgctacaccctcgacgtggacttgaaagacgtggttaccgtcgatgctctccagaccaaggacaagaaagtggccgcttgtaaggcaactaaggagaggtttgaagagaggttcaagactgggaaaaacaggtggttctttactaagctcnaggtttaagtgttttattggaacatgttttatgcttaagtagttttatcgaacaattttgaatttaatgaccngatttgaatctgttggataa

SEQ ID NO: 12977 - DNA, 419 bp, Gossypium hirsutum
  Clone ID: uC-gsflmaxxa089a02b1
cggagtgcctgcttataaattttcttttatttttgcggtcctgtaatcccagagctttttctcagctctctcgctctctctctctctctctctctctcatcttttacatggcatctcaagccagcctcctccttcaaaaacagctcaaagatctttgtaagaatccggttgatgggttctcggctggattggtcgatgagaacaatatctttgaatggagtgtaacaattattggacctcctgatactctttatgaagggggatttttcaatgctatcatgaggtttccaccaaattatccaaacagccctccaacagtcaaatttacatcagagatttggcatcctaatgtttatcctgatgggcggtgttgcatatcaattcttcatcctccgggcgatgatcccaatggctatgag

SEQ ID NO: 12978 - DNA, 552 bp, Gossypium hirsutum
  Clone ID: uC-gsflmaxxa089b05b1
cacaaagaaaacaacaaagggggaaaagagaagtagaagtagaagatagaagaacacaacagaagatctctttctctctctctctctagctggtgttttagcgatgtttcgttaagaatcatttggaggttgatgtatgaaatccagcactggggaataatgggtaaaacaatggaggttcagcgtatgaaggaattgttgttactttggtcgaggttccaaagtaatcgtgtggctctcgtgggtggaaatcacactgccgctcgattttgcactcgctaagttttgccttcttcattcctctctttctcgcctgttataatctcttccttgttttactttaatatgctatctctagattttcttttccggaaaagttttctatttttcttttcgtacaatctaccttggctttgatcacctttggtttctgaatttttgtgattggatttggaagcccttttttctttgtgttttaatcgatcatttggatcaaaatggctgtccatattatttatggacttctgaacaaatccataaaacaagcataag

SEQ ID NO: 12979 - DNA, 503 bp, Gossypium hirsutum
  Clone ID: uC-gsflmaxxa089b06b1
cccacgcgtgcgtgcatcctttactcatcacttcaagtctttatctcccctcttaaaacaaaaaccatggttcaagaaaagaagctagtccaggacgtatctggttggctaagagtctatgatgatggctcagtcgacagaacctggactgttccccctgaggtcaagttcatggctgaaccagtctcaccccatgaacaattcattgatggtatagccactcgtgatgtcaccatcgatcaaaattcaggcctgcggtctcgaatttactcgccggacgaggaacagcataagatctcgatcatacttcatttacatggcagccgctatcgcatcagccgagctgattggtgcatgtactcatcagttgtacactaggttagccaaatcgagtccaggtattgccgtctcggcttacctgaggccagcacccgagaacaagctgtcagcagcttgagacgatggatacgccgctctcctttggctttaatcgctatctaaag

SEQ ID NO: 12980 - DNA, 567 bp, Gossypium hirsutum
  Clone ID: uC-gsflmaxxa089b10b1
ggtttccccaaactcccttcaaatcctcgtctgagcaattttttttttaaagcctagtaaaatggcgtccacatttagcggtgatgaaactgctcctttcttcgggttcctcggagccgctgctgccctcgttttctcctgtatgggtgctgcgtacgggacggcgaagagcggtgtcggggtggcatcgatgggagtgatgaggccggagctggtgatgaaatcgatcgtgcccgttgttatggctggagttttaggtatttatgggttgattattgcggttattatcagcactgggattaacccaaaggccaaatcttactacctgttcgatggctatgctcatctttcctctggtctcgcttgtggcctcgccggtctctctgccggtatggccattggaatcgtctgcgatgctggagttagagccaatgcccaacaaccaaagctttttgttggaatgattcttattctcatttttgctgaggctttggctctctatggactcattgtcagtgtcattctctctttcccgcctggtcaatcccgaagcagatagaatgcaaa

SEQ ID NO: 12981 - DNA, 555 bp, Gossypium hirsutum
  unsure (1)..(555): unsure at all n locations
  Clone ID: uC-gsflmaxxa089b12b1
cttcagtgtctcactctctccgtgcttcactccagtttctcctttccctcttcgaagaaaaaatgcgtgagatccttcatattcaaggtggccaatgcggcaaccaaatcggagccaagttctgggaagttgtttgtgctgagcatggcatagatgcaactgggcgttaccaaggagacttggatcttcaacttgagcgaatcaatgtctactacaatgaagccagttgtggtagattcgttcctcgtgctgttctcatggatcttgaacctggaaccatggacagcatcagatctggccctgtcggtcagatttttagaccagataacttcgtttttggtcaatctggtgctggtaacaactgggctaaaggccattacacagaaggtgctgagttaatcgattcccgacttgatgttgttcgtaaagaggctgaaaactgcgattgccttcaagggttcaggtttgtcattccctgggaggaaggactggatctggaatgggaacactngtgatatcgaagataagggagaatacccagataggatgatgctg

SEQ ID NO: 12982 - DNA, 512 bp, Gossypium hirsutum
  Clone ID: uC-gsflmaxxa089c06b1
cccacgcgtccgaaaaaaagagagatggcgtctgtgataaaatctgcaatcttaattctgtcggtgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggctttggttttgaaggtggtcctgataaatgttgttcttctggatgttccggtaattgtaatcctggtggtttcggtctaccatttactcaaattgcagaaatcccaagaattccagaaatgccacagatcccacagatcccacagatcccacaaatttcactaatcccacagatcccacaagtgccacagatcccacaagtcccaaaaatcccactaatgccaggacagtccggatgtgagagtggagagtgttgccatcaggg

SEQ ID NO: 12983 - DNA, 560 bp, Gossypium hirsutum
  Clone ID: uC-gsflmaxxa089c10b1
ttccacgcgtccggaaagtttcaatggcaaccgtgaaagttccagatcacgttccttctgcttctgatgatgctgagcaacttcggaaagcttttgaaggctggggtaccaaccgagcaattgattatcgacatattggctcacaggaatgcagcacagcgcaattcaattcggaaagtttatggtgaagcttatggggaagatcttctcaagtgtttggagaaggaacttacaagtgatttcgagcgggctgtgctgctttttacgttggaccctgcagagcgagatgctcatctggctaatgaagctacaaagaagttcacatcaagcaattggattctcatggagatagcttgcagtaggtcttcgcatgaactactcaatgtgaaaaaggcctatcatgctcgttataagaaatcccttgatgaagatgtcggtcaccacactaccggagagtactgcgagcttttggtcccttttgttagtgcattccgatttgagggagaggaggtgaacatgacattggcaaatctgaggctaaaaactgatgataaaatctc

SEQ ID NO: 12984 - DNA, 571 bp, Gossypium hirsutum
  unsure (1)..(571): unsure at all n locations
  Clone ID: uC-gsflmaxxa089c11b1
ggcggagaatcagactctatgtcgctttcaacgctaaaaccctaattctctcttaaaccctaaaattattcattggaagggccatttgccaaatttcactctttttcaacatgcaaatgcccttgagttgagcctctccatcttccccccttttagtatatctcaaaaaatcaatgttacccacttctatttcaagcatgaaatctctaattttccctcccttttctcccttatctcttcatttccccaaaaccaaaccttttgccttcttctctttaccctcaaaaacccccaatgtgtcgtaccccaaatttctccacgtaaacccttcaatgcctttggcaaggacccccgattttttcaatccccgattcgacaatcgcatatagagacaccccaatcttcttcgctgtgcggtgaggtccacgtcatcgtcggacccatgtttgctggcaagactaccactcttctccaccgaatccaagctgaaagcaacaatggcagaactgtggctgtaataaaatcaaacaaggatacanggtatggattggattcaatgtgacacatgatg

SEQ ID NO: 12985 - DNA, 459 bp, Gossypium hirsutum
  Clone ID: uC-gsflmaxxa089d01b1
aaaaaaaaatccccttaaaaccaccgaaaaaaaaaaacaaaaaacacacaacaacaaaaaaaccaaacagcaaaagaaccaaagcaaacatgacaaaaaaacaacccgaaaaaaaataaaaaaaaacaaccaaaaaaaaccgaaaacacaacaacaaaaaacataaaaagcacaaacaaaaaaaaaaaaaacacaagatcacataacaacaaaaaaaccccaaaacaaaacaacaaaaacccaaagaaaaaaagcagaaaaacaaaaaagccaaaacacaaaaaacaaaaaccaaaacacaaaaacccaacaaaaaacagaaaccgcaataaaacaccaaaaaaaaaaacacaccaaaagaaaaaaccaaacacccaaaccaacagcaaaaccacacaaacaacagcaccacccacaaagaaaaagaacacaaaaaaacaaaaaaagacacaaaaaaca

SEQ ID NO: 12986 - DNA, 395 bp, Gossypium hirsutum
  Clone ID: uC-gsflmaxxa089d07b1
tccacgcctactgtgacacacacagcgctcaggggggttttcagaacaaattggtggtcactgcggattctatcttacccactactgccgctctatagggttttgaagggcaagcgttcgcgtgtacatttcataactcctccggagataatggactctgacacccaattctgtacctgtctgtcagcgtacacatcaatggcttcgggtgattggattacgggtgacacgtggatcagatttcatgagactcatattatccacttcgatggtccgtgagaccctcgtcgagctgataatgcaccccgaattccacatcaacagtcaaacatccaggctgtctgatggctgctccgtgactgctaatatggactgagatgctttcgctttacctg

SEQ ID NO: 12987 - DNA, 515 bp, Gossypium hirsutum
  Clone ID: uC-gsflmaxxa089d08b1
tataaaaaaaaaagggaaaagaaaatcaaagttatttttctttcaattgagcccttcatttttctctcattttctttcttcccaaacaacaaagtttaaagaaaatgccaacagatacaagcaaacccatgaaattagaacgatacaatagctatattcgtaaagtccatagcacgaagctgttgaatgcttcatctaaatttctatttcgtgttacccttcttattgctttagttttgatcttgtttttcaccattaactaccctccactttcggataatacccagtgcacctcaccatcaccaccgtcatagctttctttcaacttcacttttctccggttcttccctcgttggtggtgcggcgtgggagaaacaagtccgtcactcttctactccacgtagagttaatgggttttccgttttggtcaccggcgccgctgggttcatcgggtctcactgttcacttgctttgaaaaaacgcggcgatggggttttgggattggataattttaa

SEQ ID NO: 12988 - DNA, 538 bp, Gossypium hirsutum
  Clone ID: uC-gsflmaxxa089e05b1
ccctctcgtccgcagaaaggtaaatcgctaagggggggatttttaagagatggccgggtgcgcaacagtgatcggagcacttctgggactgggcacccagttgttcctcaactgtttacgcacggctccttatatgcgacatccgcgggagcacctgtcgcggatctgtactcgcacgccatttgttaaccagcttgtgaattgggacgctcagctcccacgggaccttgacaatatgctcgaaaaggccaaggttgccaacgagcgccggttctctgatggagatgatgattaacgctcatgccctatgactacatgcgatatgctaccgccagtctgaagctggaggagaccggatcagattgtgagtgggtgaatactgactctgcttttgtgccagaattaaagcctgttgtacctgttgatgcattaatgtgaagggcgcattgcagaggaaaatggtgagtgaccgaaggagaccttgcaagtgcttcatcggatttttacctaaaaatgcaagtgttttaacaggacatcc

SEQ ID NO: 12989 - DNA, 564 bp, Gossypium hirsutum
  unsure (1)..(564): unsure at all n locations
  Clone ID: uC-gsflmaxxa089e08b1
gcaagcttggcgctggtagcaaagcttacgaaatgggtgggctggataaagagcaatggcatgtttactctgcttctgctgaatctgttaacaccaaagcccctacttacactttagagatgtgcatgactggtttggacactgaaaaggctacggttttttacaaagacgaatcgacctcggcagcttcgatgaccatgaagtctggcataaggaacatacttccaaactctgagatatgcgattttgagttcgaaccttgtggttattctatgaattcaatcgaaaccgatgctatttcgaccattcatgttacacccgaagacggttttagttatgcaagcttcgaagctgtgggctatgatctgaaagagttgaatctggagcagttggtgcaaagggttttagtttgcttcaaaccaagtaatttctctgttgccgtgcatgtggatgttgattgtcactcatttgaacagacctgtctgctggctgttgaaggataccattgccnggagagtagcatcgaagagcttggttcatgcggttccatcatttaccagagct

SEQ ID NO: 12990 - DNA, 450 bp, Gossypium hirsutum
  Clone ID: uC-gsflmaxxa089f03b1
ttatatttggtccttccggtaattcaccatgccagcattcgatactatcctccttcgggatttggtagctgcagcctgcctcttctttatcacacgttattttattacgtcgttttctcagtaaccccaaacgaacacttcctccgggtccgaaagggtggccggttgtgggtgctcttccactcttaggttccatgccccatgtcgaactagccaagttagccaagaagtatggacctgtaatgtacctcaaaatgggaacctgcaacatggtggtggcttcaaccccggataccgctcgagctttgcttaagacccttgacttgaatttctctaatcgaccatccaatgctggtgccacccacatagcctataactcttaagacatggtgtttgctgagtttgggccgaggtggaaattgcttcgtaaactgagtaaccttcacatgc

SEQ ID NO: 12991 - DNA, 350 bp, Gossypium hirsutum
  Clone ID: uC-gsflmaxxa089f07b1
ctcacgcgaactgtgactcacacagctctcaggggggcgtttagaataaactgggggtcactgctgtttctaacttacccactactgcctctctataaggtttctaagggaaagctttcgcggagacatttcagttctcctactggtatgatggtctctcacacccaagtctgcgccgaccttgcagagtacagaacaaggcccctgggttctcggattccggaggagccggggaaaagagttcatgagatcatattagccgcttcgatgatccgtgaggtcctctttgagctgaaagttcaccccgaattacatatcaacagtttaacatccatgatgtctgatgcgct

SEQ ID NO: 12992 - DNA, 454 bp, Gossypium hirsutum
  Clone ID: uC-gsflmaxxa089f09b1
gagaaatggggtttttaaatcttgcagtcattgctgtagtggttattggttcattctgataaatattgatatttgtagagagaagaacgatcctaaaaaactagatgcagatctcaagtggtgctggaatggggttgcttgaatctcttttacgtgctgaacgaagaaaatccttcactaggacagacagtgatgcaggctaagcaggcaaagcattggacgagctgatgggatccctatacaatgagcttagaacatcagagcgagccatgcgacaacagtaactattttgtggaccgaacgcggcagatcacagtcaatttcttcttggctagtggcactattctaaccaaccaactactgattgggagagtctgcttcaatttcccactcttattaaccttactacattacgccgtatcatggcttttactagcaatatcgaggacacttt

SEQ ID NO: 12993 - DNA, 566 bp, Gossypium hirsutum
  unsure (1)..(566): unsure at all n locations
  Clone ID: uC-gsflmaxxa089f10b1
gcgcccacgcgtccgcgggtatcatcacagagagagattatcttaggaagataatagtacatggaagatcatccaagtcaactaaagttggggacatcatgactgaagagaacaagctcatcacggtcacacctgagaccaaagttctgcaagcaatgcaattgatgacagaaaaccgaatcagacacattccagtgatcaatgagaaggaaatggtaggcatggtttccattggagatgtggttcgtgctgtggtgagcgagcaccgtgcagagctggaccgcttgaatgcttacatacagggaggttactagatgatgatgatgatgatgatgatgatggaatatggngtatgtttcacttgttggacttaagcaagcaagcaaggggagagcttgcaaatatgctatgttttcgtggtttttctgtgaatatgcaagtgatgttggaataattaccatgtggactaagtgtttgacaataatcattctcatgttgcttccttcctatttgactaggaaagtggcanaggcaaccttgatcaanaaaaaaaaaaaaaaaaggaa

SEQ ID NO: 12994 - DNA, 524 bp, Gossypium hirsutum
  Clone ID: uC-gsflmaxxa089g01b1
gtgacatgaattaagggaatatgggtacaaaggaggggaaatatttgataagtaaacaaatgagaaaggaaatatgaaatcatgaagatgatttcaaggaaattagattgagtaaggagttttgataaaataaaaggaaaagacttaataaaagaacatcattgtatatgagggcagaagaagaaaaacatctacaggcagattgaaattagagtaattgagaaaaacgcaatggctcaaaagatgttgatgatggcggtccttgtgatattggggacgaagatagcgacatttaccgatggtgatccgacttgtttgcagagcttgatgtcttgtgctccttacttcaacaacgccactctccaactagaaaggcgattgctgtaaccctctcagacaagccgtcgctactgaacttacttgcctctgcagcctgattaataactctactttgcttagttcttttaacatcaacatccccattcctgcagctcttatgatcacatcgtgctgcggtgtcactg

SEQ ID NO: 12995 - DNA, 539 bp, Gossypium hirsutum
  Clone ID: uC-gsflmaxxa089g02b1
taacattggtggtagcaaaggagaagatgatgtgctacgaggaaatccgtcagaaacgtgtggaagaaaacaagaaaagaatggaagccctcaatcttccacagctttctacacttcttcataccccatctttcaaaccctctccgagaaaacagatgaagcctcggacagtcgaaaaacaattggttgtggttagaagatcgagtcgtgtcgccaacaaacccgccccggtttaccaagaagtgagtgaaatcctcgattctctttcatgggtttagttaaaaatgggggcatttatcttaccttccgccccggtttaccaagaagtgagtgaaatcctcgattctctttcatgggtttagttaaaaatgggggcatttatcttaccttgatctctgtgagtaggttcttgttgataaagtgatgatacctagaaggtaatgcttgtttggatttttttatatttgtttgaatttgaggggttaatgactttttgggtgcaaaattaaggtatctaagcatagggatctgtcaaaccg

SEQ ID NO: 12996 - DNA, 342 bp, Gossypium hirsutum
  Clone ID: uC-gsflmaxxa089g07b1
ttttctcttacgcctagatatacttctaaggggggctattttttaatcatttttggggtatggcaccaatagctgaaaaaatgccagcctagaagaagcctggggagtgagaaaaaagccgtatctcagatagccccggccgataagaagcctaaggctggtataaagcttcccaaggaaggtggatcggctgtcggagacacgaatatgtagatagttaagaagagcgtattgacctacaatatctacatcttcaaggttcttatgcaagttcaccctgacatcaggatctctagcaaaggtatggggatcatgaacagttacatcaatgatatcttcttg

SEQ ID NO: 12997 - DNA, 205 bp, Gossypium hirsutum
  Clone ID: uC-gsflmaxxa089g11b1
ccaacctgaccattatcacaatagaggggggcgtttttaagaatcttccgggtctaacacatctatctgcaacagttgctgtggatggcacctgtgttcattgccaatgccattggcttcaattacttaacaggacctgaaggacattaagcagttggcctttaggtgccctgtatgtcgggtcatcatgctcaactgctcatct

SEQ ID NO: 12998 - DNA, 500 bp, Gossypium hirsutum
  unsure (1)..(500): unsure at all n locations
  Clone ID: uC-gsflmaxxa089g12b1
tcaaaaccaaataaaaacatggcaccacaccttaatattgttccttccatgtttgtgcttttattattattcatttcagcctctaaagttcaatcaggcgctattgatgttgttgccaagtttggcgcaaaagctgacgggaaaacggatctgagtaagccatttttggatgcttggaaagaagcatgtgcctctgtaaccccatcaacagttgtgattcctaaagggacatatttattatcaaaagtaaacttagaaggtccatgcaaggctcctattgagattaatgttcagggcactataaaggctccggctgatcctggtgctttcaaggaccctaattgggttagattctatagtattgaaaatttcaaaatgtccggcggaggaattttcgatggtcagggaagcattgcttatgagaagaataaagatccccacaatcgtgcatttcgtgtcaaactccccgnaatataaggtttgactttgtgaccaacgca

SEQ ID NO: 12999 - DNA, 414 bp, Gossypium hirsutum
  Clone ID: uC-gsflmaxxa089h01b1
ataccaagtcggcgttctcggtctcctctcacctgctccaacacccccctttcttttcttttcttttctttcttttctccctgtttcttgggagggacttgcctgaaactttgggtcgcttatcgttcccacaatccaaaaacaatttcaacgcatcaatcttcttcttctttttttttttttaagttaatttttttttgtttccttgttttcctacttgggaatctcatatattttatatgtcctaaaatttaatagagcctactgaattgatcaggtgagttattttacttttattttctcatttgacgtccgaataatccatactctctttttttccctcataaattcttttcttaattttgtttctaaactggaaatttgaagcattaggatcgaacgcccgttagattt

SEQ ID NO: 13000 - DNA, 402 bp, Gossypium hirsutum
  Clone ID: uC-gsflmaxxa089h03b1
gcggtggaaaagaaacttaccaggattcccctgggggcggttttgcgaaccgggagaagcccaggttgagaatctgtcgccatctgcgtccgacttgtagcttggagaagcgtactcatcgacggacctggcccaagtgccctggaaaggggcgccggacagggtgagagccctcggttgcccggaccctgttgtaccaagaggcgctgtctacgagtccttgatggtagggaatgcaggcctaatctggcggtaaatatccgtccaggggtgaatacggacgagagacctatagcgaacaagtgcctggagcgacagatgaaatgcgctttgagaataaactcaaagaccgcttggttgaaaagccagtggctcgaagctacctgccgctggattatgact

SEQ ID NO: 13001 - DNA, 451 bp, Gossypium hirsutum
  Clone ID: uC-gsflmaxxa089h05b1
cttttggatttactctcacaaccaactcaccacagggggtgtctcttaccaaacctatgcgattgataacactcaaaacacccaacagagtctggtgagaatctagctctaaggaaaggggatccaaaccatacaatcacacgattgcttgactatctaggttatctaaaagctcgagacagagaattcacacaccggtctgcgcatctatagatcatgtctctaaacgccatacccaccgtcctcctgcattttgagaacctgcctacccctttgatgacactgccctttgatctgtctcatgcatattctaggctagatcttgtagcaagtgtaacatgacaggcaatcgaaatggcacataggtcagccgcggcgccctgcgtgacgaaaacgtaccagctggtggatgatccgaacaccgacgacgtgataacatggaacgaaagca

SEQ ID NO: 13002 - DNA, 519 bp, Gossypium hirsutum
  Clone ID: uC-gsflmaxxa089h07b1
gcgcccacgcgtccgcttcagtgtctcactctctgggggcttcactccagtttctgctgtccctcttcgaagaaaaaatgcgtgagatccttcatattcaaggtggccaatgcgggaaccaaatcggagccaagttctgggaagttgtttgtgctgagcatggcatagatgcaactgggcgttaccaaggagacttggatcttcaacttgagcgaatcaatgtctactacaatgaagccagttgtggtagattcgttcctcgtgctgttctcatggatcttgaacctggaaccatggacagcatcagatctggccctgtcggtcagatttttagaccagataacttcgtttttggtcaatctggtgctggtaacaactgggctaagggccattacacagaaggtgctgagttaatcgattccgtacttgatgttgttcgtaaagaggctgaaaactgcgattgccttcaaggggttcaggtttgtcattccctggaggaggaactggatctggaatggg

SEQ ID NO: 13003 - DNA, 124 bp, Gossypium hirsutum
  Clone ID: uC-gsflmaxxa090a04b1
cccaacaattcactgaaacatgtccagctcaaaaatgtacactgctccaaatcatttgaagttaaagatgactacccaactcacaagacctacccatgctatgttcttaacgaccgcacctaca

SEQ ID NO: 13004 - DNA, 468 bp, Gossypium hirsutum
  Clone ID: uC-gsflmaxxa090a06b1
cccgccgcccatgcttcctggtctgacgcgagggcttgcccgggagggattttatatccataaaggtggtattcaatgtggtctgtatcaagcatactcacagggcttctatctttcatgctggataacagtgctaccactggcagtgtaaacactacagctgctgagaagcaacgcctggcacaaacatccctttcttttaattgtaaaaacccaacttgaagtatgtcggtattgaattgtggcaggtaaaatctggaacaatgtttgataacatcttagttgccgatgatgtagagtagtgccaagaaactagctgaagaaacatggggcaagcagaaagatgctgaaaaggcagcgtttgatgaggcagagaaaaagagagaggaggaggcatcaaaggatgacccagttgattccgatgcttatgatgaagatgatgccgatgatactgaagggcacgagtct

SEQ ID NO: 13005 - DNA, 379 bp, Gossypium hirsutum
  Clone ID: uC-gsflmaxxa090a08b1
gcctccgattttatgtttaattcaatggaccaaaagacggggggtgttatttagaagtatgggggagtaaagaggaactcccagatgcttatccttataaatctccatcaattggctttataaacacgatctatcacccgaatgtagatgaaatgtgtggttcagcttgtttggatgtcatcaatcagacttggagccctatgtgcgacctggtaaatgtctttgaagagattcttcctcaacttcatatatatcccaacccatctgatccatagaatggagaatcttctgcactaatgatgcgagcacgtgctgactatgaacaaggagttaaagagtatcgtgagaaatatgccaaacccgaacacattgtatcaaa

SEQ ID NO: 13006 - DNA, 410 bp, Gossypium hirsutum
  Clone ID: uC-gsflmaxxa090a09b1
ttttgtagtatttatcctagcgatatcctatctgaagttatttgaagcacccgtgtgttatcccatactgaaatatggtcacctttaccaaccctccaacataatccatctgtcaagagattctttgacgaccaaatactgctccaggtaagtgaagggtgccacaaattcgccattgtactcctcattgctggaaaatgaacaatacttgcagttaaaaagcatcccaccaattgcaaaacttccgtttctctggctgaatcagatacaatttgtacttggaaaatatcatcttcctcctccggaagagcatcttaatgctatatatgggtcaccagatagttgcaatcagcaggacaaaataatttgcttgataaacagtgtaacatggtaatattggggtgaacttt

SEQ ID NO: 13007 - DNA, 486 bp, Gossypium hirsutum
  Clone ID: uC-gsflmaxxa090a12b1
cccattcttccgccatatttgtagaaagaaaacataggagggattaaaaataatagagggggttataaaattaatactgtattagcttacttacagggctcctatctttcatgatggataacagtcctaccactggcagagtaaacactacagctgttgagaagcaacgcctggcacaaacataccattcttataattgaaaaaaccctaattgtggattcaattttggtcttttatgcaagtaatagctgactcaatgtttaaaatcaaaatatttcaaaaatttgaaaagagcttactggaaccggctgaaactagccggctgatgttttaaacgacagcgtttttggaccgtgatacctcagatgagattcagacggtgctgcctttaaagaaaactcgttctttgcgccacttttttatttgatggggttttttcaccacccatttttcaattttttggggaccttctttttttttttttaa

SEQ ID NO: 13008 - DNA, 394 bp, Gossypium hirsutum
  Clone ID: uC-gsflmaxxa090b01b1
gggggccggggcggagatttctcgggcgacccacacgtccggcagtaataaggccaacataaagaagagacattttgggagcacccagttttgatcatcggtgtgttggttctcgggttcgatttgatggatccttttgaaatcagtcctgccggtgggatctagtttaggccctgtgaacatgacattgcaccatacacggaagtcatggcaagttggcctagagacaataaaagccggttgggaaatgggaaactccagtttgtcgcgaggggtctcggacccgaatcgctggagattgatggattcggtcgtggaccttacactggattagcccatgggcgtattgttcaatggatgggtgaagatttctggtgggagacatttgtcattg

SEQ ID NO: 13009 - DNA, 148 bp, Gossypium hirsutum
  Clone ID: uC-gsflmaxxa090b03b1
cggcgcggaattgccgggaccacaccacgccggcgtttttttcccacaaaacctagaagttccactaggggggcgattatatacaagtttgagagtttccacaagccccaaaaattccactaatgccaggacagacgggatgtgaaaa

SEQ ID NO: 13010 - DNA, 521 bp, Gossypium hirsutum
  Clone ID: uC-gsflmaxxa090b04b1
cccattcttccggctgagttccaagctagtgatttgggtgtgctcgttgagaatacctcagttgagcagcttggtattgccagaaaggtgatcattaccaaggattcgactcaactaattgctgaggcagcctcaaaggatgagatacaaactagggtggcacaactaaaaaaagagctagctcagacagattctgtctatgattcagaaaaattggcagaaaggattgccaaactatctggtggtgttgcagtcattaaggtgggggctgcaacagagactgaacttgaggatcgtaagctacggattgaagatgcaaagaatgctacatttgctgccatagaggaaggtattgtgcctggtggtggtgctgcattagttcatctctcaagctgtgttcctgcaattaaggagaagcttgaagacgcacatgagcgcttaggagctgacattgtgcagaaggctctggttgcaccagctctgttgatagctcacaatgcaagcaatgaaggtgaggtggt

SEQ ID NO: 13011 - DNA, 520 bp, Gossypium hirsutum
  Clone ID: uC-gsflmaxxa090b05b1
ttcgtgttcacggactcttggctatacacaaagggtagggcatttttctctcaaccctgtggatcctcaaccccgagtccagccaaatctagcaagccaccaccgtaactccgccgtgggtggtggccggaagtgccaaaatcaggccttttcgaccccttttcaaccccctttttatttataaaaaaatttgaactgctacgtctgtttttaaacaaaataaagagcgagattcgtaaaaacaaatggggatagaacaccgttcgatccctcgaacgaacctccccgtttttgaggtattcgagttctcatcggcgactactcaggtgcaaagatcgtggcactcagcgtacggaggctgagctggcgtacggaggtgcgctggaggccgtatgtgggggagcggcacgaggcacatgggggctagggttttggctgaatttgatttagtttctgggccagttgggccttagggatagttctgtttcaggcttgtatttgggtttaagtttttgaattt

SEQ ID NO: 13012 - DNA, 457 bp, Gossypium hirsutum
  Clone ID: uC-gsflmaxxa090b06b1
cagttttaatggcaactacacacgaccacacttgggatggttattattgtctttctaaggggttctcaaacttgtcattacgctcgctgaatactatcgctcatttcttgcctcagaaaccctaatcgataactgaagccattgaatcatgtgtgggcgtgttccaaaaaaatctgataacactaagttttacgaagtacttggggttcctaaaagtgcatgtcaggatgaattaaagaaggcttataagaaagctgcaattaagaatcatccggataaaggtggagaccccgagaagtttaaggaactggctcatgcttatgaagtacttagtgacccagagaagagagaaatatatgatcaatatggtgaagatgctcttaaagagggaatgggaggaggcggttcttctcacaacccatttgacatatttgagtcatttttcggtggtggagcc

SEQ ID NO: 13013 - DNA, 459 bp, Gossypium hirsutum
  Clone ID: uC-gsflmaxxa090b09b1
accccgccggcggttttttcacccgaagcttaaacgctccaaacgggggagcttttatgcagtgtttgagcttcccacatgctccagaacttctactgatgccagtacagacaggatgggagagacgacagtggtgccgataggctggtgctgggactagtgatgtgtgcggccagactatgatcacatcatgaacttgacagtgtgaatctgtcacgcgcgaaagcttggatccggtaatggccagtgaacgcaatttatcgacgtagagcgatcataccacataaggattatgttacgatgcccagaacagtgcagatacattttcatgcatacgatagattattgcccaactgtgagtggaaagatataacacttgtaagacatatcgcttttaatactagcgcaactagagaatatgggttgttgataatacgccatcctagcttagctgaaagt

SEQ ID NO: 13014 - DNA, 443 bp, Gossypium hirsutum
  Clone ID: uC-gsflmaxxa090c02b1
caaatttttttttttttgatttccgcttttcagtttgggggatttttgcaccttgatatcgactcattgtttcgacgctttggcctctatcgatccacaaagatgattgagatcagcagtgggtttttgccatttttaggggttttatatttggactggtaattgcttaccattacgtgatggccgatcccaaatatgagggaaactgaaaccgttagacagttaaattatattacatgttagataagaacttagattatgttcgtaaacatgttagttttctttgcataattgaactgcttgttttggtcaatcttcttttacatactaaagattgatctatgatcgattttcgttagatttgaaggatattaacttttgtctttcaatgcatttagtgatgcttttgtctcttaagggaaatgggcctttcatttgctggg

SEQ ID NO: 13015 - DNA, 528 bp, Gossypium hirsutum
  Clone ID: uC-gsflmaxxa090c06b1
ggagttatcaacggttagtgggaaaacttatctatctttgtcacactcgttcagacatagcttttggagtaagtgttataagtcaatttatgcatactcctagggagaaacatttggaagctgcctacaggatattgagatacttaaaagggactcctggtaaggggttgcattccaagaaagatgtaaatcgaagcatagaagtctacattgatgcagactgggcaggggcaattaatgacaggcgctccacaagcggttactgcagctatgtttggggtaatcttgtgacatggaggagtaaaaagcaatctgttgtggcacgcagcagtgctgaatctgaatatcgagcattgtcccacggtatatgtgaaggaatgtggttacaacagctaatgagagactaaaattatcctatacaaaacctataacattatattgtgacaaccaggcagcagttagcatagctcataaccctgtacaccatgaccgtaccaagcatgtggaaattgatcgccactttattac

SEQ ID NO: 13016 - DNA, 563 bp, Gossypium hirsutum
  Clone ID: uC-gsflmaxxa090c09b1
gtgacccccggggggcccgggcgcaatatcccgggcacgccacacgccggcggtaataaggccctcaccccatttagacattctgggagccaaaccacaaagaccaaaccttagccgacacttttgggctactcatgggaatcatcggcgttcacgcctccacctctgacgtggttcacgacccaagtcgcgtaaatacaagaggagaccgcagtacctgcttgtggttagatatacaagccggaggatggcctacgacaatcgaaaccgcaggcttgcgaggagtcaacgaattcaggggttttccactatggagcaagcttgcagacctcgggcgttagacgtgctgacaccatgtgaggagtggcgatgcacaaagtacatgaggctagggtttctggtcggctcaataagctttagatatatgggccgttcgggccttaggttagggacggttgattatgggcttcgtctggattgataaaaacttagattatatttggttatgttattcatgtacttttgagtataatgggcctggtcaaaaaggcctcttacaatta

SEQ ID NO: 13017 - DNA, 495 bp, Gossypium hirsutum
  Clone ID: uC-gsflmaxxa090c11b1
cgtccggtaccagatgccaacctcatgcggggtttgttaacatcagatgttattgatctgatgaacctaggacaaaggaatcgtgcagttggtgcaacagccctaaatgaccgtagtagccggtctcatagttgcttgaccgtccatgttcaaggaagagatttaacatctggaactactctccgaggctgcatgcatcttgtggatcttgcaggcagtgagagagtagacaagtctgaggtaacaggagatcgactaaaagaggcacagcacataaacaaatctatatcagctctaggagatgtgattgcttaccttgcccaaaagaatccacatgttccttacagaaacagcaagctcactcagctatttcaagattcacttggaggacaggccaagacactaatgtttgttacataagccctgaacctgatgccttggtgaacaataagtacttcaaattcgagagcgtgtacttccgatgacttggggctg

SEQ ID NO: 13018 - DNA, 115 bp, Gossypium hirsutum
  unsure (1)..(115): unsure at all n locations
  Clone ID: uC-gsflmaxxa090d01b1
ccccagatataaaccccagaacccacagacgaaccccttggggataaaaaaaataaaccggctgttccccaccacccccaaggccaanaaaacccccaagactcacccaagaacc

SEQ ID NO: 13019 - DNA, 469 bp, Gossypium hirsutum
  Clone ID: uC-gsflmaxxa090d03b1
aaaatgagtcattttcatacgtgaggttcttttttaagtaattttgcggtatactcaactaattttcatcacttcggccaaaaaaatcaaataccgatggagccctgcgagattctatcagagcttaacagtgttataaaaaatcagaggtactttctattgcgtataacaagcagcaatcgatatggattttctgaattggctaatgtactctggtttctacttgatattgcttcaagctttccttttgatcacgagacggaaattggtcagatcccatatggttccgcccggtccaccaacaattccgatcttcgggaaccttttccaggttggtgataaaccccataggttccctgccaaacttgtcaagattcatggggacatcatgactctgaaacctggccacactactacccgagttttttcatctgcaacaatggcccaaggaaatccttcaaaaggcatg

SEQ ID NO: 13020 - DNA, 519 bp, Gossypium hirsutum
  Clone ID: uC-gsflmaxxa090d04b1
aaattagtgaagcgtttttcgggtcatcacgtaggatccagagatcgtgtttgatggagaaattatgagcatcacatcacttttgaagtatatttgaatctttttgctcggttgatgatacatatgcctgcattgtgttgtttgctaatggggatgaatgtgggggaattagaggccagtggtttgttatgtattaactgagtgcaactgactacatgtaggatgttaggcactgaatttacttaaaatggttggttttatggttgtgccatgactgcttccagcattcttgaaaaacaaaagaaaaagggtttaagcttctcatattgtaatgaaaagaggacacttgctggttgggggtcttttattaggaagaaaagggaggtgagaactaatttcagataatgagggaaatgaggaggcagttcagtgtaggttattgaacttggaattgggtttaatggtttgtcgcctggtattatacaggactaagaaaagtcatgaatcctttgaaagctt

SEQ ID NO: 13021 - DNA, 533 bp, Gossypium hirsutum
  Clone ID: uC-gsflmaxxa090d06b1
acccacgacgtccgcccacttttttcgcatcttacatacagggtgtatgtaaaagagagaggggtattatttaatatgcttccatcagatgcaacctatatactgctgcatgtacctttggaaacttttgaaagattgcactcaggatgcagtaaaaactctatcaaactatcttacgtataatggtgttgaaggtcttcatacaaaagtgaccgaatttgtgaaggacaaggactgtctcgtctgtggtccgggtgccctcatcgagctggatactgcagttaccctaaaaaagttcgttgatatgctagaggaggatcctaaggtgctgatgacaaaggcctcgatcacatatcacggaaagaatctatacatgcaggctcctcctgttttggaagagatgacccgatcaaatctggagttacccctatatgatcttatggataaaacccccaaagacgtcctccatgcaactggtacgatcaacaaggatgacaaaaagtcgtctggtttaagaaaataaccagttgttt

SEQ ID NO: 13022 - DNA, 503 bp, Gossypium hirsutum
  Clone ID: uC-gsflmaxxa090d09b1
ttcaaggtatgcaaccgaaaaaggaagggggggatccatgaagtgagttagggctaaactcagcaatgtttgcgtccaaccaccagctttcgggtcaaccgagggcgttagctgttgttgaaaccaccacaacttcgattcaggtggatctgaacgaagcctctatggcttccagggatgaagtgcaaaatggaggattttcagaagccaaatccatcatggagagctctgagaaacttcaagatgatcttcgaatgttgggaatgaaaatcaagcagcatgaggatagcttagaacttctgaggaatcagaagaacaaattagatgataccatacttgatatgcaaggtatacttttcttattctaaaacgcatgcatgacataaaattcacttgccattcaagaatggaagtaaagatattgtgatgtttgcaccgattgctatgggtgacaatcagaatgagttaatatacagctcatagatgacaagaagctaatgact

SEQ ID NO: 13023 - DNA, 511 bp, Gossypium hirsutum
  Clone ID: uC-gsflmaxxa090d11b1
cacttcatgtattggtttccagcattggtgcttaaatggaatcattgacagcaattgaagaaaaagtaagagaaattagcaatttgcgggaaacaaacaccaaagaaagtaatattcatctattattatttgcgaaacagagcaattggcaatggtttgcaggtttcaactctctcaagctctaaaacacaaaaaatgcagtaaaaagaaacaagctttgtcactttgtcttatcctctgatatacctagtcatcttcattgtcctaatggtttaatcaccgttgttttttaagttaaacctctacttgtaaacacaaagtaccctccattatcagatatgattatctgctacatttcctagaacacctttctggcataaccaaaaacctaagctttttgaacccaatttcaagtttaacaacaacaaaaaagtttggggttttcgaatgggttgtgctacttcaaagaaagaggaagaagatggtgttgtgtcactgtgtaaagagagga

SEQ ID NO: 13024 - DNA, 143 bp, Gossypium hirsutum
  Clone ID: uC-gsflmaxxa090e03b1
caccggcccaaaatccccgggaccacccacgcctcccactattcctccacaacactatacaacaccaaaattggggtttaaaaaaaaaaaacccacctttacccacccccactacaccaaaacatcaacaaacattctttcac

SEQ ID NO: 13025 - DNA, 278 bp, Gossypium hirsutum
  Clone ID: uC-gsflmaxxa090e04b1
gccgcttctctagaggtctggtctaggggacatttttataaatcctttttgggttcaaaaactcagatccgttcggattcctttgtcccagacctagaatggagacctttctatttacattactagtctgttaccgagggacaccctgtcatgctttgtgaccaggtctctgatgctgctctcgatgccctgcctcgcccaggaccctgactggatggattcctgtgaaacatgcactgcaactaacatggtcatggtctttggagagaattaccacc

SEQ ID NO: 13026 - DNA, 228 bp, Gossypium hirsutum
  Clone ID: uC-gsflmaxxa090e11b1
cgcgcgcgttttttgacaaccggaccctgctctcttcctgggtggggattttctacattttgtcaattatatattacatctttattcttcagtaatggctttcatgttcttcaactctcttgttgttcttcttctgcttcttctacaaatctcatgttctagattctcattggcattgcaagagaactcatcagccaccgaccgctcgggtcagagcagttccaactc

SEQ ID NO: 13027 - DNA, 434 bp, Gossypium hirsutum
  unsure (1)..(434): unsure at all n locations
  Clone ID: uC-gsflmaxxa090e12b1
tttattggcatattactctgggttggggattttataagcgggtctggtttttctcagctggccacaaaacaaagcaagtaaatggaaggaacagaaggggggaaaagcatatcagcgtatcataatatgcaaaagaagctgaatgttaaggaaaatagttgcagagataaaggaaagggaaaaaaaaatggtgggtaaggatgtggatgatgatgatttaaaggagctgagcattataatcgttcatgaagggccttctttatctcgattcctcgatgcttatcccataagggaacctttaaggatcccttcatttctcttctaggaaatttgaaatgtctctggttcttttattataatttagactttgggaaagatcggattttcttttttttgtaaggcataagagngtaatttttttttaatgtaaagaa

SEQ ID NO: 13028 - DNA, 494 bp, Gossypium hirsutum
  Clone ID: uC-gsflmaxxa090f02b1
ggggcgggggcggggtatccggggcgacccacgacgccgcccattttttcgcaaaacccatttcctcttttgccgagggggcctttgacaacaaccggggctttgatccccacatttccctctttggggatgcaagggttgaagatggaagctccgatgtgcagctcacgcgtcctcacgcgcctagttccgggcttctattgctagacaagccattgaagctcacaatggaaaacaatgtgggtcaaccggggtcgtattcaactgagttttacttttctatagctcccggtgattgtgatggataagctattgagctcattcctaatgggatacacacaagagatccgggccaagggtctcatggtcatgatggcgaaaagatattgcttggcattgcatttgatacaaagaacgatgatgataaagctggaaactttaatgcagatcatgtaagcattgatattcatggtgttgaatctgctaaacttagc

SEQ ID NO: 13029 - DNA, 420 bp, Gossypium hirsutum
  unsure (1)..(420): unsure at all n locations
  Clone ID: uC-gsflmaxxa090f04b1
cgcccattttttcgcgaagaaaaaaagaaaccagacaganggggttttttataaatatattgtgtgttaccacctccgttcagtagttgaagctatatctgctgatgacgataacgccgcttctctttatccagtattctgtcccgaagaagtgatgacttttccatcaacatgtggagcctgtgctgccacaagtgagacttggatgtatgtaaccaggattccatattttcaagaagttattgtcatggcatccacatgcaatgcttgtgggtacagaaattctgagatgaaacctggtggggcaattcctgacaagggaaagagaataaccctgtctgtgagaaacctcactgatttaacccgcgatgttataaagtcagatactgcaagtgtaaaaagcccagaacttgatttgga

SEQ ID NO: 13030 - DNA, 139 bp, Gossypium hirsutum
  Clone ID: uC-gsflmaxxa090f06b1
gcccaaatccccgggacacccacgccgcaattatcgtacggcacccactcgaactaacgtaggacctttaaaaaatgttgggcggttaaaacaacaagacagaggccagggacaacaaactacaccaggagcgggaaac

SEQ ID NO: 13031 - DNA, 409 bp, Gossypium hirsutum
  unsure (1)..(409): unsure at all n locations
  Clone ID: uC-gsflmaxxa090f10b1
accaccgccgccggtttttggcaacttgtttttgatcattgcatagnggtgccttatgtaaatagctggtacttacttgactaatggaagtgagcttttgcttgagatcctcggtcctggcattgcccgaggattggtcttgcctatacttggagctcatcccgatgcaatgctgattcttgtatctggactgtctggcacagtagaaacagctcaagagcaggtcatagtccgaatggcgtagatagcagggtcaactgtcatgcttctcactgtgatatggggttactgtgtagaagaagaccgatgcgaccatcatgactcactagcggttgatggaactataacaaacggattgcacctgacagagactggtgtgagaccggatatatggacttcgctatgctgc

SEQ ID NO: 13032 - DNA, 531 bp, Gossypium hirsutum
  Clone ID: uC-gsflmaxxa090g01b1
gctttattggtttgatcacttggggctgtgcttatgggatgaacagggtatttgttacttgacaagagaggcagataacatggctcataccgcggcagcatgtgctgagagggcaaccaatgatatgttgattggtccagattgtgctctaaacattgagctatgtgacattataaacatggacccagggcaggctaaggatgcgttgaaaatcatcaagaagcggctgggcagtaaaaatccaaaaatacagctattagctctttttgtattggattctctcagcaaaaattgtggcgagcatgtttttcagcagattgttgagcgcgatatcttgcgtgaaatggttaaaatagtaaagaagaaaagaaaaaaagaaaaaaagaaaaaagagaaataaaagaataaaagtgaatgaaaatttctctcgtttgagaagtgaatcactacaaaatatatatcttccgcaggaggcagaattacttaaggctgtagagtagaaaccgaggttgctttctcttttatgaattc

SEQ ID NO: 13033 - DNA, 505 bp, Gossypium hirsutum
  Clone ID: uC-gsflmaxxa090g06b1
cattccttccaagcttactgtcaatttcggggttccttatgcaactgagttggccaccaaagaggttgacatggttatagtaccagccacaactgggcagatgggtgttcttccaggacatgtagcaacaattgcagaactgaaacctggagttttatcagtgcacgaaggaagtgaagtgacaaagtatttcgtcagtagcggctttgtttttatccatgccaactcttttgcagatataatagctgttgaggctgtgccacttgatcgacttgatgttaaccttgttcagaaagggcttgcagagttcacctcgaagctgagctctgccacaaccgacttggagaaagctgaagcccaaattggaattgatgtgcacagcgcactcaactccgccctcacgggctagcgttgtttgccattcatccgatttttttttccttaaacctgccctaccgatccttaagatttatatgatggatgcagatatagttctgaatatgtt

SEQ ID NO: 13034 - DNA, 131 bp, Gossypium hirsutum
  Clone ID: uC-gsflmaxxa090g07b1
acggtttttatcatactcgactcgactggccaagaggaggtctttttattagatcctggggcggttacatcacagccccatgtcaggcgccgggggcaaactcatgaccggtacccctaatgaaatcctcc

SEQ ID NO: 13035 - DNA, 491 bp, Gossypium hirsutum
  Clone ID: uC-gsflmaxxa090h08b1
acttatgctcgtggcctcgagaaccatttacttgatggtgggtccatatttaaaatttttagtgagctaaaacgagagagcgcatatccagtccacatctgtcatgctggtattcaagtcaggaatgcctgctggggactatactgccttgaacatggaatccagcctgatggccagatgccaagtgacaagactgtcggaggaggtgatgatgcttttaacacctttttcagtgaaactggtgctggaaagcacgaccctcgagctgtctttgtggatcttgagcctactgttattgctcaagtgaggactggtacttaccgtcagcttttccaccctgagcaactcatcagcggcaaggcagacactgccaacaacttcactcgtagccactacactattggcacagagatcgttgactagcgcttggaccgtatcaagaagctagctgataactgtaccgggctttaaggtttccttgtttcaacgct

SEQ ID NO: 13036 - DNA, 334 bp, Gossypium hirsutum
  Clone ID: uC-gsflmaxxa090h09b1
ccggcccaaaatccccggcgaccaacccctccgacttttttttcttcccttcagaaaacatcacctgaaggtgggtcaaaattaaataaactcgcaattataaacacctcgcccctcaaaccaccagaggctgatcctcctgctgcacaaccaatgctatgatgaagggcacagagtaggctctaggcaggcaaccagctaacacaatattgtcgagcttcatcagcttcaagatgattactgatcgtggttgtaactctaacactcgtactggaaggcacctcccccaagcctacacagctggccctgaggcctttacttttctgacctacac

SEQ ID NO: 13037 - DNA, 478 bp, Gossypium hirsutum
  Clone ID: uC-gsflmaxxa090h10b1
ttattaagagatgaaggaaggtcaaatgggggatttaattaaggcaatcaggatcatgattgcgactgtcttgcttcttagtttgatttgatatatgggatgtataggagcctaaatctgatcctttgatgaatgatacatcaaaaggattagaagttccaggtcagacggtgaggaaaaccagtatatctgaagatttctggaccactagcgcttgcgatatggataacagtgcagcgcagtcacaaggaagcatctcgtcaatcagcgtgatcaatcagtctctagatccccatggcaatgccaatagcccatctgaattcgtaaatcatggtcttcttctctggaatcgaactaggcagcagtggattggaaacacgaagtctgaaaatcggcctcaaaaggttcgggaacccaaactgagttggaatgcgagttacgaaagtttacttggaaacaacaaaccattccctaacct

SEQ ID NO: 13038 - DNA, 425 bp, Gossypium hirsutum
  Clone ID: uC-gsflmaxxa090h12b1
acgccgcgccttttttggcacttcatgccaaacaacgacaggggggggcataggataggccaaagcggaataacaccaacgtccaaggaggggcttccaagggaaatataagaccaaaccgcgcaacaaaacatggggcaaaagtaacataattttacacaccacctacacctttatcaaaacagggaaaagcatgggcgaaggatctaatctcaattttccatcacaaaaatgaagccttaagatcttttctgtacaccaaaacaactgctgtctacttattgtacccatccagagaaacccttgatatcattgaaatgtcactaagcccaaagggcagcgagacattctagtgcgatatcgcccacatattgtttgtccatcctgttccgttcttacgcagctccttcagctttgcgcctttc

SEQ ID NO: 13039 - DNA, 443 bp, Gossypium hirsutum
  Clone ID: uC-gsflmaxxa091a05b1
aacatttttatgaggagcatttgtgttgtgcttgttatgggtttgtctttccttctcggcattgcccagggtttcgatttccacgacaatgatttagcgtcggaggatagtttgtgggatctatacgagcgctggcggagccaccacacggttgccaggagtctcgacgagaaacatcggaggttcaatgtgttcaagcagaatgttttgcatgttcacaacaccaacaacaaggacaaaccttacaagttgaagatcaacaagtttgctgatatgaccaaccacgaatttaggaatgcttacgctagttccaagattaaacatcataagatgttccaaggacagtcccgtggcgcccggagtttcatgtacgagaacgtcgaccgtgtcccgcccgcccgtgattgccgacagaaaggtgcccgcacttgctgtaaggatca

SEQ ID NO: 13040 - DNA, 562 bp, Gossypium hirsutum
  Clone ID: uC-gsflmaxxa091a07b1
cgcggggttatactgggagggaaaaccaaaacatgtatgggggccatattatcaccatccatccattgtctggaagaaacactcagcactctagattatgctcatcgtgccaagaatatcaagaacaaaccagagattaaccagaagatgatgaaatctgctttaataaaagatctatattctgaaattgatcggctaaggcaagaggtgtatgctgcaagagagaaaaatgggatttatattccacgagatcgctatctccatgacgaagcagaaaagaaggctatggctgaaaaaatagagcgcatggaacttgtgtcagaatctaaagagaagcaaattactgagcttcaggaactctacaattcacagcagatggtgactgcagatttaagtgagaaacttggaaagacagagaaaaaactggaggaaactgaaaatgcgttggttgatcttgaagataaacatagacaagcaaatgcaactattaaagagaaggaatttttaatatctaatcttcttaaatctgagaaagcgcttgttgagcgtgcttttgaactcc

SEQ ID NO: 13041 - DNA, 539 bp, Gossypium hirsutum
  Clone ID: uC-gsflmaxxa091a08b1
ctcatgcgtccggagaaaatagaaatactaattgcgggggaaatttataaacttcttcgctctctccttccgcctttctctccatgcgaatctctacctagggggagaaaaatatcaagaaagagccaatctcgaaatttctgcgaaaatatgggcgatacctgaaattctccgcttcaagcgacgccctgcaagcgactagtttcacttcgacgatgtctctttctggttctttgcaattgacctatgatttgggactttgcaggaaccaggtatacaagacaaaatttaagattgtacttggaagggggaagttggatttattgagctctgacctctcatctcgtgcttcgttcctgcaacagcatgaacaggatgtttggagaagttcactctccaacaaattgtacaggccaatgcattttgttccatacagaaacaatgcctttaggtgtcatgcttttggagtacctgcccaaaattagaactgcccggtgtaaaagctgcatctatttcattaacaaggtcttacaatacct

SEQ ID NO: 13042 - DNA, 394 bp, Gossypium hirsutum
  Clone ID: uC-gsflmaxxa091a12b1
cgattgtgtagacagccctgccaagcctacttcaactgttaatggtttagaaccaatgattagaggcattgaaaagccaagaaatttggaggatgtgtctgataaaaccaaaccttgggagctaaccgagattgttgatcctactcaatgtcgaacagtcaccttgccagataactctgagattgctagcaaggttgctagacttctttacacaaattctggtgttggggttcttgctttatatacaaatggggttcaaaaactacttctgttttgaaatgcattcgagactaatgtttcctgaacccttggggtttcaattttattgttcttaatgaacaaattggcgaattttattcttaaaaaacaaaaacaccattatatatataaaata

SEQ ID NO: 13043 - DNA, 525 bp, Gossypium hirsutum
  Clone ID: uC-gsflmaxxa091b01b1
cggacgtttgggggaagataacccttgtgcagggtctggccttggttatggtaactttgctatggactggaaccatggctcaatcagactgcaccagtgtgataatcacgatggctccatgcgttgattatgtgactggaacctcctcaaccccatctgttccatgctgctcacagcttgctaacgttgttcaattacagccacattgcctttgcatggccctcagtggtggaggttcatcactgggtgtggaagtaaaccagacacttgcccttgcactccctcaactttgccatgtcaaaaccccacctgagagcaactgcaaagctgctgatggacctgctgtaatttcaatatctccatctggttcacctcaagggttaccaccccattcaaatgataccccaggcagcaacttatcaacatcaggtggatctagaacaattgcagctactgccagtgatgttatcttcaacaagtcccttcagatcatcctgttcttgcagcccaatgttttgttttctt

SEQ ID NO: 13044 - DNA, 534 bp, Gossypium hirsutum
  Clone ID: uC-gsflmaxxa091b02b1
cccatttttccgcccacgcgtccggcttctttctagctgtatccttatcagctttcaaagatggcaggaatcgcctttggtcgctttgatgattccttcagtttggggactgtcaaggcctaccttgctgagtttatctcaactttggtgtttgttttcgccggcgttggctctgccattgcttacaacaagttgacaactgatgcagccctagatcccgatgggctagtcgccattgctgtttgccatggatttgctctctttgttgcagtggctatcggtgccaacatctcaggtggccatgtcaaccctgcagtcacttttgggttagctcttggtggccaaatcaccatactaactggcatcttttactggattgcccaacttcttggatccattgttgcttgcttcttgctcaaggctgtcactggtggcttgacagttcctattcacggtcttggagctggagttggagctattcaaggagtggtgatggagatcatcatcaaatttgcattggtttacacagtgtat

SEQ ID NO: 13045 - DNA, 581 bp, Gossypium hirsutum
  Clone ID: uC-gsflmaxxa091b03b1
gttattttctacaattttcatcatttttaccctggagtgtggggctattgagacatatattttttcctatattttggaattatttttatgaacaatgtactgagaccttataaaccatttattgtgtgaagaagatatagtttgaataccatgggagcaaaatttccaagccctattaatagtctccataacttggaaaaccaagttcaagctctctttacgaaatcaataagtttcaaagatgtgaatgtgaagacagtgatgcaatcattcagttacaacaggcttgtttcaaattcaaaaggattagaaccaaatggttgtgggactgggagcatgcaacttgaagaacctttaagttatgacaaaaaggaaatactctcacatattaaggaaaataatacagtgttttgttaaaccagaaagctgttacaattatttaccaaagatcaaacactgaagaaaagtccggttctggctttgacgagcccggggtcgacaatatcaagctgcattgaagttcaaaaggtgttcaagagttttcgaacaaggagacaagttgctgattggcgcttgttgct

SEQ ID NO: 13046 - DNA, 525 bp, Gossypium hirsutum
  Clone ID: uC-gsflmaxxa091b08b1
cttatttgtccgcagccgcccggcgtgagttcggctggtggttttattccgccgccgttgatgcagtaccaggtgcctgcaggtcaggttccgaatcctgctcttagaccgtttgctccgattccaaatggatatgcagcgctaccgggagctgttcctccgggcaccatgcctcctccggtaggctgtatactttctggtagttataaggataatttcccattcatgggtttatgaattgccagcagcagaccatgttaacaactgactgcttcttccttccatgtgggcactgtgtggcttgctttgcatgtggaacaagaatagcagaggctgatggaacttgccccatttgccgtcggagtatgaaaaaagggaggaagattttcacggtataatcagggggaacagcagtttatgctgatgtcccttaatcgagtgaatgatacactgtctgactgggttatctttatcaacacaagttttcaaggtgagactcttatctatcatcggtctaaacgatgt

SEQ ID NO: 13047 - DNA, 516 bp, Gossypium hirsutum
  Clone ID: uC-gsflmaxxa091b09b1
cccttgtgtccgggtcaatgtacatttgtatcaaaggccatattatcaatgcagcatggaggaatgatctccaaggaagctagaatgacaccatttactcttatagtaaccttccctgccggggctagcgaagcagaagccaaaggaaacctttatctcgacaatgacgagcttccagaaatgaaactcggaaacgggtattcaacatatgttgacttatacgccacattgaagcagggatcagtgaagatctggtcagaagttcaggagggtaagtttgctttagacaaaggttggaaaattgagaaaataacagtgttgggattgagtggaagtgtagacacgtctggacttgaaattaatggaagtccagtagccaatggtgcttccaacatagaattgagttcaatgaaacagatgcatttgcaggaatgtgaagatggcgttggcaagaaaagtctttaatggtcgaactttcatgcttgaatttatatgttggaaagaactttgacatgt

SEQ ID NO: 13048 - DNA, 401 bp, Gossypium hirsutum
  Clone ID: uC-gsflmaxxa091b12b1
gggatggcctttttgaggctattactggttatggtcgtgggggattctatatggcactgtttggaagagtcggtggtggaatatatacaaaggctgctgatgtcggtgctgatcttgtaggaaaggttgaaaggaacattccagaggatgacccaagaaacccagctgtcattgccgacaatgttggcgataatgttggggatattgctggtatgggttctgatctatttggctcatatgctgaatcctactgtgctgctcttgttgttgcttctatatcctcttttggaataaaccacgagttcactgccatgttgaatcctctgctcattagatctgatggaattcttgactggttgatcacaaccctatttgctacggattttcttcaaaataaaggc

SEQ ID NO: 13049 - DNA, 471 bp, Gossypium hirsutum
  Clone ID: uC-gsflmaxxa091c01b1
cccattcgtccgaaaaaagatggcgtctgtaataaaatgtgcaatcttaattctgtcggtgtttttatctgtaagcttcagttcgggtgttaggttgctccaggaacagcccaatgatgacctcaaaaacatggaagctattcctcccattgatgcactcaaccctaccgagttcaatggacccggtgttggcattcacgaagatcatgttgtcccaaaaggttccgaaattggtactcttggttttggttttgaaggtggtcctgaaaaatgttgttcttctggatgttccggtaattgtaatcctggtggtttcgttctaccatttcctcaaattccagaaatcccaagaattccacagatcccccagatcccacaaatcccacaaattccactaatcccacagatcccacaagtcccacaaatcccactaatgccaggacagtcgggatgtgagagtggggagtgttg

SEQ ID NO: 13050 - DNA, 253 bp, Gossypium hirsutum
  Clone ID: uC-gsflmaxxa091c04b1
caatacagacctgacctcaactctccactccagggggcatttaaaacccccatcgcgcggagcccccaaatataaaccaacaccaacgccaggggaagatccgaacgagggaggataccacttcagaggtacgcccttaagcctataccaaccttcagatgggctacacaacagccgttaacagaactgaccatggctcgattccaaagcctggcgccagagtcccctacgaaaaataatacctttccccagg

SEQ ID NO: 13051 - DNA, 533 bp, Gossypium hirsutum
  Clone ID: uC-gsflmaxxa091c06b1
cggattcgtgggcggacgcgtggggaaaagaaaaatgggtctgctagagaaactttgggatgatgtagtggccggacctcaaccggaacgtggccttggccggctgaggaagatcacaaccaccccacccttgtccaccaaagatgaggcttcatcaatggcgatgccgacgagtccgacgacacctgggacaccgtcgacgccggtgtcggctcgtagggacaacgtgtggaggagcgtgttcaatccaggtagcaaccttgcaaccaaaggtattggcgctgaagttttcgacaagcctcaacctaactctcctactgtttatgactggctttacagcggggagacccggagcaagcatcaccgctgattgggcgatggctgacggcggcggagggtagcaaaaccactagcagaaggttgctgctactgaaggagcaggatttgcatgtaaatatatatatcgttctttttaaagtttttcaatgggtcaattaagtagtagtagtagtaagtaagatgttaaaagagta

SEQ ID NO: 13052 - DNA, 363 bp, Gossypium hirsutum
  Clone ID: uC-gsflmaxxa091c10b1
cccatgcgtccgagggaacctaactgatcccctttggtggtttgttttaaactgtgacgaagaaaaatgcacgcgaggcatcagctactggaagagccaatcaggacggcgataaatctggagccattaaaggcctagtatttcccggcaacgacgaacaaagtgtgaactttaggtccaaggtttcgaaccgttgaggatatcaatggttgccttacggctggaatgactgaggctaggaaagatcttctcgaggcatgaccccggagtattatgaggaaacattccaagaatttaaaggcatgccttaaacgcactaaaaagctctgtgcggttatgttggatacctgtgggccctgaaat

SEQ ID NO: 13053 - DNA, 438 bp, Gossypium hirsutum
  Clone ID: uC-gsflmaxxa091c11b1
ccctctcgttcgcccacgcgtccgcgagaacggctgtggtaaactttagaaaaagatttccttttttattactatttttcaatttcatataagtatatacaatcattgcaatttcaatcattttctcaatccgtctttctcaaagggatagttgagcaatttgggaataaaatgggagtgaaggtggagcactgatgtcactgttctggattgggattcgtcaactagctgaaattgaagaacaaatggctacctcgaagaaagtgattacccgggaagagtgggaaaagagattaaacgatgttaaaataaggaaagaagacatgaataaattggtgatgaattttcttgtcaccgaaggttatgttgaagttgcttaataattccaaatggaatctggaactgagccatttattgaaccttggacaattacggatc

SEQ ID NO: 13054 - DNA, 427 bp, Gossypium hirsutum
  Clone ID: uC-gsflmaxxa091d05b1
aggaatcattctcgctaccaaggctgcccgtaaatctgctggaaccattttaggtgtgaagaagctttatcgctaccgtcctggaactgatgctcttcgtgaaattcgaaagtaccaaaagagtactgagctttttatcaggaaattgccttttcagaggcttgttcgcgaaaatgcccaggacttcaagactgatctgcgttttcagagccatgctgttctagctctccaggaagctgtagaggcataccttgtgggtctttttgaagacaccaacctttgtgcgatccacgccaaagcgtgcacaattatgcccaaggacatccagttggctcgtaggaacacaggagagcgtgcttaaattccatgtgtgcggaacagtcgtttaaaaagaagaaactattggttatttttaggcaaaaggaat

SEQ ID NO: 13055 - DNA, 166 bp, Gossypium hirsutum
  Clone ID: uC-gsflmaxxa091d06b1
gtcgttattacactaacaggagaccctcatgaatagagggggctttttatagcagaagtacgtgtggtaacaaagctagcttagatcatcagggtgtgacgtcataaaagtgggcgcttgactaggggctggcaacttctgcttggacacagcttttcgaccttat

SEQ ID NO: 13056 - DNA, 99 bp, Gossypium hirsutum
  Clone ID: uC-gsflmaxxa091d09b1
cagtattcaataatcccaagggagagagggaaaagggtgaatttggaagcgagacagagcttaactcacgccatggctccgtccaaccaccaaactgcg

SEQ ID NO: 13057 - DNA, 300 bp, Gossypium hirsutum
  Clone ID: uC-gsflmaxxa091d11b1
gattcttcccacccaacctaacaaacctggatcaggggggatcttttaaaactcatgtccatgcggatcggggctcgtaaagtccacaactgtacttttgtcgagccaaggaagaaagaggaagggagagacgagagagattattagcggccacatcggccaagctgggataaaggctgcgaattcatgctgcgagctggactgccttgaacatgatagccaccccgaaggaacaacggctagcaacacccgagtggccgtcacacacgatgccatcaacactttcttgagcgaaaccgg

SEQ ID NO: 13058 - DNA, 466 bp, Gossypium hirsutum
  Clone ID: uC-gsflmaxxa091d12b1
caattatctgctcagataaaagaattagaggcacatgtggcatgttagaaacttgagttggaatcattgcaagcaactaacagagatatggcggagcagctagagaacaaagcaagtgaagcagaacagctgggagaacaaaatataggactccaatcccgcatttcagaactcgagatgatgttagaaaagagagaagaagaagtttttattctcacgaagaaacttgaggatgataacagagaatcattgtctggaatggagaactagactgctcaggtaaataatctgctatcggagatggagtcgttgcaagctgaaaaggctctgttggaagaaaatataacgttaaaaggtgatgaagcatcaaatcaagtacagagcttaatggatgaggtaaacacattgcaacaacagctgaaatcccttatagccagaaggcagaatcggaattgcagcttgagag

SEQ ID NO: 13059 - DNA, 547 bp, Gossypium hirsutum
  Clone ID: uC-gsflmaxxa091e05b1
gcttttgagagatgtttccaagttggaggtctttagaagggagcttatgcagtcacttcaagaggacgatgaaagttctgccacagggggtcctccaatcattgcgaagccaacactgtcagaagatgattctgccttgatttcaagaactgcttcaatgcgcagccagtactctgattcgggtgcagaggatcgtgactcagatgtgtcagcctcaagacctggcttacctcatggcctcctgctagcatcacaaacaagcacaccgcggctaactccttcgggttcttcaccaagtgtgtcagcttctgtatcccccacaaggacatctaagccagtgtttcctaagagacatgcagtttcgttttctaccttaagaggcatgtttgatgataggtcatcaatatcaagctccgattctggatcacaggctggtcgcactcgggttgatgggaaagaatctttcgtcaagtcaggagcccgttgtcgaatgagcaagttggtgcattccttgcaaatgttaaggaactaaactcccacaaacaaa

SEQ ID NO: 13060 - DNA, 430 bp, Gossypium hirsutum
  Clone ID: uC-gsflmaxxa091e06b1
ctcttttattcaagcctttcgaccatggcggatgttgggacggaggtagcagcggatggagtgcccatgaagagaacattcaagatgtttagctttagaggtgttgaattggatgctctccttgatatgtgcactgatgagcttgtcacgctctttactgccctggctcgcagaaggatccagaggcgtctcatgagaaagaccatggatttaatcaagatacttcccaaggcgaaaagggaggcttcaccaggtgagaagccagaaccagtcagaacccacctaccaaatatgatcatcgtacccgagatgattggtagcattatcggtgtgtacaatggcaagacattcaatcaggttgagatcaagctcgagatgatcagccattaccttgctgagcactctatttcgtacaagctagttaagcacg

SEQ ID NO: 13061 - DNA, 370 bp, Gossypium hirsutum
  Clone ID: uC-gsflmaxxa091e12b1
ggcccagaatccggggcgcgacccacgcgcccggttttttcggaccgaccaacgctgattggccccgggggtctattacacccacaagagctggttctaccgcgtggacggaagcactggctgctggcgctgacgacagcaggagcggtccatgatggggtcgctttctactcagcgaacttggttgctcgacacggctcgcggaacgacacaggaagggtgttgatgaacaatacgtgtgggagtaccaaactggagcgatggccacaaggaccggggatacatgcggagagaacattgccaggggtacaaagattactctgggtccaaagacgcccaactagaggacctagaggagcgacgtttgaag

SEQ ID NO: 13062 - DNA, 539 bp, Gossypium hirsutum
  Clone ID: uC-gsflmaxxa091f02b1
cccacttgtccgcaaacagcgcctgcaatagggaaaacagagaaataaaccgaacatcaaagatgaacacagacataacagcttcggccaaaccagagtacccagttatagatcgaaaccctcctttcaccaaagtcgttggcaatttcaacaccctcgattacctccgtttcactaccattaccggcgtttccgtcaccgtcggctacctctccgggataaaaccaggattaaaagggccttcaatggtgacaggagggttgattgggttaatgggtggatttatgtacgcgtaccagaactcagcgggtcgactcatgggatttttccctaatgatggcgaggtcgctcgataccaaaaacgtggactcaaaaactagccatttctctctttttctattctcggctattcacttttatgtttttaggacaatttgaataatcttcattgctgtctttgatttcctgttgttcatttcaaggcatttgtattgctgcttaaatatgacttatatgggtctaagatcccactgaaatga

SEQ ID NO: 13063 - DNA, 462 bp, Gossypium hirsutum
  Clone ID: uC-gsflmaxxa091f03b1
aaaacaaactgacttaactattactatttgggttaggattaaaatttcaaaattcaaaaagtataaggattacaaatgaccaaataaaagtacaaggactaaatccacaacttttgcaaaatacagggactaatagcagaatttaacttctaaaaaaatatagctaaattttacctcactgaatagagatgtccgaagaaattcggagctgagcgtccaccccaccgctcaccacgcagtcacccttccaccagtctgcacataataccttgtctttgtgcgtatcgatgatagaaacaggccacgctgttcttagatcccacaacattactttcccatcataagatgaagaaagtaaatgaagaggagacgtattgtgccacttgcaagccgaaatccaagaactatgtgaagagaactgaaacacgggtgccgatgttccttgtttacgaggatcccata

SEQ ID NO: 13064 - DNA, 258 bp, Gossypium hirsutum
  Clone ID: uC-gsflmaxxa091f08b1
cccacgcgggcgggcttacacggcggtcctgcaataatactagggagctttcagcagcagaattattacatcgaatttgatatggcaaacaataggtttggatgggctgaacgaaggtgttagtgagctgcactttgttattttgtgttttggccttgaatatggaagtcatctttttcttttgcttctatttttaatggaatggtgacaaaagggttattagcttaaaaaaaaaaaaaaaaaaaaaaaaaacaaaaa

SEQ ID NO: 13065 - DNA, 553 bp, Gossypium hirsutum
  Clone ID: uC-gsflmaxxa091f09b1
aaattacctaagcttcctatttctctctcactcagtggaatctatgaaaaacactccaactacgattttgcttccatattcggccgaccgatgctacgccaccataacaacgatctacatgcccgccgttcgactgcttttcagccttagatcccctctatgcttcgatttcgacaaagcaaaaggaatccacggcatttggtaatgtttttcttttattttcaaatgttttaaaattataatgaaaaagaatagaaggaaatagaatcgaaataaaagcatagaacctagaaaagatgaatctaaaatcaccttttaaaaactgactttggattggtcttatattttctttacaatatgcgtgtatttctctgggaaaaccgaccccctttacaattgattatctggctttttatagccgaataaagagaaataagaaaaaataaaaaaataaaagaaaatacaatggccttggattttctgttatgcctttgctgcaattgctagatatttgctgagttgtttgctagtccgttttgcaggttcaaaggtc

SEQ ID NO: 13066 - DNA, 425 bp, Gossypium hirsutum
  Clone ID: uC-gsflmaxxa091f10b1
cttatgcgtccgctcatcactctcctaagaaaagcgtgtggtttttaaaaccctttttccgatcctaaccccacctcaccaaccaggattcaacatgaagggaggaaaaaccaagtcagatactaagagtgccaagctatccgtgaaaaccaaagctggaaagaaatcggggaaggctgccaaggacccaaacaagccaaagaggcctgcgagggccttacatggtgcaaggaggagttccgtgagcaatacaagaaggagcaccctaaaaacaaatccgttggggatgacgggaaagctggtggagaaaaaaggaagagcttgcctgaagcacacaaggcaccgaaaggagcgaatgcaaaaaaagcggagggtgggtatgaaaagaaccatgaagggccaccataagagacaggcctagggga

SEQ ID NO: 13067 - DNA, 314 bp, Gossypium hirsutum
  Clone ID: uC-gsflmaxxa091f11b1
caatattctccaaacctccacatctacggaaaagatgtcaattttgaagaccatgttgcttgtgccccccccggcaataatgcctgatgcaaatatccctaatcaacactgctagggtgcaagctcaaccaaacaccatctgctaaccatgagccaatgcccgtatgaacagttggctcaatcttcctgtgatacaaagcacgcgtcaacccaggccggtggtcttcgcccattccgagctacatttcattttgcaggatgggacaagaacctatggatcccaactttacatgagcgaacctagtggtaactac

SEQ ID NO: 13068 - DNA, 424 bp, Gossypium hirsutum
  Clone ID: uC-gsflmaxxa091g04b1
ttcttttcgaagggacattcgtcataatgaagatgaggggagcatttacctatatgatttcttgcaggcattctttgcggagcaccctgagtttgcaaagaacgacttttttataactggagaatcatatgctgggcattacattccagcttttgctgctcgagtccaccgtggaaacaaagccaaggagggaattcatataaatctaaagggatttgctattggtaatggcctgactgaccctgcaatccagtataaagcttacacagattatgctttggacatgggggtaattaaaaagtctgactatgatcgtatcaacaagctggtcccagtttgtgaaatggcaataaagctttgcggcactgatgggaccatctcttggatggctttatattttgtctgcaataacataatcaatggc

SEQ ID NO: 13069 - DNA, 510 bp, Gossypium hirsutum
  unsure (1)..(510): unsure at all n locations
  Clone ID: uC-gsflmaxxa091g08b1
cctattcgtccgtgaaaattcattttctttggactttgtctgaaatccgagtcctaggaaagatgcgtgagattcttcatattcaggcagggcagtgcggcaaccagatcggtgccaagttttgggaggtggtttgcgccgagcacggcatagattcaacgggacgctatcaaggggacaatgatttgcaactggagcgcgttaacgtttactacaatgaagcgagttgcgggaggttcgttccacgagccgtccttatggacttggagcctggcactatggatagtgttagatccgggccgtacgggcagattttcaggcctgacaactttgttttcggccagtccggtgcagggaataactgggccaagggtcattacacggaaggggccgagttgatcgactcagtgctagatgtggtgaggaaagaagccgaaaactgtgactgcttgcaaggatttcacgtatgccattcattgggaggaggaacntgaatcggcatgggaacac

SEQ ID NO: 13070 - DNA, 492 bp, Gossypium hirsutum
  Clone ID: uC-gsflmaxxa091g12b1
cccttgcgtccggtgaaacacaagattagtggtttgagtcgccttttacactcggtttggcgcgtgcgagattcttacctcctcgaccttcgccctataaatccagcagcccaaatttgaaaatcctcgtcaaaagaaaagtaacttaggctacactttagatttttctttctttttgaaaaatttggtaaagggaaaatgggaagtgaagctgggattgtgaggaaacccagatttcttggcctccatggatttagaacaagtggagcgattctcaagacacagatagagaccaaatggcctaaatcggtattggaaaagatcgatatcgtttacccagatgcgccgttttcagctcaggggaaatccgatgtcgaagggatcttcgatcctccttattacgagtggtttcaattcaataaggaatttacgacttacacaaattttgacgaatgtcttgcttatatcgaagatattaataataaacaagga

SEQ ID NO: 13071 - DNA, 353 bp, Gossypium hirsutum
  Clone ID: uC-gsflmaxxa091h03b1
cggacgtgtgggtgcgaccgaggtgttatgcttgctgaggtgaaaattagattttccatcggcggcaagcctatctaccactttgttggaacctcgacctttagccaatatactgtcgtccatgttggccaggttgccaagatcagtccaaccgcccctcttgataaagtctgtcccattagctgtgggatatgtacaggttttggggccactgtgaatgttgctaaacccaaaaagggtcaaactgttgcagtttttggactgggtgccgttggtcttgccgccgctgaaggtgcaagggtttgtggggcttctcggatcaatcgttgtgatgtgaaccccagaagatttga

SEQ ID NO: 13072 - DNA, 386 bp, Gossypium hirsutum
  Clone ID: uC-gsflmaxxa091h05b1
caaatttttaaatcctaggcgacgacgaagagaaagaggtgaaatgttgaaaggggaaaagatgttgtcttacgtaagcgtgttgttgtacggagtgggatggatagtggtggccgggatggcgttgctggtagcgttttaagagaagctcgtttacgttccggttttgccgggtctaactaagtcttacccgataacgccggcccgactccggctcgtctacgaggacgtttggctcagatccttggacggaatccgactccattcttggttcatcaagctctttcctgagtgttgaggcccaaccatcctgttttttcaagagaatgctggaaaacattgctcaccgtctggaaatggtacgcaataatgctgcagaggttaca

SEQ ID NO: 13073 - DNA, 419 bp, Gossypium hirsutum
  unsure (1)..(419): unsure at all n locations
  Clone ID: uC-gsflmaxxa091h11b1
aatgtgtggcaaagaagtacgtagatcattcttttatgtgtgggtttttagacctctttgatgctgaggacccccgggaaagggactgtttgaaaacaattctgcacagaatttacgggaaactcatggtgcacaggccctttgtacgaaaagctgttagcaatatcatctatcgatttgtttttgaaactgaaaggcataatggtattgctgaacttctcgagatattcggaagtattattagtggttttgctgtaccattgaaagaggaacacaagatgttttttgggaaatcccttattcctttacacaaaccgaaactggtgggtgtttatcatcagcaattaacattttgtgttgtacagtttatagataaggatccgaagntagccgatagcgtgattaagggactgttaaaa

SEQ ID NO: 13074 - DNA, 426 bp, Gossypium hirsutum
  Clone ID: uC-gsflmaxxa091h12b1
ggccaaatcatgaccactctcgtgaccgtgtggtttttgacaactactatccgtcgccggcgccgtatccgccgctagatatatcaccggtgatgttctccggttaccttcggaagcttcaaggttcttccgatggaggagcgatgatgatgaagttggtggcacaagatgggcggtcctgattgctggatctaatggatattggaattacaggcatcaggctgatgtttgtcatgcttatcaactcctaaggaacggtggtttgagagaggaaaatatcattgtctttatgtacgatgatatcgctttcaatgtagaaaaccctaggcctggtgttatcattaacaatcctcatggcgatgatgtttataagggagtcccgaaggactatactggagaagatgttaatggtcacaacttttttgc

SEQ ID NO: 13075 - DNA, 488 bp, Gossypium hirsutum
  unsure (1)..(488): unsure at all n locations
  Clone ID: uC-gsflmaxxa092a06b1
gagtgagtgagagatagagagatgggaggtccaccgtacgattgcttggcgaatcccctaggagccgtccgattagcattcgagaaggcaatagggtcagaattggagactccttcgacccatccctccgcctttaacggcaaagattggggtgcccttgaactcttccgccacttcctcttccaagaatcagggctttcccaggttcccatccttaatcccaaaacattaagatgggttcaacccaacagtcttgtccgttaccgtggtatgatccaagacatgttgngaaatgaattctatgccggcgctcacaaggatggaaatttatggcggaccaacanattcatggatgtttctcaatacccaatggggtcctctcctgatatgtgtattttgggaacgccgcttgctctactgtgttcctgtcccaggacagaantcatggactgaaacctctagtgaaatggaacctaattggtcatctc

SEQ ID NO: 13076 - DNA, 435 bp, Gossypium hirsutum
  Clone ID: uC-gsflmaxxa092b10b1
gatgaaatagaaaaacccaataaggaaacatcgtaggagaattggtgtttttggattcttgtttttacccaatatatatttacatgctttttctcctttgatttaactctttttcctgatatgtataatttctgggattttttattttctaaaccgcctttggattaatcccacatcggaagtgattggttttgagtaattgagggttaaagtggtggctttggcctttgggtgctttaaaggcgactttttcataaatctaggttgagggtattgaagctttttatcgtatggatctcatgggagaagtattttatagctgatttttttttttttatctttggatgtatcttgcttctattgaaggaaaggatcggcttgtgaacctgtctggctttgatttggatgttctcaggccattgaaactcctactac

SEQ ID NO: 13077 - DNA, 373 bp, Gossypium hirsutum
  Clone ID: uC-gsflmaxxa092b12b1
tcgcggtcgcgtgggtgccaatgtacccacggggtggtgcaggtcttgggcagcaaattttttatggtcaagcacctacggcaatgtttccgcagcctggatttgggtatcaacagcagctcatccctggtatgaggcctggtggagctcccatgccaaatttctttgtaccaatggttcaacaaggccaacagggtcagcgtcccggtggcagaagggctggggctggtcagcaaagtcagcaaccaggttcattaatgcagcagcagatgctaccgcgagggcgggtctattgctattcaccagggcgtggtctacctgatggttcaatggctaacattgctggaggcatgctttctgttccatatgatat

SEQ ID NO: 13078 - DNA, 450 bp, Gossypium hirsutum
  Clone ID: uC-gsflmaxxa092c05b1
ctttgaatggcggtggagtatagttgttgtgaatgggagttggttattcacatattaatagtagtgttgttggtattgttcgcgggtttgatgtcggggcttactttgggccttatgtcgatgagtctcgtcgatcttgaggttcttgccaagtccggaactcccaaggatcgtaaacatgctgcaaaaatattgccggttgtcaaaaaacagcatttgttgctttgtacactacttatatgcaatgctgctgcgatggaggcacttcccattttccttgatggtttggtcactgcttggggtgctatcttgatttcagtgaccttgattcttctgtttggtgagataataccgcaatccgtctgttctcgatatggtttggcaattggtgcaactgtagctgcatttgctcaagttcttgtttgggtcctgtttcctgttgcataccca

SEQ ID NO: 13079 - DNA, 341 bp, Gossypium hirsutum
  unsure (1)..(341): unsure at all n locations
  Clone ID: uC-gsflmaxxa092e01b1
atcattttgcggtgtagttggtttgaagccaacttatggacgcgtttcgagatttggacttatggcatatgcgtcatcccttgatgttattggatgttctgggtcctccgttgctgacaccgggattcttcttcatgcaatttctggtcatgattcacttgatgctactagcagtaaacgagaggtgcctgacttcacttctcaattcacttatgcaagttctttgaaatccagaccattagaggggtctaagggtcggtcttatccgtgaaactgatgatgcctggtgttgattctggaagttaaatcagcaatanaggggtgctgcagctcatctggag

SEQ ID NO: 13080 - DNA, 546 bp, Gossypium hirsutum
  unsure (1)..(546): unsure at all n locations
  Clone ID: uC-gsflmaxxa092e09b1
acccaaacttccgactcttgctaccgattccgttccaaggtttcccgtcatttatctcggtcccccattaaactgcaaccgcctgaggagcccacttccttggctccctagcgtaatgctccggcactgaggacagtaaccttagcaccggcagagagagcaagtaaccgtgggtagaccacccaaacgtccggtggggcgtcagacaacaccaaattatagtcacagcccctgctagcggggtggtccggctgataataagtgagggtcgggaagcaaaaaccgcccgctgcagaaaaagtgctggcgcaaccagtagatgtatattgggcgaaataaacccccgcaatggccgcaatggcaggggacagggttacggccactgttgagatagccaagctcgctagggggagtcataaagtactgcaacatggatcagaaactaacaaagctgtgcctgtggctttgaacgnttcgtcngaacctgtggaggaagttacagccactaagcacccagagaacacagggccagaagagaaactgtgt

SEQ ID NO: 13081 - DNA, 343 bp, Gossypium hirsutum
  Clone ID: uC-gsflmaxxa092f08b1
tataaacatggcaccacaccttaatattggtccttccatgtttgtacttttattattattcatttcaacctctaaagttcaatcagatgcttttgatgttgctgccaagtttggcgcaaaagctgacggtaaaacggatttgagtaagccatttttggatgcttggaaagaagcatgtgcctctgtaactccatcaacagttgtgattcctaaagggacatatttattatcaaaagtaaacttagaaggtccatgcaaggctcctattgagattaatgttcagggcactgtacaggcttccgctgatcctagtgctttcaaagaccctaattgggttagattc

SEQ ID NO: 13082 - DNA, 273 bp, Gossypium hirsutum
  Clone ID: uC-gsflmaxxa092g01b1
ctcctgtaagagggacttcaatgctctgaatcattgggtttggagtattgggaagtgtataaatctcagtgtcagtgaaaaaacaactgtcactgcgataaccggacgttgataccttacgtgaacgacccatcacctttgatttatttatagaggaagctcacaaggctatagttgaaggagttcttttcatcatttcgtttatcagacaagaagacgcaagctcaatttctgtggcgtgtcttttttttccttttctttaaccgaagatgg

SEQ ID NO: 13083 - DNA, 225 bp, Gossypium hirsutum
  Clone ID: uC-gsflmaxxa092g03b1
cccacgcgttcgcttcaataggcttctccatcaatcgtttcgtgctccaaatcgcaatctctcttctgttgcggccgatgctcataatcaatcaacgattgagaatatgaaaaagagatttacttatcttgacattaattcacaaattgggagttgtatgccaattgcttcaatgcgaattggaacctttatccacaacattgaggtgaacccgggtcaaggcgg

SEQ ID NO: 13084 - DNA, 204 bp, Gossypium hirsutum
  Clone ID: uC-gsflmaxxa092h01b1
cccactcgtcctcaactccacacccaccaccattggctgtttgtgatcatccgaaaaagaatggtgaccgtggaagaagttcgtaaggctcaacgtgcccaaggcccctgcaccgtgttggccatcggcacatcaaccccgcctaattgtgttgatcagagcacataccctgactactatttgcgtatcacaaatagtgagcac

SEQ ID NO: 13085 - DNA, 445 bp, Gossypium hirsutum
  Clone ID: uC-gsflmaxxa093a01b1
cccacgcgttcgagctgcgcttcatctcttatcctttcttcttcactttcggcagatcccaatggcaccaaagaaagacaaagctcctcctccatcatcaaagcctgcaaagtctggaggtggcaagcaaaagaagaagaagtggagcaagggaaagcaaaaggagaaggtcaacaatatggtgctattcgaccaagctacttatgataagcttctctctgaagctcctaaatacaagctcatcactccctcgattctctctgatcgtatgaggatcaacggatcgcttgcgagaaaggctataagggaactgatggcaagagggtctattagggtggtttaccgcccattcgagccagcagaatttacactagggcaacaaacacctaggtctcatattgttacgttatttgcttaattagtcttaccatagaatgctttttgc

SEQ ID NO: 13086 - DNA, 124 bp, Gossypium hirsutum
  Clone ID: uC-gsflmaxxa093a07b1
agagattcttgtttaaaatataagaaaaaaaatcatacgcaatgagcactgctggtcaggttattcgttgcaaagctgcggtggcatgggaggcggggaagccactatcgatagaagaagtgga

SEQ ID NO: 13087 - DNA, 379 bp, Gossypium hirsutum
  Clone ID: uC-gsflmaxxa093a09b1
ctcattctccgcacagttctagggttcttgttagcagctgcgacagaagaaatgggaaatggaactggaagctttggaaagcgaaggaataagacccacacactttgcgttcgatgtggacgccgtagcttccatctccagaagagccgttgcggtgcttgtggctaccctgccagccgcatccgaaaatataactggagtgtgaaggctattagaagaaagacgactgggacaggccgcatgaggtacctccgtcatgtgccccgaaggttcaaaactgaatttagagaaggcactcaagcaactccaaggaagaaggcagctgttgctgcatcttaagttggttttggtgcttcgtacttttgaactttgtatttac

SEQ ID NO: 13088 - DNA, 96 bp, Gossypium hirsutum
  Clone ID: uC-gsflmaxxa093b03b1
atcatttatatcatcatcatcatcatcatcatcatcgacctgttgttgtttagaagaaatcgtactattatcccagaaatattgattcgaccctag

SEQ ID NO: 13089 - DNA, 142 bp, Gossypium hirsutum
  Clone ID: uC-gsflmaxxa093b07b1
aaattattcccaaaccgaacaaacccatgagtcaatcagatactcattcagttcactaccaaaagagatagctctcgaaatcgcatcttccctcgaggtaccgactcttttctcactgcgttgttaatatcttccttttctt

SEQ ID NO: 13090 - DNA, 259 bp, Gossypium hirsutum
  Clone ID: uC-gsflmaxxa093b10b1
ggccagtctcctctgtgacaatattctaggtcttgcttatccttgtctagtggcggcgccaagacttagggtatccaggctattcagctatctatctgccttcaccggcaatccttcgccacctcgttcattttcgtcactccccaaatccgcgacgatgccgggtgttgacccgccggcggcagagaggcctgcgaagaaggtgccgagacaccttcatcaagttcttcgaaggcaaatatcacgtttattggaagcc

SEQ ID NO: 13091 - DNA, 67 bp, Gossypium hirsutum
  Clone ID: uC-gsflmaxxa093c01b1
cccactgctgttcgcttggaagagggcaaaaaccctaattgtgactcttatctcacaatgttggaaa

SEQ ID NO: 13092 - DNA, 70 bp, Gossypium hirsutum
  Clone ID: uC-gsflmaxxa093c02b1
tgttcgactgacactttcaaaagttctttttgtatctcatcacccggctttttttgaaatccctattttc

SEQ ID NO: 13093 - DNA, 482 bp, Gossypium hirsutum
  Clone ID: uC-gsflmaxxa093c10b1
gggactggttccatgtgaacgggacttgcacatgggttagtcgatcctaagagactgtgtaagcccgtacaacagcgcgtccagtgcgagcttacaaagggaatcgtgttaaaatatctgaaccgggacgcagaggttgacggccacgttagggagtccagtgacgacggcggtggcctggggaagagtgatcttttctgttgtaacggtctgcctaccctggaaacggttctatcggaggaggggcccagtaatcttctgatcactttacgttctgtggttgtgctctggcacgatgttcattcttattatcctatgtgtccatatttatttctcactatttttatttcattctctactgctttttcatgtttttttcttttttccttttctcattttatatcactggtttttcctcttttttctcttgctactttcctattttttcttttctttttcctttttcatttttttttctcttt

SEQ ID NO: 13094 - DNA, 181 bp, Gossypium hirsutum
  Clone ID: uC-gsflmaxxa093d04b1
gccaaatcctccgtgtagacttattgagtcaactcgactccatttttagtaggataatccatccctactcctagtgaagagaggtgaaacgcatcatagtatttcgttacccatttccgtagatccgagacccttaacttattcctgttccctatgttgatccagctgataactattctat

SEQ ID NO: 13095 - DNA, 421 bp, Gossypium hirsutum
  Clone ID: uC-gsflmaxxa093d05b1
atggattattaatgtaacggaaggaaaatttcattggaggatctaagattcatgagagagagagagagagaactcttaatttattttcattgccttgctcagattcccttccctcccctccttctctccccccttttctcctctttctctctcacttactcctccctttaccctccctcctctcctctacttcatccctcctactccccctctcctctccctctttcctctctcctcctcccctcccccttctcctcccctccttcctctttttcccccctcactatctcactctcatcctctccctttctcccttcttcaccttatactcctttccccttcctctctcttatccttccctatcctctccttcctctccctctatccttttctcctctcctcttcctcttcccttccttct

SEQ ID NO: 13096 - DNA, 221 bp, Gossypium hirsutum
  unsure (1)..(221): unsure at all n locations
  Clone ID: uC-gsflmaxxa093d07b1
ncctactctctctctctctctgagttttatgagcggaggcttttttttacataatttcttcatattcacacggttatacctagaaagattttattgaaaggtgaaatcatgaagcttaaaagtggaacgggcagtatacctttacctccacgaccctccatatgatcccccgttttcccacaagcccccatccatgaagctacccccacttatcttcccca

SEQ ID NO: 13097 - DNA, 142 bp, Gossypium hirsutum
  Clone ID: uC-gsflmaxxa093d09b1
atagtttagccaccaaagggatctggaagatacagcagggaccttttaaaaacctttttttcctatattattccccacaaaatacacacaaaactaactatcccataaaaacaaaccctcaaaatttattcaacaatcatcc

SEQ ID NO: 13098 - DNA, 291 bp, Gossypium hirsutum
  Clone ID: uC-gsflmaxxa093d11b1
ccgattctctctactttcgccaaacaaacgcaagatttgtagattcatttctattgtatctccgtctccgaatcaatggctttgccgaaccagcaaacagttgattatccgagcttcaagctcgttatcgtcggcgatggtggaactggcaaaactaccttcgtgaagaggcatctaactggagagtttgaaaagaaatacgagccaaccattggtgtggaggttcattccttggacttttttactaactgtggcaaaatccgtttctactgctggtatactgctggacag

SEQ ID NO: 13099 - DNA, 231 bp, Gossypium hirsutum
  Clone ID: uC-gsflmaxxa093d12b1
cggtcttttgggcacaggagaaatttatcacaaccatgaagcgagaccacaatcatgtccaacccaacccagacccctcttctctccgcgacgctccttctaccggaaaggccaaggtttgggacgaagaagccgcccaaacaagactgtgggatggatgagcttttggcgggtttgggttacaaggccaaaactgtagacatggctggaggggctcaaaaagcttgagca

SEQ ID NO: 13100 - DNA, 108 bp, Gossypium hirsutum
  Clone ID: uC-gsflmaxxa093e08b1
ggaacctaagaagaagaagggaaaaggcggaaaagggggggctatttaaaaacattttttcccctaaataccccccaaacaaaaccaacaaaaaaaacacaaaccaaa

SEQ ID NO: 13101 - DNA, 79 bp, Gossypium hirsutum
  Clone ID: uC-gsflmaxxa093f01b1
gcggccacgtgttcgaccacgcgtgcgtccacgcgtacgtccacgcgttcgttctgtgataattgcttaaaaattaaaa

SEQ ID NO: 13102 - DNA, 349 bp, Gossypium hirsutum
  Clone ID: uC-gsflmaxxa093f04b1
ctcactttgttataaggtatagactgcgagggaaaaaaagggagctttttacacaataccctgggctgaggtggctaaactgctagaaggacattcggttttgtaaggacacatgtcgtttctcctaaagggaaacaccaggtatctatggactggttctatggcctttggtgacaatggctcaagctccttcggctgttgtgaacgtgttcattgccaagtataaaatggatctgccctactgctcctacttgtgctggggctgtacttgtgggaatttcttacacagagtggcctgatgtttgagagcagcccgaaccaggtccacattattagggggcctttaggg

SEQ ID NO: 13103 - DNA, 436 bp, Gossypium hirsutum
  Clone ID: uC-gsflmaxxa093f08b1
aacagatctagggctttaaagagaaagggagcaaaagtgagagatttgagagaagtttctcctttctcccccccccggctcccccttccctccctctcctccccctctcttctcccccatccccccctaccccctcctccctctcactcctcctcccccccccccccctcctctacctactctccctcccttcctctcccctccctcctccttctattcccctccaacccttctatccccacctccctcctccttccctccctcttcctctcctcctcaccttcactcccccaccccccaattcacacactccttaccccccccctctctcttctctttctaccctcccccaatctctcctccccataccccccactctctatctctcctccctactccttccctcctccatctcttcctccctttaccttcctcc

SEQ ID NO: 13104 - DNA, 376 bp, Gossypium hirsutum
  Clone ID: uC-gsflmaxxa093f11b1
caaatcataaatgaaaaaggtcgaaattccaatattgtttctcagctccatgttcttgatggtagtagcgttgcctattaggctgcctataataccgcgggtgcgagcaaatccgcctcgacttgtcccgctttgcacttcccaactaatgttagtgaactatgcatgtggaacagtgccattagtcccatccctatttctatcttctaacacaccagatgtaggaaatgagaatggcaatggaacaaggagtagtcaaggagatggaaatgggatagagaatggagcaggagaaggggaaatcaagcattgccttatgcatattcataagcataagcataggcataaggagattactcctgtacataattactgt

SEQ ID NO: 13105 - DNA, 491 bp, Gossypium hirsutum
  Clone ID: uC-gsflmaxxa093g01b1
cccactcgtttgccacacccaagatctgccccccaaaaaaggaaaaatttaaaaaccaaacacctaaagtaacagatgcaagagagcgcaaaataagggcagagagagctccgtggcttgcaatggataccgtcgattcttagatctcttaaccctagccatttttcttttttatcatgtatagattctcaagatttttttctcccgagattctttcttattttctttttttttttttttttcaagaatcttggtagccactgatcggagcttcactatgctttacttttcgaaactctattggctttatttttttttgtctgcaatctgattgagcattgtttttaacgaagatatcaacggttaggtttaatttgattcagttctggctggtttactgatttacctgcatttagcgttctattttgtcgggggtgccttggtgattgttttcccaaaccaaacattggttttgacaaaaatataaacgt

SEQ ID NO: 13106 - DNA, 172 bp, Gossypium hirsutum
  Clone ID: uC-gsflmaxxa093g02b1
gcgcccgccacctgatctctcaatcttccttcttatgttctgaaaattttcacagcatattgtgggggattttctccctcaagcattctgacgaaaccatacggagagacacgcaagctcgtccaaacaccactcggctatccttattacaaccaaatccgacccgagccag

SEQ ID NO: 13107 - DNA, 68 bp, Gossypium hirsutum
  Clone ID: uC-gsflmaxxa093g03b1
cccacgcgtccgcccacgcgtccgaagaaattgaagataagagtatacagcttgaagactgatggtct

SEQ ID NO: 13108 - DNA, 321 bp, Gossypium hirsutum
  Clone ID: uC-gsflmaxxa093g04b1
tgcagtctgttcaagcctagctcagcagactgaaaaagatgggccctggtttacccattatcttcattaacgcctgagctcctgttctggaccctcaccatcatcatttgctccccccgtcacaacggcatttaaagctgtgaacaactcatgcatcaaccagtcaggactcaaacagcacaaaatcgccaaatcatcaagatcatctttcagcgcttctcatgttccgctttcgctgctttctgtgtccctagcgcgctctcttcatcctcagtatgcccaattcccctccttgctccggatctttcatccgcccagtat

SEQ ID NO: 13109 - DNA, 105 bp, Gossypium hirsutum
  Clone ID: uC-gsflmaxxa093g05b1
cccactgtctgtcgggaaatgtatttatttatattttgcaagagggcagagttggagacatcttttcaatactactagatctcttctctcatagtctcaaagccg

SEQ ID NO: 13110 - DNA, 100 bp, Gossypium hirsutum
  Clone ID: uC-gsflmaxxa093g06b1
cccacgtctccgcttttctgtttaacggcctgcccaccctggaaactgttcagccgtgtttgtagggtccagcccccggaagagcaccgcacgtcgcgtg

SEQ ID NO: 13111 - DNA, 441 bp, Gossypium hirsutum
  Clone ID: uC-gsflmaxxa093g12b1
aaacatatgagcctgctccatcgtcttcgtcgttttcatttgccagattttggaaactgatcatggctggaggaggaaatttcatgcacagagttatatcttatgtcgtcaatgagcttgtcgttgacagacttgcaaacagtcctgcattccaaagatttgctgtgaggacatcaaagaggatagaagatatctccagtatggctgagaagaagaggcaagaacttgctgaacaaatgaaagaaatctcgaaaaacatggagtctaaaaaccaatgatcgtattcgtacgactgctctgaccctctcgtagttgtggtaatctctagcttatgtattgctatatgaattcattttctgaaatgaggggtgtaatttggcacctctaatccactggttatggtactgctgcatgtatttcaaaggtgatttattctttttc

SEQ ID NO: 13112 - DNA, 480 bp, Gossypium hirsutum
  Clone ID: uC-gsflmaxxa093h01b1
gcgcccactcttccgggaaaagttgcgaaaggtgatgggaaggatgatctctctgtttactatggaggcaggcaaaacgtacaagtacaggatttgcaatacgggtatcaagacatctctgaacgtcaggttccaaggccacaccatgaaattggttgagatggagggttcccacacaatgcagaatgactatgactcccttgatgtgcatgttggacagtgcttcagtgtgcttgttacttccaatcaggaaccaagggattactatgtggtggcctctacccgttttaccagacgtgaggttacagcaactggcatcatcggttacaagaatggcaagggagctgcctcatccgagttgccaccaccacctgttggttgggcttggtcactcaattaatttcgtaccttccgttggaacttgacttttaacgctgctaggcctaacccttagggctcctacaaatatggttcattaac

SEQ ID NO: 13113 - DNA, 80 bp, Gossypium hirsutum
  Clone ID: uC-gsflmaxxa093h02b1
acaaccacacccgagcgaaagatttaaaacccacatacccaccatgaacccatgaacagacagccgactctgatagcaaa

SEQ ID NO: 13114 - DNA, 526 bp, Gossypium hirsutum
  Clone ID: uC-gsflmaxxa093h03b1
ctatagggtaagctggcaccccagcaggcgccggcgcagaaccgccgggacccacgacgcgcgcccactgtttccgacagaatgaaaaagaaacaaaggaggagggagcaatgagcactgttactgtggccacgaccgcagctacaaggaggaaagactgcgaacaacgaatagaagccgaataagggccaagggcggatgcaggctcataacgagataaatgaaaacgacattgcatctggctacaaaggaaagcgaaaggagactgctcttcgaggaagaaaactaggatttgagatgaatgaaggcaagaagctgaaaaatgaagagcattgcatgacggctggtgaattctccatggaataaccttatggaaaagctatagctttggtcaaccttaaaactgctattatagagatcagggaagaagaacccgttggagtccctatgaataaaatggctattctagtttctgaaagttcaagcaactgcgaagaaaagctgcaataatggaagggaagggggg

SEQ ID NO: 13115 - DNA, 316 bp, Gossypium hirsutum
  Clone ID: uC-gsflmaxxa093h04b1
cccactctttcggccatttgccttaatcatcttcctctttgtttaaaacctcttcctatttaatttccgactaaacttgcgctgaattccatggctactgcagaggttgtatcagctcagactgcaatccatgaggagaaacctgaagaagtggtcaaggttggagaaattgcaacagaagaggtaccggctgttgctcctgctgcagaacctgttgcttaagaaccaaaggaagcagtgtcttgaagcagctttccgtagatcccctgtctccagaaaccgaagccacactcttaatctgtctcaaatgtggcgg

SEQ ID NO: 13116 - DNA, 90 bp, Gossypium hirsutum
  Clone ID: uC-gsflmaxxa094a05b1
ttttcctgcacaccctccctagccaaacagaaagggggggattatataaagactccacccctactaaccacacagccaccaaccaccagc

SEQ ID NO: 13117 - DNA, 305 bp, Gossypium hirsutum
  Clone ID: uC-gsflmaxxa094a06b1
acccccccaacccaccccacccaattatttccacccccacccccccccaccacaggggggctcataaaaaaaaacccccctcaacccacccccacccaccaccaacacccaaccccaaccacacccaaccaaaaacccaacaaaccacacccaccaaaccaaaaccccaccccacaccccacccaccacaccccaaacaccacaaccaaccaaccaaccacaacccacaaccacccacacccaccaccaaaccacccccacaccaaacacaaccaccacccaaaacaccaaaccacacacccaac

SEQ ID NO: 13118 - DNA, 243 bp, Gossypium hirsutum
  Clone ID: uC-gsflmaxxa094a09b1
tattaaagatagagagaagatattccccaggggaaaataaaaccaattttactttataaacaccaaaatccctccttcccttaaacctcccttcttcttcctcttctgtttcgagctgtgattttctatttttatttttgcaaaatagtagagagagatggcgccgaatgaccccaaacaaagcggtcgttccctcgccttccttccttcgccctttctccaacctttctctcctcttctcct

SEQ ID NO: 13119 - DNA, 105 bp, Gossypium hirsutum
  Clone ID: uC-gsflmaxxa094a10b1
tgttcttcgcgtccgctcgatttcccgagctaggggggtgagtaatagaaggttcattctctttaaacaccggctctctctctttgtgaatccaatcaaatcgaa

SEQ ID NO: 13120 - DNA, 358 bp, Gossypium hirsutum
  Clone ID: uC-gsflmaxxa094b03b1
cagtactaccattcgccgccgcaacaacaatgtcatgagtagagtctctcatcctccaactccacgaaatctccgccgttaaattcggcaacttcaagctaaaatccggcatctctttccctatctacatagaccttcgcctaatcgtctcctacccttccctcctctgccaaatctcccaatccctcctctcttctctccctccccaaatacctctcaacctcatctgcggcgttccttacaccgtcctctcgatcgtcaccttcatttccctcttcacctccatcttcactctcatgcgccgcatagaagttaatgacttctgcacctcccaattttattttaatgcctttcttct

SEQ ID NO: 13121 - DNA, 52 bp, Gossypium hirsutum
  Clone ID: uC-gsflmaxxa094b05b1
agaaagcgccacccccggagaaccgatccggaataacccggcaacgacgaca

SEQ ID NO: 13122 - DNA, 87 bp, Gossypium hirsutum
  Clone ID: uC-gsflmaxxa094b08b1
ttttaacatatgatctccttcaccttgacgggggggccactataaagagccacaggtgttacaccaagcacgagccgtcacagacgc

SEQ ID NO: 13123 - DNA, 99 bp, Gossypium hirsutum
  Clone ID: uC-gsflmaxxa094b10b1
tatacatattcgagctcatccaaagagcttgtactccttagctgctctgttaagttatgcttcccgccggggatcaagaccgctctgcttagtaattac

SEQ ID NO: 13124 - DNA, 93 bp, Gossypium hirsutum
  Clone ID: uC-gsflmaxxa094c05b1
aaatcgtactgcacactcccttcgctcgcgagagggagctctcacagaggggcaccgaaaagagcccccgaacggaccgccacccacgccccg

SEQ ID NO: 13125 - DNA, 118 bp, Gossypium hirsutum
  Clone ID: uC-gsflmaxxa094c10b1
gtgtccatcagtgataatgctggaggcattggggggatgtttgacatgagccacatatttccagagagaactgatgctcttgatgctgcaggaaacaccactgctgcttatcggcaag

SEQ ID NO: 13126 - DNA, 130 bp, Gossypium hirsutum
  Clone ID: uC-gsflmaxxa094c11b1
ctcacgcgtccgaataaagattaatcgattctagttgttttatctgacccagggtttttgttcccctaaaaccctaataagctcaatagctaatccgtctcactgttcttttcttaacctttgtctttgc

SEQ ID NO: 13127 - DNA, 150 bp, Gossypium hirsutum
  unsure (1)..(150): unsure at all n locations
  Clone ID: uC-gsflmaxxa094d09b1
ctccgggtgctgcacccaacacagaccaagccaagntggcgcaataaaaaagagaaacccctcttaaacccccccccagccccgagccagacacgaaagacacacagccccccacccccacgacacagcacaccacagcaaaccaaacac

SEQ ID NO: 13128 - DNA, 72 bp, Gossypium hirsutum
  Clone ID: uC-gsflmaxxa094d11b1
cactataggtaaagcgaaaacgccccgcaggaaccaataaccaaataaaccacccaacattacacacccccc

SEQ ID NO: 13129 - DNA, 215 bp, Gossypium hirsutum
  Clone ID: uC-gsflmaxxa094d12b1
ataaaacccacttccatgtccaatatcccctggattctttatcaagcctttcattatcaattctgccttttgcctttacaaggaccttcatttctggtgcaagatagctccattccagcttagattcatgtccacatttccccacaaaaccaattatcttcttttacttatttaagctcctttttttttcttcttctttctgagtttattggaca

SEQ ID NO: 13130 - DNA, 288 bp, Gossypium hirsutum
  unsure (1)..(288): unsure at all n locations
  Clone ID: uC-gsflmaxxa094e08b1
ataattcacctttgctttggccctcctgntgggagcactgagagtcaactccttattgcaaccgcggcccgaccggaaatcgatagctaagactagaaaacatcctccgggtccaccaaggcggcctatcgtcggcaatcccctttaattcagctcactcccacatagggacttacctcccttatggtatcaaaacggctcactagtttaccctccgctcgcctcgtgacgcaccttcacccctcatgccttcacagaccctccctgcaaatactatctaccgcctca

SEQ ID NO: 13131 - DNA, 172 bp, Gossypium hirsutum
  Clone ID: uC-gsflmaxxa094e10b1
ctcacgcgtccggggttgctgaagacggcaggggagttgctggaaaacaatggtcgttttcaaccccacactgcctccgcagatcaagcaatactcttaaccaaccttactgaagagcacagctcaacttcgcggaaaagcacacctgtacagccgggccacacaggctcac

SEQ ID NO: 13132 - DNA, 473 bp, Gossypium hirsutum
  Clone ID: uC-gsflmaxxa094f01b1
ggatttttggcaacaagataagtggagcggtagggtgcctttttagtggcacatcattaaagatgttcccaacagccattttagacacatcatattaggcaataatgaaaacaagccagtgactaatagcagggatacacaagagataatgtacaagcaaggtatggagatgctgaaagtattcaaaaatcatgcgatgaagacctctctacttgatgactttatgttctatgaaaatcgtcagagaatcatgcaggaagagaaagccatgcagctaataaaaagcattgagaatccagtcctagcacctgctttcgatcctgtcaataagctaaaccgtgttgagctactcctgaatgaacatgagagaagttccaagcaaagtgatcctgaactattgagaacaattgttccttcatctaatcagcctgtttctacagattgtgataggactaatgctaggaagatgaatg

SEQ ID NO: 13133 - DNA, 156 bp, Gossypium hirsutum
  unsure (1)..(156): unsure at all n locations
  Clone ID: uC-gsflmaxxa094f06b1
caataaggcttgccagagcctcaatttagctcanaggatttatagaagctttattctgctatttacaacatgtgtacccaaaagccgcctcacgactattctcaacagtggtttgatatgggtcactaatccttcgaagaaaacaccacatcgtct

SEQ ID NO: 13134 - DNA, 561 bp, Gossypium hirsutum
  Clone ID: uC-gsflmaxxa094f12b1
gctcactactctttcgagctcaaattactggggaagtccctacaagccgactctgcagagcagttttggttttccttggttgttttacttttcatttagcttactttgttttgctttgggttactgttttctaattttaacaccgtcaaggactttgttgttggtttttagggtggtcggagaatgagatgatgaactgaatgtttccctattggtttgattgccgtgatgatggcatctacaatgtattagctctatctgatcattctctttaccttttgcaaattgatggcaatgtttttcttttttttttgctattgtttttgacaaattttgaaactttgctatttctctccttgttaagtaattgtgtgctttgcttttgggccccgaaaatcaaaacaaacaaaaaaaaaaaagagggaaccccatttgtactcagtttacaacttctgaaagcaaccttaggtcttgggagaatgaaatgaggactgcgatattgtttccctattggttggatagccatgatgatggcatctttagtattagttttttttatca

SEQ ID NO: 13135 - DNA, 376 bp, Gossypium hirsutum
  Clone ID: uC-gsflmaxxa094g03b1
ttttggtaggactaaaatgtattctattgttttgcattttagatcctattgggagcaaacttgtttcctacagtcctacacatctacacaaggcttcactttacagaacgacctcagggaaagttttctacatcaacccagtttttctttttatcaaatctctgaatgaaagatatgatgggagtatgaagtagattttacctggcattagcgttatgcctgtgagtctgattctcatgatgatctatccaaaaaatctggggctgaacagtagtaaatatattcctgctcctgctaatctgggagatcatgactataagcagcgcatgtcaagggagaagaacaatggagcatgaaccagaacactggcctctcc

SEQ ID NO: 13136 - DNA, 202 bp, Gossypium hirsutum
  Clone ID: uC-gsflmaxxa094g07b1
tgataaatatctaacctccttaaatctgagaaaaggcttgtttagcgtgcttttgaactccgagcagagcttgaaaacgctgcatcagatgtctcagatttgcctgccaagattgaaaggaaggataaaattgaagatggaaacaaatcacttatccaaaagttccagccccagttgaccgcacacttatgacttcttgcac

SEQ ID NO: 13137 - DNA, 291 bp, Gossypium hirsutum
  Clone ID: uC-gsflmaxxa094g12b1
atgtcgcgtgggttggtagagacgaaaccaggggacatttttaaaaagtttagtcattacgtcgccagctttggcgtcgccgacagcatgtttgaaggctgacgctgaagcagattgcggctgccattgccattgctccttgtcacaagaggcctatgttctaccacaagacgataaaccttgcgcatgctttggcctggaccgccccccccagcctaggctaaacccaggctcaccgccttacaaccaacccccaatccccccccattgctgggctccaccgcatttttt

SEQ ID NO: 13138 - DNA, 395 bp, Gossypium hirsutum
  Clone ID: uC-gsflmaxxa094h02b1
tgaaatggaaaaccatccacacaaacaaacaagggaggccttttttaaaaggggacccccttaaacaacccccgaccacactcacacatgcaatgagcccaaccatggcccaaggcccaacacaacccaccccaagcaccagcaaagcaaaagcaccaccaaaccggctccaacacccccattgctaacaccccacccaacagccaatacccccgtacaactctccgcggaaaccccacacccggaaaccaccccccgcaagcacaacacaaccaaacccgaccatgcgctaccacccaacacacacaacacggacaacacaccacccagcccacaaccgcccacctccaacgcccaccccccacaaaccacaaccccacaccaaacacctccca

SEQ ID NO: 13139 - DNA, 372 bp, Gossypium hirsutum
  unsure (1)..(372): unsure at all n locations
  Clone ID: uC-gsflmaxxa094h05b1
cccatgcgtccgcaaagtcttctcctttctttcaggatccattgtagaaaattagcattcacgattccaggttacgagatgtagagcncctctttcaccactactattagccctatccccaatcccaatccatgacccccccgatttttaccaagcaccatacgcttctgcacccaccttttagctccggctctgcctcctctgactacttcgcttatcccccaaattaccctacgcattcccaaaaatctgaagctgacccctccactgtttacgctaatacttctccgcttctcagcacaaccactctaccggatccggacatagctccacaaccttcttttaattcaacaacccatggggccacccttg

SEQ ID NO: 13140 - DNA, 432 bp, Gossypium hirsutum
  Clone ID: uC-gsflmaxxa094h07b1
tatccgagagcatccaaacaaacaaaaaaacaaggcatttttaacagctcaatcatgggttcatccaatgattacattcacatcgtaatggttccattcatggctcatggccatctcattccattcttagctttagcaaagcaaatccatcaccaaactggcttcaacatcgccattgctaatacccctcttaacatccaatacctccgttcaactctccgaggaaaccccattcccggtatccattttttggagcttcaattcaacagttccgaccatgggttaccacccaacacagagaatacggagaacttatcgttagatctcatcggtaaattctttgcttcatcggtttatttgaaaactccgttttataatttgctacaagatatttgtaaaacacagtgcaaaccacctgtttgtgctattgtt

SEQ ID NO: 13141 - DNA, 217 bp, Gossypium hirsutum
  Clone ID: uC-gsflmaxxa094h11b1
ctcacgcgtccggtttgttgtgtttcgaatcggggtctttttctaactttttctgcttcaattctccagatgagggctgcttcatgccttgcatcgcgctgagcggcgtgcgcctgctatgcgcgccgcacggtggggtcggtggtgagccggcggccctcgaggagtgccctggagtcggcgctcttcattccgctagttggggtacaggatccat

SEQ ID NO: 13142 - DNA, 536 bp, Gossypium hirsutum
  unsure (1)..(536): unsure at all n locations
  Clone ID: uC-gsflmaxxa094h12b1
taataaaataaagttgcagaaactgagtgcaaatcttactaagccccagctcgaactcctctgtcccattaactgtatgagagagaggaaatctgattttcaatttcatcactgcatcttctctttgcttttggcctcaccttcagaaaggtaagtcaagttctttagattgcttgccgctttttgagtttcaagatctatgaaccccagatctgtagagccttgatcttattgctgaattcttgaattttagtagtttgggttcttttgctttttccttaataactagatttagtttattgtaaggtcattttagctcattcaggatgttgggtcgtcctgggttatctagaactggaagctttaggcctgagaatctaggacaaaatgctctgcatatgattggcaatctttgtttcactatatttgtaattggtgtcctagttttcaccattatagctgctacttatgagcctgaggaccctctnttccaccctttcaccaagctcacgacttntctcacgtccacatcaaat

SEQ ID NO: 13143 - DNA, 184 bp, Gossypium hirsutum
  Clone ID: uC-gsflmaxxa095a03b1
ctaatattccattaaagcccttctgctctcatctgggcctgttttcatggccaagcgggtcccagcctctcctccaactcaattccctcccctccatcaagcaacaacctcttccatcgccgctgtccctaccaccggcggaaccccctcttaaaacttaagcgggtctcaataccgatcccgg

SEQ ID NO: 13144 - DNA, 195 bp, Gossypium hirsutum
  Clone ID: uC-gsflmaxxa095a04b1
accatgctatcgaccaatggcaaccctgacaacctcagagttggtttttacaagctctgaggcgagcaaccacggagcagacactaaggccaatcttgcacaggctggtgccaggaatcaagccctgactcacacatagacgccgccatctcacactatggaggtgataaacatgccaacccccaaacacactcc

SEQ ID NO: 13145 - DNA, 467 bp, Gossypium hirsutum
  Clone ID: uC-gsflmaxxa095b02b1
tttcctttttgttcctttggatctgtgaggcagccgccggttcctttgaccaccaccaccgccacctctctgtgatcaaccttcactctctttttcaaggaaattaactgaaatggctggaggattaatccaccaggttttaaggaggaaatttcaatcacagtctgctgttcaagctttatcatggttttcatcaaggaaagttaatgacgatgcgggttctgctggtatgaggactgttgcactccttggagctggtgtttcaggtttactaggttttgcaacagtagcatctgctgatgaggcagaacacggtttaggagttgcaaattatccttggcctcacgcaggcatcctcagttcatatgaccatgcttcgattcgtcgcggtcaccaggtttaccagcaagtgtgtgcatcctgccactctatgtccctaatatcataccgtgatatggttggtgttg

SEQ ID NO: 13146 - DNA, 263 bp, Gossypium hirsutum
  Clone ID: uC-gsflmaxxa095b07b1
ccaatagcggattcctcttcttcttctttgttcttgatcttcttcatcattttctgtgtttaacccacaaatttgctgctccttcagctaataacagaagcttaacaatctctctctctctctctctcttatttaacaccatgtccacttgttattagaaagcttccaactcccctgccccttttctctgctttgctcttcacacacactttttcgaggctacattattttaaaacctcaacacatccttactcatattgtcc

SEQ ID NO: 13147 - DNA, 441 bp, Gossypium hirsutum
  Clone ID: uC-gsflmaxxa095b12b1
ctttctcgtccgagaacatgtacgcttttagcaccagctacatatacgggattccaatgtaccgtttcggaagaaacctcggaaaagttcaagggattgcccggggttctttgggtgttaccggattcatacatagacgtcaaaaacaaagattatggaggtgataaatatgtcaacggggaaataattccatgcaaataccctacttatcaaccaaaggcaagaaaagaatccaaatatgtgagcaaaaaatacgagagacgaaaagacggccctcctgcaggacagtttcgaccaaagcaagcagcaagtcagtcggaatcatcgtcttgacaaggtaccagaaatgctgtttcgagactactcatacttatggtggtctaaagtccagtttttcatcatgcaacttagtttctctcgtttgctattcattaatgtttc

SEQ ID NO: 13148 - DNA, 137 bp, Gossypium hirsutum
  Clone ID: uC-gsflmaxxa095c01b1
ttctttgctacctctcattgctaacagagagacttttcattttttcaatccggggggctttgccaaagtctgtccgctccaaggcccctctcctccagcgcattccggaccatttctgagatcagccctctccagag

SEQ ID NO: 13149 - DNA, 354 bp, Gossypium hirsutum
  Clone ID: uC-gsflmaxxa095c09b1
cccatgcgtccggagaaaccagagagagacacagagagaaagatttaatggctctgttggacaaaatgtgggacgatgtagtagctgggcctcaacctgaccgctgtctcggctggctttggttgtcttcctccccctcctttttccctctcatctttcttttccctcctgtcttttttccctctttcttcactctctccttttcttttcatcctcctctttctcttctctctcttccctctctcatctctcctttctcatcttttttcttccctccttctcttcttttcttcttctcttctgttcttctctttcccctcccttttattttcctctttacttctcttccctctt

SEQ ID NO: 13150 - DNA, 207 bp, Gossypium hirsutum
  Clone ID: uC-gsflmaxxa095c11b1
cccatgcgtccggcgcgtcagctagagcccgggataagaaagcattggaagaacaatggggtcctcctccacagctcttcgggaactgcagcaggacctcgaaaacaaagccaacgatcttagcaagctccagaaagatatagccaagaaccatcaagtcaggaagaagtacactattcagtcaggaccgatcgagcttgtccctat

SEQ ID NO: 13151 - DNA, 69 bp, Gossypium hirsutum
  Clone ID: uC-gsflmaxxa095e02b1
gcgacccacgcggccgccgtttatcaacaccccaagaccaaaaaaaaaaaacgggggggccttttaaaa

SEQ ID NO: 13152 - DNA, 92 bp, Gossypium hirsutum
  Clone ID: uC-gsflmaxxa095e03b1
cccacgtgaccgagcttaaagaaaaggggggaaagatgaggccttttccgatggaatttgtgacggacccacacgaccaaggttcagctcat

SEQ ID NO: 13153 - DNA, 385 bp, Gossypium hirsutum
  Clone ID: uC-gsflmaxxa095e11b1
cccattcgtccgctccccccttctcaattttctccttgaactccaacccactgctccactctttgaaaattcaactcttcttttcttccccaaaaagccccactcactgagtcacttctcactctcaaaccccgtaaaaaagcaatttcccagaaaatgtctttctccacccggcagaggcgagcgacggtgtcggatcttccttcatcgtcgtctccaccactacctgcgaagcctgaatcatacacgaaagtggatcagccaggacgatcatcatcgtacggcttatttctaaaccccttattgttttactttcttttctcttctaccatactctccatctttttctccctcctatcctttctacctttttttttctctttct

SEQ ID NO: 13154 - DNA, 173 bp, Gossypium hirsutum
  Clone ID: uC-gsflmaxxa095f04b1
caccccaggaccgccccccaaaactcccgcacacccacgcacccggtcgtatcaccccaaagaccccacgcacggacaggggggcctttaaaaaccccactggggtctcacaccccccccccccacaccacccccgcacaacccaccctaaccaaccccacaaccccccaccc

SEQ ID NO: 13155 - DNA, 377 bp, Gossypium hirsutum
  Clone ID: uC-gsflmaxxa095f05b1
ggaacacctccagggaccgtccgaattcctcgtcgacctctcgtcccccttataaaaacgacacaagctgaacctctctcggttgtccattttaaaaacacatgggcgctaaaacctctcgcatgtttcgatcctcgtttacctcaccactaacccggaacatgtcgcactccactgagaaaccctgcttctcacctgaaaaccacaacggcttccatttggtcgaaccaatttcttcttctccaccacccaagtctcgacccttccctcctgctcataaaccccaagacgccatcaatgctcctaaagaatccattcccacactcaatccgacagcctcgctacccttcctacatagtccccctctccaactctaa

SEQ ID NO: 13156 - DNA, 118 bp, Gossypium hirsutum
  Clone ID: uC-gsflmaxxa095f08b1
ctggatgcgtgggctgtctctgaaactgaaaaaaagggggccctttttaaaaccttatcagggaaccaggccacacctaaggaagaacccctagaaccaatgccagagactggaactc

SEQ ID NO: 13157 - DNA, 320 bp, Gossypium hirsutum
  Clone ID: uC-gsflmaxxa095g01b1
cagctgaatcactttctattcagtagcatatacaaactaagggagcttggatactctccagcagaaacggctcccgcttccttccatcacgagaaagaatgcccgaaggacgcctccggcaatcacttctctactaggcaccaccgcctgttccgaagtctaacatcttcctaccccggagttcgactttctttccattcccccacctttatttctctcctttcttttcacttcctctgttaagccccttcgctttcctctccatcattctcattttctcttcccaccaagaggaaaatcggccagctaattgtgtccaa

SEQ ID NO: 13158 - DNA, 444 bp, Gossypium hirsutum
  unsure (1)..(444): unsure at all n locations
  Clone ID: uC-gsflmaxxa095g07b1
gtgactatgagaggaacattgacgttgacttggattctgatggtctgcctctcccaagtagcggtgcagagccaatactactcggagagcttaccatatgatcccaggccggttaaggtcactaatctttacttctttttgcatgaaactctccgcggtaagaacccaacagtagtcatggtagcccaagctaacaacacaagcaacgacaactactcatcagtgccatttgggaccctatatgccattgatgatcccctcaagataggtcctggngacaactcagaggtgattgtgaatgctctgggacttgggatcttgtccggcaaaattcaacgaccgtggtgatgtacttagattttggatttactgccggaaagtttaagggcagctctattagcatattttcaaggaattccgtaataaagatggaacgtgagcttt

SEQ ID NO: 13159 - DNA, 107 bp, Gossypium hirsutum
  Clone ID: uC-gsflmaxxa095g09b1
cacatagatggcaggcgcagcaaattgggtttccatgaccttactgtaaatcagtatggggatcgacaacctatggtaagaggacctgaatctccaccatgtctgac

SEQ ID NO: 13160 - DNA, 509 bp, Gossypium hirsutum
  Clone ID: uC-gsflmaxxa095g10b1
cccactcgtccgcccacgcgtccggaagaattatataataaaggttgaggacgggatggccgccaccgacgaaagaccgtcgatcgtccccctttttcgtcctttttcttctcttctttcttttccttcttttctttatcctttttctcttttttcttctttctttctttatttttcttttttctatttcctctcttttcttcttcttttttttctctttcttctctcttctttttctcttttcttttactcttatctttctttttttctctttcctcttttttttcttttcttctcttctcttttttttcctctttcttcttcttttctttccttcttctctcttcttttcccttctctttctttttttttcctcccttcttttctttctttctccctcttttccttctcttccttttacctttctttccctttcctctctcttctctctcttcttttttctcttttcttcttctcctcttttttcttcttttattcttctcttctct

SEQ ID NO: 13161 - DNA, 66 bp, Gossypium hirsutum
  Clone ID: uC-gsflmaxxa095g11b1
ccccactcatacttccacccacgaccgacacctactcaaagggggccattttaaaaaaatatttcc

SEQ ID NO: 13162 - DNA, 144 bp, Gossypium hirsutum
  Clone ID: uC-gsflmaxxa095g12b1
ctaatataatgggagattcccaggcttgtccgacctggctactttgaacaggcttgacgggtttgcatgcggccatgaacaaccttgaaggtgaattgcctgcatcctctagcggcccttatgatccaacctccccctccctac

SEQ ID NO: 13163 - DNA, 133 bp, Gossypium hirsutum
  unsure (1)..(133): unsure at all n locations
  Clone ID: uC-gsflmaxxa095h03b1
gcaaaagatggttttattcttcgatgaaaatgagcaaanggtcaattttataaactctattgggggcttcataaccatccatcgtgaagctaaatcgatcagagaaaagcctcaagcttttgagttcttcaat

SEQ ID NO: 13164 - DNA, 246 bp, Gossypium hirsutum
  Clone ID: uC-gsflmaxxa095h10b1
ataatacttaagaatggtagtgaaagcgcatcgcgcagtgcaatttaaaagccctgaggggttaacaacacgcctccttgagacagaggttcaattccatatcgtaccctcaaaaccatcaatccaatacatcctctaccaataaattcctatctttcctacccctttaaccctgtaacttacatcatttaccaacattcatgtattactattccccaaaaacaaacacataactcccattctctt

SEQ ID NO: 13165 - DNA, 528 bp, Gossypium hirsutum
  Clone ID: uC-gsflmaxxa096a02b1
gcatgattgagatcaagaggatcgagaactcaagtaagaggcttgtcacttactcaaagagaaggaatggaatcatgaagaaagctaaagagattactgctctttgtgatgctcaagcttctctgatcatctttgctagatctgggaagatgcatgaatattgcagcccttctactaagttgattgatattttggaccaatatcagaaaacttctgggaaaaagctatgggatgctaaacatgagaatctcagcaatgaaatagatagaatcaagaaagagaatgatagcatgcagattgagctcaggcatttgaaaggggaggatatcacatctttgccttacaaggagctgatggctatagaggatgccctcgaaaatggccttacctgtgtccgtgccaagcagatggatgttcttgatatggcaaagaaaaatacgaaattcttggaggaggacaataagcaactcaatttcattgtgaatcaacagcaactgactcatgaaaatgtgagagagcatatggatc

SEQ ID NO: 13166 - DNA, 470 bp, Gossypium hirsutum
  Clone ID: uC-gsflmaxxa096a05b1
cccactcgtccgggccaaattcccttgtctatagggcagtggacatctttggagaagtttgatgtttcacaaaatcaattaaatggtcaaattccattgtctataggggagtcatcatctttgaagttgtttgatgtttcaaaaaatcagttaaacggccaaattccctggtctatagggcagttatcatctttgaagctgtttgatgtttcagaaaatcaattaaatggtacttttcctctatctttgggacgactagaaagtttggaaactctggattgcgggtataatctattagaaggagttgtatcagaaacccatttttctaatctcacgagattgacaactctagcagcatcacacaatcggcttagatttgaaccaaactcaagctggattcccccatttcaatgtgaacggatcgaattgggtaactggcatcttggcccacagtttccccagtggctaaa

SEQ ID NO: 13167 - DNA, 480 bp, Gossypium hirsutum
  Clone ID: uC-gsflmaxxa096a08b1
aggcttgtttttcacacacacaaaaaaaagtacttggttttttctctctttggacaagacaaaatggcgaacgcggcatctggaatggctgttgatgatgaatgtaagctaaaatttttggagctaaaggcaaagaggaactaccgctacataatattcaagattcaggaccagcaagtggtggtggagaaagttgggaacccaggatctacctatgaggagttcactgcttctttacctgctgacgagtgtcgctattctgtcttcgattttgatttcaccactgatgagaattgccaaaaaagcaaaatcttcttcattgcatggtcacccgatacatcaagggtgaggagtaagatggtgtacgctagctcaaaagacagattcaaaagagaattggatgggattcaagtcgagttacatgcaacggatcctagtgaaatgagcttcgatattataaaagcccgggcaattaaacgc

SEQ ID NO: 13168 - DNA, 501 bp, Gossypium hirsutum
  Clone ID: uC-gsflmaxxa096a11b1
caccccgggggccccggcgcggaatccccgggacgccccacgcgcgcgtttgggtagcgtccatggggcatatacagcaggggggggtgtttgtttaaagtttttatggtgataacacccctcacacacatgaagcgggcttgggcatgacggccttggccagcggaccacaccagcagggccaagtgtcactgacaggggtcacagaccgaggcgagcaaagaaagatggtgacattggaagaagccaaatgggatggggaatagctacagctcttattgtgaacaatatatttgttgttctcaaggaaggggactctgaatatctcctgaacggaataaaaacggcagaagcgaatgttagaggtttagcaaatagaggacaaattaccaaggacaaggcggaaaaagccctctcaatgcttaaaggagccctggattactccgaatttaaagacgtagacatggtcatacaggctgccattgaaaatgtcgctaaaag

SEQ ID NO: 13169 - DNA, 446 bp, Gossypium hirsutum
  Clone ID: uC-gsflmaxxa096a12b1
gttcctgggccacagaattcctttcttggtagccgggggatttgttgcagacagttgttcatggccgcacaccaagaagcagaaccgtcatggcaggaactgcttggtagcaaaaactgggactcgctgctggatcctcttcacttctgacttcgcaaactcatcctccgctgcggtgacttctgccaggccacatatgacgccttcaacaacgaccaaaattccaagttctgcggttcaagccgctatggcaagtcctctttcttcgacaaagtaatgctggaatctgcctccgattacaaagtagaatcgtttctctatgccactgctcacgtcactctccctcaagcctttatgctccactccaggtcaagggagtcctgtgaccgcgaaacatactggattggctacatcgccacgacgttcgatgaaacatcgaaagctct

SEQ ID NO: 13170 - DNA, 517 bp, Gossypium hirsutum
  Clone ID: uC-gsflmaxxa096b01b1
ggaaactaatagaaaaagtgattggccaccatgttgggctcaatcaactctatagccatgctggtgttccttaattttagtctggatattacagaaactgcagcagcatcaccaatgtgcaatgtggttatctttatcttaagcccctgcgagagctacataaaaggcggagccgatccgtcagccggaatgtagtgttggtgctaaacgtattattgaccaactaaaggccaaagaagataggatagaagtatgccagagcattaaagcattattgccacaacttgggccatttgaccctaatcgagtgcctcttcttggccagaaatgtggtatcaagaatttctttcctcccatcacccccgctactgattgttccaaggtatgaagagagagctgggaaatgtgaaaagcaagagtacggtgaatgaaataaagaacccggatttcaaaaaattatgtataaatcaaccccttgtaatttgattccactaaataaaatatcaacttattttta

SEQ ID NO: 13171 - DNA, 561 bp, Gossypium hirsutum
  unsure (1)..(561): unsure at all n locations
  Clone ID: uC-gsflmaxxa096b03b1
cccactcgtccgcccacgcgtccggtacttaccgtcagcttttccaccctgagcaactcatcagcggcaaggaagacgctgccaacaacttcgctcgtggccactacactattggcaaagagatcgttgacttgtgcttggaccgtatcaggaagcttgctgataactgtaccggccttcaaggtttccttgttttcaacgctgttggtggaggcactggatctggtcttggctccctccttttggagcgtttgtctgttgattatggcaagaaatccaagttgggtttcactgtcttcccatcaccccaggtctccacatctgttgttgagccctacaacagtgtcctctcaactcactcccttttggagcacactgatgtggctgttcttcttgacaatgaggctatctatgacatttgcaggcgctctcttgacattgagcgacccacttacaccaatcttaaccgtcttgtctcccaggtgatctcctctttgactgcttcacttaggctcgatggtgccttgaacgtggatgtaacaganatccagaccaacttgg

SEQ ID NO: 13172 - DNA, 552 bp, Gossypium hirsutum
  Clone ID: uC-gsflmaxxa096b07b1
ttcatttcttcaaattctaccaccttcttatttgctctttataattaaaaattggtaagcaaatactttcccagcacttactctttatccatcaaccgaattccccacactctctctccaaataaaaaatcaagaatttaagaaattcgattcaccatattcatggcccgttccctttctcaatccgttctcagcttccgcctaatcaccaaacctcacccttcttcctctcgtctccttgccgtccgaacccaatccaaccaacccaacccttccgactcctccgattcttcctctgatccgctcctgcggaaactgaagacgccatccaccggatcatcgttcgccgttccgctcccgattggctccctttcatccccggatcctcttactgggtcccgccgtccacggcccaatcttacggccttgcccagctcgttgagaaattggcaaacccgttgacctcggaggaatccatgtgcaccactgccgcccgaggctggccctcctctgactatttcatcaaagataatttcaattgccaattcctct

SEQ ID NO: 13173 - DNA, 524 bp, Gossypium hirsutum
  Clone ID: uC-gsflmaxxa096b11b1
cccacgcgtccggttgatattggttggctgtgaatccaagttaaaaagagtatatggggggaagtggaagtctcgtggacggtgttcgtcgctggtttcaacgtcgccatttgattccttcttcttcgaatcaacaaaataataacattatcatcgatcatcatgatacttcttcttcatcctctactactctaaccctcactcaaaaacaatcacaagaatcaacggctgatattgtcgttcaggattttgatttttcttccttgaggcttgttaaagttcctaagcgtcattactttcctgtttcttccatggattctcacaaaaagggtgcacttgaaaaggaatttttcacagagtatggagaggcaagtcgatatcaagttcaggaggtcattggaaaaggaagttatggggttgttgcttctgcaattgacacccacactagtgaaaaggttgcaataaaaaagattaatgaggtctttgagcatgtctctgatgcgacacgaattttgagagaaatc

SEQ ID NO: 13174 - DNA, 544 bp, Gossypium hirsutum
  Clone ID: uC-gsflmaxxa096c01b1
cacttcacatctgcaacgaaaaagaaagcgcccctttatctggatcaggtattagagtggtatagtaaaaatgtcttcaactgggtcaacacgagaggaaaatgtttacatggccaagttggctgagcaagctgaacggtatgaagaaatggtggagttcatggagaaagttgtaaaagctgtcaatgtagaggagctaactgttgaggaacgaaatcttctctccgtggcttacaaaaacgtgattggggccaggagggcatcctggaggataatctcttcaattgagcagaaggaagagagcaaaggaaatggggatcatgttgctatcatcaaggagtataggggcaagatcgaagctgagcttagcaagatctgtgatgggattttgagccttctggaatctcatctcatcccttcagcctcaacagctgagtccaaggtgttttaccttaagatgaagggtgattatcacaggtatcttgctgagtttaagactggcgtcgagaggaaggaagcagctgaaagcactttgttggcttac

SEQ ID NO: 13175 - DNA, 551 bp, Gossypium hirsutum
  Clone ID: uC-gsflmaxxa096c09b1
cccacgcgtccgacaccgtgaaacatcgacggagacgctccgccattaaatccatgtttggcaaacatcgagcttcgataattttcaaatcaaggttgccatgtaaaaatacaacaggatccgaagcatcttcccccattgaatcaaatcgagaaataaagaaaaattattcaaagacggtcaatgagaaaaatgaagatgataaatagcaatgtaaaaggtaggcaagggacgttgttttcgaaacatcagaatcccagtttgttttctccgactaaagccaacgtccataaccaaaggctgtaacagggagcgaaattccagaagtttacggttttgtttctttttggctaatgtggttctgtttatcattctttgcctttgccggctactctctcaattcttctttatcattcttgttttgggttttcattttttttttctaaatgactgacagcttcgatgcgccatttttttgaactattctttttgcagcgattgggtttaatgtagaggctctacaatacaacaacatcaagttcaagtttcaa

SEQ ID NO: 13176 - DNA, 486 bp, Gossypium hirsutum
  Clone ID: uC-gsflmaxxa096d06b1
cgggaatatccaggaacctagctccatgtcccaaacagagaaatttttatggtaaacttgtcctagttcttctaaaagacgtatcttttctttccctttttccttgtcaacttagggtttccctttttcctttttttaaagatttcctcttaccttcttcacattagtcttcatcattggttttaacccccaatctttttatacctaacagtttcaattcgtgcctaattcctgaaacttgcaatgccgccatttttatcgacctcaaaggcggtcgggtcggtaatatcccgtagaaatgtgattaaccagttcgctgggcacgcaaagaacggagggcgaaccgggaacttcgatcaaatccgatgggttactagtatttccggtatccaaatgccgtcggttcacccggtacttggttcacgcaaggtggattccattgttccattaaactatcttttcaatcattatactttccaaaggaga

SEQ ID NO: 13177 - DNA, 451 bp, Gossypium hirsutum
  Clone ID: uC-gsflmaxxa096d07b1
tttacacgcccgattgaaagaaaagaaaaatgggggggctatagaaacttttgttgttgatgtaaaggccggacctcaaccggaacgtggccttggccggctgaggaagatcacaaccaccccacccttgtccaccaaagatgaggcttcatcaatggcgatgccgacgagtccgacgacacctgggacaccgtcgacgccggtgtcggctcgaagggacaacgtgtggaggagcgcgtacaatccaggtagcaaccttgcaaccaaaggtattggcgctgaagttttcgacaagcctcaacctaactctcctactgattatgactggctttacagcggggagacccggagcaagcatcaccgctgattgggcgatggctgacggcggcggagggaagcaaaaccactagcagaaggctgctgctactgaaggagcaggatcagcatgtaa

SEQ ID NO: 13178 - DNA, 561 bp, Gossypium hirsutum
  unsure (1)..(561): unsure at all n locations
  Clone ID: uC-gsflmaxxa096d10b1
atcaaatcccagcttagcaacctcacaaattttttgggtaaaaaacccatctttctggttctaaactcacccccatccatctcttttgcatataccttcagtcactaagcaatagcagccactactgcaaatggcttccaacaaaacctgtgctgtccttacagttttctctcttcttcttttcaacttatcattcaccaatgcttgccattcatgcaagccaccaaagcccattccaccacctgctgcatgccctccaccaccagcaaagcctgcttcttgccctaaggacacattgaagctaggtgtttgtgctgacctacttggactggtaaacatagtggtgggaacacctccttcgagcaaatgctgtgctttgctccaaggcttggctgatttagaagctgccctttgcctttgcaccgccattaaagccaatgtgcttggggccaacctcaacatccctattacccttagcttactccttagtgcatgtcagaaggaaatccctncaggcttcaaatgttgatcttttttaagaagcacaatcagntngtgatg

SEQ ID NO: 13179 - DNA, 507 bp, Gossypium hirsutum
  unsure (1)..(507): unsure at all n locations
  Clone ID: uC-gsflmaxxa096d11b1
ctcaactgtattatcacctgaaattgttgaaagggggtctgtttctgggggaaagcttggtgaactagactcctatgaagttgagggtggtgagacaaagggtataattttctctttcaaaatctggctgagttccagttctcttgtgtcatgttcaatgcggttttggagaatgcttgtagtgagcaaggagcaaggatgtctgctatggatagctcaagcagaaacgccggcgacatgcttgatcgcctgactcttacatataacagaacccgtcaagcttcaatcaccacggagttgattgagattatatctggagcatcggcactggaaggttaatttcaaatatttttcactgctagatttttccagacagtaatgaaataaaatgtcagtgcactgttttttttttctctatacttaatttttgagtgttttgctgaggctcttcaataatctcccccagtattaaatcttcatttctgggaataaaattanctttttcga

SEQ ID NO: 13180 - DNA, 436 bp, Gossypium hirsutum
  Clone ID: uC-gsflmaxxa096e12b1
ctttttcttagttttcctttttgtcccttgtttatgggatatttacccctcatggccgcctctgatgccgagttccggtgcttcgtcggagggctcgcatgggccaccgacgaccgggccctcgaagaagccttcagtgcgtttggtgaaatcgtcgaatcgaagatcattaatgatcgtgagactggaagatcccgaggctatggattcgttactttccgtgacgagaaagctatgagggacgcgatcgaaggaatgaacggtcaaaatcttgatggaaggaacatcaccgtcaacgaagcccaatcgcgcaaaagaggaggccgtggcagaagaatgggaggatgcaacggtggttacagccacggcggaagcagtcatggatacagggggcgccaaagccgaaactgcggcggacgccgagaaaggcgatacg

SEQ ID NO: 13181 - DNA, 552 bp, Gossypium hirsutum
  Clone ID: uC-gsflmaxxa096f08b1
cggtcgcgtgggtgggattttaagcttaaaaccctggccctagaattttctttggaactcatcgctggtgctatttgacctcattcacaatgcctcgccgtagctctggaaggtctgcttctcgtcctgcttctgctcgcagccctccacctcaaccagctcatcatgctcctcctccagctcctgctcagagtggaagtggtggatccttgctcggaggcataggctctaccatagctcaaggcatggcttttggtactggaagggctggagctcacaaggcttgggatgctgggatgggtccttggactaattcaacatgaaaccgtggtttccgaggctgcagctgcccctgcaccagcaactacttccaatagttaagctggcactgattcatgcagcatccactacaaggcattccaggattgcctgaacagctattggagcgaactcagcagtgtcagttctacattgatatgtcgactgagtgcaggaagaacacagggtcccatgttgggtgcctaaaagttattcaccatttccttgtatcct

SEQ ID NO: 13182 - DNA, 117 bp, Gossypium hirsutum
  Clone ID: uC-gsflmaxxa096g02b1
cacgcccgcagatctcgagctcgcgccctctttttttttttttaaggaacatatttaaaattcttttctcctttcacaacccccagtcccctctctcctaaaatccaaccctccatc

SEQ ID NO: 13183 - DNA, 557 bp, Gossypium hirsutum
  Clone ID: uC-gsflmaxxa096g04b1
aagcttcaaaccgacccccccccccgcccccctaggggaatgtttgtagactgctttcattaacatctcaatatattactcttcgcgggtctcctttagagatttccttttaaggtggattttccccccttagtttaaaagatgtcatcaaatgatagaacccttctcacaagtgcacgcacggtgagctgtgctaccgtgccatttggcagctcctgattgctcctgcaacaaccttgatgcttgtgcactcgagccatggtgcgtgtcggctcagaacggcggctctgttggcctttcattaaccatcatcgacgaagcgaaccgggaagaagtaccaggtccctgtctccagcgaaggcactatcacagcttccgatttcaaaaagatgacaacagggaaaggtgataaggggcttaaagtttatgatccgggttacttgaatacagctccggttcggtcgttcatttcttatatagactgtgatgaagggattcttagatacagggggtatccaattgaagaactggctgagagttccattttcttggaaggg

SEQ ID NO: 13184 - DNA, 550 bp, Gossypium hirsutum
  unsure (1)..(550): unsure at all n locations
  Clone ID: uC-gsflmaxxa096g06b1
aaagaaatcgaaattttgacttatgattctcatatacatacccccagcccccaatatctcccacaaccttccatttacgtcttaactgttgaatgatcaatttccatttattcttttggtttttgaatttttgagtttttagggcgaaaaaaacaatggcgaatttgcaactggaaagagagactagcattgggatgcaagtggaagatctatgggatgttcaagaatcaaagcttaatcctacgcagaaacttaacgcttgctttgaaaacatccctgtctctgctttccctcatactcctcaagggatcgagataaaatcggatgcgagtttggccgaggctgttcaaatacttgcccaaaacaagattcttagtgcaccagttgtcaatgttgatgcacctgaggatgcaagttggattgatagatatcttggcattgtagagtttgcaggcattgctgtatggattctccaacagtcagaaccaccttcnacctacaaccattttgcctaccgagctgaatctgcagtagcttctgctaacggaat

SEQ ID NO: 13185 - DNA, 400 bp, Gossypium hirsutum
  Clone ID: uC-gsflmaxxa096g08b1
gaaagaaaaaaaatttttgttttttttttggcaaaaaaaaaaaaaaaaaagataaaaaaaaattttttttttttttggtaaaaaaaaaaaaaaaaatttggggaaaaaaaaaaaggttttttttttttaaaaataaaataaaagttttttaaaaaaaaaaaaaaaattttttttttttttttttttttttttgaaaaaaaatttttaaaaaaaaaaaaaaatattaatatatattattccaaaaaatattattatttgcggttaaatatataattatttaaagggtatttttacatttatgagggttataattataattataaggtgatattttttattttataacttattttttaaaaaaaattattatattgtaaaataaaaaaaaaaaaatttattt

SEQ ID NO: 13186 - DNA, 551 bp, Gossypium hirsutum
  unsure (1)..(551): unsure at all n locations
  Clone ID: uC-gsflmaxxa096g10b1
gttggatcatctaggaagagaaagtatctgatggttatcggaattaatacggctttcagcagcaggaaaagaagagactcagttcgtgctacatggatgccacaaggtgaaaagaggaagaaattggaggatgaaaaaggcattatcgttcgctttgttattggccatagtgctacatcgggtggtattttggaccgagcaattgaagcagaggataagaagcatggagacttcttgaggctggaccatgttgaaggttaccttgaattgtctgcaaagaccaagatatattttgctactgctgttgctttgtgggatgcagatttttatgttaaagtcgatgacgatgtccatgtaaatatagcaacacttggagaaactctagttagacaccgaaagaagcctcgtgtatatatcggatgcatgaaatctggtcccgtcctctctcaaaaaggagttagataccatgaacccgagcactggaaattcggcgagacaggaaacatatatntccggcatgctactggacagttgtatgccatttcaaaaga

SEQ ID NO: 13187 - DNA, 544 bp, Gossypium hirsutum
  Clone ID: uC-gsflmaxxa096g12b1
gtcttcccttgtccctgttaaaatctgccactgggagcactaatggacaccgctgttacctgaagttccagccactgagcagcagcccgcggcagcagaggagccaaagccggcggaaaagcctgtgaaggagaagagacccagagctccaaaggagaaaaagcctaagcaacccaaatccgcagcacatcctccttattttcagatgatcaaggaggcgcttttggctttgaaagagaagagtggatcaagtccgtacgctatagcgaaatacatggaagagaagcacaaggcggtgcttccagcgaatttcaggaaaatcttaggtcttcagcttaaaaactcagctgccagaggcaagctgataaagatcaaggcctcttacaagctctccgaagccggcaaaaaagagagagcccctgttacgaaagctaagatggagaagaaagctaagccagcttcgaagccgaagaaagctgaggcgacaaagaagccaacatagagagtcggggccaagaagaatcaactccagcaaagccgagca

SEQ ID NO: 13188 - DNA, 496 bp, Gossypium hirsutum
  unsure (1)..(496): unsure at all n locations
  Clone ID: uC-gsflmaxxa096h03b1
ggagggacctgctctgctgccttgcctcgcctcgcctgggcttgccttgcctttttacgtttactctctctctcacgttttcaatcatcatttgccacaaagccatttccaaggaaggctctctgattgatccttgaaattgaaacataaattgtgttcatatcacaagaagttttcttcaaatgctaaattttgcaagagggagaagccagccaaggcctactagatccatgccgttgtccggaatggaatatcctgatcccaagaggaagagcaattttgtaggtaaaatccttatggctgcaacccttacagccttatgcattatcatgctcaagcaatccccaaacttcaatactctaagtcggntctccgaacatgaagaaggtgtaacacatgttcttgtaactggtggtgctggctatattggttcacatgctgctntacgacttctgaaggagtcataccgtgtaactattgtggacaatctttcacg

SEQ ID NO: 13189 - DNA, 494 bp, Gossypium hirsutum
  Clone ID: uC-gsflmaxxa096h08b1
gtcataatctgctgtgaataaggaattgggcgaacgggagtttttggagcagaaaaatggattgaaaagcatgatttcaaggactggttctgtgtcggggtttgaggacaatattttggagcaagtagagatgcctttggactgtgttgacctacaaagtagaacccatatccgtcatggttcactgtgtactggtgtcaatggcaggttgtacagtaatggaattggattagagaaatcagttgaagaccgtcctgatgataggttactgtctggggtgccgaaaggggatgataaagttgcacagatttcatcatccaaggatatgttatccgatcaaaacacagtggcatttgtgaagcagaaaagccttacaaatcaggcaaagaggacagtagaaacggaggcatcgggcaggaaagatgtgagtatgaggaggacctcatcttataatgaggctgtagtgtctgaagcatcattcatggagattctta

SEQ ID NO: 13190 - DNA, 384 bp, Gossypium hirsutum
  unsure (1)..(384): unsure at all n locations
  Clone ID: uC-gsflmaxxa097a02b1
gtccgtcctttcgtccgcccacgcgttcgcccacgcgngggaaaattagaagttcatgggggtctttatttacttttttcacaaggatgcaacatgggaatggtgatgctagctggcatgtttatctcatggatctttgtttacagattgaaccagaggaacaaagatgggcccaaaacactgccactcatcggagcagctttcggacaatcaattaactatgatcgaatgcacgaattgctacgccaatacctgctcgcatcgaaaactgttgtagttccaatgcctgtcacaacttatacttacattgctgatcctgctaaatgtgaacatttacttaggaccaaaattgccaattaccccaagggtgaaacgtaccattca

SEQ ID NO: 13191 - DNA, 513 bp, Gossypium hirsutum
  Clone ID: uC-gsflmaxxa097a09b1
ctcacgcgtccggcgttcatcaacatgatggggccgcaacagattattcctttccataaggcatttgatggcaaaaaatgggagaagttcaacagtgaaaaggtggcgactcttgcttatgctaggatccaaggaaaggctgctcttattgctcatttccagaattcaagcttaatgaatgaggataaacgttgccgccctattctctttcatactgatggcccaaatgccggtgatcaggagccctttcctatgggtaccaatattcgatcaaggccagggagacctcgaacatctggcactgaggagaaccaccgccaaagtagttcttcaactttagctaacggggaggaatattccaatggggcagaatcattgggttcttcgaaggattctgattgagcagtctgcttatccagctctaactttaaaaaaccctttcagagtactgaaacttttatctacccgactctgtatttgagggtggcttgatgacttcttttttttcttttt

SEQ ID NO: 13192 - DNA, 523 bp, Gossypium hirsutum
  Clone ID: uC-gsflmaxxa097a12b1
atctcaagtcgccgcgtttgactcggtccatgggtaacgcgctaaaaattaccaccgccatttctgcccttttccttcatatccttaatctttttttttgttcatgttctttgatcattgaccttattttctctcatgggaactttactttcaagccgtggtttctccttgttccttctttggaccttcactttatacggtctctgtttatccttctctccgatcgacaattacctcatcaacagcggtgcctccctcgattccgtcgtagacaaccgtcgattcatctccgactcgtcgaattcacccgattcccatctctcttctggtcggaccttttcgctctgtgccggaactctccttcctggtctgcctcaaatctaccacaccgctagggtttttaatttgccgtcgaaatacgtcttcaatgtcaaagatccaggtacgcacatggtacgtctccatttccatcgattcaattcatcgagattggatctgggtaactctcgatttcacgttttgt

SEQ ID NO: 13193 - DNA, 344 bp, Gossypium hirsutum
  Clone ID: uC-gsflmaxxa097b03b1
gcgtttattttcaggccactctctcttgctaatggggggggatttataaaaaatctggcgggacaaaaatggagtctctgtgaacgatctgtgacagagagttttcgatccaacagcagaagatagattctttgacggcatcgattccttcgtctcttaattccatcaagtccctagcgcttgatactgctcaaaatcatgccaaacttgcaaagttgaaagccaatttaagagaagccgaaaatgagtttgtcaaggttttagttgcgaggacccgttaagaggctaatcaaatggcaacgagggattcaatttctgctgtaaagctagagtagaagaactta

SEQ ID NO: 13194 - DNA, 447 bp, Gossypium hirsutum
  Clone ID: uC-gsflmaxxa097b11b1
tcgtttgctctctgtagccgccgcctgcgtgggtgggttcatctatatgaaccgaggggtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattggtgacactttcaggcttcaggagcaaccccctttcgacaagaagcagtttgtcgtgttcatcaagaagttcatcaagaacttgacaccaaaactggatgcggaaaagcaagagtccttcatgaaaaacattgagggagcaaccaagttt

SEQ ID NO: 13195 - DNA, 459 bp, Gossypium hirsutum
  Clone ID: uC-gsflmaxxa097c02b1
gcgttctttttttgctcttcacctgaccctatcaaggggacccagatttacatctgggtgccatacggcgccccttttctttctcagtctctttgttgctggaaaaccctaaaatttcgtcctttgttcttctattttagctactccttacattgaataaaatatcagtcttttctcagtcttaatcgacattgtgttttttttttaaactgtctcattgggtgtttatttttgtgcttttctttaattttgagatctgctggaatttattttctctgttcttctgaattctaggttacgttgggttggtggttagaaaattgggggtttcattgatgttttcaggtcttctggaaattcttaatttttttaattgataccttaagcaatcttaagtttggaaaaaaacccaataatatatgctaatccactctaagcttcttcttttttctttaaatt

SEQ ID NO: 13196 - DNA, 442 bp, Gossypium hirsutum
  Clone ID: uC-gsflmaxxa097c05b1
tgagcttagcctaagctctcctctcttcgacggaggggttattgtatatcctcctcctgtcaattgctttgattccttcccaaaatttcatcactctcacgctttgtagtgtgcggggtattgtcatggagatacagacatgtggtaaaccgattgattctctgttagagaaggtgctttgtatgaatatattatcctctgattatttcaaagagctttaccgactaaagacttaccatgaagtcattgatgaaatttacaatcaagttgatcatgtcgaaccgtggatgactgggaattgacgaggggcttctactgcattctgccttctttacaagttttttaccatgaaacttactgtcaagcaaatgcatgggctactgaagcaccctgattctccttacattagagcaattggattcctctacttgagatatgctgc

SEQ ID NO: 13197 - DNA, 143 bp, Gossypium hirsutum
  Clone ID: uC-gsflmaxxa097c06b1
atgaaccatatccaggctctttctattacgacctcaactcaccaccatgggaaacactccctttgctattgatcacaggacttttgctaggtacacagaacgaactgcttttgagaggcccctcacaagtggagtggcatatg

SEQ ID NO: 13198 - DNA, 463 bp, Gossypium hirsutum
  Clone ID: uC-gsflmaxxa097c07b1
gtcttgtgtggaccacgaaactggagagggggggccaaacaaaaaaggactggttgcaaatggacagaaggagtttaccatgggggatacactgacacaactagacaaggacatggcggcaccatataaccagaggctgggtcaacctatcaagggtacctacttaataggctgaagattatgggacatcctggatctaagcgcatatctggtatgcaagatataatatggaatgcttgatgatctataaagaaaatagaggggcatgccccaaaaagctgattcaaatactttaccgtggtatcatccgcatgatcctataattatgagactatgtttaaggaatgctaggtaattaatgggactgtatactgatgtggaagatagaaaaacccgtttgatgtattttgataataaggttcgtggttgatttgcaatatagatggggtttggatttttaaaa

SEQ ID NO: 13199 - DNA, 295 bp, Gossypium hirsutum
  Clone ID: uC-gsflmaxxa097c10b1
ttgctttacgcgtgggtttttttgggtcttaggggggggtatattagatataggtgcctttatttgaagtggatcataatggataaggaaaagactgacattaacatagaggtcataggtcacgtcgatgctgggaataaaaccaccactggccaactgatttacatgcttggcggtatctgacaagtatctcaattgaaaggcttcagaaataagactggtgataggaacacgactgcatctgaagaatgcttggagctgaccacacaaaagtggaacttcaagaagatgctga

SEQ ID NO: 13200 - DNA, 245 bp, Gossypium hirsutum
  Clone ID: uC-gsflmaxxa097c12b1
tttttataaggtaaaaactattggtatttcggggggggttttttaacaaacgcgggggtccataacaatctccatgaacaaaacctaccagagcatagaactgatcataatgtcactgttacaacccaccatctgccagctgtcctggatatctccactgttgaactcgctaaggtcttgtccctccatacaccaataaagtcacttaaacattttatgcagaatccagagcatcttatcaaaaa

SEQ ID NO: 13201 - DNA, 341 bp, Gossypium hirsutum
  Clone ID: uC-gsflmaxxa097d03b1
atattccatttttggcttctctttgggaggggatatttaaatacatggagggaagaaaatccacacagataaggatgctgtaccaacagaatttgaggagtctgttgcgcaggcatactttgatttggagaataccaatcaagatctgaaaagcgaccttaaagatctctatattaattcagcaggccaaattgatgtttctgggagccagaaagctgttggtgaccatgttccatatagattgaggaaagctttccacaaggatcatgttaagcttgagagggaacttgaaaagaagttcagtggcacggatgtgattcttattgccaccccggggatat

SEQ ID NO: 13202 - DNA, 417 bp, Gossypium hirsutum
  Clone ID: uC-gsflmaxxa097d08b1
tttcttttaaaaaaaactaaaaaaacctctgggggggggttatgaccctcggagctccgacctcatggccgtcctggctcgtcctagggtctggcgtgcttggtctccacgcgcttaacgagccgccaccagagccaccgtatacggtggttagggtttcaaaaaccctaccttttctttgccgattctcaggtacttgcaaaaaaatctggcaatagcaaaggcttgacgatggtccactggaggcgttgatctcagcgtgagttggggcctagaatcatggccttgatggggtagcaggagttgaagagtcatgaggcttggcttctggaaccttctgtttgcggcgcgaagagaaagagggcagaaaccctagggtttcttgcctgggtctgcagatgtttgggccaattgggc

SEQ ID NO: 13203 - DNA, 394 bp, Gossypium hirsutum
  Clone ID: uC-gsflmaxxa097d09b1
tcttttaacacccgggagccccgagacctcggggggggtcttataaaaaaaggggggcgctataaacccggcccacccaccctggaaaccgctaaaccggagggagggtccagcggccggaagagcacctgcacgacaagtgcagtccggagcgcccccggcggcccttgaaaatccagaggaccgagtgacccccacgcccggtcgaactgataaccacatcaggtctccacggtgaacacccactggtccatggaacactgcaggcaagggacgacggccacctggatcccccacctcaggaaaaggactggctctgagggctgatcacgggggccccagtgcccaacccggcggccgacaaagcactgctcgagcatgctccccccagaga

SEQ ID NO: 13204 - DNA, 476 bp, Gossypium hirsutum
  Clone ID: uC-gsflmaxxa097d11b1
acgcgtggggatcagaataagaaaaggggggcttttttagaatgtcatgggggcttaagccagaattagttgaaagggatgttaaggacaaggtggatgacaaagaagacaacagtggatttatagacaaggtcaagggtttcattcatgacattggtgagaagatcgaggaaacaatcggctttggcaagcctactgcagatgtagctgagattcacctcccttgtatcaatcttgagaaagcagaaattgtcgttgatgtcctcataaagaacccaaaccctggtccaatccccctcgtcgacattgactaccttattgaaagggatgggagaaaactcctttcaggcttgattccatatgcttgaaccatccatgctcatggtgaggagactggcaaaataccagttactttgatatatgatgatatcaaaaggccattttatgacatttagccctggagcattatttcatat

SEQ ID NO: 13205 - DNA, 438 bp, Gossypium hirsutum
  Clone ID: uC-gsflmaxxa097e02b1
catggtggtatattcggaccatttgtgatatggggactgtgtggatttctttgggttttagtatggctatctgcaacctcaagtacccccgatcgaagtccccagatctcaaaatatgagttggattacataatgaacaagagacagaaatcccatgcagtggaaagcaagcctaagaccaaaatgatccctccattcagaagattgctttctaaaatgccaacatggtccctaattgttgcaaatgccatgcatagctggggcttctttgttattctctcatggatgcctatctactttaactcggtccatcatgttgatctcagacaagcagcatggtttagtgctgttccatggtgcatgatggcgctaacaggatacttagctggtttatggtcagacattgataaggaatggtaccagtatcactttgactcg

SEQ ID NO: 13206 - DNA, 459 bp, Gossypium hirsutum
  Clone ID: uC-gsflmaxxa097e06b1
aatttctcaaagaagaaaaatggtgtagctccgggggggtcaaggtccaccactgaaaaaagaactcattataaaggcagctcctcccaatagttatctcagtcctcatcactcaatatcctttgaaacttaagctttgatttcccaagttttttttttttaagaaatggctcaggcaagaggcggtgcaatggcggtggcagcggcgacggtggtgctctgcttgttgctgagccactttgagttggctcaagcagcaacatatactgttggtggaaccggtggttgggcctttaacgtggctggttggaccaaaaataagcgttttaaggctggtgatacacttgtattcaaatacaacccatcaatccacaatgtggtagctgtaaacagggcccgttacagttcatgcacaaccccaaaaggtgctaaagtttaccaatccggcaaggatcaaat

SEQ ID NO: 13207 - DNA, 404 bp, Gossypium hirsutum
  Clone ID: uC-gsflmaxxa097e10b1
tctgttcacgcgtccgatcaaaaacaccgcaggggggaaaacaacagcggcgtttcgcacaagtaaagcaatagcggtgttcgccaaaggtaaaacaatagtggctttacagaaaaatgccctctctttgccatcagccgccgcatccggcgacctcctaccaccaccccttgctcgtcattgcaaaacctcactcacttacgttggctcgtccgtaccctcgggcactatctacctccactttaacgtcgttctctgttctgcactttgtttacttctctctttccctcttccttccgtcatcttcgttgctcgttcttccgtctttgctgctttttactccgttcaccggactctctctatttttattttctctttggttatcttttatctttggctggatc

SEQ ID NO: 13208 - DNA, 413 bp, Gossypium hirsutum
  Clone ID: uC-gsflmaxxa097e12b1
ttggttccacgaaaaataaagaaaaaagacgggagggacggattgtaagcaggcggagctcatggaaatgggttcgggctctttgacagactcaggtgggtcttcctccaactcctccactgagtcactcaacggcttgaaatttggtcaaaaaatctattttgaggatacatcagctgctggcaccggtggtggtacgaccatggggactccactcaagtcaggtatcgggtcttcaagctcatccgggtcgggtaagaaggccatgggtggagtggtgcaaggtggtcagcctccaagatgtcaagtagaagggtgtaaagtggatctgactgatgcaaaagcttactattcaaggcataaggtttgtggtatgcactctaaggcaactaaagtcattgctgctggtcttg

SEQ ID NO: 13209 - DNA, 469 bp, Gossypium hirsutum
  Clone ID: uC-gsflmaxxa097f01b1
gcctcttttgctttgggcctcttttgctttaccgggtggggaagctatgcaaaggaggagttcttgcttctaaaactgcagcagaggcattggaggaggccaccactgccgagtctcttgttaggaatctaagcgtgttttcagaactttcctctaactccaagcctgggaaccctttgccaaccattgaccgatttttatccatttacgacgatgtcgtaaagtacactggaattgctgaaactgttgcagctggttacagatcctgcattgaagaacactcgaaatcatcttctctatgggttgaagctgcagtgacaaccgatcttgaaatagtctcccttctaacccctcaaaacaatgaatctctatcagctttacaaataaacctgtctcaacatgctttacccaaaaaccaactcaaaaccagttcaatgccacagctgcagcaaaataacaatgctgcaat

SEQ ID NO: 13210 - DNA, 466 bp, Gossypium hirsutum
  Clone ID: uC-gsflmaxxa097f05b1
gcgcccactcgtgcggtttttcagacccggcaacggggggggaagataagcaccaatggagctcctcctgctgaggacagtgcagataatgcagggatggagtcaagagaacctttttcatttccggagatcagtacggttcgttatggtatgaatccagctgatattgatgacggaattcctcgtttgtcgagggtgctatcaaataaatctagatcaaccaagtctaagcaggctgctgttgcaaaggtagagctggtactgctgggtttggaaaggcagtggatgttctggacacccttggtagtagcatgacaaatttgaatcttggcagtggctttacctcaggggtaacaacaaaagggaataaaatatcaattctatcttttgaagttgcaaatacaattgttaaaggtgccaatctgatgcaatcgctttctaaggagaatattagacatttaaaaga

SEQ ID NO: 13211 - DNA, 320 bp, Gossypium hirsutum
  Clone ID: uC-gsflmaxxa097g02b1
atgcggtttgtttctctggctgaaaattcccatccaagggaggctctaaaaaggagtgggggagttaatgaaaaacatggcaacgctctcgaacagtctgcgagagctggtgcagccttgactgaaggcactatggagaaaccgcttgcagggccggtcaacaccggacctattcatactactgacatatacacagaattgttgagccccatggcagccgacgccaaacctcttagggttggtactcttccaaattatgggttcagcttcaagtgtgatgaacgggctgagaaaaggagagagttttacactaatcttca

SEQ ID NO: 13212 - DNA, 481 bp, Gossypium hirsutum
  Clone ID: uC-gsflmaxxa097g05b1
ttttgattcgccggcatccagctcctcgagggggtttccttaaaccgggtgcgggaagccaaaactccatgaaccccaaacccagatctttggtttcttggcctttccactgccagggtataggctgtatcattaacagaccgaggaataaaacgctgtgtgatcactgacaaagaatccttttctacgaccagacaccggaaacccatcattcgcgcgcacagttataaccttacacaggcccttgcttcagcaatgaacgcatgagccacatcctgtatcagataagtgtgggctcctataatatcacctataaaatctctggctaaaactgctattgtagaagttctagaatctgtttgaaaggtagcatcaaaattaatggtgatgaaacccaaaactggaggcctacaatccccttttatcagaaaaccatcagagccaccgaagttctctttgcaaagatttacttcctaaacat

SEQ ID NO: 13213 - DNA, 367 bp, Gossypium hirsutum
  Clone ID: uC-gsflmaxxa097h01b1
ggttgatgaagaaggtgttgtttcgcaaagaggggtaatggctttagctcaaggatgtcttgaattggaatacttggctgtttatgtatctgacatcaccaatgcatcattacaatatattgggacatactcgaaaaatctgtgtgattttcgtctggttttgcttgatcgagaagaaaggataacagatttgcctcttgacgatggagtccgtgatctattgaggggctgtgaaaagcttagaagatttgctctgtatcttcgacctggtggtttaaccgatgtgggacttggttatattggacaatataattcgaaagtaagatggatgcttctgggatatgttgggggaatctgattcggggct

SEQ ID NO: 13214 - DNA, 180 bp, Gossypium hirsutum
  Clone ID: uC-gsflmaxxa097h02b1
gtttaatttccggtgccgtgtctcataaaatgggggggactaattgtgacgcggagagcatctgcacactcctcttcaagagttatgttgtttgcataacagcctgaccactcagcacacaagctaagacgctgttgcttccattgatgcactaaagcactacccgttgaatggaccccg

SEQ ID NO: 13215 - DNA, 505 bp, Gossypium hirsutum
  Clone ID: uC-gsflmaxxa097h11b1
tgctgggatcaagagctcttcgacgacatcggggggtaagttcgatgacgtatgggggatctcggggtctccgcctcgtcccaagaataagtcgccaaacaactctccgtttgatgacctgcttgggaatctcggggggaaagaaccggagatgaaggttaagagtgagagagtgaaatcggagaaagatgcgcctctgtttgatgatttgctttctggttttggccggagtagctctcctacacccgcgagatcaacttcagatgctggtcagtcccagaatccaccttcaaattcaagtaagactgggtccaatttgatggaagacccttttgttgtcttaggatcaacatcagaccctgcagatgcatcctcagggttgtttatggacccctcagaagtaataagtaaacctaacgggtctgggaagtcaggagtggagagttcatctggtagtgggggagtgtttgatgatatagatccttttgatggtattgaaaaatat

SEQ ID NO: 13216 - DNA, 243 bp, Gossypium hirsutum
  Clone ID: uC-gsflmaxxa098a06b1
cccatgcttccgcccacacgtccacccacccttgtggggctttttcaccccccatgggggttacaaacctaattctgtccgtgttattatctgaacgcttcacttcaataagtcatgttgcctccaggaacaacccaatgatgaccccaaaaacatggacgctattcctaccattgatgcactcaaccctaccaaatcgaatggacccgcccttggcattcaccaatatcatgttatcccaaa

SEQ ID NO: 13217 - DNA, 523 bp, Gossypium hirsutum
  Clone ID: uC-gsflmaxxa098b02b1
cccactcgtccgcagacaacggggaaggaaaatgcaaggggcgtggaaaccagattgttggtcttcttttttctcaatttgcttttacttttgcttccaacgttcttcttgggacaccaacttccgtacgccatggcccctcctatgaaaattgttttcggattgttaacatttgtcactgttggaatgataatcggggctttgtttcagctagcattcatacgcgggttagaagattcatacggtgatgactttccaactacaaaattacatagacgtcagagtgatggatatcttaagttgccaagaggtatgagtcactggcacggtgacaaagaagcagaaattttgcgtcttggagttgtcaaacttgaaataataagctggtcacctcgaataattgtacttcataatttccttagcaatgaggaatgtgactaccttagagccattgcccgccctcgacttcaagtttccactgtggtagatgtaaaaactgggaagggaattaagagtaatgtca

SEQ ID NO: 13218 - DNA, 527 bp, Gossypium hirsutum
  Clone ID: uC-gsflmaxxa098b04b1
tatattatttcaggtgatgtggtacaatattagaggggaacatacaatgtcctaataactagactagtggttgaactagtcagaccattggttcctggttcaattgattggatcgggtttacaactataccaataataattaaataaatattcataattcataaaattttaaaaaataaaaaatttattaaatcggattaaccttttcaactattggtttttgtctttattttttatcgatttcaagcagttttcaattcaatcagctcaacccctttgtttggactagtgtatggttgatcttcaatccaatcagtctgaccaatcaatctagtcatgttccaaaaacactgatcatatcatcaaatcttaacgaaatccaagttcagggaccaaaatgattctagttgcaaatttaggtatcaaagtgaaccaaaaataaaaatatcaaagtgtatgtaattgccaagttccaaaaattatattattcaaatttaaaagtgtaaaaatgtaataatgaattatat

SEQ ID NO: 13219 - DNA, 526 bp, Gossypium hirsutum
  Clone ID: uC-gsflmaxxa098b11b1
ttttcttttcttttttcttttccttaggttaatgcgcttaaatataaatcaatatacattctagctatcttactaattcctctttctctctctctctctctctttaatttttcaaaaaaatggataacaaaccatgcaaatcccaagatgttgaagtgagaaacgggccatggacaatggaagaagatttgattctcatcaactatattgctactcatggtgaaggtgtttggaataatcttgctaaagctgctgggttgaaacgtaccggaaaaagttgccggctccgttggctgaattatcttcgtccggacgttcgtcgaggcaatatcactcccgaagaacaactcttgatcatggaactgcatgctaagtgggggaataggtggtcaaaaatagcaaagcatctgcctgggaggacagataatgaaataaagaactattggaggactagaatccagaaacacatcaacaaacaagcagaaatgttttcttttaatatcagtaccccagaattacttgatca

SEQ ID NO: 13220 - DNA, 532 bp, Gossypium hirsutum
  unsure (1)..(532): unsure at all n locations
  Clone ID: uC-gsflmaxxa098c05b1
atctatgtttaaattatataaataataaaaatggcggtgttttggagagggcttattagattacctctcctatttgtgtatgcaagcagccattttatatatactaaacgacatttcgataaacccgaggtagtcgggtttaaggaccttgattacctccacggcgatggcggcggtttccttagtggccccatagaagccgatgatggtgtcaaagcttcgaagaccgtcgttgaagctgagagtgacgatgatgacaatgacgatgacgacggtgataagaagagtaaaaagaagaatgaaaagaagaataagaagaataagaaggagaaaaagaatagcaagaaagacaaaaaatacgatgaaagtttccatacattgccggtcgaaagccttgtaaacgaaaagggtggtgacgggaataccgacgattcgtctcaactcgtcggctataatgtagtgacggctcaaactacgtttaggngagttgggaattgctcgttgaaaactctggtgtttccgctatgcatgt

SEQ ID NO: 13221 - DNA, 520 bp, Gossypium hirsutum
  Clone ID: uC-gsflmaxxa098c07b1
tatttaccaagtttcacattgggttactaccattaatcttctttttttctttataagcctactgtctctcgcctttcttctcccccacacattcaaaatcctattccttttctcctttttctttttctcagacaagatgggttctcagggatcggttatggctatgcttttgctgatgatgttcactttatcatcagcttccgacatgtccattatatcctacgatgaagcccatcccgacaagtcaacgtctagttggagaacagacgacgaagttatggccatgtacgaggagtggcttgtaaagcatggaaaaacatacaacggtttgggtgagaaagagaggaggctccagatttttaaggataaccttagatcttgtagggaaggcgatggaggggagggtgagagactagggatgcttcttgaagtggccattgcttgctgttcgagttgtagtgaacaaaggcccacaatgtggcaagttctgaagatgttacaggagattaaagaagctgta

SEQ ID NO: 13222 - DNA, 530 bp, Gossypium hirsutum
  Clone ID: uC-gsflmaxxa098d05b1
tacatcactattcaaagagcattcagggaaaaaggggatagttatgttcaatgggccggtaaactggcccttagcttgaatgccaatgtcccatggatcatgtgcaagcagagggatgccccagatcccattatcaatacatgcaatggaaggcactgtggagatactttctatggtccaaataagcgcaacaagccggcattgtggactgagaactggactgcacagtatagagtattcggtgatccaccatcccaaaggtcagctgaagatttggcatactcagttgctcgattcttctccaaaaatggaagcatggtcaactactatatgtactatggtggcaccaattttggcaggacaagtgcctcatttacaacaactcgttactatgacgaaggccctcttgatgaatttggtcttcaaagggaaccaaagtggggtcatcttaaggacgtccacagggccttgagtttgtgcaaaagggctctattttgggggtttcctactactctaaagctgggtccaga

SEQ ID NO: 13223 - DNA, 524 bp, Gossypium hirsutum
  Clone ID: uC-gsflmaxxa098d07b1
tattgtcaagagctatcagacaattatacggggagtcttttaaatattttttagtttttctcaaacaatcatttcgaagttcgtgttaatctgcaattttttacggaaatcgacccgggatccgccgtaattagacctccagaaggttcctaactgaagcttacaacaatccgctatattcaagaacaggattttgcatggaaattagtctcagtaccaacaaattggtttcaacaccaacataattagggttccgacggaagagtcaagtcatatcatgtacggttgataatttcgccgccacggaaagggggaaaaccaatttttataaagtactttctcttgattccgagaacgtcagtttagctgaaataaagaaggcttatagaagaatggttcttcaatatcatcccgacgtttgttctccttcagcaagggaagaatcgacccatagatttctcgagcttcaaatggcttacgaaactctgtcggatccgatttctcgtcaaacgtttgattatgaa

SEQ ID NO: 13224 - DNA, 527 bp, Gossypium hirsutum
  Clone ID: uC-gsflmaxxa098d11b1
cctacgcgtccgcggacgcgtgggcttttccgacgcaaattgaacgagtttttggatcgttttcctttgcaatcaatctgaaatttttaaaattttcactcttttggtccatcaatttcagattcgaaaaaaaaaaaattatgagcgcgtataaacgcgtggttcaattagggtttgatgcgtattccagttccctcgttaacaaatttggatcccggcagatttctcaacttgttaattccaacggaaagcgtgcatttctcgtcgatacattggctctggttcgaagtttggaagcggaaggcgtgccatcaaaacaagcagaggcaataacagcagcaatcaccgaagtgttaaacgacagcttggagaatgtttctcattcttttgtttctaaagcagaaatgcagaagactgagatgctccaagaagccaatttgtcaaagtttaaatctgaagtaaaaagttctcaggattatcatttttctatgttgcaacgtgaaactgaaaaacttcgaggtgacata

SEQ ID NO: 13225 - DNA, 475 bp, Gossypium hirsutum
  Clone ID: uC-gsflmaxxa098d12b1
tttttcgcgtccgcccacgcgtccgcaaagacaagacatgttttaccatatctgggtgtcaccatcatcttcaacctccattgttttagcaatggttttagctttaactctcacatttgttcattcactaacattgagatcagatacggaagctcttcaagcacttacgcgttccattgatcccaacatgattccaccatcatcatatatcagttcatgggatttctcagctgatccatgtgatagtactggtgctaaatttctggggattttgtgttcaaaccctggggataattcaacaaaccggatcatatcgatcgagctcgatagtgctggatatgatggttttttgacacacaatataggaaaccttactgagttaacctcgcttgatcttagcaagaaccagtttagagggccattaccagataccttaaagaatttcaagacactaatccagatttctctttcaggg

SEQ ID NO: 13226 - DNA, 524 bp, Gossypium hirsutum
  unsure (1)..(524): unsure at all n locations
  Clone ID: uC-gsflmaxxa098e11b1
tctacgcgtccggctgcttccatgcgtagcggggagctcggtaagtccaaaaccgaaattcactccaacccctgctacatcgtctaatccaattaccatagagcagaagatgacaacttcctggaatgccaagggaaaaacctactacaggtattccacaatagtgaccaacaagtcttacaagacactgaaggatctcaagctttctatatcaaagctttatggtcctctatggggtctctccaagtctggcaattcttatggtttcccaacatggctcaactctctacctgctggaaagagtattgagtttgtatacatccattctacttctcctgctgatgtctcggtttcaagctacaatttggcttaagaatgaaaggaccaacaacaatgctatagcagagttaaaaatccactctgtttcctgggttattgtggtgcttagagttgtgcagtataccgaatacctatccaaaaaaaagggttttctttctcttgtttggggatatccaactntactt

SEQ ID NO: 13227 - DNA, 493 bp, Gossypium hirsutum
  Clone ID: uC-gsflmaxxa098f03b1
cgaaataatatgatggtcggagaaactcaccgtcgtaatccgacggtccatgttccaccatggcctaacctcgacgatgatcaaacggccgagatttactctccactcaactacaatgcagccgatagtcacttcaacaacaacggcggcaacccggttcatttccatgaagcgttagcagcgttacaacgttacttgccgtcgaacgaaccggactttgtctacccagattccgatcttccggttctcgaaaacgcggattctccggtcgacgcttactcgtgcgatcatttcaggatgttcgagttcaaaatccggaagtgtccacgtggccgagcccatgactggaccgagtgtccgtacgcacatcccggcgagaaagctcgccggagggatccgaggaagtatcattactccggtacggcttgtgctgatttcaggaaagggaactgttggaaaggcgacggttgtgagtttgctcacggcgttttcg

SEQ ID NO: 13228 - DNA, 524 bp, Gossypium hirsutum
  Clone ID: uC-gsflmaxxa098f10b1
tattataaaaaagatggcgtctgtaataaaatcgggaatcttaattctgtcggtgtttttatctgtaagcttcagttcgggtgttaggttgctccaggaacagcccaatgatgacctcaaaaacatggaagctattcctcccattgatgcactcaaccctaccgagttcaatggacccggtgttggcattcacgaagatcatgttgtcccaaaaggttccgaaattggtactcttggttttggttttgaaggtggtcctgaaaaatgttgttcttctggatgttccggtaattgtaatcctggtggtttcgttctaccatttcctcaaattccagaaatcccaagaattccacagatcccccagatcccacaaatcccacaaattccactaatcccacagatcccacaagtcccacaaatcccactaatgccaggacagtcgggatgtgagagtggggagtgttgccgtcagggttgcggtgggacttgtgctgagtgtggtcagcccaggtgcgcatcaggat

SEQ ID NO: 13229 - DNA, 525 bp, Gossypium hirsutum
  Clone ID: uC-gsflmaxxa098f11b1
tccacgcgtccgcccacgcgtccgcccacctggggttttctttgtaataatcgaactcccctcccgtcctctttcccgatttgtcttcttcattgccccgccatggcttgtgttagcttcgctaaactcaacgcgccgtcatcctcttggatcggtggccagcagtctctccctcaacgctccggatcatacgctcggctcgccactcgcagagtctcactcccgatccgtgctggcgcttacaccgactaactcatcaaaaccgccaaaactattgcttcacctggtcgtggaatactggcaattgatgaatcgaatgcaacatgtgggaagagattatcttctattggcttagacaatactgaacccaaccgccaggcttacagacagcttctgctcacaactcctggcctcggagaatatatttccggtgccattcttttcgaggaaacactataccagtcaactacagatgggaagaagtttgttgatgtcttgcacgaccagaaaatcgtacctggcatc

SEQ ID NO: 13230 - DNA, 500 bp, Gossypium hirsutum
  Clone ID: uC-gsflmaxxa098f12b1
tttttacgcgtccgcccacgcgtccgggggttccaagaagtgactaagaagctcttcggcttgatacaaaaggcagcatatacagttggaggctactccttcagcgcagctgcaatcgaatatgtaattttgaagatgaaaccaccattgcatagaccgcaaattgctttgcttcttgcccttcacaaactgaaggtgtcagatgagcaacgcaagtctgcaatcgatacatacgaaccactcgtaacttttgcactcagctctgggatgtactcatcacctgcggtgagaatttacactgctaagaatgttagggaagagcttgaagaagcacaacgcgattttatacgagcttcggttggggttagcagcaaagggaagctattagttccgaagttactgcactgcttcactaagggctttgtggatgattccaatttggcagtatggatatctcattacctgccgccaaatcaagctgcctttgtggagcaatgcat

SEQ ID NO: 13231 - DNA, 476 bp, Gossypium hirsutum
  Clone ID: uC-gsflmaxxa098g02b1
attgttctccaaccatattttcaggtcaaacttgtgggttccctaaaacctctttggggttcttcttcttcttcttcttcttcttcttatcctcttttcaatctcaattattaagttcaactacgttttaattttcggtccttgaatcattgaatgtcacaaaaaaaaaaaagaaaagaaaaaaaagacaatggcagacactggagacactgccagctccattggacctgatattctcacggagccttcatcggaagcaaccctgctcggacaatacgacctcgggaagttgctgtgatgtggggctttcgcaaaggtttaccacgcgctcgacctcgacttcgggtagagcgtgcccatcaaggccgtcagcaagaagaaggctttaaaaggcggcttcatggcacctgactagagggagaacgctatcacacgcctggtgcgccaccctaacatcgtcaagctcatctaggttt

SEQ ID NO: 13232 - DNA, 520 bp, Gossypium hirsutum
  Clone ID: uC-gsflmaxxa098g05b1
ctcattaattttcaactgttttgtggattgtcttctacctatttacacaaccaataacacagtgagcaaacaaccttttcacaaacctcatcatcatcttcttctaaatctgttgcctagaaaatgaataatcatcatggatttacggagaagaagcccaagactaagatcgtatgcaccttgggaccagcatcaagaccggtccctatgatcgagaagctgttgatggccggcatgaacgtcgctcgttttaacttctctcatggatctcatgcctatcatcaggagactcttgataatctcaggtccgccatggtcaataccggtgttttgtgcgctgtcatgctcgataccaagggtcctgagatccgaactggctttctgaaggagggaaaagttcagctgaaacagggtcaagaaattaccataactactgactatgatataaagggggatgaaaaactgatcagtatgagttataaaaagttggccgaagatgtcaaaccagggatggttatac

SEQ ID NO: 13233 - DNA, 504 bp, Gossypium hirsutum
  Clone ID: uC-gsflmaxxa098g08b1
ggtcttaaaggagaggccatggatctgggctcaccaaatggattttcgggagttgagtggatggcggcatcattggttgcacaaaaaccagagccattaagatggcataaggcttattttaatgcacctgagggtgatgagccgttagctttggacatggtgagcatgggaaaaggtcaaatctggattaatgggcagagcataggtagatattggacagcatatgctcatggtgactgcaatggttgtaattatgctgggacgtttcgaccaccgaagtgtcagcttggttgcggccaaccaacccaaagatggtaccatgttcctcggtcttggctgaaacctacacagaatctgttggttctttttgaggagctgggaggagaccccacaagaatctcacttgtaaaaagatctgtgtccagcgtttgtgccgatgtcactgagtatcacccgaatattaagaactggcagattgaaagctatggaaaggcacaacagttc

SEQ ID NO: 13234 - DNA, 523 bp, Gossypium hirsutum
  Clone ID: uC-gsflmaxxa098g12b1
ttttcgcgtccgcccacgcgtccgcctggccgtgaaaatggtgagcagtatggggctccatttaaagaagaagcgtgggatgatgaggaatattctagtaaccctttagatacaattactcctgtgaagccacctaatgaggtcattcctgttgataatgtaaaagctaatgttcaatctgagtctccattgaatgatattgaggagtttatgagacagtttgctgatgagcctgtgcctccacagccgcaagcttatcatagccatgtattgcatcaggttgtcagtgcagaagagacacaaagtactttgctggatccatctccaaggggtgttctctttcccgagcaacttacagttctccatggtcaagcaagatttgaattttcagagtcgcctatttctcaattgctgttgcaggaggcacctgaggtcacaactgtcgccgaccaccttggtcaggtacctcaattatgtgaggaggatttcttggagattgatgatctccttggtcctgaacctt

SEQ ID NO: 13235 - DNA, 514 bp, Gossypium hirsutum
  Clone ID: uC-gsflmaxxa098h12b1
tttctaagcagctagaagtgcagcacgagccaaggctttcttcggtgaatcgtttgaggagcaatgagtaaaaaaaaaaaccctatggtattcttcgatgtttcaattggtggagatctggtggaaagaattattatcgagctttttgcagatgttgttcctaagacagctgagaatttccgggcactctgtacaggtgaaaagggcattggcaaatctaccgggaaacccttgcactataaaggaactttttttcatcgaataatcaaaggattcatggcccaaggtggtgacttttcaaagggaaatggcactggcggagaaagtatttatggagggaagtttgcagatgagaattttaaactgactcatgacggacctggtgttctctctatggcaaacagtggtccaaacacaaacggatctcaattctttataaccttcaagcgccaacctcatcttgatggcaaacatgttgttttcggaaagggtatcaagggagtagaagttttga

SEQ ID NO: 13236 - DNA, 433 bp, Gossypium hirsutum
  Clone ID: uC-gsflmaxxa106a04b1
agctgctccacaactacagagaagagagtaaaggggaaaaaaagcgtcgtcgtttttgcttcttcttctacttcgctctctctccttctccgaagttcctctttcgttctttcatttattcagtattgtaaaagatggccgacggtgaggatattcaacccctcgtctgtgataatggaactggaatggtgaaggctggttttgctggtgatgatgctccaagggcagtttttcccagtattgttggtcgtccccggcacactggtgttatggttgggatgggtcagaaggatgcctatgttggagatgaagcacaatctaaaagaggtctccttactctgaaatatcctattgagcatggtattgggagcaactgggatgatctggaaacgacctggcatcttaccttctaccctgaacctccgtgttgctc

SEQ ID NO: 13237 - DNA, 445 bp, Gossypium hirsutum
  Clone ID: uC-gsflmaxxa106a06b1
cggacgtttgttgtgcaccatcgcccatgctttggagaagacaaaatatccagattcagatatctattggaagaagcttgaagacaaataccatttctcttgccaatttacagctgatctttttgcaatgaaccatacagatttcatcatcaccagtactttccaggaaattgcaggaagcaaggacactgttggtcaatacgagagccacactgctttcactcttcctggtctctaccgtgttgtacatggtatcgatgtgtttgatcccaaattcaacattgtttcccctggtgctgatatggagatatacttcccttacaccgaagagaagcggaggttgaagcattttcatcctgagatcgaagaccttctttacagcataagtgagaatgaagaacacttatgtgtgctcaatgaccgaacaggccattttgttacaatg

SEQ ID NO: 13238 - DNA, 388 bp, Gossypium hirsutum
  Clone ID: uC-gsflmaxxa106a07b1
gtgcaatccttggtcgtatcataaatgacattggagagcctattgtcgagaaaggcgaactcaaaaccgaccacttttcgcccagacacagagaagcaccagcctttgtcgaacatgctactgaacaacagatccttgtcactggtattaaggctggggcagtgctggaaccatatgacggaggtgcgatccttaaaaacgtcaagtagaaaacgtcaactcatgaagtgatttataccccacgctcactacttaaagtaacctatcggctaaactcaaaatgatgtgacgcgacgtcgatccgatacctaacctaacacaaaatcttgtagatagactggtccaacattaataagctttggttcaaattctcggaccaaaacagacc

SEQ ID NO: 13239 - DNA, 266 bp, Gossypium hirsutum
  Clone ID: uC-gsflmaxxa106a10b1
gcgatttgattctttggaaacttttctggttaataggacgtggggaccaattgaagtttggaagttggtttgctaagccaaattaccttttagggtaatcattttccttctggaaaattgcagaaattcagaagaagtctggataaggatctgtagagaccgagtgcagcttcaccatctgtacttgcagtgaattcaatcaaggatcggataagcattgctgtggaatggaggtgatggtacttttatggagtaggaagggaatg

SEQ ID NO: 13240 - DNA, 99 bp, Gossypium hirsutum
  Clone ID: uC-gsflmaxxa106a12b1
gtttggtgagctggatatcaaagaggaagaaaaagggaggggattgagttagaatatagttctgtaaaccaccacgtaacaaaaacgatccatgcttgg

SEQ ID NO: 13241 - DNA, 113 bp, Gossypium hirsutum
  Clone ID: uC-gsflmaxxa106b02b1
taaagggaaagctgcacgcccgcacggcaccggcccggatttaccggacggccccacccaaacgacccatttttttaccaaccccagaaggcgacaacaaacaggggaccgtt

SEQ ID NO: 13242 - DNA, 302 bp, Gossypium hirsutum
  Clone ID: uC-gsflmaxxa106c02b1
aacagttacatgaaggaaaagagggaaaaaagagaggaaggaaacataaagggatttggactttggacggaaaaaaaatagagaaagaaaacggggaaaggaggggacaagagaatggaagagaaagatgaaggattagcaatggcgaatgatttcttttggtcatatacagatgaacctcatgcttcaaggagacgtcagatcctctctaaataccctcaaattaaagagctttttggtccggatccctttgctttccttaagattggtgtggttgtttcgattcaactatggactgtcac

SEQ ID NO: 13243 - DNA, 592 bp, Gossypium hirsutum
  Clone ID: uC-gsflmaxxa106d04b1
cccactctgttcttccacgcgtccgaagaaaaagaatgatggggagggggatgattgtgattttgtttttttttgccccccagttcctcgttggcattttattttttcgtctattttttttttttcttttttttttttttttttttttcttttctttttcctatctcttctttatctttctcttctttttttcttttttctcttttttttttctttatttctctttttttctttttttctcttttttctttttatttttttctttctctttttttttctcttatctttctttttttttttcttttctttatttctctcctattctttttctttcttttttttctcttttttcctttctccttttctccttttttttccttctttctttctcttttatcttccttttccctatttcctcctttctttatttcattctcttttttatatttttttttcatcttctttttttaacttattcttttttcacctatcttcattttcttattttttttccttttattttatcctatttctctttttcctcacatttttcttttttttattttttttttttcctcttcttatttcttct

SEQ ID NO: 13244 - DNA, 358 bp, Gossypium hirsutum
  Clone ID: uC-gsflmaxxa106d05b1
tttagttcccacacaaatcgacggcgctagtgggatgggggggccatgagaagagtcaaccgctttcctacccccggcagaaccttaacctgtggcggcgccgctgagaaaccgctggctcaagcggcggtgatgagcacatgcccttcttcatcgctaaaatctcataatttcccgcagaaacccgctgaacgaatagggctgtcgcgtccttccctcgtgcgcaggggagcggggaccacgctggaccccggggcagcatccactactggcacaagaagcccttgctaaggagaagccaccctctgcaaaggccccccccaaggaagccggtctctaccagcaagaagcctgcccc

SEQ ID NO: 13245 - DNA, 284 bp, Gossypium hirsutum
  Clone ID: uC-gsflmaxxa106d10b1
ctcagagcttttccaatttgatggcgtttgtgggtttatttgaagtttttttgcctctcgctttctttctgcttctctactgcttaagagataagtatcatggccctccaaagagtttcccgcttgtcgggatgatgccacagtcttctcttctacattctctcggctgtcatgactgtcttaccaacactctcccgatatgtcactccactcttcttcccactagggttttgctaacacaaccttccctgctcccttctatcccttccatcatttaccacatc

SEQ ID NO: 13246 - DNA, 459 bp, Gossypium hirsutum
  Clone ID: uC-gsflmaxxa106d11b1
gtataactagaacatacatcgacatcgctatttcgatttgcaaccatgagaagagtcaacggactcgctatcgtcggcagaaccttaacctgtggcggcgccgttgagaaacggctggctcaagcggcgttgatgagtacatgctcttcttcatcgttaaattctcatattttctcgcagaaactcgctgatcgattagggctgtcgcgtccttccctcgtgcgcagggttgcggggaccatgttgttttctgtggcagcatcgtctttggctcaagatgctcttgctaaggagaagcctcgctctgaaaagttcctccccaaggaagtcgttctctaccagtatgaagcttgccctttctgtaacaaggttaaagcatttttggattattataacattccatataaaaatggggaagtcaatcccatcaagcaaaaggagataaagtggtctgattat

SEQ ID NO: 13247 - DNA, 67 bp, Gossypium hirsutum
  Clone ID: uC-gsflmaxxa106e02b1
gtgatctcttttgaagtagttggtcattgtacatacataatggggttgttttaagtgaagttttctt

SEQ ID NO: 13248 - DNA, 364 bp, Gossypium hirsutum
  Clone ID: uC-gsflmaxxa106e04b1
ccctttacttgtccgaaaaacaaggcaccacaccttaggagggggcctttcaagttggtacttccattatcacccccctcagcctctaaaggtcaatcagatgctcctgatgctgctgccaagtctggcgcaaaagctaacgggaaaacggatttgagccagccacttttggatgctaggaaagaagcatgtgcctctggaactccatcaacaggtgggaaccctaaagggacatacctattaccaaaagcaaacttagaaggcccaagccaggcccctaccgagataaaagcccaaggcaccataccggctccggctgatcctagggccttccaaagaccccaaacggggtagagtccatagt

SEQ ID NO: 13249 - DNA, 145 bp, Gossypium hirsutum
  Clone ID: uC-gsflmaxxa106f03b1
aagagtccgatgtaaaagcttcgtcttcttcgcaagagaatcagaaggagaaccataaacttgctttccaagctaagcgtgctaagacctccaagcctcaaccccagcttgagtactttgaagataagcgtaacttggaggattt

SEQ ID NO: 13250 - DNA, 402 bp, Gossypium hirsutum
  Clone ID: uC-gsflmaxxa106f07b1
cccactcgtccgcggacgcgtgggtttctttctcattaggctactctcgtcactaagaactttaggcttggaccatggaagactctgctggaggcgcatcattacggtcgggtcccgacgggaagaagcggcgtgtgacatacttctacgagccaacgatcggcgactactattacggtcagggtcacccgatgaaaccccaccggattcgtatggcacacaatctcatcgtccattattctctccaccgtcggatggagattaaccgtccttatcccgccggtcccgacgacatccgtcgcttttacaccgaagagtatgtggacttcctcaacgccgtcacccccgattccatctccgaccccgcttatttctgccatttgaagcgttccaatgtcggag

SEQ ID NO: 13251 - DNA, 51 bp, Gossypium hirsutum
  Clone ID: uC-gsflmaxxa106f10b1
gcacgcctgcagggaccggacacggaacacccggacacacactacaccaaa

SEQ ID NO: 13252 - DNA, 293 bp, Gossypium hirsutum
  Clone ID: uC-gsflmaxxa106g04b1
accgtttacttgtggcaattggtttcatcgaggggaccaacggggttatattgaggtgccttttccggatcctcaatgaacccagctggttcattcggaccagtcttggttagctggacatgggacatccactggatctactgggtcggaccccttaacggtggggggctcgttggcctcatttacgagttcatttgtaatagtaacacccacgagcagtttccaaccacccattatttagcctaatcaggggttaattgattcggctgtcacttttaaaccggatttttttc

SEQ ID NO: 13253 - DNA, 89 bp, Gossypium hirsutum
  Clone ID: uC-gsflmaxxa106g05b1
gttggttatccaccccaagaggcgccactaaaaaggggacgcttgaaaagcccttttctttgtcaaaccccacccaggaccaccgaaac

SEQ ID NO: 13254 - DNA, 108 bp, Gossypium hirsutum
  Clone ID: uC-gsflmaxxa106h03b1
gaacaacaccaccacacaacacaaaccaaaccttttcttttccaaccccaacacaccacacacacaaccaggggggggggggccaatatgaaaaaacaaccacttccc

SEQ ID NO: 13255 - DNA, 392 bp, Gossypium hirsutum
  Clone ID: uC-gsflmaxxa106h04b1
ctttcgtttccgccatgatactcgtggctcacatggcagggttgaacttaattagttagtttttcgtgagaaattatgaatgcagtgctgatgtgcataggatactactgctgtcagcttttgatcatgagaggcatattaaaaattgggaattgttttacaatgttaatattgaatggggagagttcctgaaattttccgggttttactttgagataagtgatttgagataagtgaaccgtaacccagtttaaggggattgctagcttccctacggtcttaccaggtgaattagctgatctacgctgcaaggtaattattctgcgaatgaaggctcctaatgtttttctcttttttagggtatggaattttttgttcttgtgcaaggatga

SEQ ID NO: 13256 - DNA, 320 bp, Gossypium hirsutum
  Clone ID: uC-gsflmaxxa106h06b1
ttacctgtggcaaagggttacatcgaggggaccaacggggttaattgaggtgccttctccggatcctcaatgaacccagctggtgcatccggaccagccttggctagctggacacgggacaaccacaggatctactgggtcggacccactcatcggtggtgggatagctggcctcatctacgagtacatcgacatcagcaacacccacgagcagttcccaaccaccgattattaagccaaatcagggtttacttgattaggctgtcactctgaaaccggatcttctccgaacacatttgagactactatctatttccttg

SEQ ID NO: 13257 - DNA, 251 bp, Gossypium hirsutum
  Clone ID: uC-gsflmaxxa106h10b1
tattttcatatctccagctcccaaggtaaatatgccgatcagaaacatagcagttggccgtcctgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtct

SEQ ID NO: 13258 - DNA, 291 bp, Gossypium hirsutum
  Clone ID: uC-gsflmaxxa107a03b1
gggaaggagagggggtgatcaaatacggccggaaactcatcggagcaacagatcctcaaaaatcagagcctggaaccatcagaggtgatctagccgtggttggcggaaggaatataattcatgggagtgatggtcctgagactgccaagcatgaaattaactggtggttcaagccacaagagttggttgactatacaagtcaacgctgagaaatgggtctatggaaacagctgatgagggcttttttattctagttaattagccgatgttcatgatattttagttccacat

SEQ ID NO: 13259 - DNA, 313 bp, Gossypium hirsutum
  Clone ID: uC-gsflmaxxa107a04b1
gattgatttaaaaagaaaaaaagagagatggcgtctgtaataaaatctgcaatcttaattctgtcggcgtttttatctgtacgcttcagttcgggtgttaggttgctccaggaacagcccaatgatgaccccaaaaacatggacgctattcctcccattgatgcactcaaccctaccgagttgaatggacccggtgttggcattcacgaagatcatgttgtcccaaaaggtgctgaaattggtactcttggttttggttttgaaggtggtcctgataaatgttgttcttctggatgttcccggaattgtaatc

SEQ ID NO: 13260 - DNA, 193 bp, Gossypium hirsutum
  Clone ID: uC-gsflmaxxa107a07b1
tctacgcgtccgcggacgcgtggggaaggaaccagatgaggttgtaatatttcgagatgggacgtacctaaccctgaaagaagtttttgagagcctggatttaactggatatgatttaaatgtggaccttcttgatgttcatgcagacaaaagtaccttccaatcgtttgataaatttaaccttaagtataat

SEQ ID NO: 13261 - DNA, 549 bp, Gossypium hirsutum
  Clone ID: uC-gsflmaxxa107a11b1
ttataaattagagatatggcgaaagctgaggttgtaattgttctgtctttgttgttggtgacaacagtggttgatgggttgggagggaggttgtggttttttctttgttgaggaattccttgtggtttaaccctttatttatgtttttttttttatttttatcttttccttcatttatttttttcttgtttattgtttttatccatttttactctttttatttttttcttatttttttaattattttttctatttcttattttttcttttttttctcatttattgttcttttaaattttcttttttcttttttttatatctccttttattttctgttttcctcttgcgtgttttctttttccttttcattattttttttacttttttccgtcctttttttttttttctacttttttttattattcacttatcttcttttttttgttcttttctttttatccttttctctttttttttaatattggttattctaatttttttcgttttactctttttttttttttttttaatctcttgattttgtccttt

SEQ ID NO: 13262 - DNA, 449 bp, Gossypium hirsutum
  Clone ID: uC-gsflmaxxa107a12b1
gtttaatggtaccaatttaccacttattttttggctctactagtgaagggttgtgacttagtccttggcattcaatgattgttatcattagggccgattgtggggaattttagctcattcactatgcaattttagtgcctggggcaggcgtgcattctcagaggtattttacgaggaggcctacaacttttatctagtgaccaactatctaatgtttcaacatggtagcacatgggcattgactaatgttgtttactttttgcgatcaagtagctctatcacttccaaagtctacactgtcccaaaactcgtagagagctctcagaggaagttcgtgatgtgttgaaaccattactagcctccctcagtgcagggtataggaccataagatgcctttgcaggatgaaacatcgatggcgtgagtgagaccatataggttttttgctgtg

SEQ ID NO: 13263 - DNA, 529 bp, Gossypium hirsutum
  Clone ID: uC-gsflmaxxa107b04b1
cctactttgtccgattttttcttcactttgaggtttgagcagatcggatggcaccaaagaaagataaggcccctccaccttcttccaagccagcaaagtctggtggtggcaagcaaaagaagaagaagtggagcaagggaaagcaaaaggagaaggtgaacaacatggtgttgtttgaccaggctacttatgataagcttttatctgaggctcctaaatataagctcatcactccctcaattttgtctgatcgtatgaggattaatggatcccttgctaggaaggctataagggaattgatggcaagaggatcgattcgtttggtgtctgcccattcaagccagcagatttaacactagggcaaccaacacctagatgctttgttatagttttgcttaaattagttctatgtagtatttgcctttcttgactttctgtgaacgatttttcctttttgctaagacctccatctataatgtgtgagctacagcttcttgctgttctgtttaatggataatttttgttcctc

SEQ ID NO: 13264 - DNA, 383 bp, Gossypium hirsutum
  Clone ID: uC-gsflmaxxa107b12b1
gcgtgtttttgattcatcaaacaacaatgtcgtggcgaacttacgttgatgatcacttgatgtgtgaaatcgagaacggccatcatttatcctccggtgctattctcggactcgatggaagtgtttgggcccagagctccgcttttcctacgtttaagcctgaagagattactgccatcatgaaagattttgatgaacctgggtcccttgcaccaactgggctgcaccttggtggcgccaagtacatggtcatccagggagagcctggagctgtggttcgtgggaagaagggcacgggtggcgtaacagtgaagaaaacagggcaagcattgatttttcgggatatatgatgaaccctgtgacttcaggacagcgtaacatgg

SEQ ID NO: 13265 - DNA, 521 bp, Gossypium hirsutum
  Clone ID: uC-gsflmaxxa107c08b1
gagaaagaaacaagatagtgaagtatcaaaggagaatgcagtgcccgtaccaaatattgatgtagtggcagaaaaaggatctactccaataagtttgagtgctcctgctgttaacacaggtggtcgtgatgccatgcctttaagaacattagtggtgccaggttcttcatctgcattggatttaattaagaagaagttgcatgaccctggagttccttcttcctcacctgttccggttatgccagtaacagcaacgcatgaattaaatggctcaagagcagttgatgttaaaggcctgtatagtgagagcaacaaagataaactaaaagatgcaaatggggatggtagcatatttgattccttttcagattttgaggatgcagacagtgggccttttaaggaagagcgttttatgcaatttaaggaaatgcttaaagtactgggagttgcaccattctaaaatgggaaaaggaactgccaaagatagggttctgaccacgtttaaggtttttcaagtcatt

SEQ ID NO: 13266 - DNA, 391 bp, Gossypium hirsutum
  Clone ID: uC-gsflmaxxa107c11b1
ttttaattgaaataatataatttagaataatattttcaatttcactatatatatttcaattccttaatctcggttcacagttcatccagcacgtaatttcattgagaaagatcaagaaatggagaagaacagtagctgttgcttttcaaatttatcttcaaatcttccgatcacttgtttgatcactttcatcaccattttcctacaccgagttcttaacgtcatttaccgaaccggcaagccactaggcaaaagagtttctccgcagcggcctcttagcactctcattgttttaggttcaggaggtcacacagcgcagatgattaatctcttgttagtttcgggaaaggaaaggtttacacccgaggtttatatccgcgctgcgactgat

SEQ ID NO: 13267 - DNA, 385 bp, Gossypium hirsutum
  Clone ID: uC-gsflmaxxa107d04b1
gctttttctgttggcttagccaaaaaagtcaaggacccttcttatctttccgatgatggaacttatgcaatgaaaaaagttctcgttcagaataatgagcagttggaattggttcgttgaggagatccgtgcttcatccttgtttagtcaccctaatctgctttcacttcttgatcatgctattattgccattaagcctacacaagaaggatcatggactcatgaagcatatttgatatttcctgttcatttggatggaacattactggacaattccaatgctatgaaagctaaaaaggaatttttttctacctcagatgttcttcaaatattttcggcagctgcgtgcagggctgaaacatatgcatggtcttgctcctccata

SEQ ID NO: 13268 - DNA, 105 bp, Gossypium hirsutum
  Clone ID: uC-gsflmaxxa107d05b1
atttttacatagctcacagacggatcattatttacttcaaataaaaaaagaacaagacaaagaaccggcaagactaaggttatgttttgaaatcggaccccggct

SEQ ID NO: 13269 - DNA, 571 bp, Gossypium hirsutum
  Clone ID: uC-gsflmaxxa107d06b1
tttttctatatcctctttctaaaaataaaacaaaatattaattaggatatatggcaggcgattcacgtaagaaggccgtgctctctcttccctccatctctccttcttctcccctttccctttccctcctttcccttcttttccccttctcttcttctcttcttcttttcccccctcttccttcttccctcttctttcctctctcattcccttcctcctctcctcctctcctccctctccccttctctctccctccccccccctcctccttcctctcctccccccctctctcctccttctctccatccttcccctccctcttcttccctctcccatcttcttcctctctctctcctttatcttcctccttccacccctttcttccattctcttttctcttctccccttttcctctttttccccctcttcccttcctcctcttcccttcccttctctctcctctccctcttcctctttccatttccctctttccctcctcttccctttcttcttcccctcttctcccctctctattccaatttcttctccctcttcttctctctcttttctt

SEQ ID NO: 13270 - DNA, 534 bp, Gossypium hirsutum
  Clone ID: uC-gsflmaxxa107d11b1
ttttacgcgtccggcccctaattccacttccaaatccctaatcactcattcacagacacgacacctcccccaccaatctaggatttatttttgtttcttcgattcttcattagttttttttacttaaaaagaagattggtttcggtttcttctcaacattcatacgaagacggagaagacgaagatgaaaaagaacattcccattctgtgttttggtcaaacttcaatcaggactcaagaatggctgggaaagcagcacaatctgtggtgaaggcagtgggagaataccaatatccatggcgtgaaaagatggccaagtacaaagtagagttatcaaagggagtatggggctattgggaacttggagcctggaagcctctaggcatcagtgccaggcatcgagccagactccgaaaagaaatgcttctagcgggccaagattggccatgcgatccagagaagaaagagatgagagctagatgaaggtcacaagtgcgacagaatatccgggagagaagggagattctgctaatt

SEQ ID NO: 13271 - DNA, 72 bp, Gossypium hirsutum
  Clone ID: uC-gsflmaxxa107e01b1
caataatatcgcctctagcttttacatcatgtcaccagaaatatcaatatctcatagcctaaagcattaaca

SEQ ID NO: 13272 - DNA, 92 bp, Gossypium hirsutum
  Clone ID: uC-gsflmaxxa107f12b1
gataaaaaaaaaaaaaatcaaagatggcggaaaaagaagatctgggtttgagtctcgatttctgcctccttcacacttcacccctctttaca

SEQ ID NO: 13273 - DNA, 408 bp, Gossypium hirsutum
  Clone ID: uC-gsflmaxxa107g02b1
ctttttcgtccggccagttatctctctgtttcagccagtcatgatgatcttggcgtcatgtgttttcttatgggctaatatgtgatgaatgctgtctgcggaaactgctaaagctattttgttcgacatcctgcaatttgcatctgatttcatattatcacactgaagcttttgatgatcggatcaatggtgttggaatagtttggtgcggccatggaacacgctaaagagtggatcaaggtgcacaatttttggtccggattgcatggggtgtattatttatatgttggggtttgtaaattacactcatttcttttggagttatctcccttgactcatttcttcaattctccttctataccctgtaccccatttatttgtatatttcttcttatttaacacgttttt

SEQ ID NO: 13274 - DNA, 399 bp, Gossypium hirsutum
  Clone ID: uC-gsflmaxxa107g12b1
taatcttctttccgggccctcctaaagatgtcaaaaattgacaataacaatgctccatggcaccgtctcaggcgtgcttccacaccagggaaggcaacggtgctcgccatcggcaaggcctttccacggcaactaattcctcaagaatacttggtggagggctatatacgcgatacaaattgccaagatgtctccatcaaagagaaactggaacgtttatgtaaaacaactactgtgaagactaggtacacagtgatgtgcaaggagattttagatcaatacccagaattggcaactgagggttcatcaactatcagacaaaggcttgaaatagcaaacccggcagttgttgagatggcatttgaagcaaggttaccttgcatagaggaatggtgggag

SEQ ID NO: 13275 - DNA, 63 bp, Gossypium hirsutum
  Clone ID: uC-gsflmaxxa107h04b1
cgcgttcatatgcagccacgaccctgccgaatcattcgtgagaaatttcccaacgttatccca

SEQ ID NO: 13276 - DNA, 386 bp, Gossypium hirsutum
  Clone ID: uC-gsflmaxxa107h10b1
cctatgtttcgttgatttgtttctaaggatttaatctccaaaccttcttcccatttcttcattacattgttcaagaaaaaagaagcaaaaaaacatggccaaagttctgttgttcattgcactatgtgtgcttttagctttggttagtgctacatgcattctgtattatcaattggtgtttgtcgtgtattttttctttttatcttttctttatttttctttttattctatttatctcttcttctttctctctccttctttttattttttttcttttttttttcttttttttctctctatctctatatatctttattatttatttcttttttattctttctatttctttattcctttcttttttttttttttttctcttcaatttt

SEQ ID NO: 13277 - DNA, 90 bp, Gossypium hirsutum
  Clone ID: uC-gsflmaxxa107h11b1
tggtaaattcccttcttttcccctccacccaagccgtaaaaattcatggcgacagctctaaatatcccaaaacgaaagttcgtcgctgac

SEQ ID NO: 13278 - DNA, 469 bp, Gossypium hirsutum
  Clone ID: uC-gsflmaxxa119a04b1
cttttatgcaagaaacaaaccaaaaaaaagcttctaaaccgatggctaagaaggaaacccaagaattccaatttgttgtttacaataccatgactcagcaaaaagaggttttcaagcccaaaatccctggaaaagttcgcatgtatgtctgcggtgtcactgcctatgatttcagtcaccttggccatgctcgtgctgccgtttcctttgatgtcctttacaggtaccttaagcatttgggttatgaggttacttatgtcaggaattttactgatgttgatgataagataattcgtcgagccaatgagactggagaagatccaataagtttgagtgaccggtactgttaagaatataatatagatttgagtgatctacagtgcctttcttcaacacatgagccacgtgtttttgatcaacatggagccgatttaagatattattaacttatattattaacaaagacttt

SEQ ID NO: 13279 - DNA, 518 bp, Gossypium hirsutum
  Clone ID: uC-gsflmaxxa119a06b1
gatctttttcagaggtgaaggaaaagattttggatgatttttcaccccatttcagtctgttgaatcaacttctccttcacccaccctgcatccctttttatttttattgctttccaatggctgttcaagctcagtatccttccaatgtgctcttcttaaacagaggtggacaagaggagcatgaattttcgttgcagcaacaagcgggaggagtttttcttaatcaaccccatatgttattcaacaatggcaccaacaataagattaatccaaggaaaagagcaagggaagttacggcaggggccgcaataactacgcccatgaattcatattctttgcaaatgcaaccgcctcagctgatagagctttcccaactccaccaaccgaatgtggtttccaccggcctccgattatctttcggcggcgaccaacaacaatatcagaatcagaatcttcaaaccaacaacaccaacacccaccacggcaacagaattttggtcccagctccactttttttt

SEQ ID NO: 13280 - DNA, 177 bp, Gossypium hirsutum
  Clone ID: uC-gsflmaxxa119a12b1
gattgttttaagaggtgaaggaaaaaaaaatggagagattcatcatcaaagtcgttcttgagaaagcaatgggatgaatacaaagaattctgggccgatcgatttccgttcactaatgtctatttaagatacatcggccgtgaacagtcccttccttcatggtctgaatcctatgtt

SEQ ID NO: 13281 - DNA, 115 bp, Gossypium hirsutum
  Clone ID: uC-gsflmaxxa119b01b1
aattaggctccaaggccaaaggcagagataaacggggtcgttatgaacttctcatcatcggcaaatactttcctgcttgcatggttagtagagaggttctgaataagtatttcga

SEQ ID NO: 13282 - DNA, 307 bp, Gossypium hirsutum
  Clone ID: uC-gsflmaxxa119c02b1
cattggtgcaccagagcagatcataactctttgcaactgcatagcagatgtaaggaacaaagttcatgcagttattgataaatttgccgaacgcgggcttcgttctttagctgtcgcaagacagtaagttctctgtgtatcaatttagtgtaccttttgttccttcattttttttttttttttttcttctttctctttctttttttctttttcttttttattttctttctttctttatctctatttttcttttttctttatttttattttttctttttattttcttctcttttctgctttttctttt

SEQ ID NO: 13283 - DNA, 109 bp, Gossypium hirsutum
  Clone ID: uC-gsflmaxxa119c03b1
ccccgtgctatcgccatggtatctgtccctgggaatcccgtcaaggttaaccacccagcagcccgagattcatgttagaaaatcgtatcgcgcgaataaagccatccct

SEQ ID NO: 13284 - DNA, 104 bp, Gossypium hirsutum
  Clone ID: uC-gsflmaxxa119c06b1
ttccaagcccccgcgtaggaaccggcaaaagcaaaagcaaactcctggggggaatgtaaaaaaacattgacagtgcaggacccttccagaccgtgtactggtta

SEQ ID NO: 13285 - DNA, 451 bp, Gossypium hirsutum
  Clone ID: uC-gsflmaxxa119c07b1
ataaaacacccaattgaccaccatgttcaaattaggtcaacattctaaccatccttgtgctatttacattaattctattatatcgtagattccgttacctccgtgccaggaggttatcgtgtcgattaccccttgcttgagcttcataaaaggcttatccttatactctatttgtttgttgttcgggcgctaatgggcttgctaagcaagctaacaccaaactagataggcaaggaatatgcgagtgccttaaaggtgtattgccaaaaataggaccatatgaccctaaaagattccctcttattgcccagaaatgtggtatcaatactttaattcctccaatttctgccactactgattgcaccaaggtgtgaagagtgaagtggggggaatgtgaaaatgaagagcatgccaaatgaataaaaaaatgggcagaaactttcataattga

SEQ ID NO: 13286 - DNA, 209 bp, Gossypium hirsutum
  Clone ID: uC-gsflmaxxa119d10b1
cgatcctacacaaaaaagaaaagaaaaattacagcgaaaatttcaacccttaaagttccagctcatgtacctgccccttctgaggatgctgagcaacttcgtaaagcttttgaaggatggggttcaaatgagcatttgattatcgacatcttggctcacaggattgctttttatctcattttgatttcttataacttttcgtaattcta

SEQ ID NO: 13287 - DNA, 51 bp, Gossypium hirsutum
  Clone ID: uC-gsflmaxxa119e01b1
agcctccgaataaagatcgcgtctgtaataaaatctgcaatgttaattttt

SEQ ID NO: 13288 - DNA, 492 bp, Gossypium hirsutum
  Clone ID: uC-gsflmaxxa119e04b1
ggtaaaaaaaaatcccgagcttcaacactccagtcgctcactgattaatttcaataaaaagaagaaaaagacagttgctcactgatattggtgtagtggcagagcagtgaagagaatcagttgagatatgtctaagcaaggagaagtggtctgcgtaaccggtgccagcggcagcattgggtcttgggttgtcaaactcctccttgctcgcggctacaccgtccacgggaccgtcagaaatctcaaggacgagaaagaaacgaagcatctagaagctctagaaggagcagactcacgtctccgcctcttccagatcgatctcctcgattatgattcactcgccgccgcaatcaatggctgtgctggtgttttccaccttgcttttccatgcagcgtcgatcgagtttacgaatcctcagaaggagcttttggatcctgcgattaaaggaacgcttaatgtactgacagctgccaaagagcttggtgttaaac

SEQ ID NO: 13289 - DNA, 54 bp, Gossypium hirsutum
  Clone ID: uC-gsflmaxxa119f01b1
ctttactctctgccttaacgctataatcatagaagaaaaatttgtttgaaggat

SEQ ID NO: 13290 - DNA, 166 bp, Gossypium hirsutum
  Clone ID: uC-gsflmaxxa119f02b1
ctccgcttctctctttctttctacttgcccattcccatgttatcatttcaaacccccatttaactgtctagttttttcccatttcagttcaaaagttttgttcttcttttcaatttgttgaaaagtagatcattttaaagatttctattagtgagatacattgggg

SEQ ID NO: 13291 - DNA, 125 bp, Gossypium hirsutum
  unsure (1)..(125): unsure at all n locations
  Clone ID: uC-gsflmaxxa119f04b1
accccccggatcncatccgcgtaaaatcaaaaccaaattgtgttttattttaaacatatagccgcgcaaaaacacaaagggcataaaaaaaggatattcaatggggatcttctccttcaatgcca

SEQ ID NO: 13292 - DNA, 547 bp, Gossypium hirsutum
  Clone ID: uC-gsflmaxxa119f09b1
gatgttttttcagttttgtttatatgttagaaaaatgggggtcttgtgtttttttagtaaagatttgaagagagattcatttccaattccagggacaaacattctggaataaacccatgttgtgttatgaacacaagaagacattattatatacaaaaacattccacaatgattcacatttttgttgctttccttcttgtttccacttctcttggccctgtcttgtctttacaatcagtaccggattccggtcaccggcaactacagaactgtactttaaacccttacaaagatattcagaagctaagaagagtccaagcttatctcaagaagataaataagcctgctgttaagaccattcagagtccagatggtgatgttatagactgtgttccgtctcatcttcaacctgcttttgatcatcctcagcttaaagggcagaaaccattgaaaccggctgtgaggccaaaaggacataacttaacagaagcagtctctgaaagctttcagctatggagagatacaggtgaatcatgtcctaaaggga

SEQ ID NO: 13293 - DNA, 519 bp, Gossypium hirsutum
  Clone ID: uC-gsflmaxxa119f10b1
cctacgcgtccgcgtaaaatcaaaaccaaattttggtttaatttatacatataaacacccaaaaacaaaaagggcataaaaaaaggagattcaatggggatcttctccttcaatgccatagctttggccttcttattagccattatctctggcgccgtcaatgcttgcccttcttccgaccgagaagcattgctagctttaagttcatcgttaaaggagccttatttaggcatcttcgattcatggaaaggcaccgattgttgttccaactggtacggtattagctgtgaccccaccactcaccgagtcaccgacgtttccctacgcggtgagtccgaagaccccattcttcaaaaaaccggccactcatcttccggttacatgaccggtaccattaacccttctatttgtcagctcgaccgggtcactactttaatcattgctgattggaaaggtatcgccggtgagatcccatcatgcttggcgtcgttgcccaacttgagagtcttggatcttatc

SEQ ID NO: 13294 - DNA, 116 bp, Gossypium hirsutum
  Clone ID: uC-gsflmaxxa119f11b1
gcttccagcgcgagcttcgaaagggaatcgggttaaaatttttgaaccgggactcggtggatgacggtaacgttagggagttcttagactttataattttcatttttaattattta

SEQ ID NO: 13295 - DNA, 100 bp, Gossypium hirsutum
  Clone ID: uC-gsflmaxxa119g05b1
tgcttctctatctttctgggcttatagacaaaacctcatggctcatggtgatgtacactcacttctctattctagcggttttctgaatgtatggtatgat

SEQ ID NO: 13296 - DNA, 76 bp, Gossypium hirsutum
  Clone ID: uC-gsflmaxxa119g07b1
ccgtccgaattcccggtcgactccaccccccccgacttcagaaaacattattggatgtgagattaaaacgggtgat

SEQ ID NO: 13297 - DNA, 341 bp, Gossypium hirsutum
  Clone ID: uC-gsflmaxxa119h01b1
gtccgatttcccgtgtcactcaacgcccccgcgacgcgttcggccacgcgtccgcccacgcgtagcggtccacttcacctctcttcctcctttctgaatttttcagcaattattttcccttagcttctcaaagtaaaagaaaacactatttaaacaaatagtaaggcaagccaaagcaaaccaaatcaatccgacttttctcatcaggtgaacaacttataaaaccagaatttattttattcaaatatggaaggagagaacctagcaagtactgaaatcccagtgaaggaagctcttaaggatactgtacacattgtcgagcccgtaaatgtccgaaagga

SEQ ID NO: 13298 - DNA, 399 bp, Gossypium hirsutum
  Clone ID: uC-gsflmaxxa119h05b1
gactcggagtcttgatttggatacgctctaacaggtgtccgtacagataattcatactaaagatttaaccggaaaccaaagccatggaaatgtccaacgatctcgataggttgctctttttcgagcaagctcgtaaaatttccgaggctacttacgcttccaatcctctcgatgccgataatttgaccagatgggccggagctttactggagttgtatcatctccttatttgtccattttcttatattccgtttcatgtctttatttcttttttctcgcttgttttctatttactttacttcattattttccttttttcttctattcttctttcttctttatttctatatctcttttccttctttctctctttcctacttctctctttcctttatttcc

SEQ ID NO: 13299 - DNA, 231 bp, Gossypium hirsutum
  Clone ID: uC-gsflmaxxa119h07b1
ccctcgcgtccgctctttctatctcgatttctccgtctttcttccctaaatgacgacgttcaggaagcttaatcgacccactggtcatcgtatgtccatgctcagaacaatggtttcttagtcgttaaagcacgagcgcattgaaactactgttgtcaaggtataggagattcgtcaacttgttgtttccatgcttcttctttttttttatcctttctttttttttttttt

SEQ ID NO: 13300 - DNA, 96 bp, Gossypium hirsutum
  Clone ID: uC-gsflmaxxa119h08b1
cgattttatctcaattctagaatctccgccatgagcgacaacttttaacaatagcaacaggttcgatcccgatcgtcctgtccgtgttaacaccta

SEQ ID NO: 13301 - DNA, 472 bp, Gossypium hirsutum
  Clone ID: uC-gsflmaxxa003e10b1
ggaaacccagaaattccctttttttgaattttttgggctcaaaaccaagtggagaggacgagaaaaaaggaagaaagaaagaaaaaaacaatgggttttgcttcatttgttggacgagtttgctttgcttccattttcattctatcagcttggcaaatgttcaatgagttcggggtcgatggcgggcccgcaggaaaggagttggcaccaaagcttaatcttgctaagaaacatttatcttcacaattccatgtaaattttccggatatcgaagttagacaaatagttttaactgctattgctatgaaaggacttggtgctattctctttgtattcggccatggttttggagctttcctcctgatcgtgtatttgctggttagcactcctattcttcatgacttctacaactacggtcccgacgagcccagatacaatattttgcttcgtgatttcttgcaatgtgttgcac

SEQ ID NO: 13302 - DNA, 389 bp, Gossypium hirsutum
  Clone ID: uC-gsflmaxxa004b02b1
cctactttccgcccacgcgtccggaacttttagttacatatagattcatgggtcgcattgtgagaaagacagtgaagtttctttttgtgtttttccagtttcgttgaatatggcgcgttagctatttgtggttagagagttgtctggatcttttagagagttctctggtgtccattagccttgttctgtttttttgtgttggcttcttttcttgtttatcttttcttattctttctctttctattgtttttttcttcactctttctttcctttttatttatttttttttttttcttcttcctttttatctttatttcttcctcttcttctttcctcttcttttacttttcccttattctctttctttatctatctcttttcttcttttc

SEQ ID NO: 13303 - DNA, 490 bp, Gossypium hirsutum
  Clone ID: uC-gsflmaxxa010b12b1
tctttccattcattttctctctccccaaacaccattgtctctcccactttctcctcctccgcaacacttccatttctttcttgtgttggactctaaaaaaggattcattaaagctttgccttccatggtggatatcgcaaagtgcttgccattcaatggaacagctatcaaaacagagtttaagaacctgtgttcgatcgttaaaacgagtacaacactggctctcttcattctttccttcgaagcccacactctattcttagctttgggcccttcttctccttggtttaccacttcctctgactcttatagatcacaattcccttccctttttggttacttatttcccaacacttcatctccttcatcatctaatcacactctgcaaccattacccaacgacaaaaacaaaggcacccaacctttcaacaacagtgaacaacttcccagttcgaataacacgaatatgaactaatcccagagttcattt

SEQ ID NO: 13304 - DNA, 136 bp, Gossypium hirsutum
  Clone ID: uC-gsflmaxxa011d03b1
gaaatatttcctcgctctctcttttatcctcactttctcagccatcaaagacacccttttcttttcttaaggttgtaaaagatggcagatggagaggctattcaccctcttgttagagtaattgtaactggaatgg

SEQ ID NO: 13305 - DNA, 423 bp, Gossypium hirsutum
  unsure (1)..(423): unsure at all n locations
  Clone ID: uC-gsflmaxxa011d11b1
caaacacaaacatattactgctcactatagcctaatagtggaattgttgaaagagaaaacaaaaatggaggtagctttccctgttattgacttgtccaaaatcaatggtgaggagagaggagccaccatggacatgatcaaagatgcttgtgagaattggggtttctttgagctgacgaaccatggaatatctcatgaactgatggacactgtggagaaactgacaaaggagcattacaaaaagtgcatggaggataggttcaaagaaatggtgacaagtaaaggttttgaagttgttcaatctgagatcactgacatggattgngaaagcactttctttttgcgccacttgcctgaatcaaacctttatgaaattcctgatcctgaatatgattacaggaaggtgatgaagccatttgcagt

SEQ ID NO: 13306 - DNA, 102 bp, Gossypium hirsutum
  Clone ID: uC-gsflmaxxa014e09b1
cggacattcccggacccaccgccatcgcgctcactcactcggaacggatacaattggttgatttgctgaaaagtgatattaggcaacctgttcaaaacaaaa

SEQ ID NO: 13307 - DNA, 170 bp, Gossypium hirsutum
  Clone ID: uC-gsflmaxxa014f05b1
atcactcttccgattcctgcaaattcccttcttttccccttcacccaagcctaaaaaattatggccacagtttaaatcagtaaaaaacgaaatgttcgttgttgatgtagctctcttttcttttccattcattatttctccccctctctttccttctttttctttctcct

SEQ ID NO: 13308 - DNA, 337 bp, Gossypium hirsutum
  Clone ID: uC-gsflmaxxa015d05b1
tttgttttctcattttcgagaaaagggagaccccttcacttgttatacccccacacaaacaggaatcataagcattaagttttggttttcattttcttcatcagttttaggaggatcaaagctataaagctagtatttgaatcttttgtttcgttcatacacacatacatatatttaatcggttttacctagtttgttgtcgtcaaatttctattatttgttgtttctatgtttcttattttatcatttttccttttcttttcttcacctttttctgtttaggctttattttctgtcctttttatcttctttatacctctcgcatttatatttattt

SEQ ID NO: 13309 - DNA, 536 bp, Gossypium hirsutum
  Clone ID: uC-gsflmaxxa028f01b1
tgttcgttctcgcgctttccctcaatcaatcatttttcttaccatgaagattatagattttttcctgatctcatcacttctcttctcaatctctagggctgaatctattgcatcagttttcttcatcgacagttctactcatcaattccttcgcgctccatcctctaacgatgtctctcagtcagagccaatgttgttacctgaagttggtgcgactgcatcagtcttgcttggttttccaccacccattacactttcagctgctggctcatctaagctgaatgaggttctcatttctaatccgtttgatagacctcgtgctgtttttatgcttgaagttagtggagttgatgatcctcttgttgttggacccaagaatgctctcttccacaaagccttgaagagtagtgttggtcttggttcaagtaaagtggacattcaacttccagatgaagagcaagtatctgttatttccttggacgagcctctaagagattacactgaagaagagaacaatgactttgcatcttggttgg

SEQ ID NO: 13310 - DNA, 483 bp, Gossypium hirsutum
  Clone ID: uC-gsflmaxxa028f09b1
ttcacgcgtccggccagcagccgaaccaccataatatttggtgatcaacagtacgcaaacagtacccgatcctaccattgaaggtgctcgaccatgcctaaaaggatttggtaagtatatttttcctccttttcttctttattaaaaaaaaaacttcaaatctcatgttgtttttttaaaaaaaccgtagaaaaattcataaaataaagaagatttcatcactattcgacttctcgcccttacctccgcatttctgaggtatttaggctctcattggtgtcgattcacatgctaaaaatccaagccaatagaaagaaaataaatcagaatagaggaaataaaacttgaaatcacctttgctaaaagaattgctttttctttcttctctatgcgtgcgtttacgttcgtaagtcctttttgcaaatacaatcatcggcttttatagccggatttacagagtaaaataaaaaataaaaatacaca

SEQ ID NO: 13311 - DNA, 408 bp, Gossypium hirsutum
  Clone ID: uC-gsflmaxxa029h10b1
cattaattttcgagtcaaccaacgaattgcaacaatggggggtcatctaaacccacccagctgttgccacatggagggtagttcgggtttgggtcgagctgactgccgagccaaaggtgggttaactggtttcaaggtggcgattttgggagcggcaggtgggatagggcaaccgttatcattgttgatgaagatgaatcctttggtttctgttcttcatctttatgatgtggttaacacttcatggtgttacttgctgatattagcccacatggattacctggagctgtgggtacgtggaattttttgtgggcaacatcctatttgtgaggagtgcttttaaaccaagaatgggaccctttgaaaattaatttccagcgtgggagttaacctaataaaaccttggaa

SEQ ID NO: 13312 - DNA, 504 bp, Gossypium hirsutum
  Clone ID: uC-gsflmaxxa038a07b1
gttagatgaaacatcatttaccatccattttcctgctcaaggagaaacatctgtggtcaaagcatggcttcttcgtccttctctgatgtggaaggatggtaattgggttgaatggtccagttgtggggataatgatggctcttcccacgagggtgataccccactggaaaagcgaccaaggatatgcagtcctgtgatagagaacaaagaggatagtactaaatgttttgacagtaaggaatctgagaaacctgacaacacaagattgctggatttaactgctggtgaaaaaatatttaatatcggtaaaagcaccagagacgagagtaagcctggttcactcagaatgaaacgttctggtttaaagaaagaaggatcaagggttatttttggtgttcctaagccaggaaagaaaagaaagtttatggaagtaagcaaacattatgttgcggatcggagcagtagaactcttgaacaagtgattcagctaatttacaagcattc

SEQ ID NO: 13313 - DNA, 257 bp, Gossypium hirsutum
  Clone ID: uC-gsflmaxxa038c04b1
ccttctcgtccgcaaaagttggttcacgtaggaatgggcgcagtagtgcacggaaaagtgcacgtagaataccaaaaggagttattcatgttcaagcaagtttcaacaataccattgttactgttacagatgtacggggtcgggtaatctcttggtcctccgccggcacttgtggattcaagggtacaagaagggtgacccctttcgcttctcaaaccgtatcggtaaatgctattttagcagttttttaccatggt

SEQ ID NO: 13314 - DNA, 470 bp, Gossypium hirsutum
  Clone ID: uC-gsflmaxxa041g02b1
cctcactcgtccgggttggttgggaagaggaaggttggctaggatgagccttatgggaattcccatggatagaagtttactagtatgtctaatctctgtgtatgtgtgtttcataacacgcgaatgcatgaacaaagttgcatcttttctcatgtccatcatatatcaatgtacctgtactcttacgtacaatggaatccgatgtacttgtcctcatatcttttctgttctgtgtttatttaaattctatgaaatattgcagctcctaaatgatactgcaccttcaccaattgaaattgcaaaagcatacatggcaaaccggacatcagaatcaaacctaagttctaagagtattatatcaaaagatgaaagaccaacaatgcttgctaatgattttgcatcaaaaccatttgttccatttgcttcaccgaaggcattcacatgttggccaggttccatggtacatgatc

SEQ ID NO: 13315 - DNA, 415 bp, Gossypium hirsutum
  Clone ID: uC-gsflmaxxa043b05b1
ttctactctcttttgatcatctctgcataaaagcattaagcattgttttctctgtttgccatttgccttaatcatcttcctctttctttaaaacttcttcctatttaatttctgactaaacttgcgctgaattccatggctactgcagaggttgtaacagctcaaactgcaatccatgaggagaaacctgaagaagtggtcaaggttgaagaaattgcaacagaagaggtagtggctgttgctcctgcaacagaacctgttgctgaagaaccaaaggaagcagtgcctgaagcagcatccgaagaaccccaggctccagaaactgaagccacagttgaaactgaatcaaaggaggtggttgaagagcccaagctgtgactgaggagccagaagttgagaaaaaagaagaagagac

SEQ ID NO: 13316 - DNA, 410 bp, Gossypium hirsutum
  Clone ID: uC-gsflmaxxa043f01b1
ttctttcgctatctgccttttccctttctctctatctgattcctatcgacaatggccgccgccgccacttcttcaccccgcgaggaaaatgtctacatggcgaaactcgccgagcaagccgaacgctacgaggaaatggttgagttcatggagaaagtctctgcctccgccgacaacgaggagctcaccgtcgaggaaaggaacctcctctccgtcgcttacaagaatgttatcggcgctcgccgtgcttcctggcgcatcatttcctccattgagcagaaagaggagagccgtggtaacgatgaccacgtcgctacgatccgtgattaccgggccaagatcgagtccgagcttacttcgatctgtaacgggatcttgaagctccttgacactaagcttgtcccctcggc

SEQ ID NO: 13317 - DNA, 295 bp, Gossypium hirsutum
  Clone ID: uC-gsflmaxxa045d07b1
ctgcccctgctgctgccgccgcggcataattgccgggacgaccccctcggtctttcacgcgtgcgaccacccgtacggtggagtgggtctatctgaacccaattctgatggtgcaatgcgacatgaaaggcgagcacatgaaagcgctaatgagcagtggaccttctatggggaatgtcctttttacaatggatgttcactgacatttgagggctcatgcggttgtaaatatcttgatatatcatgcgtcctaaaactataactaaattatctaagctctatttttggtgaatgt

SEQ ID NO: 13318 - DNA, 403 bp, Gossypium hirsutum
  Clone ID: uC-gsflmaxxa045e03b1
ttcttttgctttagttctttctacacacactctctgcctgcctccccttatccactctttcccaaaaacccagaaaccaaaacaaagcctttatcttctttattgttttacttatcctttttgttcatcaaactacaataaaaagaaatggcctctgcaaatgctctttcttcagcttctattctttgctctcccaacaaggggagtttaaggaggaagggaaatcagagacagaaccaaagggtaaattataggcaaggaaacaacccgtttggtgtgaaggcttgtgctaaaaaaattgcttttgaccagagttcaagagctgcaatgcaagctggcattgataagttagctgatgctgttggccttacacttggctctaagggaggaatggtgtgttgga

SEQ ID NO: 13319 - DNA, 441 bp, Gossypium hirsutum
  Clone ID: uC-gsflmaxxa045e11b1
ttcttagaaccctcactattcttttcttttgtttgtttatatggcatctcaagccagcctcctccttcaaaaacagctcaaagatctttgtaagaatccggttgatgggttctcggccggattggttgatgaaaacaatatctttgaatggagtgttacaattatcggaccacctgatactctttatgaagggggatttttcaatgccatcatgagctttccgcccaattatccaaacagccctccaaccgtgaaatttacaataaagaattgggcttctaatggttattctgggggcgtggttggataataattcttcattcttcaagggatgatcccaatggttaccaacttgcaagggaacgcttgatgccagtccatacacgtgaaagtattggtttgagtatcatatcaatgctttcaagccctaatgatgaatct

SEQ ID NO: 13320 - DNA, 519 bp, Gossypium hirsutum
  unsure (1)..(519): unsure at all n locations
  Clone ID: uC-gsflmaxxa046c05b1
cccacgcgtccgataaaataaaaaaatgtgcctttttgcgtcgtatatgaagaaagaccgagtctgaaactccaatgaaagatcaaaaactcaactttacagtttgatttcaatttccaaaggatatagattttttgttttgaaggtttggtgaaaatggacaagaatttgactttttcgttttcttttatcgcttctgagttatgttatcaaatacattgtcaagtctctttattctttcacagttaaaagcctttctttaatctggctaaacaggtgcggcaggtgcggcctgatgtgcttcttgggttgtctggtgttggaggattgttctccaagaggtgttggaggctcttaaaggttcgacttcagctaaaccagctatctttgcaatgtcaaaccctacaaaaaatgctgagtgcaccccagaggaagctttttcgattgtaggcgacaacattatatttgcangtggaagtccatttagagatgctgatcttggaaatggtcaaattgggc

SEQ ID NO: 13321 - DNA, 518 bp, Gossypium hirsutum
  Clone ID: uC-gsflmaxxa048g07b1
tatttctttttttttttttgaaaaacctcgagcaagaatcacagataaagaagatggaaggcatggagatgaaggaggtaaagttcgagaataaggatctgaagcacctaggcttcgtgagggtggttgctatccacgccttggtttgcgtgtcgaacctctacgagttcgctaaacagaactccggtccgttgagatccaccgtcgaaggccccgttacgaccgtcgttggtcccgtctacgagaaattcaaggatgttgctgatcatcttcttcgatttcttgataagaaggtagatgaggctttacacaaaattgataatcaccttccggccaaagctaagcaagcaattaaccaagcccaatacttggttcacaagacagcacaacatgcttggaaactagtcgacgaggcacgaaccaacggaccacgaggagcgttgcactacgccacagccgagtacaagcacctcatggtcataaactcaactaagttatgggtcaagctgaatcacaac

SEQ ID NO: 13322 - DNA, 79 bp, Gossypium hirsutum
  Clone ID: uC-gsflmaxxa052e07b1
tcggtttcctttacttttgggttcccatggcgtcggctttgactgttctcagtctcctctacctttccatttataatta

SEQ ID NO: 13323 - DNA, 428 bp, Gossypium hirsutum
  Clone ID: uC-gsflmaxxa052f11b1
ttcacgcgtccggagcgtgcactttcacttttagcagtcaagtcaaacaagcccggacaacatgatgagcgcgtgcatgctgctgccagtcgcatacaaaataagtttcgtggttgtaagtgcagatattagatttttttaattctttttcgctattgttatattcatttcttatttttaggttatcctttttgtaatactattattattttttcattcttttttctttttcctcttttttttttatatatttttatatttcttttatcatcatacctttttctattttttttattttattatcactcttttttttatttttattttttattctcttttcctttttaatattttatctaatttcttctctttttctttttatctttaatatttcattcttttttttttctctttttattttactcttt

SEQ ID NO: 13324 - DNA, 338 bp, Gossypium hirsutum
  Clone ID: uC-gsflmaxxa055c09b1
ctggagtgcttgccggatatgacaagttgcagctcattgtgttcggaaagaagtacggatccggcggtgcttaatatctctttttcattatttactagtttatgattagatggtgatgaaaagctcgactacccagaaatttattttggccaataacttcaataaataattctaatttagtgagagagatgagagagggggttttaaaccctaaactatgtatattctcagatggaaatgttgattaagaaatactggcggctaatgcccccagcccctgtcggatttatatttgttttgatatttggaggttttagtcttgtttttataaaagatac

SEQ ID NO: 13325 - DNA, 123 bp, Gossypium hirsutum
  Clone ID: uC-gsflmaxxa058g01b1
agtttttctctctctaaataataggctcaacatcgggatgggttcaaatcacatcggataaagatataaaaacacgttgcggagaacacctataacaaacgatgattcacaattactctgaca

SEQ ID NO: 13326 - DNA, 304 bp, Gossypium hirsutum
  Clone ID: uC-gsflmaxxa061b07b1
tattcgaacagcactatgatcgattgttggaatcatattactccttggaaaaaaaatacataaaggccatacctgatagctggagttgcattagccaaatggaggaacttaaatagactgcatgacaggaatgaaacactatactacagagtgcttattgacaacatcaaagattgcgtacactataatggatactccaactgtggagctcgtactgaaaaactactctggattgtttagacgcccacatgacttacatgcaagtgcgactgataacgtagagatgatactctatgatatatga

SEQ ID NO: 13327 - DNA, 480 bp, Gossypium hirsutum
  Clone ID: uC-gsflmaxxa069f01b1
cccacttttccgttcagctattacgtggagagcctggggtttgtgtagcgattctcaggtagtcttttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggccattcaagtatgcttgggtgcttgacaagcttaaggctgagcgtgaacgtggtatcaccattgatatttgccctgtggaagttttgagaccaccaaatactattgcaccgttattgatgcacctggacaccgtgactttatcaagaacatgattaccggttccttacaggctgactgtgcctgtctattattgactcaaccactggtggtcttgaagctgg

SEQ ID NO: 13328 - DNA, 131 bp, Gossypium hirsutum
  Clone ID: uC-gsflmaxxa069g05b1
acggtgttattataataataaacaataataaataataggggctttatttgcccctacctctaacctttattcgggagctcctcagctaagctaatggcaatggctaccgttgaggagattaagaaggccct

SEQ ID NO: 13329 - DNA, 451 bp, Gossypium hirsutum
  Clone ID: uC-gsflmaxxa070d05b1
gggactctcaagttctcggtgaagccccacacaagtttgggagtgttattgaagctgtaaagaaactgagagaaaatgccaatgaccagtacttgcctccctttgtcatcgttgatgataacaacaaggctgtgggtccgatagtagatggtgatgctgttgttaccattaacttccgagcagatcgaatggttatgcttgctaaggcacttgaatatcaagatttcaacaaatttgatcgtatacgggtccctaaaatccgttatgctggaatgcttcagtatgatggcgagttgaagcttccaagctgctaccttgtttctcctccagagattgatagaacatcgggtgaatattgggggcataatggcgtccgtacttttgcctgcagggagactgcaaaatttggccatgtcacttttttctggaacgggaaccgctccgggtattt

SEQ ID NO: 13330 - DNA, 499 bp, Gossypium hirsutum
  Clone ID: uC-gsflmaxxa076g11b1
tttctctctaaaagcacgattagacctactctcacactaaaatttcaacatttatgaaatttcgctctcaaaaatttttttgttcctattttttcacacggaaatatctgctaatttaagatcgtggagatcaattgagcacgatttggaaataatcatttttggaatttgcatcggtgatcaattgagcacgatttggaaataatcatcggagatcaatcgaggacgatttcaacataatcatttttagaatttcaattcatggcccttcgttacaaggtgtgattactcaaacactaggcttacatcagtgggaaaaaaatagtatatagttgaggggcagcttagaatacaaggaaaagaataagggtgaaaaaaaaaagtatgggaaaagagtctccggccgattgggaatcgaaaacagcaagaaagaaaagcgataaggagctcgagcgtaagtatctgaaaccaggtgctcttggtcacttcgatcaataag

SEQ ID NO: 13331 - DNA, 368 bp, Gossypium hirsutum
  Clone ID: uC-gsflmaxxa090g11b1
acgccgcctgtatatataccgaaaaagaaaaggggcttgaaggaagtgtttataaaagaacatgggcgtaaaaaaaaacaggaaccctaagaaccctaaccctaacactaaagatggacgaagatggcgaaatttgcagaaggggagatcgcaggtgaagacgatgatacgaccagcgcacacggtaacgaaaggtatcgacgaacagtctcacccgtgggagtatacataggcctgcaggtttgatgaccctcttgctaaatcaaaccaaggtatcccgggaccgactaggcgccctatttacacttggtgcaccagcggacaatactggaatctttacaataaccaacatcgaccaagcaaatggt

SEQ ID NO: 13332 - DNA, 507 bp, Gossypium hirsutum
  Clone ID: uC-gsflmaxxa091e01b1
cccactcgtccggagacaatgagaggaacattgacggtgacttggattctgatggtctgcctctcccaagtagcggtgcagagccaatactactcggagagcttaccatatgatcccaggccggttaaggtcactaatctttacttctttttgcatgaaactctccgcggtaagaacccaacagtagtcatggtagcccaagctaacaacacaagcaacgacaactactcatcagtgccatttggcaccctatatgccattgatgatcccctcaagataggtcctggggacaactcagaggtgattgggaatgctctgggacttgggatcttgtccggcaaaaattcaacgaccgtggtgatgtacttagattttggatttactgccggaaagtttaagggcagctctattagcatattttcaaggaatcccttaataaagatggaacgtgagctttcggtggtgggaggaagaggagaattcaagatggcagaagggatgcacgac

SEQ ID NO: 13333 - DNA, 511 bp, Gossypium hirsutum
  Clone ID: uC-gsflmaxxa091g05b1
agccttctcaagtaccggacatcaatcaatgtcttctgtggtggagttgacagcatctcaagaaagccatgatgagggtaaaaatgaacggttagataattttcttaacatggatccaacgctttctaatagtttgtcactctctgctgatactttccttaaagctgccatgactctcaagaaccaggtagtggaggttacatggaaaggaaggggaagtggcggcggcggcggcggcgggttaggtacgggaatagacccgactgtttatacgggtctgctggggacagctttcacttgcttgagatcttacgaggctactggtaatcggcaggacttggtattgtccgctgagatcgttgacacgtgcctctcagtcgcacgtgcctcccctagacatgtgacatttttatgtggtagaggaggggtgtattcgcttggagcagtggtggctaattacatgggggatcatcaaagacttgaattctttctgaatctcttcatcgaggta

SEQ ID NO: 13334 - DNA, 100 bp, Gossypium hirsutum
  Clone ID: uC-gsflmaxxa094a04b1
caaataaaacagccactccccgcaggaaccacacccacaataacccccacgacccaccccgccccctacaaaaccgcatcaaccaaaacaacacccgggg

SEQ ID NO: 13335 - DNA, 158 bp, Gossypium hirsutum
  Clone ID: uC-gsflmaxxa095b01b1
tgagagttttctaagcaaggagaagtggtctgcctaagcggtgcctgaagcagcattggggcttggatagccaaactcctccttgctcgcggctacaccgtccacggtaccgtcagaaatctcaaggacctgattgaatctcaacatctcagaatctc

SEQ ID NO: 13336 - DNA, 118 bp, Gossypium hirsutum
  Clone ID: uC-gsflmaxxa095c05b1
cccacgctaccgagactctctttcctaccttaaaaccatggactcttttagactctctgtggggtactccaccccgcattctcctcgactccatccttaacgacctcaatctctagga

SEQ ID NO: 13337 - DNA, 538 bp, Gossypium hirsutum
  Clone ID: uC-gsflmaxxa096f11b1
ggttgcattatcctcttctcatcaaactttcataggcaatgctttctcatttaatcgaaaacccaaagcaaagcttcccaattctcctactttcattacttgcaggttccactcagacgaccacgacaattcctcctggagaaatgagaaacagttagctcagctagcaatcgtgacattggcagccggggcagtgactctgggttcggtgggtgacgcatcagccgccaaatctggtggcagagctggcggacaagctctccggtcagcggctcctcgctcagcaccaagagccaacaacaattccaggaccaacatttacattaatccgcgggtcgccccacctctagtcggaggctacggatacggatacggcgtgccgttctatggtggttggggctggtcaccattctcattctttgctcccggccctagcgttgcggtcggcaccggaggcggattcgaacactcctcttattatgtttttgggtgcattcgcagctgttgtaaggagattctttgatcaagaatgagatga

SEQ ID NO: 13338 - DNA, 522 bp, Gossypium hirsutum
  Clone ID: uC-gsflmaxxa098d09b1
ttttgttacaaaaagccgtcgagaacgcttgggggctcctccgagaattcaaggcgagcgtcgtcgagtacacgagttacgccgacaccaaaaccatccccggccactacgttatatactgggaattgttggtgaaagacgccgcgaactcccccaccgacgacgttttgaaacagtgctgtttagcaatggaagaatcgatgaactcggtgtaccgacaaggccgagttgctgacaactcaatcggcccactcgaaatccgggtggtgagaaacggcacgtttgaagaactcatggattacgccatatcaagaggagcttccattaatcaatacaaggttccaaggtgtgttaacttcacacccatcatggagttactagactctagagtggtatctacacattttagcccagctttaccacattggacccctgaaaggcgaagatgatgatgatgatgattcagtgactcagttattcatttaggcacccaccaccgaccaggaattagtttataaatct

SEQ ID NO: 13339 - DNA, 197 bp, Gossypium hirsutum
  Clone ID: uC-gsflmaxxa107b05b1
tgcgtttactacaacagtaaatatcaagcaaagatagtggaggaagtaccatacttgaactacttctcgctgtttggattctttccgatgcatatgaacgccatttatgaggtgataagaagcttcacaatgaaggctaaatatggagcagattatacagatgggtggctgatgtttggtgtgagattatttggatt

SEQ ID NO: 13340 - DNA, 478 bp, Gossypium hirsutum
  Clone ID: uC-gsflmaxxa119e11b1
attgtgggagcctccacttctacctatgaaaaatgtgatattaagcgggtgtccaataggaagagaagatccacagagctcccaagtgatgttaggagcctgagaatttttaggtgccacaatatcagatgcttgagtgatttgcccttctttcacaaaccattgagtttgtttttttgttacttctcttctttttattttctctattttttcttcctttttttttttttctcttttttttttttcttttttttatatttttctctttttcttttttttttttctttttcttttttttcctttttctttatactcctttttttttttctttttatctttctttatatctttcacttacatatatttttatctctttctttcatttaatctctctttttcttcttcttctctcttttttaattttcttttctttcttctcttcctcctctcttttcatctctttattttttcctttttt

SEQ ID NO: 13341 - DNA, 211 bp, Gossypium hirsutum
  Clone ID: uC-gsflmaxxa119g06b1
aataatataactctccaagccaaaccatttctccgctggcatttgcttacaacaaaaaaaattcaaattgaagaatgcctgtatttgcttcaagagttgggttcaggagacacgactacaagaatagatcaaaggaacgaaacgatgaccgtaaagacaaattgtccgaagtgttcaagagctatgctgctaaagggctgtttgacacgga

SEQ ID NO: 13342 - DNA, 979 bp, Gossypium hirsutum
  Clone ID: uc-gsflnu33B137e01_FLI
gttaagttcatggaaaccgtcgtttcctccgtcgttgctcccgacgaactcaccgtcgaggaacggaatctcctctccgttgcctacaagaacgtgatcggcgcccgccgtgcttcctggaggattgtttcttccatcgagcagaaagaggaaggacgtggcaacgccgatcacgtctccatcattcgtgagtacagggccaagatcgaggctgagttgtctgagatttgtgccggaattttgaagcttctcgaagagaagctcgttccggctgccgggaacggggattccaaggtcttttatctgaagatgaagggagattaccataggtacttggctgagttcaagactggagatgaccggaaagccgctgctgagaatacgctctctgcgtataaatctgctcaggacattgcagtttccgagctcgctccaactcatcctattcgtttgggattggctctgaacttttctgtcttctactatgagatcttgaattctccggaccgcgcttgcagtcttgcaaaacaggcttttgacgaagccatctcggagcttgatactctcggagaggattcatacaaagacagcactctgataatgcaacttcttcgtgataaccttactttgtggacctcggatatgcaggaggatggaacggaggaaatcaaagaagcctccaaacctgaggatgagaaacaacagtaaaatccgtaatcttcgagttagtattttacttctctggttgtttttgtatggagaagttgattggtcccactatcccttcagtttgccttatatttttaaaaaaaaaaaacttgaaaatactgctaaaagtttcttggtatttcactatatatatatttagttgaagctttctaattatagtgggggcattgtgcactattttcctaattgtttacttcacaataatggaactgatgatttgagatatttttctaagcttaatgattttgat

SEQ ID NO: 13343 - DNA, 220 bp, Gossypium hirsutum
  Clone ID: uC-gsflnu33B002a04b1
tttctgttatgtatcatacagctagtactcatgtaatgttatagatttttatataaaaaatacgcttttataatattttgattaagatacttagaaagtttattattcacttaagtttatgtaaaaacagttttattgaacaagttcatgatgactattttgtttataatttaattaaaatatatcgatactgcattattgtcttgaatttcatgctgtt

SEQ ID NO: 13344 - DNA, 276 bp, Gossypium hirsutum
  Clone ID: uC-gsflnu33B002a06b1
tttgacagcgtggggccgtcgttacgaaaatcctttcgtcttgctttccatccttcattattctcgccgccccttactcagaagaccctcactttttcgattgggactagagccgtttcggggtccgggaagttttattggagagccaaggcgtcgatggccgggaccgccatggagaaagggaaagggaaagggaaagtcgaagttcttgattccgaggagaatctttcggttacgctcgttatatacaccccctgattctagtcgtttcagtcc

SEQ ID NO: 13345 - DNA, 340 bp, Gossypium hirsutum
  Clone ID: uC-gsflnu33B002a08b1
tccacgcgtccggttttttccacttatagaagttaaagcttcttcagatctatgaagaaaattcccactgattttcttcctttattttctttgctccgttaaactgtagtgtaaattctatttctttgggtttttgaagatgatccttgaaaagaatccatttttctctttcattttcactccaaaaatattctctgtttttctcgagagaatttgagtttcttttcactcttcttttacttgggttcttgagagagattttgaaccattttaaagaaaaaaaactttcctttttttttttgaatcccctcacccccacttatggttccttgttcaaact

SEQ ID NO: 13346 - DNA, 333 bp, Gossypium hirsutum
  Clone ID: uC-gsflnu33B002a11b1
gaaagctgaaatggtgacgatagtagtagctacaactagcgatccggcctcaatcaatccagcctacgccctcttggccatgcccggttggctccccgtgcctgctccctctttattgcaacagggaatcaaaagttttgctaataaaaatgtgcgatttcttcaacacgacaaaggcattgtcgaagaggacgatttggatcgccgttgggaggaagctaccggcgaggctgtcgatgaggttattttctttagcaaacacaccgctgtttccaaccgccctgctctcaccgttcatccatttggggtgcctcatttgcgcgaaggagatgt

SEQ ID NO: 13347 - DNA, 301 bp, Gossypium hirsutum
  Clone ID: uC-gsflnu33B002a12b1
tcacatattcagtgttcatcccagaggatgttattcgtaaacggaatgttagtatagaggagaggcttagtcaaatttctcctgagcaagtgaagatcatgagagaggcagtcataaatctcattccaaggctaatatatgctgatcctcgctctaaattggagactcttcgagatgctttcgatgttgctgtacatgcggtgatcaataaagtcactaagttgaggaggaacattatccaaggtcgttccgaatatgataacttcgtggaggagaacatttggaaagcccgccttatttc

SEQ ID NO: 13348 - DNA, 372 bp, Gossypium hirsutum
  Clone ID: uC-gsflnu33B002b04b1
tcacgcgtccgcaaaaagaacatgggttctgaaaagcatgggtttatatggctatcagggcttttgttcctgaatatctttgtcttatccacagccgatgtccactactacgagttttctttgcaagaatccctgtttacaaagctgcgtagcacgaagatcatcttgaccctcaatggcagctttccagggcctgagattcgggttcgcagaggggacacagcttttgtcaatgtccacaatcaagcaaactatgctgtttccctcgactgggagggcgttacggatacaattgatggttcgaataatacaattcagccagggagaaacttcacttacaatatagagttaggggatgaaataggaactcta

SEQ ID NO: 13349 - DNA, 248 bp, Gossypium hirsutum
  Clone ID: uC-gsflnu33B002b07b1
tcacgcgtccggtcggaggacatattgtcttcagggattcttgttttgatcgatccggccactgcaagcaaaagcatgacccttcgctatactgtgagccaagatgttacacacagggtttcaaagaatgtcatgcatctgatgattcaagacactcgtttaaactttatatagttggctacaagtgcatgagtgcctatgttaatcacaaaaagattcagaatcacatttgttggatctgggaaaaa

SEQ ID NO: 13350 - DNA, 242 bp, Gossypium hirsutum
  Clone ID: uC-gsflnu33B002b09b1
agccagccaaggagaacaacaagagtggggaattttaatcagggaaacccacataccccgtcacaaagagcacgccggagaccggaagatactattggtgtgttcgagagcacacagtcaacagacactgactagggcgccaagactccaaaggatgtcaagaccacttggcgtactggaatgcatcagctctgcttcataaacaaggactagtatgaatctgcttaattctcggctgaaat

SEQ ID NO: 13351 - DNA, 233 bp, Gossypium hirsutum
  Clone ID: uC-gsflnu33B002b10b1
tgtaggaaacgaggtccgataatgtggagaatcgtttcattttggcttgcttcctttgtcatcccatgctctctaacggtgatctcagctgaagagagcggcgaatcgaaggagtttgtcttgactttggatcaatctaatttcactgacaccgttagtaagcaagacttcatcgtcgccgaattttaccctccttggtgcggacaactgattgattcttgctccagagtatg

SEQ ID NO: 13352 - DNA, 117 bp, Gossypium hirsutum
  Clone ID: uC-gsflnu33B002c04b1
tgaaacccacaaaccggaacacgagctagggtgtcattcctatcaaggccccgaatgcacccaactagaagtaaacaggacctaggctcagatagttaaaataaaaaccactatggg

SEQ ID NO: 13353 - DNA, 375 bp, Gossypium hirsutum
  Clone ID: uC-gsflnu33B002c05b1
tcaaaacacatcactgcccttgcactcggctcataccaatcaatcaaaatccccaaaaaaatattaaaaaaaatgagctctcagattttcagatctgcttctagagccgccaggtctctcctttcagcatccaaggcttctcgcttttactctgaagggcgagctgtagctgccgctgcagcagtttcacttggcggtaaagtgcctcttttggcttcagcttatggaagtactgcttctgccaatgcatctagagcatggctttcaggagtttttgctcttccagtggcagcttacatgcttcaggagcaggaggttcatgctgcagagatggagcgcacctttattgctatcaagccagatggagtgcaaaga

SEQ ID NO: 13354 - DNA, 324 bp, Gossypium hirsutum
  Clone ID: uC-gsflnu33B002c11b1
tccacgcgtccgcactcaccaaagctaatctattctttctttctttctttctttctttttctcttcatttattttaatttcttgtttacatcaccaaagctaaatctattctttctctgtaaactgccaaagctaatttattttctttatagaaaaaaaaaatggtggccatatctaagattgcaactggtaatggtcatggtgaagactcaccttatttcgatggatggaaggcatatgagaccaacccttttcatcccattgatagacctgatggtgtcattcagaatgggtcctagctgagaatcagctttgctttaactt

SEQ ID NO: 13355 - DNA, 132 bp, Gossypium hirsutum
  Clone ID: uC-gsflnu33B002d01b1
ttgacgcgtgggttcattactcaattatgggtgtagatttctaataaagtgctatacatacatcatatatatatatgcatctatgaatgtatatatgcatgcgtgtatgtatgtatgattagcacgttctat

SEQ ID NO: 13356 - DNA, 155 bp, Gossypium hirsutum
  Clone ID: uC-gsflnu33B002d02b1
tgtaactatcgccataacttcttccttcactattgtgagcattcttaaggactctgccctagcacgctaatccccgtcctttttacttaatgcccttcgattgccaatgtattgagccaggttcacttgctgatattaggatgtgctcaaaacaa

SEQ ID NO: 13357 - DNA, 119 bp, Gossypium hirsutum
  Clone ID: uC-gsflnu33B002d12b1
taaaaaaagagagatggcgtctgtaataaaatctgcaattttaattctgtccgtgtttatacctgtacgcttcagttcgtgctgtctaggttgctccagtttcactccaatgaatgacc

SEQ ID NO: 13358 - DNA, 334 bp, Gossypium hirsutum
  Clone ID: uC-gsflnu33B002e04b1
tgtacgccgtcggacgctacaaaatgcatcggggagtgttagaataagcggatatgcggacagtcccacaagaggaaaaccttctagactgatgctgaatgcatggtcggacaagagacagccttggaaactgaaacatctatagaatgccgagaaaaagaaggcaaaagcgaacagccgtaatacaatatgagcgaaatggcagcactctaagaccgagaaaacggggatgtgagataaaggggaagaaacataggcacatgatatagaagcacccatggcaagggtaagatgcatcgtgggaaagggcagaataaagggcagacacccaagg

SEQ ID NO: 13359 - DNA, 255 bp, Gossypium hirsutum
  Clone ID: uC-gsflnu33B002e05b1
ttcagatctgaatattgaaactgcctttctcgggtatctcttaagccaaaaacgaagcagaccttcgacaagactcataacccggcaagacgatcactcgcgaggacgagagcctccgacacgatcgacaacgcgaagaccaatatccaagataaggaaggcataccttcagaccagccgcgtatgaccttccccggaaaacagtttgaggaccgccggacctcgggccgaatacaaacattcaaaaggaggcaa

SEQ ID NO: 13360 - DNA, 144 bp, Gossypium hirsutum
  Clone ID: uC-gsflnu33B002e07b1
tggacgcgagggacggacgcgagggtttcgcggggaatttttagatctttacttcctcagccttcattactgggagaaaccgatctatttcttctcgaacaaatcagtgaaaatctttcctaacaggccattcaggcctagttg

SEQ ID NO: 13361 - DNA, 453 bp, Gossypium hirsutum
  Clone ID: uC-gsflnu33B002e11b1
tggacgcgtgggctggaggaagcctgcaactggccattttaaatgcacagattaagtggccagctggacctaaactacagtatcctgaagctcttcaccaattcgtgacttggatgcttcagcctcagcctagtgttcgcccttgcatagatgatatcatatttcacgtcgacaagttaatctcgaagtttttacagtgaaatatcataagagggattagggtgagaaggaaagggcattcaatcagtaatggacgagttgatcatctacattttagcaacttcttataaacgtgagtttcttcacaagtcttcgaaatacttctgaagtgacagcagtagcaatttctttatgaaaaagttccatagtaatccctttttgttccgatttgggttaaatgttgatattctttgcctcctattttcttcttttctaaagtctttcatatattta

SEQ ID NO: 13362 - DNA, 157 bp, Gossypium hirsutum
  Clone ID: uC-gsflnu33B002e12b1
tgacttgccttgacttccactttcagacatcttctccctctcttcgcttctgatttcactcccagatggattggcaagggcaaaagctagcagagcagataatgcaggtgatgctattggtatttgcagcggcctcatttggtgctggatatgcgtt

SEQ ID NO: 13363 - DNA, 463 bp, Gossypium hirsutum
  Clone ID: uC-gsflnu33B002f04b1
tcgatacaagaacatggtcgagggaaagtgctggagactgtggttgagattcaagacaggcatgatgcagcgaaagagatcgagaaaagtttgctggaactgcactcaggtgtttttggatatggcggtgatggtggaggcacaaggtgaacaaatggatgattttgagcatcatgtgatgaatgcaagccattatgtgaaagatggttccaaagagctcaacactgcgaaacagtatcaaaggagcaccaggaagtgtatgtgtattgggattattcttttgttgcttcattgttctagagattgacattcccattggtactagctttttcaggttttgattgggatgttctttacagaggatttaaatgtctatttttcctttctgcttttttttacttgaaacagtttgatctggagtatgcatatagtccttttgttgggactcacattccttttaaat

SEQ ID NO: 13364 - DNA, 206 bp, Gossypium hirsutum
  Clone ID: uC-gsflnu33B002f07b1
tgcattcatctcataatggagggaaattttagggatatcttatcatctataaacctgtttcactcattggctatccaatgatgattgattggctaaactagctaccaaaaaagctgcatcagtacaaattgggccataagggataccatttggctaaggaagtgaaattgagagacagaaagaacgaatgcactaaggatcatgcc

SEQ ID NO: 13365 - DNA, 358 bp, Gossypium hirsutum
  Clone ID: uC-gsflnu33B002f08b1
tccacgcgtccgagaagggaaatggagggcatagaagatgatgttagattgggagccaacatgttcacagagaggcaaccaattgggaccgcggctcagagtcaagatgacgggaaagactacactgaaccaccaccggctccatttttcgagcctggcgagttaacctcatggtctttttatagggctgggattgccgagtttgtggcgactttccttttcttgtatatcactattttgactgttatgggagttgttaaggaaaaaactaagtgcccaactgttgggattcaaggaattgcttgggcttttggtgggatgatctttgctcttgtttactgcactgcttggcattttc

SEQ ID NO: 13366 - DNA, 323 bp, Gossypium hirsutum
  Clone ID: uC-gsflnu33B002g02b1
tggtgataaaaaaacgacaaaatgggaagagggaaatttaagggcaaaccaaccgggcaccgccatttctctactcccgaagagctccgtgctacgtagagaaaagaaaagggagaaatttatacttttaaattttaagttttagcttcgtataaacttgggaatgattccgcctttaatgcatgaataacttgggaactttgagtcaaattcttagacaaaaataagaaactatatatttttcttttataacttttattaatttcacctgatttgcttttttgtcttccttaaatgttctaatgggatgcagttgctggtag

SEQ ID NO: 13367 - DNA, 465 bp, Gossypium hirsutum
  Clone ID: uC-gsflnu33B002g03b1
tccacgcgtccgccaaaccctaaataaacccgacccatatactgcagcctttaccacctctctataatttctatttctctctttcgtttctccatacccccctcttaaaaaaccaaagccaaagccaaagcaaaatccaactcgaaacgctatcttctttttgctctgtaaaaagatatctatggctgctgaagctaggcatcttaatcttttcccccctgagtttacaggaaacagggagacgatgaatccaattcaaggaaacgggaatatgtatcaaaccgagattggatatggggttcccgttttcgggaaccacgacggtggcggaagggttgcttccgttgtataagtataactttacggcttcggcggcgatgaaatcggagagtagctctgacgtacaacaaccatgttcttcctttaccgaggaagcgttcgagggattcaattaatcctgtcctt

SEQ ID NO: 13368 - DNA, 367 bp, Gossypium hirsutum
  Clone ID: uC-gsflnu33B002g06b1
ttcaaacgtcatgttctaggatcatattatgaaggcgtgtagatttgattttaataatgcattcaacatgcttgatgaaatacctctgtgaattattagctttcaatgaatttactctgcatatgatgatcgtccatgaactaaaatctattggctggagtgtgtctaaaatgcacaaaccccatttttcctattggttgtttttttcatctcatgcgttagtagattgctgcaggagtcacattggggcttgatgaagggtgcatctattagcttaaggggcatctttctcccactgtgtacatctagcgcggagctattgattatccattactaccctatgccttctttgagcattcctgctaat

SEQ ID NO: 13369 - DNA, 178 bp, Gossypium hirsutum
  Clone ID: uC-gsflnu33B002g07b1
cttgtaaaaactagacgaccgccactatcttgctcgggtctacgtcttgcaggcacccgaccgtcctcctcattataaatgaaagcttctcctcactctctcttttacgccctttggctatggaataatagagacgcctacccgataaataacaaagaaattaaaatcctacttcaaa

SEQ ID NO: 13370 - DNA, 65 bp, Gossypium hirsutum
  Clone ID: uC-gsflnu33B002g08b1
tttaaccctcgagggggcatagttcaaaatggtaaatttttccatatgacatccatgacacacat

SEQ ID NO: 13371 - DNA, 338 bp, Gossypium hirsutum
  Clone ID: uC-gsflnu33B002g11b1
tccacgcgtccgcggacgcgtgggttactggggcaacgttaatcccatcggtgtccgaagctgctacgatgagggaaagcgtactgccgagacgttgacaatggactatcacagaggggccggagttgaggttaggatcgccagaattttcaatacttacggaccttgtatgtgcatcgatgatggtcgtgttggtagcaactttgttgctcaggctataaggaaggagcctttgactgtgtatggtgatgggaagcagacaagggagttccaatatgtctttgatcttggggagggcttcatgcgtttaatggaaggagaacatggtggacctttta

SEQ ID NO: 13372 - DNA, 113 bp, Gossypium hirsutum
  Clone ID: uC-gsflnu33B002h03b1
ttgacgcgcgggaacaacggatgcggacagggaaaagtttggctacaaggaacggtgggacggaaaagaacgaggccagtgacgagaaacgcgagcttaacatcaaagaagat

SEQ ID NO: 13373 - DNA, 374 bp, Gossypium hirsutum
  Clone ID: uC-gsflnu33B002h05b1
ttctctctcttattagaaattagacactactagacttgtagaaatgcaagggctcgtcttgttgccggtactcctttgcgccacctaccatatcgctctttccgcgaccaacgttacggtggcggacgggctgttagataatggtaactttgagcaagccccgaatgcctcaaacatgaagggcacggttgttgtggggcgttatgcaataccaggatgggtaaacgaagggttcgtggaatacataaagttcgggcaaaagcaaggggacatgttgctggtggtgcctgagggagcctatgcagtcaggatggggaaccaggcttcaatcaagcatgagataaaggtggtgaaaggggattcttacctccatc

SEQ ID NO: 13374 - DNA, 161 bp, Gossypium hirsutum
  Clone ID: uC-gsflnu33B002h06b1
ttaacatatgagtggaggagtgggcaagactggttatgttcaaaatccatgtcgccagaaatcggatgcagacaagatgaagcatgtaatcatggaaactatacagcaactatcccatgaagtaacatccaagagcctacggatagctgatctacgatgca

SEQ ID NO: 13375 - DNA, 275 bp, Gossypium hirsutum
  Clone ID: uC-gsflnu33B002h12b1
tccacgcgtccgccaatgcctccattgcccttctctgaggcatcagcttgttgcagtcaatgggaagccatccagcggtggggataatacaagtgaagatgagctataataactgatgataggcacttgtctgagcagctttatccttttactacgtttgttttcctttaaaaatgctagcaatggtaaacctcaccagcctttctggctgggatttagaaaataaattctggtgccattttttccaaaagcaaaaaattattttattgattctt

SEQ ID NO: 13376 - DNA, 348 bp, Gossypium hirsutum
  Clone ID: uC-gsflnu33B003a05b1
ttatctctttctatttacctcccttgtgcatctcttttaatgtagtttttttatttttttcatttgataaagttttttttatgtttatgaaaaaaaaagtgaaagctaaaatcaaaataaaacttgctactcatattctctcccacatttacaaacctttattatccatcatcgctttaacaaacctatttgattctttcaatgatctagtccacaggttcgcctctctcgaagaccttaccagtcgtgacttactgcagtccatctttgacaaagtttttcaagcttgttcccttaatctcctaaccaaccccttcaatcacctttatcttcttacctacaacattt

SEQ ID NO: 13377 - DNA, 395 bp, Gossypium hirsutum
  Clone ID: uC-gsflnu33B003a06b1
ttcccaccagaaaaaaaaagttccatcttttagataagcaaaatgagtgatcatcttgttgtatgcgtggaccgccttacgaaacccgaaagtttgaaatcagtgaatgaacccgaggttgcgggaccttcgggtgaaggttcttctgtagttgctgagccacatgtttgtgctattgatgttgaggaagtggaggaacacggttcgtgtgacgaagaagaaccactcatccagacggttgaatgccgtatctgccaggacgaggacaacattaacaatttggagacaccttgttcttgcattgacagtttgatgtttgctcacaggaattgtgtttaacgtttgtgctacttgaaaggagacatatcgtgtgatatatgttattattctttatt

SEQ ID NO: 13378 - DNA, 396 bp, Gossypium hirsutum
  Clone ID: uC-gsflnu33B003a07b1
ctcacgcgtccgcggacgcgtgggccggaacaggaattcttagcgcaggtctccatggtttcgagattaaaagacgaaaatgttgttcagcttcttggttattgtgttgatggatccctccgtttcctggcgtatgagtatgcctctaatggatcactccatgatagacttcatgggaagaaaggtgtgaaaggagctcagccaggtccagttctatcatggacacagagagttaaaattgcttatggagccgcaaaaggcctcgaatatttgcacgaaaaggcacatcctcatataatccaccgtgatattaagtccagcaatttgcttctttttgatgatgatgttgctaagattgctgatcttgatttgtcaaatcaagcccccgacgcgacc

SEQ ID NO: 13379 - DNA, 412 bp, Gossypium hirsutum
  Clone ID: uC-gsflnu33B003a09b1
tccacgcgtccgcccacgcgtccgcccacgcgtccgtgttaagctaggagccaacaagttctctgagagacaacctattgggacatcagctcaaacagacaaggactacaaggagccaccaccggcaccattgtttgagcctgatgagctcaagtcatggtctttctacagagccggaatcgctgagtttgttgctaccttcttgttcctttacatcactgtcttgactgtcatgggtgtctctcaatctaagaccaaatgtactactgttggtattcaaggcattgcttgggcctttggtggcatgatctttgctcttgtttattgtaccgctggcatttcaggtggccatattaacccagctgtgacctttgggttgttactggcaaggaagcctgtcccttacaagggc

SEQ ID NO: 13380 - DNA, 225 bp, Gossypium hirsutum
  Clone ID: uC-gsflnu33B003a10b1
tttctaactgtctaccatgcagctgatgagttacgatgattagatctacgtgcgcgatgacttgggattggggacagtggaagccggtaaaacctgaagattatgatgaaatgaactgaatggactgagagggttgcgtgcctctggttaaaaaaaaacaaatttaaaaaaaaaaaaacaaaataaaacaagggtcggccgggccagcggttccaaaggaaccaa

SEQ ID NO: 13381 - DNA, 354 bp, Gossypium hirsutum
  Clone ID: uC-gsflnu33B003a11b1
tccacgcgtccgataaaccgcacacggcggggatggactatagtttagcagcgctgaaactgctatgcggccaactaaaagacgctcgaggaacaccttcacaaagcgccttaacccttggcggcatcctctttcaacgtgtctggcttcagggcgttttggtttcaaacgacgacgaagatcacctgcttctcgacgatagcactggcattgtcgagcttaacctctacggtgatttccgtctacgtcaatggaaaacaggcatgtatgcaatggtggtgggaggatactttgttcgtacaggagatattcctgtaattaaggttcataagattgttgatctaacttcatttc

SEQ ID NO: 13382 - DNA, 275 bp, Gossypium hirsutum
  unsure (1)..(275): unsure at all n locations
  Clone ID: uC-gsflnu33B003a12b1
tccacgcgttcgaataaacgtacaattaatggatcttttatagttcatgaacaccgaaatcacaatgagatcgagcaaatgtataatgaatcaaacttttaagtaggagattaagtagatgactatcacaacggtgaagatacttgatctggtacactaagttatcatacaattagaattattagctgtgtattctacaaatcactgacttccacgactgatncgtttatggtgtatcttgattacatgtacaggcacaatgactagaatttatc

SEQ ID NO: 13383 - DNA, 67 bp, Gossypium hirsutum
  Clone ID: uC-gsflnu33B003b01b1
ttcacgcgtccgactaaataaaaaaaaagagggaaatttttggttctttttaaaaagaagagataag

SEQ ID NO: 13384 - DNA, 425 bp, Gossypium hirsutum
  Clone ID: uC-gsflnu33B003b03b1
tcaactctctttcttttaaagtccacgccttgtttctttctcacattaagattctcaaatcccctttttttgcggcggttaacgtttgctgatcgttgcttggcttccgaggatcaatcatgactcgtggtaaccagagagatcgagatcgagaaagggctcaatcccgagcggtcggcaaaggcagcaagaccaaggacgatggcttaaccccagaacaacgtcgtgaaagagatgcaaaggccttgcaagaaaaggcggcaaagaaggctgcgcaggcggcagctggagggaacaatgctggaggcggtagtaaaaccaagaaataattatccgatgatgtcaaattgttaatgatttatttacgctggacggttaagataggtgttgttccgtgattggggaatcagatctatgtgtttctt

SEQ ID NO: 13385 - DNA, 318 bp, Gossypium hirsutum
  Clone ID: uC-gsflnu33B003b04b1
ttaagaacgctttaccatcaaaaccagctaggtaaatcataccgatttcaccaggatggctagagggttgaagaaacacttgaagaggctcaatgcccctaggcattggatgcttgacaagcttggtggtgcttttgcacccaagccattatctggaccccacaaatccagggaatgcttgccattaattctcattctgcgaaacagattgaagtatgctctcacgttcagagaagttattgctattcttatgcagaggcatgtcatggttgatgggaaggtttggaccgacatgacttattctgctggtttcatgga

SEQ ID NO: 13386 - DNA, 430 bp, Gossypium hirsutum
  unsure (1)..(430): unsure at all n locations
  Clone ID: uC-gsflnu33B003b05b1
tctcttttcttttttaaaaaatttacagagcccaactccccattttttcttcttttcctctgctaggttttcaaagcctagcttgcgctgaataaaaagaagcaaaataggttttcaatctttctctgctagggcaaaagagttagcccatccttgcagctgctccgttgtgcgcgcaccaacgatggcggcccgaaaaaaaatcaacggttctgctctctgtatgctcttgtccttgctactgttctatcactgtttcagcctctgttatggctgctactttcgtttcttttttgctctctttgcaagctttgaaggaggtgatgggatggagcagaggagtcaagcctcggggcgaagagcgggtggtgcgcccgaggaggagccgcgacagcttttanggtagggtttctttttttttgctgaaggt

SEQ ID NO: 13387 - DNA, 438 bp, Gossypium hirsutum
  Clone ID: uC-gsflnu33B003b06b1
ttcttttcgaaaggaatggctgaagcagaccaccaaattctctctgctgagatcaaacttgggtcacagtactatttctatatggagacacaaactactctagctgttccagatgaagatgacagtatggtggtgtacagctctattcaatgccctcaaattgcacatgaaacattagctcaatgtcttggtcttcccgcaaacaacattcgtgttattacaagaaggattggaggaggttttggtggaaagaccataaaagccgtctctgttgctgcagcctgcgctgttgcagcttacaaattacagcgaccagttcggacatatctgaatcgcaagactgatatgaaaatggcaggaggaaggcattcaatgtaagtcacattcactgtaagatttaaagaaagcgggaagattacaggcctaaaactgagaatt

SEQ ID NO: 13388 - DNA, 369 bp, Gossypium hirsutum
  Clone ID: uC-gsflnu33B003b08b1
tcaatttaggacttgattcttctaaaagcagggataaattgaacaacagaagctctgctccatggaatgataacccaatttctgtcgcttctccagaaagtaccattgaggctaagaatgtgaagaaaacttctgcttccaatttaaaagttgatagcacagttacaatgtttggcaataatgcagggtctttactagattgtggaaaaactcaggattctcaaatgaagactgcacacaaggatctcccaaagttcaccggtgctgcagtgtctgaggcaccatgtgagggtttgctaaagccttcatctaattcctcgggaaataaacctgctttggccttaatttctgtgaccaagcccgagcaaa

SEQ ID NO: 13389 - DNA, 269 bp, Gossypium hirsutum
  Clone ID: uC-gsflnu33B003b09b1
tcctcgcgtccgcccacgcgtccgaaaaaagggaaaattttaaaaaaaaaaaccaaaaaaacccaagaaaaccaatattgtgagaatcatgtattccttccttcttgggtgggccgtcctagtttttctatcctttctccttcctgctttcttctgcccggctttctttttctttgtgtttgtttttttcctctggctgcccctttccttcccccggtctggctttcccctttctttctgctttcttatttttcttgggggcccttccc

SEQ ID NO: 13390 - DNA, 230 bp, Gossypium hirsutum
  Clone ID: uC-gsflnu33B003b10b1
tccagaccgctcgaaaatagaaaccaggtagggggggtatttaagttaaaaaaccctaaaaccccaagaaaaaaaaacaaaataagatggggggacaattaatgaggacacacgcatacatccgcgggcgctgggacaaaaagactcatgaacgggggcgcctaaatcaaattcgcgggcagaaatcaaacaatgcctgaacagggaaaagccgggggcaccccaaacag

SEQ ID NO: 13391 - DNA, 285 bp, Gossypium hirsutum
  Clone ID: uC-gsflnu33B003b11b1
tccacacgttcgggaaaaatgagcaccaagggggtggtttagcagaagtagcacgaacagaacaagcagaactaatactatagggagagacaaccgaacaatgagaaagcgacatgactgcgacatcccacccactgagatgaagatggtcaaaacatatattggcaaaacaacacccacaccggagaggttcatggaaagaaagagagcaatccacagctatgactaagaggaaggccttcttgcactaggaacacaaactaaggcatgaatgacatgaattcc

SEQ ID NO: 13392 - DNA, 192 bp, Gossypium hirsutum
  Clone ID: uC-gsflnu33B003b12b1
tccactcgtccggtgacctgccgtcaaaaggggaagaattgagaggggataccgtgaaatcacaaacaaacctaacacgaagtgacggttacgacgcggtataactgaccccaatagtgggactcatgaagtgtgaatgaaactgaagggtgtgcatgacttatacatacaaccacactaagtacctgggta

SEQ ID NO: 13393 - DNA, 107 bp, Gossypium hirsutum
  Clone ID: uC-gsflnu33B003c01b1
ttcacacgtccgataaaatggtgaatgtatggagcatttttggatatttgaaccagaagggaaaagagtataatgtatttaaaaattgaagataagttttaagtata

SEQ ID NO: 13394 - DNA, 420 bp, Gossypium hirsutum
  Clone ID: uC-gsflnu33B003c02b1
ttataagtgatttaatctacgttattcagactcgtgtgttggatatgggtatgcatctgacagagtatatccaattatttaaaacttttctatatatttggagggcttttaaaaggttatatccttgtaactgtgtccaaaatggtgttggagttaagtgcttcaagaaaaactaagacgcgaaggtaaacgggtcaggtcaatttggattttaaaatttacgggttatttagggttcagatcctttcaagtgtaggttattctggtttgggtaatcttctgctcgggttatttaattctgctagttggttcttttcagattaggtcgtctcaggtttagggcattttggattaagtgtttagctcatttccggtttaagttattctgagttttagccattttggatttgagttattttc

SEQ ID NO: 13395 - DNA, 69 bp, Gossypium hirsutum
  Clone ID: uC-gsflnu33B003c05b1
ttgacatggccttgaagaggcaggacgagagccccgttagttggcaataagcccgttcgacgatggcga

SEQ ID NO: 13396 - DNA, 236 bp, Gossypium hirsutum
  Clone ID: uC-gsflnu33B003c09b1
tccacgcgtccgcttatgatcttttgttcaagggaagtcctccggtgaacttgtagatttcctgtatttcttgttgccgaaatccacagaacttaagagtagaagctacctgcctaaggagaagtgcaattgcaggtaaatgtccaaaatgtttccaccatccagagcatgaaaggagattatcttttatctctgtatacattggtgctgggtttttgagcgttctaagggtgtat

SEQ ID NO: 13397 - DNA, 194 bp, Gossypium hirsutum
  Clone ID: uC-gsflnu33B003c10b1
tccatacgtatttctgaagtagagaatgttgtcaatgcttgagctgatggccattactaaagggcagagattgttactatattagagaaactgcaagatgataatatattgatgatagccggtgaaacagtgcatatgatagtatgagatgttaggaaagacctggatggtttcttttatgcaataactttaca

SEQ ID NO: 13398 - DNA, 67 bp, Gossypium hirsutum
  Clone ID: uC-gsflnu33B003c11b1
tccacgcgtccgttaaaacgcaggtgctagggataggtttcaggacaaatgccctacaatcaaaagg

SEQ ID NO: 13399 - DNA, 111 bp, Gossypium hirsutum
  Clone ID: uC-gsflnu33B003c12b1
tccacgcgtccgtataaactatgaattaaggggagatttttggaacataagcaccataatcagaagaagatcttataagtatataatggatcaaattcatatgaataagaa

SEQ ID NO: 13400 - DNA, 396 bp, Gossypium hirsutum
  Clone ID: uC-gsflnu33B003d02b1
ttccattcaaaaccctaaaggccgctcccgccgcaagctccgacgaaaatggcagtctccgagggattggttctccgcggcaccatgcgagcccacaccgatatggtcactgccatcgtcactcccattgatatctccgacatgatcgtcacttcctcacgtgacaaatccatcatcctttggcacttaaccaaagacgaaaaaacctacggcgtcgcgcgtcgacgtcttaccggccactctcattttgtccaagatgctgtcctctcctcagattcccagtttgctctctccggttcctgggatggcgagcttcgcctatgggacttaagcgcatgaactttcgttcgtcgtttcgttggccacaccaaagatgtgctttcccgttgccttttt

SEQ ID NO: 13401 - DNA, 265 bp, Gossypium hirsutum
  Clone ID: uC-gsflnu33B003d04b1
ttagtatgttaggtactacagagacttcgttttggaactcaacaaggctcttgctgctgaccccaggattgagatttgcatgctccctgttggcgatggaatcaccctttgccgccgtgtcaaatgaaccaccaccaatgctaccgtcgccacagccgctactaccacccaagatcgacaaactttcatattttttttgtgcaatttcaaatatggtgtaaatttaatttggcatttataaacgcaatgcctatctaccattatc

SEQ ID NO: 13402 - DNA, 93 bp, Gossypium hirsutum
  Clone ID: uC-gsflnu33B003d06b1
tcagctcccaaggacaaacttgaccaccaggggaaagttaagtttcaaaaaaccggtgatactgagaaacctgctggagatgcccaaggacct

SEQ ID NO: 13403 - DNA, 303 bp, Gossypium hirsutum
  Clone ID: uC-gsflnu33B003d08b1
tccacgcgtacgtccacgcgtacggtacaacaagggtttgttgattgtggatcaccaactggcgtacgacaaaaggaccagaccttatgtgaagaacatggtcaagagccaatactatttcttctaggagttcttaagggccattactctcctctatgagaacaatcctttcactggtagcaagggtgagatcaggaagcaattgcaatcttgcaaacaagcttcactaatatgccttgtcaatgagaaagccgagtgtggccgaatataatgtttgcttaactagttttcttttacaagaga

SEQ ID NO: 13404 - DNA, 303 bp, Gossypium hirsutum
  Clone ID: uC-gsflnu33B003d09b1
tccacgcgtccgcccacgcgtccgcccacgcgtccgatttatgaaaggtatacatggaaaatttattctgaaaggctgatgacattggctggagtatatggtttctggaagtacgtctcaaaactcgagaggcgtgagacccgaagatatcttgaaatgttctacatcctcaagttccgtgaattggtaaaatctgttcccttggccagtgatgattaaaagcttaatccctggttgcgctcgtagggtactggcagtatacatttaagggtctggtcgattgcgtggattaaccctttcata

SEQ ID NO: 13405 - DNA, 83 bp, Gossypium hirsutum
  Clone ID: uC-gsflnu33B003d12b1
tccacgcgtccgctgagatgctgtgctcatgggccttttcaagaataaattccccagaatgccattgacactgtcaaaataaa

SEQ ID NO: 13406 - DNA, 176 bp, Gossypium hirsutum
  Clone ID: uC-gsflnu33B003e01b1
tccacacgtccgaacaaaaaaagaatataaggtccatcttaggaacctacacctcaaagccacatggtactacagcaacaattcaaggaatcaaagcttcaagtcttgaaataatgatacaactctcagaaagactcaaaaactggaacgggaacctttaaaaaccatataaacag

SEQ ID NO: 13407 - DNA, 195 bp, Gossypium hirsutum
  Clone ID: uC-gsflnu33B003e06b1
tccacgcgtccgtccacgcgtccggtttttcctccatccttccctgtgtaatattgttaggctttgtgcttccaagaggagtaggaataaaaataaaccttttttttttcttcttttaaaattataactaaaacacatataataaaaaaaaaaaaaaacaaaaataatatatcctaaaactacatactaaaattt

SEQ ID NO: 13408 - DNA, 343 bp, Gossypium hirsutum
  Clone ID: uC-gsflnu33B003e08b1
tccacgcgtccgagaatttcttgctgagggaactgcatttcaagatcttttcaatcctgatcgtgttcttatcggaggccgggaaaccccagaaggcaataaggctgtccagcattgaaggaggttatgctcattgggttcctgaggagagaattcttaccaccaatctttggtctgcagagctttccaagcttgctgccaatgctttcttggctcagaggatctcatccgtgaatgccatgtctgctctttgtgaggcaaccggtgctgatgttacgcaggtctcttatgctgttggtaaggacacatggattggacccaaattttttgaatgctagtgttc

SEQ ID NO: 13409 - DNA, 171 bp, Gossypium hirsutum
  Clone ID: uC-gsflnu33B003e09b1
tcagaagctttgtttgtggtgaaaataatgtataagcctgttggttgggagcaaattttccttttgtccaaaggattttttgctgctcattcatggtgacttggtttatggctttatctgttgttaaaatcttataaaaatatatatcgattgctgctcttggtttgtatc

SEQ ID NO: 13410 - DNA, 179 bp, Gossypium hirsutum
  Clone ID: uC-gsflnu33B003e10b1
tccacgcgtccgactaatcgcccccccaagggcccgtttctggaccagagcccccccagacccaagcccctcatgccactatctaacggatcaagttcccaaggaagaccccacgccgccgaagcttacaaccgcctaaatacaagcgaggagaacctgagctcccacccacaaagaac

SEQ ID NO: 13411 - DNA, 115 bp, Gossypium hirsutum
  Clone ID: uC-gsflnu33B003e11b1
tccacgcgtccgaccaaacgacgaagcaaggggcgggttaaggaacaagagcacaaaggccccaaggagcccgacagggggcacaaagaaacaaaccggcaaggagaagacaaag

SEQ ID NO: 13412 - DNA, 123 bp, Gossypium hirsutum
  Clone ID: uC-gsflnu33B003e12b1
tccacgcgtccgaccaagcgaacaagaaagggatctttttgagaagagagacaccgcaaccaaaaggtgagaacgcaagtgtccaatgaaccaagtttacacgtacgagaaaactgagatgac

SEQ ID NO: 13413 - DNA, 170 bp, Gossypium hirsutum
  Clone ID: uC-gsflnu33B003f02b1
tccaggcgtacgattaatggcacattgacaggggcgtttttagatcatagacccggcttttcgaataggataaggcaatttttctatgaataaaatgtattcaggggtgtataaattgaatgtgtataagaaatgaaataatacatggaaagagaatatcaaagaataat

SEQ ID NO: 13414 - DNA, 429 bp, Gossypium hirsutum
  Clone ID: uC-gsflnu33B003f04b1
ttctgactggctgacgtatgagccatacttatgggagattgagaagcagtcatacctcaggcatgctgtgctctttgggttctttgttcaacttaatcggatgtatacagatactgtacagaaactgcctactaattctgagtcgaatattatgagatgttctgtggttcctcgtttcaaataccttccaatcagtgccccagcattgtcttctagagggaataatgggaaacctattatggctgcatccaatgatgttacttcaagaagttcctggaaagcttatacaaatggagagctttcccagaaaggtgatttggatgatcaccagagttttggtgttgcaacaccattcttaaaaatctttcattgcagggtgggagcagattcggagagagcacgttaaaactgggatcaatgtttacggat

SEQ ID NO: 13415 - DNA, 423 bp, Gossypium hirsutum
  Clone ID: uC-gsflnu33B003f05b1
tgatcacaaagcttttcaatcttttctttcgtttcaaatcttggaaatcaaaattcctatggcaccaaaggccgagaagaagcctgctgagaaaaaaccagcggaagacaaaaaagccgagaaggcaccaaccgagaaaaagcccagagccgagaagaagctccccaaggaagccggcgacaagaagaagaagcgaccaaagaagagcgtcgaaacctacaagatctacatctttaaggttctgaagcaagtgcaccctgatatcgggatttcgagcaaggccatggggattatgaacagtttcattaatgacattttcgagaagcttgctcaggaagcttcgaggctcgctcgttacaacaagaagcccacaattacatcttgggagattcaaacagctgtgaggctggttctgcccgggga

SEQ ID NO: 13416 - DNA, 384 bp, Gossypium hirsutum
  Clone ID: uC-gsflnu33B003f06b1
tagtttgaccctagatttaaccctggtgtcagagtcagttgttactatggtccacaacttccgacggctcaatcttacaacataactttgtatgtaagcaccacggtaagcgtggaacctaataaccaagatggagatggtgtagtgctcacgagcagtggcgaatactgcaaaaattggccaaacacgaaagcgtatcctgtgccgaaagcctctcacctaggtattttgcaaaccactgacatcttgaaggccatcgtaaatgccgccaacttggtgtaacccctaaaaataaataaattccgtttttttggaaataaaatttcattttataaatatattttaataacaccatcttatttatttacttactctcatcattag

SEQ ID NO: 13417 - DNA, 388 bp, Gossypium hirsutum
  Clone ID: uC-gsflnu33B003f08b1
tcttgactattgaattctttccttcactttctcgagaaaaaaaaatgtcttcaggttgcaattgcggttctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagtataaataacaggcctctgtaatgatttattttcaaggatgaatgcctgcaaggtctatgactataattatgtct

SEQ ID NO: 13418 - DNA, 244 bp, Gossypium hirsutum
  Clone ID: uC-gsflnu33B003f10b1
tccacgcgtccgaacaaacgctccaacaggggatcgtatttagtatcgagcacaccttaaccgaataacgtaattctaagttgcaatggatcgaacccgcatgtagcagagcaggtggccggatgctactacgtaaaaagagcgtgagcggagaagcttctaaagcatgcactaagtactactaacttggatactgagcaacaccagatgttctacaaccgtggccctgctcctgaaccagtag

SEQ ID NO: 13419 - DNA, 178 bp, Gossypium hirsutum
  Clone ID: uC-gsflnu33B003f12b1
tccacgcgtccgaccacgcgcacaggaaagggtaggtttttagaacagagaccccaaagacaaaaggagaaagagcaagggtacaatgaagcaaatcatcaagggtgggatagatgaacaaaagatcacaacggtcaaatcgcaagagggggaaaccagagatataaaactaattaga

SEQ ID NO: 13420 - DNA, 246 bp, Gossypium hirsutum
  Clone ID: uC-gsflnu33B003g01b1
ttcacgcgtccgattaatcgaagaaggaatggtccgtttatggttcatatgcatcaaatttagaaggtgatatggcaaatgtatattgagttaaagttttaagttgtagattaaggataagagtatcataaaggtcaccatacttgtatgggtacattcagaaatcatatactttgaatgagatgtcgtttaaactacaaatgactgatattgattactgaagagcttatggtgtattttgagtac

SEQ ID NO: 13421 - DNA, 263 bp, Gossypium hirsutum
  Clone ID: uC-gsflnu33B003g02b1
ttcacgcgtccgatagatgaaaggaggaaagggaattttttggtgcacatcccccgcatccaggagtggcttctgcaaaggtccaatacggtaaacctttaaagtacagaacaaggtgacgattctaacaaaggtcaacaaacttgcatgggtacactcaagaaagatctactcagcgtgagggggtgtggatacgacccaatgactgacatggcgttatgcagggcgccaagaggccttatgcgtacacatacaagagcaaa

SEQ ID NO: 13422 - DNA, 404 bp, Gossypium hirsutum
  Clone ID: uC-gsflnu33B003g06b1
tttaaaagtgtcttacaagttcaatctcttgaaatcaagatgtccaaggaggacggtttgctcagtgaaatgcgctttgccagaagaaagggctgacaagcatttagatgactccaaagcgaaaatagctgagggagctgcacctggtcttgcaattttgaagaacaaagctccaagatggcatgaacatttacagtgctggtgtttgaatttccacggtcgggttacagttgcatctgtgaaaaactttcagctggctgcaactgtagatccaagtcaaccaggagggaaaggagatgaagaaaaggttctcctccagtttgtgaaagttggggatgatacattcaccatggattacaggtcacccttgtccccctattttgcatttgccatctgccttacaa

SEQ ID NO: 13423 - DNA, 207 bp, Gossypium hirsutum
  Clone ID: uC-gsflnu33B003g07b1
tcatttctcattacttcctacattccctcacgtctcatatggaagaaaattacggatcacatgattcacaaagctcagccatatttcgcagtcactgtttagaagttgatgaatactaattacccagaaagtgaacatggtcaacaaccaaacatcatcgtcaccagccaactccagataagatcctctcctcggtcatcccctgaa

SEQ ID NO: 13424 - DNA, 241 bp, Gossypium hirsutum
  Clone ID: uC-gsflnu33B003g08b1
tcacgactttttcatgtgaacagaccattctcaactgttctctgttccttaagcggaagaggggatttctttctggctgtcctaacaaggcaaatagcctaaggacgggactgcttcctgcttgagaatcagctgttcgggattacgttgattgacctaaggacgggataggaatgaatgatggctgccaattcccttataaaaaaaagtgaaatattgaagagagctgtgggactgaata

SEQ ID NO: 13425 - DNA, 371 bp, Gossypium hirsutum
  Clone ID: uC-gsflnu33B003g09b1
ttcacgcgtccgcccacgcgtccgcaaaacctaaaagatcgaaaagagagacaatagagaaaaagtagcgacgaacatggaaagagagcaacaagtttacttggcaaggcttgctgagcaagctgaacgatatgacgaaatggtcgaggccatgaaaaatgttgccaagttggatgttgaactgactgtagaagagaggaatctgttatctgtggggtataagaatgtgattggagcaagaagggcatcgtggcggatactgtcttcgatcgaacagaatgaggaagctaatggtaatgaacaaaatgtgaagaggattatggagtatcggcagagggctgaagatgagcttgcaaagatttgtgctgata

SEQ ID NO: 13426 - DNA, 167 bp, Gossypium hirsutum
  Clone ID: uC-gsflnu33B003g10b1
tgaaaggagcatatgctccgctcagaagtgcatttgttcttgagcatatcaccgaattcgttaaggaagccgtgagaggagggaagggaaatttaccactgaatggtggtttgttcatcgtatagacagacgctcgggatggtaaagatgggaaaatcactgttgag

SEQ ID NO: 13427 - DNA, 365 bp, Gossypium hirsutum
  Clone ID: uC-gsflnu33B003g11b1
tccactcgtacgaacaatgtgccccttatgtgaatggataaacaattactacccttttttggagtctatgtagttcgagtgtatcttgctttcaatctattagttattctaatcagctaactggtatggaagccatgcacaatcttggattgtatcatttcttgagctatcatcgtcacccatatacctgaagttcaaaaagaaggctttgaaactgttctacctccttaattatctatctaggttctgtgaggtaatcctgatcgggttatatagaaaaaacaagtgacaccctacaagattgaggacatcatctgctaatatattggacttggttcttcccacaaagcaatccaaattaactt

SEQ ID NO: 13428 - DNA, 207 bp, Gossypium hirsutum
  Clone ID: uC-gsflnu33B003h01b1
ctcacgcgtccgatcaatcgctgaagataagggcagtttttggatcctacgccctgcatccaaaagatgatagggcgaatatttcttgactcaaagtttcaagggatggaacaagggcctgagtataagaaaggccacaaaacctggatgggtacatttaataaccatccacttagagttaggggctgttgaaacgacaaaaacctg

SEQ ID NO: 13429 - DNA, 270 bp, Gossypium hirsutum
  Clone ID: uC-gsflnu33B003h03b1
ttcacgcgtccgattaatctaagaaggaatggtccgtttttggttcataggcatcgaatttagaaggggatatggcaaatgtttattgagttaaagttttaagttaaaaatcaagggaaagactattggataggtcaccatacttgtatgggaacattcaataataatatacttagaatgaggtgtgctgtaaactacaaatgattgaattggattactgaagagcccatgatgtagtatgagtacaggtaaaggcacaaaaactagagg

SEQ ID NO: 13430 - DNA, 203 bp, Gossypium hirsutum
  Clone ID: uC-gsflnu33B003h05b1
ttctacagtcggtggcatacgaaacacaaagggagaggttaaaatcttggacctatgaatgacgaacaaccgctaaagcattagccaaggttgctctcattaagcaagaacgaaagctgggggctcgaatacgatcaaaaaccgacccagtgtcaaccataaactatccctacccgagatcggcagatgttgcttttaggact

SEQ ID NO: 13431 - DNA, 380 bp, Gossypium hirsutum
  Clone ID: uC-gsflnu33B003h10b1
tcacgcgtccggcaaaagccagcttttgtctttgatggccggaacattgtgaacgtggaccagctgagggagattggtttcatagtgtactcaattggcaagccacttgatgcatggctcaaggacatgcctgcagtggcataaatgatgcatgcagaggttatcgatgcacgtcaatgtcggtttgattctttactacctatctttttgacaggtttcattgtttccttgctttcccttccccatggtagccaagcatttgaaggcagtaaacggctcttcgttgtgccacacattgtattcaataatatttaccatctattctgttgtttgttagaaaacttgatattatttttggatttcatctaatttcatattca

SEQ ID NO: 13432 - DNA, 504 bp, Gossypium hirsutum
  Clone ID: uC-gsflnu33B004a03b1
tttatttgtgatgcagttcaagctagggccgagcaagacaagaaccatggggtcatcctcctgcctgaagggcttatagagagcattcctgaagtgtatgcgctattgaaggaaattcacagtttgctcaggcaaaatgtatctgctgataaaatttcttcccaattatcaccttgggcatctgctttgtttgaatttttgccacatttcataaggaaacagcttcttctccaacctgagtcagacgattctgcacagctatcacagattgagacagagaaactactggcgcaccttgtagagaatgaaattaataagcgcctgaaagcaggcacttacaaggggaagaaattcaatgctatttgccacttctttggctatcaagctcgtggatccttaccatcaaaatttgattgtgactatgcctatgttcttggacatatctgctatcatattcttgcagctggtctaaatggttatatggcaactataaccaacctaaag

SEQ ID NO: 13433 - DNA, 263 bp, Gossypium hirsutum
  Clone ID: uC-gsflnu33B004a04b1
ttcaactgtggatgccctatcgttctttatgatcgatcacagctcttcaaacccatcaatggaaacaaccctacactcagtccatgcatgactctagactcaggatgatccagtgccggggggcctctggacttcagatggctggaggagctagagcgcgaccaacaaggctgaggcaacggtactgctagacctggaatggaggacggagactacatacacatgcgcacttgactgtggccatcattggtgctgataatact

SEQ ID NO: 13434 - DNA, 272 bp, Gossypium hirsutum
  Clone ID: uC-gsflnu33B004a06b1
ttcacgcgtccggaaagaaggccactgttatagccatggatgaaatcccctgcccgaaccttcacatttctccggcattcgggttctaaatcactaagacccaggtacgtgcgtgagtgcatcactgatgtggcatggtggagcagcgcatgacgcggaggaagcgcgagacgtgcggtgcctggagactgccctgggttgtgacggctgatgggggttttggttttggttttattatttttttgggctgtgggggttatgtaattgggctt

SEQ ID NO: 13435 - DNA, 509 bp, Gossypium hirsutum
  Clone ID: uC-gsflnu33B004a07b1
tctcacgcgtccgcccacgcgtccggccgcgttcgcacaaagacggtgaagaaatcgtcccgtcaggtaatcgagcggtactattctcgaatgaccctcgattttcacaccaacaaaaagattatcgaagaagtagctataatcccatccaagaggctccgtaacaagattgccggtttctcgacccatcttatgaaacgtatccagaaaggaccagttcgcgggatttctcttaagcttcaagaagaagagcgcgagcgtcgcatggattttgtccccgatgaatcggccatcaaggtcgaccaaatcgaagttgataaggaaacacttgatatgctttcggttcttggaatgggtgatattcccggccttgttaaggttgatccggttgctgttttcggttcctcaagttgggttcggtcgcggtggtggaccccggaggagggtctgagtggtgggtcttcatgggatttcatggtttttttttaagcttctatgtttttttctct

SEQ ID NO: 13436 - DNA, 507 bp, Gossypium hirsutum
  Clone ID: uC-gsflnu33B004a08b1
ttcacgcgtccggtcagacgtgcctaaatttaaaaatcgcgaaacacacgggcaaaaattagggcacacgggtgtgcccgacgggcgtgtgccccaaaatctatataaacccctcactattcatcatcttcctccccaaaaatctctaaccctagtcacttcaactccacacgccctacctgccacacccttacgccgcctacaacactatttccgatgactcaagcttctctcttttgcgtttgttcactcttttctctctattctctttaaatattttgcctatttcatgttttctctggtccattttactattttaagtgaatattaatagtagaataatataaatactcgtgcttgtcatttttcatactacattcatccatttttcttattttcatggattttatatttacccacatacattcatgcattagatttttccgtcgtattattctcatagtcctattttaataacctatataaatgctttagttgtttaagttt

SEQ ID NO: 13437 - DNA, 123 bp, Gossypium hirsutum
  Clone ID: uC-gsflnu33B004a11b1
tttagccttggttgtatgattgctggaatgatattcccggatggagcccaccctgccccgaaccctccacatattctccggcatttcgggttattaaaagccctaaagacccagggtacgtgc

SEQ ID NO: 13438 - DNA, 130 bp, Gossypium hirsutum
  Clone ID: uC-gsflnu33B004b01b1
tatgtttcagtttccctctgtagtttgctgtaataagcttcgtactgacataaaacggacttgcttcaagtttgattattgaaaccttgtattggagctattctatggatgctttatctgtttcctcctc

SEQ ID NO: 13439 - DNA, 309 bp, Gossypium hirsutum
  Clone ID: uC-gsflnu33B004b03b1
ttctaaagagattattgtaaattcgagtacaaggcgctatccaagatgagagccaagtggaagaagaagcgtatgaggaggctgaaaaggaagcgcctatagatgagacagagatccaagtagatgcccctcgcacggaaatagttttgccctgacaattcctagacttcataattatcctgcatatgttgcttgaagttgtgaagattgaagggtattttcaggaaaccttatctgttgtcttctaaatctaggttaaagttttaagactatttgagctgtttgtctaggactattagatattatgtt

SEQ ID NO: 13440 - DNA, 483 bp, Gossypium hirsutum
  Clone ID: uC-gsflnu33B004b04b1
ttatgatgatacagactcagacagaactaaggggaagaagcttgatgtcggattttcggggactactaaacagtgggaggatacattcggcaaaagatactcgaagtcgggggccatgtatagagggaattctccatctcctcttgcagctattccttgcattcccgacattttacctaagaaaatagatgcaacaaatgagtttccgaacattattaagcttcctgagatgaggattgtagaggtacttttggagattgttgcagttaagaacttaccggacgaaaagaaggggaatctctttgtcttgttaagtaaaactcaacccgatgtattctgtaatactaagcagaaactgactattttatctgagtctgggaagaaacaggttcttttatttcagtgtgaacctactggtgaactgcatttcgaactcgtatcaaattcaagttccactttaccaggtacagagacatgcaaaac

SEQ ID NO: 13441 - DNA, 493 bp, Gossypium hirsutum
  Clone ID: uC-gsflnu33B004b05b1
ttcacgcgtccgtaaaaaaaaaaaaataaaaaataaaaaaaataagaaaaaaataaaaataataaaaataaaataaataaaaaataattaacgaatgttaatatatgtgttttattacttcctcttgggcgcgtgccgtctctttggtggttcccaatttttccgtccgcgtgcttgcaacgtttactttttttttgggtgcccctaatttcatttcactgcccttctttttccaaccttgtgcttggtaaacccctggcgttccccaccttattgcccttgcggcccttccccctttccccctttggcttttttgcgaaggggcccgtcccgttggcctttcccaacatttgctctttctgattggcaattgggcccccccctttttcggcccattaatcccgtccgctgtggttgttcccccccacttgcccgttccttttgcgggctcctttgcccctttcttttcgttttttttcctttcttttttgcc

SEQ ID NO: 13442 - DNA, 516 bp, Gossypium hirsutum
  Clone ID: uC-gsflnu33B004b06b1
ttcacgcgtccgctttcagcaactgatatcaggagtgagttattgccatgcaatgaaaatttgtcatagggatcttaagctggaaaacacgctgttagatgggagtactgtgccgagacttaaaatatgagactttggctactctaaggaaccccaacctacattgcaccagaggtcttgtctaggaaacaatatgatgtgaagacttagccctcgatctcgatgaacagatctcgcagctcatacaatgtaagccactttcgaaacagcaggttagagcattatgcgacaaggcaaaggaaatattaatggaagaaagcaatgtccaggattggactggtttgaactttcaggaaataatggatgaagtagaaaaaattcgaataacggtgcatactttggctttctgttccggtgttttggattctctagcggttgaattgaaagcatcaaagacttctctagttatatgcaggcattgcaatactttggcttcatccaagcttggaccagacc

SEQ ID NO: 13443 - DNA, 480 bp, Gossypium hirsutum
  Clone ID: uC-gsflnu33B004b08b1
ttaagtgtgatcgtccacttatgcgggcacctttaccgaccacatctgtcccttatggattggatcgaccatgactcaatgaggttgctgataggatgagcagggaaatcactgtactacccaatatcagtatgcagattagggaggaacaacatccagagagaatatacatggtgtgattgggaggatccattttagcatctcttagcaccttccagccgatgtggatttccaagggcgagtatgatgaatcaggcccagctatcgatcaccggaagtgcttataattcgaatgtatcggaagcctacatttatgagccatctgtctgtgagagttcagtttgttcgacatctgaagctttggtttttatgaatggatggaaagtttatggtatatacagtctgtctctcattagatttcaggttttagattccaaatgtactcttggcatggagtggcttgaatggatttcgaacttg

SEQ ID NO: 13444 - DNA, 395 bp, Gossypium hirsutum
  Clone ID: uC-gsflnu33B004b09b1
ttcacttgctgccgatgtttcttttactcgacggtgtgacggccgctagtgttctttttcctctcttctccttctctcttctttcttcgtttctccttttctctcctctcttcttttttcttttctcctttctcttgttttttctttttctttatttcttttcaaaattttcgaagatctaaaggtgtcggggcccgtttcggtcactgtcgctggggttcccgttagccctcggtggccgtagccggattctccttttccgctggcgtctcccttcaaaaggtgagttgtatttttacttttatttttattttggttgtcttggttgttcgggttttggtgatgttagaagaggaagggcaatgggtcggcgatgggcagtaacggtggtgata

SEQ ID NO: 13445 - DNA, 98 bp, Gossypium hirsutum
  Clone ID: uC-gsflnu33B004b11b1
tcatgcgttcgctttcagcatataataacgggagtgattttattgccatgcaactgaaaatcctttactagtggttcttaagcttggaaaacaacgct

SEQ ID NO: 13446 - DNA, 494 bp, Gossypium hirsutum
  Clone ID: uC-gsflnu33B004c01b1
ttgttgcttactccaactgcgctcgcaagccatcctgatatactcacaagcgtgccgtctgaccactagtagtggttaataaaactgttatttgctttgttagttagttttagattatttccccgaccaacttcttcctcttctctcttcgtggctggtttctttacattgcgttctcctgatttggcgactgtgtaactccgataaagtttgcagcccttggttgaatcacaatggcagtatctgcaattggatttgagggttatgaaaaaaggcttgaaatttccttttttgagcctggcatctttgctgatcctgaaggaaagggtcttcgggcacttaccaaagcccagttggatgagattctaggtccagctgaatgcaccattgtttcttcattatctaacaagcaagtggactcctatgtcctttctgagtctagcctctttgtctatccatacaagattataatcaaaacctgtgggacaactaag

SEQ ID NO: 13447 - DNA, 433 bp, Gossypium hirsutum
  unsure (1)..(433): unsure at all n locations
  Clone ID: uC-gsflnu33B004c02b1
ttcatctgcacttctgtatcttcatgaagagtgggagcagtgtgtggtgcatcgagacattaaatcaagcaatgtaatgcttgattctagtttcaatgtcaagcttggtgacttcggattggctaaactaatggaccatgagctaggtcctaaaacaactggattggctggaactttaggctacttggctccagagtacataagcacaggtagggctagtaaggagtcagatgtttatagctttggggtagtccttttagaaattgcaactggaaggaaatctgttgatcctggaagaaaatctgacatgggattggttgagtggtnntttggggtctttatgggacaggagagctaattttggctgttgacgacaagttgggcaaggaatttgatgagatacaagtggagtctttgatgattgttggactgt

SEQ ID NO: 13448 - DNA, 510 bp, Gossypium hirsutum
  unsure (1)..(510): unsure at all n locations
  Clone ID: uC-gsflnu33B004c03b1
gtggcatttctcatcgagggacaagtcctataatgatgacagagatcataggaagggaaaccatcttcttttagaaggggcaaaaagggaggctgaagaccgaattgttccgcgcagtgttgatgctgatgattctgatgtggaagtcaacagtgacaatgaaagtgatgacgacgacgacgatgatgatgaggatgatgaagaagctctcttggctgagctcgaacggataaagaaagagaaggctgaggagaagctccgccaggaaaaactagagcaagaagaacagctaaaagccaaagaagctgagcttcttcgaggaaatccactactcaataatccaacatcttttggtgtaaaaagaaggtgggatgaatgttgggggttcaagaaccaggctcgcggtgaaaccaagcctcanaagcgcttcattaatgataccataaggaatgacttccacaggaaattcctgctgaaatacatgaagtaattcgcttggataccctagca

SEQ ID NO: 13449 - DNA, 112 bp, Gossypium hirsutum
  Clone ID: uC-gsflnu33B004c04b1
ttgaacgcctctaagtaagactacggactagaagcgacacacgcgcccgtcgcccgattgcacgacccgcagtaggggcctgtggaccccatgggcacgtgtcctaagtgca

SEQ ID NO: 13450 - DNA, 487 bp, Gossypium hirsutum
  Clone ID: uC-gsflnu33B004c05b1
cttttacttctgttttttttctatcaagactctgtttttgccctgtttttttgtcttaccatccaactttctccaaccaaaaacaaaacaacatgggggctctcgattatatttcaaacttttgtactgtctctagaagaagaaccaaacgcaaaccaatgcagacagttgaaatcaaagttaaaatggactgtgatggctgtgaaagaagagtgaaaaatgctgtaaccaacatgaaaggtgtaaaaagtgttgaagtgaaccggaaacagagcagggtaacggtgacggggaacgtggaacccaacagagtgttgaagagagtgaagagcacggggaaaagagcggagttttggccgtacataccgcaacatgtggtgtattatccgtacgcatccggggcgtacgataaaaaggcaccggcgggatttgttcgaacgtgtttcagcttatccgtgtagttctttcaacgcgcccgaagagaact

SEQ ID NO: 13451 - DNA, 439 bp, Gossypium hirsutum
  Clone ID: uC-gsflnu33B004c06b1
ttcacgcgtccgggcactcccaaggcctcccagaccgtgtcagaggcatcgatgatgttattaacgcatggaggttggtaactatgtccaccatcacagcccattgtggagtcacattcattgactactttagctttaacagtttgtccgttcccatgtatgttaatatacttgagacaccttttttttccttgttgaaccatcctgttgaaaatgtcaccacaagttctttgttggagtggtacttgttatcacattcaggtggtccgcggccatcctcaccatcatcaaaccgtacgttgagagtctgggttgccttcgtatggtttgaaacttgtggggaacacttgtaaatgtcataaagcttgccttctttgcagcaattggagtcatgttttgtattacgttccttaggaggctttttcccttttatcttacc

SEQ ID NO: 13452 - DNA, 309 bp, Gossypium hirsutum
  Clone ID: uC-gsflnu33B004c07b1
ttaaatcaggagtaactgaagaagatgcagatattcgtcaaaaccctaacagggaagactattactctcgaggttgaaagcagcgataccatcgacaatgtcaaggccaagattcaggataaagaaggcatccctcctgatcagcagaggttgatttttgctggtaagcaactggaagatggccgaaccctagctgattataacatccaaaaggagtccactcttcacctagttttagggcttaggggtggacccatgatcaaggtgaagactctacccgggaaggaaatggaaatggacattgaccca

SEQ ID NO: 13453 - DNA, 506 bp, Gossypium hirsutum
  Clone ID: uC-gsflnu33B004d03b1
tttatttgtagagcatacattggcacttactgaggccctttgtggctttcagttcatactgactcacttagatggcagacaacttctcattaaaacccaacctggggaagtcgttaagcctgatcaattcaaagcaataaacgatgaaggaatgccgatttatcagaggccatttatgagaggtaaacttttcattcacttcactgttgacttccctgactcgttgaccccagaccaatgcaaggcactggaggctgtgcttcctcccaaggcatcggttcagctgactgacatggagctggatgagtgcgaggaaacaaccatgcatgatgttaacattgaggaagagatgcgtaggaaacaggctcaagctcaacaagaagcttatgaggaagatgaggacatgcatggtggtgcgcagagagtacaatgcgctcagcaatgataaaaaagccgaatgtccgagacacagacggtggtttttggcgatggaatgtactgtggtt

SEQ ID NO: 13454 - DNA, 485 bp, Gossypium hirsutum
  Clone ID: uC-gsflnu33B004d06b1
ttttcacacgtccggagaaaaagagcaaaaagggattggaaattgaagggtaccgagtggaagggttgtcaataggagggcatgaaacttgcattatttttcccactcttaacctagcatttgatatcggtcgatgcccacaacgtgccctttctcaagatttcctttttatttctcatggccatatggatcatattgttagttttttcctttctctctttctttttcttgtgttcttgttcttgcttttggtagtctaattattggttttcctctttttcttttattagatgctgaattgataataatgttagaaaattaggtgattactaaagaaatgtactctgcttaaagaatttattgtttgaaggtagaattggaagtttcttcttatgaatctctgttttcaggtacttcaaattgtgtagatgtttacggttttttttttaatgtgctattttcttcatgttgattcctacattact

SEQ ID NO: 13455 - DNA, 448 bp, Gossypium hirsutum
  Clone ID: uC-gsflnu33B004d08b1
ttaaaaaaaaaagaagcaaaaaaacatggccaaagttctgttgttcattgctctatgtgtgcttccagctttggttagtgctacacgcattctgaataaccaattggtggttgaaggctatgtgtactgtgatacttgccgtgctggttttgaaacccctaagactagaaggctagctgatgccatggttaagctggtatgctccgacaggaagaccggcggagttgttttcgagaaggagggatataccgacaaaaccggaaaataccagattcgtgtatccgaggatcacttggatcagatctgtgatgcagttcttgtgaagagcccccagcttggatgtgccacaatgtcccccggtcgtgaacgtgccccgtgttattcttgaccaactccaatggcatttcatccaccacccgttatgccaatagcatgggcttcatggttg

SEQ ID NO: 13456 - DNA, 473 bp, Gossypium hirsutum
  Clone ID: uC-gsflnu33B004e02b1
ttagaattcaacagatttaataaatggaggaaacgagggatttcgcgtgtgccgatcgtgcaagaagtgattgtgaagccaactcgtgcgacagtaagcatcttaaatgatggatccattgttgttgaagttggagggattgagatgggccagggtctatggaccaaagcgaaacaaacggctgcatatggtcttagtttgataaaatgtgatggcagtgaagagcttttggataaagtaagagttattcaagctgatacattgagtttgattaagggggtttcactggtggcagcacgacatcagaatcgagctgtgaagcagttaggctttgctgcaatgtcttggttgagagacttacagctcttaaagaaaagttggtggaacaaatgggatctcttcgatgggagacactgattcttcaggcatatgtcgcttctgtggacttatcggcaagtacactttttttaccg

SEQ ID NO: 13457 - DNA, 467 bp, Gossypium hirsutum
  Clone ID: uC-gsflnu33B004e03b1
tttcacgcgtccgcccacgcgtccgggcgcagagacgggccaatccaatatgactaagcgaggcatgggaggtagtgctgggaacaagttcagaatgtccgtgggcataccgtttggcggatactgtgaactgcgccgacaacactggggccaagaacctttacataatttgtgtcaaaggaattaaagggcgtgtaaacatgctaccatctgcttgtgttgcagacatggacatggtcaccgtcaaaaaaggcaagcccgattcgtggaagaaggtgttagaccgccgcatcattcgacaacacatactttggcgtacataggacggtggttacatggacttcgaagataacgctggggtgattgtcaatcccaagggagaaatgaaaggatctgttatcactggttccattgccaaggagtgtgctgacctgaggcctaaaattgcaagtgctgacaatgctatt

SEQ ID NO: 13458 - DNA, 392 bp, Gossypium hirsutum
  unsure (1)..(392): unsure at all n locations
  Clone ID: uC-gsflnu33B004e04b1
caccacctatgggaggaggaatgggaatgcctccgatgccaccatacggcatgccacaaatgggcagctattaagtcctaaccaagtctgttttgtcaaaaaggttttattagcagcggggaatcccatggtgcattgaggttaaaaggctgacgtagttctattagtggcaaattttcacgcttcgacgctgtcattttatttttcttgtccgtctctggtagggtgtgtgatatgtcttgtaatattcattttttttatgtagcaagaggcatttttttggctgctgatagggggcaagccgaggatttaatgcatatttgtaattttcctttttgtagtattattttcttccggtgtttggaagcgacttacgagtnaaaaaaataaaa

SEQ ID NO: 13459 - DNA, 485 bp, Gossypium hirsutum
  Clone ID: uC-gsflnu33B004e05b1
tctacgcgtccggcaaaataaagaggacagcaaaggaattggattttgcaataggaagctgggtaaacgagcatcgcgaacggaggctcgacaaaggcatcgaagggaaccaagatttcattgatgccatgttgtctatcatggatgaaaacaatgtaccaattcaagaggctgatgttaccattaaagctaattgcctgactcttgccttgggtggcatcgatacaaacgtgtccacactttcatgggcgatctccttgctattgaataaccgccatgttctaaagaaggctcaagaagaacttgacatccatgtcgggaagcaacgacaagtggaagaatcagacatagctaacttggtatacctacaagccattatcaaggaaactttgcggttatacccagcgacgccagtatcggtagcaagagaagctatggatgactgcaccgtagccggtttccacattccggcaggcactcaactg

SEQ ID NO: 13460 - DNA, 442 bp, Gossypium hirsutum
  Clone ID: uC-gsflnu33B004e07b1
ttcacgcgtccgcccacgcgtccgctcaaatcgcagaacagtttgtgacttctcttggattaaagtttaacccctatgttactcagattgagacccacgattatatggcaaaactttattatgcaattatccggtttaataatatattgattgactttgacagagatatatggggctacatatctgtaggatactttaagcagataaccaaggcaggtgagattggttcatcaacaatgcctcataaagtaaaccctattgattttgaaaacagtgaaggtaatcttggtaaggctaatgaagacctaacttacctgagcatgaagttgcctatttcccgttggcagcgagatttaactgattcgacagtcttgaggaacatggggggaggacttgggtcattcccttcttgcttacaaaagtgcgctgcaaggaataggaa

SEQ ID NO: 13461 - DNA, 355 bp, Gossypium hirsutum
  Clone ID: uC-gsflnu33B004e08b1
tctcacgcgtgcgcccacgcgtgcgcccacgcgtccgatcagctggaattatggaccatgaagaagccagaagaaagaatgttggtgggaaagtacttggcttcttctactgagaaatttgcctttttcattttgaatcgaactcatattattaagatggcatctttttgtagttcagcaattatggttttaatgttttgtttacgattatgaattgttgggttggtaagagattttgtctatttgggagtttcagatatgattgttatgtttttaaagcattttacgcaggattggtggggtaaaaaaaaaaaaaataaaaaaaaaatataaaaataaacaaaagaaataaatg

SEQ ID NO: 13462 - DNA, 403 bp, Gossypium hirsutum
  Clone ID: uC-gsflnu33B004e09b1
tctcacgcgtccggacagatgttacttttctcatctgatcaagaacttttggaatacatcaaagaggagcatcctgactgggaggtgaagaatggatccgtgtatttccagaaggctaaagattctgcaccatgtaaggagatcccatccctacaactgattaaccaaactcttagctatgctagggagttggagcggattgtgtaggcaagctgctatccagtggttgcttttgctgctcttaaagaaaattcatataacttgcaatcattttgttgttgtgggtttttactttctacattcagtatgaaacttaaaaaagttgtttccatttcatatttctagttatatacattagtagcttccaaattgctagaatctatgttagttggatttcgagacg

SEQ ID NO: 13463 - DNA, 268 bp, Gossypium hirsutum
  Clone ID: uC-gsflnu33B004e10b1
tcttacatctggctgccacataaagacggacagtgggtcgtattggatttttgcaataccgaccctcccgttaactatgcattgcgaacggaggctcgaccaaaggcatacgaagggaatccaagatttcattgatgccctgttgcctatcatgcccgaaaacactgcattctaccacagacgctgatgtcaccacttcagcctatctgctttactcttgccttgggtgtcttcccttgcacaccttgtcacacttttcatgggcgat

SEQ ID NO: 13464 - DNA, 451 bp, Gossypium hirsutum
  Clone ID: uC-gsflnu33B004f02b1
ttttcctcctcctactgagatggccccagaggaaggcttccttcttcgcgagtggcggcgtcaaaatgccattcagcttgaagagaaggagaagaaggaaaaggaattgaggaaccaaattatagaagaagctgaggagtacaagcgagcattctacgagaagcgggaaaaaaccattgagaccaacaaaactaacaacagagaaagagaaaagctatacgtggctaaccaagaaaagttccataagactgctgacacgcactactggactgcaatagcagaactcatcccccgtgaggtccctaacattgagaaaagaggcaagaaggatgcagaaaagaaaccatcagtatttgtcgtccaaggaccgaaacctggaaaaccgaccgatctttcaagaatgccacacattcttgtgaagctgaagcattcacctccaccttacatgatt

SEQ ID NO: 13465 - DNA, 501 bp, Gossypium hirsutum
  Clone ID: uC-gsflnu33B004f04b1
tttgagtggtcgctttggactcgtgatgttgaggaagaactaattcccctttgcagggaactcggaattgggattgttgcatatagtccccttggtcatggtttctttgccggtaaagcaaaggaggatacctctaatagttctctggaagtgtacccaaggtttcaaggagaaaacttggagcaaaataggatcctatattcgaaagtagagaagttggctgaaaagcatggatgtacaccggcacaacttgcacttgcctgggttcttcaccaaggggatgatgtttctcctattcccggaacaaccaagattaaaaatctagacagcaacattgaatcagtgaaagtaaagctgacaaaagaagatttgaaagaaatttcagatgcgatcccaatccatgaggttgcagggggtacttatctgaaggtttaaagcaattcacttggaaatatggcaatacaccaccaaagaagaggacctaggtttagaagcaaagtt

SEQ ID NO: 13466 - DNA, 386 bp, Gossypium hirsutum
  Clone ID: uC-gsflnu33B004f06b1
ttgactttctctgtaaccttagtttgttccacagaagtgattattggttgagaaaacatggggaaggacaagcataagcctgatgataagggtctgttttcacatcttgctcatggtggtcatggacaccctcctggcggatatccaccggctggagcgtacccccctcaaggctatccaccagctggctaccctcctcaaggaggatacccccctcacggctatccaccatctggctatcctggtgcatcccattcagggcacagtggcatgggagcgctgcttgcaggtggtgcagcagctgccgcagctgctatgggggctcaccacgtgtctcatgggtgcttatggtgctcatggtgcttatggtgctcatggtgcttatg

SEQ ID NO: 13467 - DNA, 466 bp, Gossypium hirsutum
  Clone ID: uC-gsflnu33B004g01b1
gcgctcacacgtccgccacgcgaacagatgagccgagctttagatgctccagccactggtgcatatgccgatcaccacctgtgtgaactactgcaatgacacggtgcctgttttgaaagcctgccttacagattccatgaaatccgcgaccctgcagtggtagaacctggtgaatcagtttcaacttgttgagatttgcctcaatcttcatggtaatattagcagaactgacactgattttctagtctgaccaggaatccatactgagctttgagttattggaaacccattgcaaagtaaagcaatgtatatctccactcaagttcaggtcaacagaaaataacagagctaaggggttttacctatgaattctagctgaagctggccacggagtgaattgagggtccattgaaagtgaagcaacaactagtggaaagatagattggacattgagaggctgtccccg

SEQ ID NO: 13468 - DNA, 373 bp, Gossypium hirsutum
  Clone ID: uC-gsflnu33B004g02b1
tttacgcgtccactcactggatcgtttacatggccaatctgtctccggtttcggtcaggccaggcggtgaatgagtgaaagagcgccagtgagcaaagaccgagacccatgcagcgacacaggagaggcaatattcctatgggtaccagtaggcggagcacgaaaccaggtctcactgttaacgctaagatcgtgcaagaggctccggagaccgctcaggagtgccggttggcgctgattagctatactactagctaaggcagcgacaagtgcctgactgagaacagggagacaaaagactgggacgactttatgtcagctattgccactaaagggactgtagatgacaacgaggcgagtaagatttacctta

SEQ ID NO: 13469 - DNA, 423 bp, Gossypium hirsutum
  unsure (1)..(423): unsure at all n locations
  Clone ID: uC-gsflnu33B004g03b1
aagagcatgaaaatggaaattgtagggctttatgcatcttacattgtcgaaagcttgaggaagtgactctctttgaaactatttcatgaatattgtagtaaattttactcgttgggtattaaagaaatgttggcnnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttttaggggtcccaagtttcctccccggggttggcaagtaaaaattttttttttggggccccaaaaataaaatccctgggccgggttttaaaaagggggggctgggaaaacccttgggttccccaatttaaatcgctttggggaaaaccccctttt

SEQ ID NO: 13470 - DNA, 486 bp, Gossypium hirsutum
  unsure (1)..(486): unsure at all n locations
  Clone ID: uC-gsflnu33B004g04b1
ttaaaagagagagaaaagaaaagaaaagaaatggaaaatctggctattctactactagtgattttcttggtagccatgccaatggcgtattgcgtcaaagaaggtgccgaggaagtagatgaatggttcgacaagcttccatacgcaaaacaaaaggttactaagctccatttcttcttccacgacagatttgctggaaaacacaacagaaccgccgtccgggtcgcccacggaccggagaccgacaaatcaccaacctcatgtggtctcgttttcatcatggatgacccattaacagaaaggatgaatccgacatccaaagagttgggtcgagctcaagggctgtacgcattttctgggcaagacgaactgagcctgttgatgtcgtttacttggtgtttaccaccggcgagttcaacggcagcactgttactgtacttgggaggaatccgcgcgatccncaccgtgagatgcctattgaggtgg

SEQ ID NO: 13471 - DNA, 71 bp, Gossypium hirsutum
  Clone ID: uC-gsflnu33B004g05b1
gcgttcacgcgtccgcccacgcgtccggtttgtatcaaatcattgtctgaaaatatatggcatcttttatt

SEQ ID NO: 13472 - DNA, 314 bp, Gossypium hirsutum
  Clone ID: uC-gsflnu33B004h01b1
ttcacgcgtacggctttaggcctctttgcttttgcttgctcatcggcctcagcatatgaccccagtcctctccaggacttttgtgtagctatcaaggacatcaagaatggcgtgtttgtaaatggtaaattttgcaaagacccaaagcttgcagttgcagaagatttcttcttttcaggcctaaacaggccggggaacacatcaaatccagttggatcaaatgtcactatgatcaatgtagatataataccaggacttaacactctaagtatatctctggttcgaatcgactattcaccttatgggtgtaaccc

SEQ ID NO: 13473 - DNA, 496 bp, Gossypium hirsutum
  unsure (1)..(496): unsure at all n locations
  Clone ID: uC-gsflnu33B004h06b1
tgagcttatacgaggttctcaatgttgcaaagacggcatctcagcaggagattaagaaagcatattataagttggccttgagactacatcctgataaaaatcctggtgatgaggaagctaaagagaaatttcagcaattgcaaaaggtgatatccattctcggtgatgaggagaaacgagctgtctatgaccaaactggttgcgtcgatgatgctgaccttgctgnagatgttgttgagaatttgaaaacctttttcagggctatgtataaaaaggtcactgaggctgatattgaagagtttgaagtgaactataggggatctgactcagagaagaaagatttatttgatctttataaagaagtgcaagggcaatatgaataagctttttctgttcaatgctttgttcagatcctaagcttgattcacaccgtttcaaggatttgcttgatgaagcaatagctgccggggaactgaaagaaacaaaagcctacagg

SEQ ID NO: 13474 - DNA, 441 bp, Gossypium hirsutum
  Clone ID: uC-gsflnu33B004h07b1
tgaaggcgaacatcgtcacagcgtctcccgagacaggagggctgaattaccacatgacgagtgtgttcatggggctgattcgggtcaagctaagcccacaccatcggaatgaatctgggaactgatgcagccgctactgctgtagctgttgaagttgccacagactggcccccaactctggctactgagatgcaggctgacgacaagcgtggacttgatgaacagccaaagagagaagtgaaacatgagcatttaacatacagctctctctgaagagacgagcgagaaattagaagacgaggctgatgactggataaaagctgaaactatcggaggacagtggaacacgtgctaccaccatgcctcttggaaaggatgaggactgtctcattcagggaccttgaggatgatgatgaccacatgcccataaactacaagaaa

SEQ ID NO: 13475 - DNA, 151 bp, Gossypium hirsutum
  Clone ID: uC-gsflnu33B004h11b1
tgagccttggcgccgaccacactgctgcaaagacggcatttcacctcgagacccagaaagcatattataagccgtccttcgacactccaccctgataaaaaccctggtgatggaggaacctaaagagaaattcctctcgctcgtaataggt

SEQ ID NO: 13476 - DNA, 515 bp, Gossypium hirsutum
  Clone ID: uC-gsflnu33B005a01b1
tttctaaatctcccccaccaccagcccactctccctcaccaccatactactacaaatctccacctcctccatctccctcaccacctcctccatactactaccactcacctaccccacctgtgaaatcacctccacctccagtctacatctacgcttctcctccaccaccaacaccctactagatctaaaaagatcgaccacacaccgttcatgttgtagtttcgccagcaaaataaaggaaggtgccaaggaggaagggagatttggacatcaaagcagttccttttcaagtccatggaataagggtctaagcattacattggagagatacaattttgataattcaggcctacatataacttccacttctttggtagccatgttacacatgctctttatttattgtagtggcataagaaggaagcgagtggtttttctattttaattattgggttctcactttaatttattcgtgtatagaaatgtggcccttccgatgattgatgaaagctttt

SEQ ID NO: 13477 - DNA, 446 bp, Gossypium hirsutum
  Clone ID: uC-gsflnu33B005a02b1
gtctatccatgcacttcatcatgttggctgttgaaagaaaaacaacagaagagattcttcttctaggtgttctttggttgcttatttcttcgcaaggaaagaacacctagaagaagaatctcttctgttgtttatccatgcacttcatcatgttggctgttgaaagaaaaaccttttaatcatgagtgacctatgaaatggaatatagattgtaggtgaattaatttcattttgtatgatgtcgagtttattgtggtttgtcctttgtgttgagtgtgatggcatgtttcacattattaatattcataaatggaattgaatgattgatgaggacgtatgttgaatctatgtaaataagccctatctactgatttttatcctttgattattataattcttgcaagttgatgggatattattgggagaaaaagcatattccttccttg

SEQ ID NO: 13478 - DNA, 496 bp, Gossypium hirsutum
  unsure (1)..(496): unsure at all n locations
  Clone ID: uC-gsflnu33B005a03b1
tttgcaagctttatatgcgtccaagatatgcagttatgctcaagggatgaatttgttgagagcgaaaagtgttgaaaaaggatggaatttgaactttggagagttggctaggatttggaaaggtgggtgtattattagggctgtgtttttggataggatcaagaaggcttaccagaggaaccctaatttggctagcttggttgtagaccctgagtttgctagggagatggttcagaggcaagctgcttggaggagagttgtggggttggccatctctgctgggatcagcacaccaggaatgtgtgctagtcttgcctatttcgatacctataggcgtgcaaggctcccggccaatctcgtgcaggcacagagggacttgttcggggcacacacctatgagaggatcgatcgtccagggtcatttcatacaaagtggaaaaagtccgcttaaagattaatgccggtgttggtgcactcaattgangtttctgagttt

SEQ ID NO: 13479 - DNA, 447 bp, Gossypium hirsutum
  unsure (1)..(447): unsure at all n locations
  Clone ID: uC-gsflnu33B005a04b1
tttcacgcgtccgggcatttgagcatcaatggacctcacacactgaggttgaactacacacgaggcgaaggagttattagaaaggatataatgcaatggatgctgcacaactgaagatttgaaactcttttccgtttgcatttgtggacttcagaaaccccctatggtcgtggaagggggtatgtttggtgctggaaattgtttttttgaaaggatacattgcttttgagtttggcctgttcatgggacaataaaatgtacttgtcatctgcgtttgtagattctttcgagtctatatgttccagcattctgttgcttggagaacacagatgttatgacattgtcgttatgttatacaagatctgtgaatcatttggtttgccattgccatatggaaattttctttggacactatttgtgataacgttgaattttacttaanaaaaa

SEQ ID NO: 13480 - DNA, 489 bp, Gossypium hirsutum
  Clone ID: uC-gsflnu33B005a05b1
ctgaggtggaagctgcaagtgctaaaatctagggatttgcggctggagacgacgagagcccatctctctgcttcaaagctcctgtccaggtagaattctcttcttcccttgcgttgtgttctttgctgttcaatcgccatggcttcaaagcggattttgaaagaactcaaggatttgcagaaagatccacccacttcttgcagtgctggtccagcagctgaagacatgtttcattggcaagcaacaatcatgggaccctcagatagcccttatgctggaggtctgtttttagttactatccatttccctccagattatcctttcaagcctcctaaggtcgcgtttaggaccaaggtcttccatcccaacatcaacagcaatggaagcatttgtcttgatatcctcaaagaacaatggagccctgcactaaccatttccaaggttctgctctcaatctgctcgttgctgaccgatccaaacctgatgacc

SEQ ID NO: 13481 - DNA, 391 bp, Gossypium hirsutum
  Clone ID: uC-gsflnu33B005a06b1
tttcacgcgtccgcccacgcgtccggatctgcagagtacaatctagatcgaggtcttctgatctaagcttctaattgatatggtctggatagatagttacttgactaccaagatggatgctctcgctgcttaaattgaaagcatgtctggaaacgtgcttgtctacaggcagtatgagaccacgactacgatagcaagtgaaggtattcttgctgcttctgctaagctggtggatgcaggaaagcaccacacatatgctgagaccgagaatgctcgataggctatataacccaatgaaagctatttattcgtttgttggagcaaacaatcagagcaacattcttgaagatttggagactttatgactgctctacaagctggaaactgagta

SEQ ID NO: 13482 - DNA, 258 bp, Gossypium hirsutum
  Clone ID: uC-gsflnu33B005a07b1
tctacgcgtccgttctctaaaaccaaacaaattccctctattgttgggttgtcgtccttgtttttctttttccatgtctgacaaacaagctcaccttaatggggcctactacggcccttcaatcccaccacctacaagaaactaccaccgtcccggccgtggctccggctgtggctgtggctgctgtcttctcaaatgccttttcaacatcatcatcaccgccatcgtcatcatcggcttagccgttttcagtctttt

SEQ ID NO: 13483 - DNA, 486 bp, Gossypium hirsutum
  Clone ID: uC-gsflnu33B005a08b1
tttttcgacccgtccatctttttctcttcttcccagcagaaataataatagcaataatcatggagtccaaacatgggagttggagactctcattaatgttgcttctggttatgcttgggttggcaaaagctgatatcaatcaagacaaaacagaatgtagtaatgagctagtagggctggctccatgtctcccctacgttggtggagacgcaaaaacccccaccatagattgttgcagtgggctgaaacaggtgctggataagagccggaaatgcctgtgtgtattgcttaaagatagagatgaccccagccttggcctcaacatcaacgctactctcgcggcaacacttcctatcacttgtcgtgcccctgtcaacatgaccgactgcatctctcttctgcacttaactcccgattcccaggaagctaagttatttcaaggatatcagaagctgacacacactggcaacttcaacttcactacca

SEQ ID NO: 13484 - DNA, 515 bp, Gossypium hirsutum
  Clone ID: uC-gsflnu33B005a11b1
ttaaagcgggagagaaaaggaaataatagagttagatgaagcacggctacaagggcaagcggagatatggcgatacatgttcagctttgcagattccatggcgcttaagtctgccgtggagctccgcatagctgacataatacactctcatggtgtcgccatcactctatcgcaaatagcttcatgcattaatggctgccttacttcgccggacatcaccacccttgctcgcataatgagattgctcgtccgtagaaagattttcactgtccaccaccctttagacggtggagatcccctgtacgatctgactcactcatcgagatggctgctacatgactttgagcaaacattggcgcccatggtattgatggagaaccatccatggctaattgctccttggcactgctttagccagtgcgttaaaagaagtggcattgccttcaaaaaagctcatggccgtgagatatgggatttgacatcaggaaatcctgaattaacaagctttttatgat

SEQ ID NO: 13485 - DNA, 398 bp, Gossypium hirsutum
  Clone ID: uC-gsflnu33B005b01b1
ttgggcattccgttcaacgcaaaagaaatcatgtgtggagtagtagtctttagggtctagaagatatggtggttagaatgtgattttggtgggtcttgatgttttgtattattggacccaaaccaagcttttgacatatttaactagtttaatttatctttggtgatgctaattacatattccttcttcaatttcaatagtggggttgaaagatcaaactgtgtatgtgtgtaaagtagagtgcaaaatgtctagttattaaattttgaccaaaatcttttgtgttacagattccaatttcaagttacaaggaatctattctttttgtttcgtaatttagagctttgggaatgtgtggggccaatcaatttcatattttataatgacaaaactttgat

SEQ ID NO: 13486 - DNA, 505 bp, Gossypium hirsutum
  Clone ID: uC-gsflnu33B005b02b1
tttagaagaaaccatgccgaagaacaagggaaagggaggaaagaacaggaagagaggaaagaatgaagctgacgatgagaagcgtgaacttgtgttcaaggaagacgggcaagagtatgcccaagtgcttcgtatgctaggcaatggccggtgtgaagccatgtgcatagatggtactaagcgcctttgccatatccgaggaaagatgcacaagaaggtttggattgcagctggtgatataattcttgtcgggcttcgcgactatcaggatgacaaggctgatgtgatccttaagtacatgcccgatgaagcaaggctcttaaaggcatacggtgagcttccagagaacactcgtcttaatgaaggtattgtcgatgaggaagatgaaggaggtgcagatgattacattgagttcgaagacgaagatatcgataaaatatagggttatggagctggttttggttgaatgatttgctcgaatggtggaagagagatatggtggatg

SEQ ID NO: 13487 - DNA, 434 bp, Gossypium hirsutum
  Clone ID: uC-gsflnu33B005b03b1
ttgagatggcttctcgccacagagtccggttcccatgtatccagattatcaagactgcaactatcccagccaagctatgcaagagagatagcaccaagcagttccacaactccaaaatcaagttcccattggtgttcaagaaggtaaggccgcctaccaggaagctgaagaccacttacaaggcatcaaagcctaacttgtttatgtaagttctctcattgcaatgaaaagagagttgatgcggcttatagttctaaaatttttggtagtgaacgtctgtcagtttgttgattggatattgtttttcatttgagaagcctaggccacatctgactggctgaagttgaattttctttaatttactatcacattttggttacttcgatgagctggtttgcaatgtttgaaccctattggccagggtttttgtttct

SEQ ID NO: 13488 - DNA, 509 bp, Gossypium hirsutum
  Clone ID: uC-gsflnu33B005b04b1
tttacgcgtccgttcgtggtttaagggatttttttcattcgtttcttctcacgctcgattaccttacaaaaagagaaaatgaccaagtgttacccaactgtgagcgaggaataccagaagtcagttgaaaaggccaagaggaagctcagaggtctcatcgctgagaagaactgtgctccactcatgctccgtttagcgtggcactcagctggaacttttgatgttaagaccaagaccggaggtccattcggaaccatgaagcatcctgctgagctcgcacatgctgctaacaacggcctagatatcgccgtcagacttctcgagccgatcaaggagcagttccctaacctcacctacgctgacttctatcagcttgctggtgtcgttgccgttgagattactggtggacctgaaattcccttccatcccggaagagaggacatgcctcacccccctcctgagggccgtcttcctgatgctaccaagggttctgatcacttgaggcaggt

SEQ ID NO: 13489 - DNA, 411 bp, Gossypium hirsutum
  Clone ID: uC-gsflnu33B005b05b1
tttacgcgtccgtttttgagctctcgtgtgtgtctattgaattgtttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctgtgtaatgatatattgtcaaggatggatgcctgccaggtctataattatgactct

SEQ ID NO: 13490 - DNA, 444 bp, Gossypium hirsutum
  Clone ID: uC-gsflnu33B005b08b1
tttacgcgtccgcccacgcgtccgcccacgcgtccgtgggttgctgtggagccacatggaatcccagacccagaatttccaccatttcaatcctcgacgaagatgaagaaacacctcaatcacaacaagtcattaccaggaccaccacccgattcaatgtcgtaaacagcgccaccgtccccctgttgctggcccgccaccaccaccaacaacagcaagcggtacccaccccgccgacatccgcctcggggatgaacttagcaatggcgctggccgcggagcgtaatttgcggggaaacaacgacaacaccaacaacgtgggtcccagaccggttcaggtaaagacattgatgagattgattgaagaaacggagggtgaagattgttggacacaacatgaagagcaactgaataagaagcagaggaaagaggctgtggaaaatg

SEQ ID NO: 13491 - DNA, 432 bp, Gossypium hirsutum
  Clone ID: uC-gsflnu33B005b09b1
ttttccgtgatggtcctatccctgttcacaaatgcgattggaaatgtcaaaatgaacatgtttgtggcaacatgtatcgctgcaaactaactggaattacacacatctgtgacaagaactgtaaccagcgaatcttgtatgataaccatagttccctctgccgggcgagcggccaggtctttcccctcactcaagccgaggaacaggcggtcagaggcgtccggaggaagtttgatgcggacaattccccgtcctctgatagctgtggttttaagcgcagacgcgatgcgcagttccatccttctccgttcgaaagatctttctctgctgtgagtccgatctgcagccaagtcggagatggcatggatactagctagattagaaatttacgtttcttatatttatagatcctaatattaccataaaaagact

SEQ ID NO: 13492 - DNA, 447 bp, Gossypium hirsutum
  unsure (1)..(447): unsure at all n locations
  Clone ID: uC-gsflnu33B005b11b1
ttatttctcgagttccatataacccataatgcgtaacaaaaaatgcggatctgctcttttgttcctctactgaatacccagggcatttcctaaacacatgaaggctatccttttctgcagaacaaccacgtggacaccttgcaatagtggtcactctcttagatctgagattaacaagtgaagggatgtagttccaagatattcgccatatgaaaattaggatttttgttggtagctgtagattccataatttcctgtagaaatctttagtatctgcctgtaataaacaattactagaatccaagttagcttcttgtaatagtttataggcacttctaactgtaaattcttcggagggttcccctttccacactttcgtgtcatcacagtccgttcttgcgagaggaatctgcaaaattttttgagcggnttccctttgaaagtttt

SEQ ID NO: 13493 - DNA, 492 bp, Gossypium hirsutum
  Clone ID: uC-gsflnu33B005b12b1
ttaaaagctagagtgttggcgattgaggttattccgttttcgaggggaagtgtatgggagcaacctccaccagacttatcatcgtttttgtacaagaatcagatagtttacttgggaatgtcgcttgttccttctgttacagagttgatactggctgaatttctttaccttcaatatgaatatgagcagaagcctatttacttgtacataaactccactggaacaaccaaggtggcgagaagttgggttatgactaaactataggctgcatagattgaccataaatttactcattaaagctgactttacaaattttgctgttggatttgcttccaaatttgggctaaacacaactgcttgtttcttgtacgtattacactcaaaggttaaactctatgccaaacatatgggaaaatcaactgagcagattgaagaagatataaggcgcccatatattttaagcccagtgaagccagtgaatatggcatcata

SEQ ID NO: 13494 - DNA, 477 bp, Gossypium hirsutum
  Clone ID: uC-gsflnu33B005c01b1
tttcacgcgtccgataggcacaattaggagttccttagttgtgttgtaggagccaaagataaaaaaatggtgaagatagcttttggtagcattggtgattcttttagtgttgggtctctcaaggcttatttggctgaattcattgctactttgctttttgtgtttgctggtgttggatcagctattgcttatgggaagctaacgtcggatgcagcactagacccaccaggcttggtggccatagcggtagctcatgcacttgcgttgtttgttggggtagccattgcagccaacatctcaggtggtcatttgaacccagccgtcacctttggtttggccatcggaggaaacatcaccatcttgaccggccttttctactgggttgcccaatgccctggctcaattgttgcttgcctttttttcagtttgtaccaaccgattgagtgtaccaaccacagcgttgcttcagaatgatgc

SEQ ID NO: 13495 - DNA, 489 bp, Gossypium hirsutum
  Clone ID: uC-gsflnu33B005c02b1
ttcctcccttattgtgggcactccttccatgtaacatgcatagacctatggctgcaacagcattccacctgccctgtttgccgaatatcgctgcgtgaattgcccgagaaaaaacggttgatgcaaccgttgttcagttcagccggtcgttctcattttggcacagaatcttttaatatgcatacgtacaactgtttgttgagagggcacggatttccctcaagaacccgtgagaaccccgtgatggacccaaaccaagagaattcatttgcaactggaaatctgggatcgggggaaaacatgtcccgtacaatcgaagatgatgaagacaacattaaagaaccaagaaagaagcttgtggaaagcccatcaaacccttgaattatgtttgtttgtgagttgatgcaaagatcttctggttgtgaaagtggattattttcccttggttcttctttggtggattatttgtaaatatgtcaaaaagtggat

SEQ ID NO: 13496 - DNA, 496 bp, Gossypium hirsutum
  Clone ID: uC-gsflnu33B005c03b1
tctcacgcgtccgcccacgcgtccgcaaaagcaaaaggctaaagagtaaggcccccttccctttgttgacatcctcaccaaatctcttgcttttcttctctcttgctactctcctctaatttttcaccttctgatttgtttaaagaggcaaacaacacaactcgtttttatccttatatatcagtttgggaaaaaaggtagaagaaatgaacggtgatgatgctcagagtatgatggaatcccagtacatacagagacatcacaggcacaacatcagagacgaccagtgcacctctgctcttgttaaacacatcaaagctcctgttcatctcgtatggtcattggtaaggagatttgaccagccgcaaaagtacaagcccttcgtcagcaggtgtataatgaaaggggacctcgggatcggcagtgttagagaggtcaacgtcaagtccggacttccggcaaccaccagcaccgaacggttggaacttctcgatga

SEQ ID NO: 13497 - DNA, 503 bp, Gossypium hirsutum
  Clone ID: uC-gsflnu33B005c04b1
tttcacgcgtccgctcatttcaagggagagagtgtatcagtgtttcttcccctctttacttaatttctctccgccatggctctctccgtcgagaaaaccgccgccggccgtgagtacaaggtcaaagacatgtctcaggctgacttcggtcgtctcgagatcgagttagctgaggttgaaatgcctggtttaatggcttgtagaaccgagttcggccctgcccaacctttcaaaggagccaaaattactggttctcttcacatgaccatccaaaccgccgttcttattgaaacccttaccgccctcggagctgaagtccgttggtgttcttgcaacattttctctacccaagaccacgctgccgctgccatcgctcgtgactccgccgctgttttcgcttggaaaggggagaccctccaggaatactggcggtgtactgagagagcccttgattggggtcctactggtggacctgatctgatcgtcgatgatggtggtgatgc

SEQ ID NO: 13498 - DNA, 332 bp, Gossypium hirsutum
  Clone ID: uC-gsflnu33B005c07b1
ttcacgcgtccgcttaaaaaggatccttaaaacaggaaaagaaatctggaaatttcctatacagatttgtttcagatgcccacagagaagaaactaaatggcggtaagaccttcccctcaaacagaaacgtcaggaaggagattgaggtctgcattactagatgaaacaaatatccccaatctaaaaaaaaacagagtaaatttgttgtctatggtggccggtgggagcgacgatcggaggctgctaaatcagaagctttcactagagcatcttcaacccaaaaacagtcttctaacctccgtaaaccctcttccgccattgcatgagcaac

SEQ ID NO: 13499 - DNA, 382 bp, Gossypium hirsutum
  Clone ID: uC-gsflnu33B005c08b1
tcgcgttaagccaccaatcatctatggtgatgttagccgtcccaaaccaatgactgctttctggtcatctaccgcccaaagcatgacttcacgcccaatgaagggaatgcttaccggccctgttaccatcctcaactggtcgtttgtccgaaatgatcagcccagatttgagacttgctaccagattgccttggctatcaaggatgaagctgaggatcttgagaaggctggtatcaatgttatttaaattgacgaggccgctttgcgcgaggggttgccttttaggaagtccgagcatgctttctacctcaaatgggcagtccactccttcaggatcactaactgtggtgtcaaggataccacccagatccacacccacatg

SEQ ID NO: 13500 - DNA, 428 bp, Gossypium hirsutum
  Clone ID: uC-gsflnu33B005c10b1
tcgggttgagtgtagagatgaggaaaatcatgggtgccaaagttctcttcttctttgctttgctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagcttcggcctaaggaatttcaggttcattgagaccatcaaagaagctgtagaaagggaatgtcctggagttgtttcttgtgctgatatccctgtcctgtctgctagagaa

SEQ ID NO: 13501 - DNA, 473 bp, Gossypium hirsutum
  Clone ID: uC-gsflnu33B005d02b1
ttaaggcactccttaccatgatggtctcttcttctttgatgttttcttccctgctagctatcctaaagaaccaccacatgtttactatcactctggcggacttcgactcaacccaaatttgtatgactgtgggaaagtttgccttagtcttcttaacacctggtctggtaaaaagaacgagagatggatacctggcatgtcaactatgctccaagttctggtatccattcaagctctaatcttgaatcagaagccttactttaatgagccaggttgggaacgtcttagtggcacaccaaaaggtgaattaatgtccaggcaatacaatgaagagacatttatcttgtcactaaagacaatgatctattcaatgaggaggcctccaaggcattttgaggactttgttgtcggccatttctacacgcgtgctcaagatattcttctggcatgcaaagcatatatggatggggctc

SEQ ID NO: 13502 - DNA, 492 bp, Gossypium hirsutum
  Clone ID: uC-gsflnu33B005d06b1
ttcaaaatctctctttctcgtcaatatggcagcaaatggcgttgtttctgacaagagcttgatcgtcagcttcggtgagatgctgatcgattttgtccccactgtctccggtgtttctctagccgaagctcccggcttcctcaaagcccctggcggtgctccggctaacgtggccattgctgttgctagactcggaggcaaagcgtcatttgtcggaaaacttggagacgacgagtttggtcacatgctggccgatattctcaagcaaaacggtgtctccggtgacgggatcttgtttgaccaaggcgctagaactgctcttgccttcgttacgttacgcgccgacggagagcgtgagttcatgttctataggaatcctagcgccgatatgctgttgaagccggaggagttgaaccttgatcttatcagatcttccaaggtatttcactatggatcaataagtttgatcgtggagccatgcagatcagctca

SEQ ID NO: 13503 - DNA, 402 bp, Gossypium hirsutum
  Clone ID: uC-gsflnu33B005d08b1
tctcacgcgtccgatttgagattgtcaaataataagctcgttggtagcataccagctggtttatttgatctgggattggaagatatggatctttctgataataggttaaacggttcgatcccgagaggttcaagtagtcttttcgagtctcttcgaaacttggatctgtctagaaacaatcttgaaggtacaattcctgcagaaatggggctttttgctaacctgaggtacttgaacttatcttggaacaagcttgaatcaagcataccaccagaactcgggttatttccaaacctgaccgtgttggatcttcgaaacaatgctttatccggtgatgttgcaggggatatatgtgaatctgggagcttggttattcttcaattagatgggaactcattgact

SEQ ID NO: 13504 - DNA, 383 bp, Gossypium hirsutum
  Clone ID: uC-gsflnu33B005d09b1
ttcacgcgtccgcccacgcgtccgaaaatatctgctttttcttagttttcctttttgtcccttgtttatttgatatttccccctcatggccgccgctgatgtcgagttccggtgcttcgtcggagggctcgcatgggccaccgacgaccgggccctcgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgcgcaaaagtggaggcggtggcggaggatttggaggaggaa

SEQ ID NO: 13505 - DNA, 62 bp, Gossypium hirsutum
  Clone ID: uC-gsflnu33B005d12b1
ttcacgcgtccgcccacgcgtccgcccacgcgtccgcccacgcgtccggttctagatcgcga

SEQ ID NO: 13506 - DNA, 500 bp, Gossypium hirsutum
  unsure (1)..(500): unsure at all n locations
  Clone ID: uC-gsflnu33B005e02b1
ttttcctctctgcttgaagttaccaaagaaacagagcaacaatggcgaaaaccagccttagccgcctattcgcgtcactctcggagcactccatagccaaaccgtctttcactggttcgagatcagagtcggtgactcgttcagcttacaactccgtgactcgcttcgtatgttcctctgctcaggaaactcaattgatccgtgaagaaagatccaacgagggagatcgagaagctgcgaaagagaatctcgaatctgtgaataaagaagaagatgaaggtgaagatggtgatcacgtgaataaagagacgggggaaggtttcnggtcctaaaggcccagaacccactcgctacggtgattgggaacggaatggtcgctgctccgacttttgaattttttttttaattgttatgaatgtaaaactgaattgaatcagcgatttttaatttcccggagaataaaaaacattggtggagtaatgataaataatttttttggt

SEQ ID NO: 13507 - DNA, 500 bp, Gossypium hirsutum
  Clone ID: uC-gsflnu33B005e03b1
tttagtgctgctactgaatgtggttgcctaggaggtgctggtgaagcagggctgccattactgttcataatggcattgattgtgctcggactatttacggtgattggcatattttatagtgttctggttgctacaatggttgggcaaaggatttggcagcgtcactatcacatactcgcaaaaagaatgctgacaaaggaatatgttgttgaggatgttgatggagaaatgaatggatctgactggtctcctcctcctctcccacctgaccatattcagcagctgaaaacacttggccttctatgagttcagaattatattgccattgacaaaaacaacataatgtaaagatggactgactccccattctcgtaggtcagtcttgactacaggcttgttatgaatccacttatttcaacaaaagtgttttatgcagttatcaagctagaaaagctacgaaagattgtcaaaatcatttagttagaagtctgtgaatgata

SEQ ID NO: 13508 - DNA, 505 bp, Gossypium hirsutum
  Clone ID: uC-gsflnu33B005e04b1
ttcaaaccactcccacattaaatattgttgctgaaacaatggcgttttcagctctgacaggtaagcttgaggcagatgtagagattaaggcttctcctgagcagttccatgaaatgtttgcccacaaaccgcaccacgtgcaccatacttgctatgacaagattcaaggatgcgatttacatgaaggtgaatgggggaaagtcggtaccattgtccattggagttatgtgcatgatggaaaagctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcttagtgcactggactttggaatacgagaagctgcacgatgggattgcgcatcccgagactctgctgcaattcgttcaagatgtctctaaagacattgacgcccacctcacccaagc

SEQ ID NO: 13509 - DNA, 456 bp, Gossypium hirsutum
  Clone ID: uC-gsflnu33B005e05b1
gttaccttaacacaacttaccaactcaaaaaccccaagttttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgtgtctgctgtagtttgtgtggtgacttatatctgtcagttaacctttctctcctttactatgatgtaatggctatgcttatggccttatctggttaatgaagtattcttactat

SEQ ID NO: 13510 - DNA, 229 bp, Gossypium hirsutum
  Clone ID: uC-gsflnu33B005e06b1
ttcacgcgtccggaaatatgaaccattctaaaccatagttgatgccaacaaaaactttgcattcctcacttcaccattcccattttgtttacaattattattatttttgttggagtgaaaacatgttgaatattgagatgcatacttctaggacgagcttttgttattacgcggtcattttcatgttgttagctctaaaaacaataacatatatctacattttgcaatc

SEQ ID NO: 13511 - DNA, 238 bp, Gossypium hirsutum
  Clone ID: uC-gsflnu33B005e07b1
tctggtagcaatggttgaacatttcccatcagtgagttaagaaaatatgcatttactttcgtttgagtgtgttgtttcagttaaaggagttttgggtgcaatttttctttattgctttcatgggttacatatgtttctcccttgaatgctttttattatgcagttcaggtggagaaattttttcttaatgtttctgagctgttttttttgaaaaaaaaaaaaaaaaacaagcatctac

SEQ ID NO: 13512 - DNA, 409 bp, Gossypium hirsutum
  Clone ID: uC-gsflnu33B005e08b1
ttgccgcccaaagaatcaaatctctgctactgcatagtcaaagagagaaagagcgacaatggaggcagcaagaacagttaaggacgtttcccctcacgatttcgtcaaggcttacgccggccatctcaagcgctccggcaagattgagcttccttcatggactgatattgtcaagaccggctaactcaaggaacttcctccatatgatcctgattggtactatatcagagccgcttccatggcgaggaaaatatacctgaggggaggtcttggtgttggtgcctttagaaggattcacggtggggctaacagaaatggaagccgtcctcgccatttctgtaagagcagtggatctgttgctcgccacattctttaacatttgcagaacgttaacatcattgatattgat

SEQ ID NO: 13513 - DNA, 495 bp, Gossypium hirsutum
  unsure (1)..(495): unsure at all n locations
  Clone ID: uC-gsflnu33B005e11b1
ttcacgcgtccggtcaagagcccagctggatgagattcttggaccagctgagtgcactatagtttcttcactatcaaactatcatttggactcctatgtcctttctgagtctagcctctttgtttatccatacaagatcatcatcaaaacctgcgggacaacaaagctacttctttcgatcccacccatcttgaagttggcgggtagcctttctcttaccgtaaaatctgttcggtacactcgtgggagttttatcttccctgctgctcagccatatcctcatcgttacttcactgaagaagttgttattcttgatagccattttggcaagcttggcgctggtagcaaagcttatgaaatgggtgggctggataaacagaaatggcatgtttactctgcttctgctgaatctgttaacaccaaagcccctacttacactntagagatgtgcatgactggttcggacactgaaaaggctacagttttttacaaaga

SEQ ID NO: 13514 - DNA, 455 bp, Gossypium hirsutum
  Clone ID: uC-gsflnu33B005f01b1
tttccgttcattgaagttagggatccaaagttattcaccattttggtagataatcttccagaggatcattcggtagaaaatattaagaggatatttggtgaagtgggaaggataaagaaaatatcagttcgtgatccacatgctgttgaagagacaaagaaaactggtagagccgatatattgatcagtagtaagttacacgcactggtggagtatgagactattgaggctgctgaaaaagctgtggctactttgaacgatgaacatgactggagaaatggcatgcatgttaagcttcttgagcgaaagggtaagcatggacagcgaaagcaagcttggaggggacctgctcatgaaaaaaacatcaatgctcaggtatctgatcaaactggaaccgaggagaaaaatgcttcagtgagtatcatgaaaatataccagatgatgaggatggggag

SEQ ID NO: 13515 - DNA, 469 bp, Gossypium hirsutum
  Clone ID: uC-gsflnu33B005f02b1
gtcccctggtgccgacatgagcatatactacccttacaccgaggagaagaagaggttgaagcatttccattccgagatcgaacaacttctttacagcaaagttgaaaatgaagagcactggtgtgtgctaaacgaccacaacaagccaattctatttacaatggcaaggctggatcgtgttaagaatttaagtggacttgttgaatggtacgggaagaatgctaagttgcgtgaattggttaaccttgtagttgtcggtggagatcggagaaaagagtccaaggatttggaagagaaggctgagatgaagaagatgttcgagctcattgagaagtacaagctgaacggtcagttcagatggatatcatcccaaatgaacagagttaggaacggtgaactttaccgttacatttgtgacacatagggtgccttcgtacaacccgcattatatgaagcctttgggttgact

SEQ ID NO: 13516 - DNA, 398 bp, Gossypium hirsutum
  Clone ID: uC-gsflnu33B005f03b1
tttacttcaattcacctaaggcagataattcactggcccttgtttctttgggagaaccacaacaagcacctactgcatcacagcagaatgccctcgttctctttgatatgttctctgatggtagcaacacctccaattctgtcaacacccagtcttcaggtttggctggacaaaccaaccctttgactcctcaaattcagcagcagcaccagcagcagcacaattttcatgcaaatggaactgcaccaaacatgggagcacctcctcaatatgagcagccatatgctcaaggcaccgttcctgcctggaatggtcagctggttcagcagcaacagccgccctcacctgtcaatggtgctgagagcagtggctcactaccaccaccaccctgggaagca

SEQ ID NO: 13517 - DNA, 449 bp, Gossypium hirsutum
  Clone ID: uC-gsflnu33B005f04b1
gttgtggtgagtgttttgatggggaaggaacagagcttagatgagacttcaaactccatttctaattctggaagtgaaagaacgcctcttttgaacaaggaggcaagtaagcaaacaaatgggcaacaagcagctgaaagtcctctgtcagaccttgagcaaggcaatgcagaagaggcagtcaatgttggattttggagagtatttgcactggcaaagccagatgcttggaagatatttgttgccacctttgcattattgatagcatccactacaaatctcttgattcctaaatatggcggaatgatcatagacattgtttcaagagatataaggacacctgaacagcaatcagaggccctggaagctgtcaagaatactgtaacatacattgtgctgatcgttgtattagggtctgtgtccgcagcactttggtcatggctcttttc

SEQ ID NO: 13518 - DNA, 435 bp, Gossypium hirsutum
  Clone ID: uC-gsflnu33B005f05b1
tctcacgcgtccgcccacgcgtccgcccacgcgtccgcttataaatccttaatcaatcatctcattcctttgtcatctaattattaaagcaaagatagatggctaaacttgccacctttttcgtcttaacccttctcttcgtttccactctatcctttgccgcccgccctggtccagctttccctaaccagtctcctaccaaaactcaagctaagggtattactgtggtggagactgaggttgagcggtcgactgaagctgttgaagatagctgccaaggagttggagaagaagaatgtttgatgagaagaactcttgctgctcatgttgattatatctatactcagaatcacaagccatgagagctttttatgaatttatggacatggtcttttaaattttaaataacataatcactcaagttaatttgtgaaa

SEQ ID NO: 13519 - DNA, 458 bp, Gossypium hirsutum
  Clone ID: uC-gsflnu33B005f06b1
ttcaatttcttctcattttcgagaacatttttttaaagattttttctatatattctttgaagatattaatcagaaaaatggcgctggtttctttcatcggaagggttctttttgcgtcagtgttcatcctctctgcttggcaagagttcaatgaatttggcgtcgatggtggtccagcggtgaaggagctgaggccaaagttcaacgtcttctcaaagactgtctcatctcacacagggttgcaagtgcctgaatttgatatcaagtatgtggttgctgctgctgtagcctttaaaggtgttgggagtattctctttacctttggcagcaccatcggagcttatcttctggttttgcatcaactcattcttactcccattgtttatgacttctacaattacgagaaggagaagaaagaatttggccttctttttacgaagttctcacagaacttggcg

SEQ ID NO: 13520 - DNA, 444 bp, Gossypium hirsutum
  Clone ID: uC-gsflnu33B005f07b1
tttcacgcgtccggaaatacatggccccttcaccaggggagtacgagagaggactatttgctcacactgataaacctgtcagcacaatcatttgtgatgatcatgtttcggggttggaaattgaggtcaatgacggccaatggatcaagttgtccttatctccttcttctttttgctttgtggttggggatcctctcaaggcatggagtaatggaagattaaaagcggtcaatcatagagtgatgatgagtggggacaaagatcgactttctttagcagccttcgccattcccgttgagggtaccataattaaggcacctagagagcttatagatgagcaacattctcagctttacaaggactttaattttatggactttttcctttttgccttttccgacccggcaaagcacatcgactctggcgagcagctccagcttttgc

SEQ ID NO: 13521 - DNA, 501 bp, Gossypium hirsutum
  Clone ID: uC-gsflnu33B005f08b1
tttaaacttgccgtgaatctcatcccctttcctcgtcttcactttttcatggtgggttttgctccactcacttctagggggtctcaacagtaccgagctctaacagtacctgagctcacccagcaaatgtgggacgcaaagaacatgatgtgtgctgctgatcctcgtcacggtcgatacttgactgcatctgctatgttccgtggtaaaatgagcaccaaggaagtggatgagcagatgttgaatgtccagaacaagaactcctcatactttgttgagtggatcccgaacaatgtgaaatcgactgtttgtgacatcccacccactgggctgaagatggcatcaacatttattggcaattcaacatccatacaggagatgttcaggcgtgtgagtgagcagttcacagctatgtttaagaggaagggcctcttgcattggtacacaggggaaggcctggatgagatggagttcacttgagctgagagcaacatgaatgat

SEQ ID NO: 13522 - DNA, 138 bp, Gossypium hirsutum
  Clone ID: uC-gsflnu33B005f09b1
ttcacgcgtccgttaatctcggagtaagttcgtagaaaaaaaatcaaaaaaaattttgattgaaaaaaaaattgagttgtaattattttctcttgtatttagcttactattgtattggagtattaaaaaatcttgtac

SEQ ID NO: 13523 - DNA, 449 bp, Gossypium hirsutum
  Clone ID: uC-gsflnu33B005f10b1
ttcttcttctctgagtagaggttttggatttgtaagcatttacaatgtcttcgtcctatctcccagcaaccactgactcaattgctctggccttagaagccaaaacaccatctgaagccatctcaatcctttaccgtgtactagaaaatcctgcatctgctcccgatgctctacggattaaagagcaggccataacaaatctatctgatcttcttagacaagagaaccgagcagaggagctcagaagccttctgacccaactgaggcccttttttgcactaattccaaaggcaaaaactgctaaaattgtccgtggtataattgatgatgtagctaagataccaggaacatcagatctccagatttctctttgcaaagaagtggtgcagcggacttgtgctgagaagcgaactttcctttgccaacgagttgaggcaaaagcttgcggc

SEQ ID NO: 13524 - DNA, 292 bp, Gossypium hirsutum
  Clone ID: uC-gsflnu33B005f12b1
ttagatttgcgctggaattttgaagctccttgacgagaagcttgttccggctgctggaaatggggattccaaggtgttttatctgaaaatgaagggagattaccataggtacttggctgggctcaagaactggcatgacaggaaatatgctgtcgagaataccctaagtgcctattaatctggtcaggacattgcagaaggtgagctagcccgaaccatatgctattacgtgtaggatggatatgaacctttctggcttctaccaagaaaacctgaacccttctgaacgtgc

SEQ ID NO: 13525 - DNA, 456 bp, Gossypium hirsutum
  Clone ID: uC-gsflnu33B005g01b1
tctagagaaaagtcaaggagtgccagaaataagcaagctggtggtgctatcgtcatggatgctgatgctacctctgcactgcacaagaagggagtgtctacaacagatgattccttcaaattcatatggttccagccccatgaaagtgtaataaaggccatatacaatggctctgagtttatggaaaatgcaactgctggcaatgatgttggcataattttggaatctacgagtttctatgctgagcaaggtggtcagatttttgatactggatatcttgatggttcctttggctccttccaagtatgtaatgttcaaatttttggaggttttgtacttcatattggttctctttctggagcttctggcaaattctctgttggtgataaaagaacttgtaaggttgactatgataggcggacgttgattgctcctaaccatacttgcacgcatatg

SEQ ID NO: 13526 - DNA, 456 bp, Gossypium hirsutum
  Clone ID: uC-gsflnu33B005g02b1
tttacgcgtccgaaccactcccacattaaatattgttgctgaaacaatggcgttttcagctctgacaggtaagcttgaggcagatgtagagattaaggcttctcctgagcagttccatgaaatgtttgcccacaaaccgcaccacgtgcaccatacttgctatgacaagattcaaggatgcgatttacatgaaggtgaatgggggaaagtcggtaccattgtccattggagttatgtgcatgatggaaaagctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcttagtgcactggactttggaatacgagaagctgcacgatgggattgcgcatcccgagac

SEQ ID NO: 13527 - DNA, 498 bp, Gossypium hirsutum
  Clone ID: uC-gsflnu33B005g03b1
ctgttggacgtgtacaagataaaagttgaacttctatgaatttgatgtatttaggttggttgaaaaaagctatagcttacagaaggttgtaccttaatggccaataatctgggtaacttaatattgcgagcagctagactctattcattgacattctctgatcaatcaatgagtttcttaatgcaggttccattatatgtggcaacaaaaatggcatcaatcaaaagatcgtctttctttgttccatcaacagacggatatgctcgtgcagcaatgcagtggataggctatgaacctcattgcacaccctactggccccattccatcctttggggcttagcttattcactgccagagagtgtggctgatgcatggcgtttgcgctcttgtcttggcattcgaaagagggggcaaatgaaagattctaggaagaaggaatgaaaacacattgctgagtctggtctattttctgttatggagttcatattttacttggat

SEQ ID NO: 13528 - DNA, 373 bp, Gossypium hirsutum
  Clone ID: uC-gsflnu33B005g05b1
gtttcactgggctatactgtgtctatcaggatggccgatctataccaagtgctatctgcacctgggctatactccagtgctgatgtgcaacacgctggccgatcttgtggagacatggctttggtggcactaacaagttgtgatactcgatagcgggaccaggctgtgagaggattctaggacatagctatgagctcactcatatgaagggcttgctgtgctgtgtgcaagacacatgttgatctgatggagagaccatttgctgtcgatccagcatcgaagatgaccatgatcaaacatggatggctatttatgcctgacatacggcatagctggacgatgaacgtgagctatcaaggatagatgctgagag

SEQ ID NO: 13529 - DNA, 476 bp, Gossypium hirsutum
  Clone ID: uC-gsflnu33B005g06b1
ttcgctcgtgcaacaacggcgtcttaagctttgactgatctgattgcggcagatgcccagagactgccatgctcctggacggttgcacgaaacgaccgccacataccgaaccgtgtgcaccatacttgctaggacgagactcaaggacgcgattgacttgaagagtgaaaggggaaccgacggtccacttcagatggcgaattgggcccgatggataggcttaggctctcaagggatctagtagctgcgttagatcctagtaggaacttgatcactctagagtgatagagggcgatcaagctgaagcaatatgagatacttcgtaacctctgtttaagctgctattaagagcaaggattgtgcctgcataggaggctggaccgtggaatgcaggagactgcaccactggattgcacgtagagcgactcatggagcatactggggggatgcctccaaggtcattggcgctcacctta

SEQ ID NO: 13530 - DNA, 337 bp, Gossypium hirsutum
  Clone ID: uC-gsflnu33B005g07b1
tttaccgagaaagcggcatcaagtttccttttatcctatcaccatgagagccaagtggaagaagaagcgcatgagaagactgaagaggaagcgccgaaagatgagacagagatccaagtagacagaaccatcagcccctctgttatacgaggtttcacaatgtcttagctaatatcggtgtacttttagggtccacttagttatctgccatttttatttcagttttaagcttcttttttgtcttgggtttctattgtctttcaagttggtgctaatccgactgtgggatcatgtatcattgttgagaacagtgaattgcaaaaagcagcagattttc

SEQ ID NO: 13531 - DNA, 475 bp, Gossypium hirsutum
  Clone ID: uC-gsflnu33B005g08b1
ttgctggcatgggccatcccattgagaagagagacctgtatgatgccgatcacgggaaaaaggtcttgagcatggcgcctggactcgagcggctgaacatccttccgttcagggttgccgcgtacgataagacccaaagcaaaatggctttcttcgatccctcgagagctcaagacttcctcttcatatcaggcaccaagatgcgagctcttgcgaagaacaaagagaaccctccagacggattcatgtgccctggcggttggaaagtgttggtcaaatactacgacagcttgacaccatccgacaacggaaggatccatgaagccgttccggcttagaccaatgtacgataaagatacttcatatgattgggaggagcatatttaacactgtttgatttccaatgtgtgtgtgatgcaaaatctttttaataaaaccatgagaggcactggtacagagccaatgaaaaagcttg

SEQ ID NO: 13532 - DNA, 431 bp, Gossypium hirsutum
  Clone ID: uC-gsflnu33B005g09b1
ctctcacgcgtccgcccacgcgtccgcggacgcgtgggggctcacctcttcagagaaagaatcttcttcttcttcttcttcttcttcttcttcttcttcactttacatccatcaaggctgaagaaaaaaattaggttatcctgagtgatgggtgtgagctgccgttgttcccacacctcccatatcactgaaatcatcataaccagcttctttcgtcataagtcttaaaacaagtgaacaactttgtgttctttaaaatccaaaagccagagtagtctttctttctcttctttttcttttgttttttatgttaaatttttatatcatttgatgatatggtgaagatgacttcttgaacaagatcgatcatttagcttgaaactctcatggcgggtgggagggccgtctcttgtaataatactaatagtgtt

SEQ ID NO: 13533 - DNA, 149 bp, Gossypium hirsutum
  Clone ID: uC-gsflnu33B005g12b1
ttcacgcgtacggtttaccctggtccaactggtaagtacgactgtgatttttaaaaaaaaaaaattgcatagcaatgttacgatagttgtagttataaaagtaagcgtgatttggaatggtaggggaagtgtatatatgtgggatgtct

SEQ ID NO: 13534 - DNA, 458 bp, Gossypium hirsutum
  Clone ID: uC-gsflnu33B005h01b1
ttgcatattactacaggatgatttttgagaggtttttccctcagaactcggctagattgactgtccccggaggagctagtgtggcatgcagcacagctaaagctgttgagtgggacgctgcctggaaaaacaaccttgacccttcgggccgggctgccttgggggttcatctctctgcttatgacgcagagactcccctcagcaacaagccatccaaggttattgatagtataccacggatggactttcctggagttgccatacagagttaatgcctgcctactggaagacaacagaatgtatgaattatttaataaaatgagtaggagctgtggcatgtccaaatgtatgaagtatttaataaaatgagtaggagctgtggcatgtccatcaaactttcgaatacattgttgtataatataagtgatatttacgagtaccaagagattctgtgatca

SEQ ID NO: 13535 - DNA, 291 bp, Gossypium hirsutum
  Clone ID: uC-gsflnu33B005h03b1
ctgacgcgtccgcccacgcgtacggcttctgcaccttctacttcaatcggttcccctccaggtcctaccccatcaagtggacctgctccagcctccgagcccactgccgaccaaggccctcctccctctggcgactccaccaacggtgtttccattggtgcaatcgctcttgccgacagtttacttcggtggcgcttgggcttaagaaagcgaagtgaagtgcatcttttttgggttgtggatcatgattcttgagaatctttactttcacgctctcttttgaccttacga

SEQ ID NO: 13536 - DNA, 450 bp, Gossypium hirsutum
  Clone ID: uC-gsflnu33B005h04b1
ttgaattatttgggtacattttggagtcaatagtggtgcaagtagatttgctgttgagcgtcaagctgcgaatgaagctactttccgttgccctgatgagatgggatggaaacctcagaaagtacccattattcctgcagatggtggaatttcacgtgtaagagagacttctcttcctgttgaggagattacaaaggccttagcaaagaagggatttgaggtgatgacctccgatgatgcaggacggtttgtgtgcaattatgtttactatcactcccttcgctttgccgaacagaatgggatcaaatctctctttgtccatgtccctctcttcttgaccatagatgaggagacccaaatgaaatttgccgcttccttgttggtggtactcgcttctctatgtcagtaacatactgcattcacttatctttatgtccagaaattgatatg

SEQ ID NO: 13537 - DNA, 325 bp, Gossypium hirsutum
  Clone ID: uC-gsflnu33B005h06b1
ttcacgcgtacggacaaagtggctattctttacctgaagaagtctgggcctgatctcactaaagtcctgacccaggtctatgttggcattgccgggactggcgttgctgcagccttttctgttacacagaaggccgcgtatgtgcgagcccaattgtgtacatctatctctacagcactagccttggcatccggctcgtttggctctcctgggcaggtaacagactgtgggacactactgtacgtactagctggattactgacagggtgaatatgaaggtagaagagatgatccagagagtcgagataagtgttgaggacgttta

SEQ ID NO: 13538 - DNA, 257 bp, Gossypium hirsutum
  Clone ID: uC-gsflnu33B005h07b1
ttcacgcgtcctcccacgcgtccggcgccattaccggggattggtaacgtactaatcttgttctttgttttttatgaccagatctactccaagtacttttacgtttgattcgaagatagaaaaaactgcgagagccaatcgcaaggaaacaaagttatgcaaaaaacagttaagagtggttgggactcagaataacccaccaccagaaattggaatcaacaacgaagtaaagtctagggttaatgaaaaccctactc

SEQ ID NO: 13539 - DNA, 347 bp, Gossypium hirsutum
  Clone ID: uC-gsflnu33B005h08b1
ttcacgcgtgcgtctgctgcatccaactcctaggatgatcctgctaaggaggctgcaaagttcactgctcaggatatcatcatgaaccatactggacaaatcggaaacggatatgcccgagtcctctgctgccacacctcacacattgctgataagtttgctgaactattgaccaagattgacaggcgatctggtcaggagctcgagaaggaacccaagctcttgaagaatggcgatgctggaatgattcagatgattcccaccaagcccatggttgtggagaccttttctgtgtacccacccttgggacgttttgctgtgagggacatgcatcagaccgaggcagt

SEQ ID NO: 13540 - DNA, 222 bp, Gossypium hirsutum
  Clone ID: uC-gsflnu33B005h09b1
ataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataataaaaaataatatatattaaatagagaaaaataaattaaaatggttgttcctctttaatacaactgtatgactgagacatccttggggaataccaaattattaaa

SEQ ID NO: 13541 - DNA, 510 bp, Gossypium hirsutum
  Clone ID: uC-gsflnu33B005h10b1
ttgaccatgatgctcaaaggcttgacgatggctttcacttcttcaaaaccaacatatttgacaaaaaccgagaatgtttcaagaaacttgcagaagatcagcatcccaagttcttggtgatttcatgctcggattcacgagtaagcccttcagtcgttttgaatttcaaaccaggagaagccttcgccggccgcaatattgctaatatggttcctcaatttgaccagttgagacacactgaaattggttcagtcatcgagtatgcagttaaagaacttcaggtggacaacatattgataatgggacatagccgttgtggtggcataaagaggcttatgagtcttccagatcaaactcaaacatatgacttcattgatgagtgggtgaaaattggtttgccagcaaagaaaaaggtactggaagaagctggtgacctgtgtcccgaacaacaaagaacgctttgcgaaaaggaatcagtgaagaactcgatgggaaatctactgacgtatc

SEQ ID NO: 13542 - DNA, 451 bp, Gossypium hirsutum
  Clone ID: uC-gsflnu33B005h11b1
ttcgaagaaaaaaagaagaagagagagccatgggtggaaacgacgatagattaagaacccgtgacaacatccctcccgctgacggtagtcgctacgctttgagtggcaaaatcatgctcagtgccatcgtggttttgctcttcgtagtggtacttatgtttggtctccacctttacgcacgttggtacctcctccgtgctcgccgtcgtcattcacgtaaccgacgtcgtcatcaccgtcgatcgcagctggttttttacgtagaccccgacgttaatggtcctcccgccgtggcttcacgtggactagacgcgcaggttctcaagtcgttaccggttttcactttctcctccgagacacacccggattctgccctcgaatgtgctgcttgtttgtcggaatttgaagaaaacgaatcgggtcgggtattacccaaatgttaacatagttt

SEQ ID NO: 13543 - DNA, 252 bp, Gossypium hirsutum
  Clone ID: uC-gsflnu33B005h12b1
gtaaaataaagctaaaagaaaatgcctgctgtaggtggaatcgggccgggtaccggcaaggaatacccgggtaatctcaccctatacgtccttgtcacctgtattgttgcagctatggggggtttgattttcggctgcgatattggaatctcatgtggggtgacgacgatgactccatttttgctgaattcctttccatgtgtctggatgaaataggaatcctacaagacgaacaacctgtactgtctattg

SEQ ID NO: 13544 - DNA, 510 bp, Gossypium hirsutum
  Clone ID: uC-gsflnu33B006a01b1
ttcacgcgtccgcggacgcgtgggcaaaatcccattgtgcattagccgctgcagagacccttcacccatgaaacaaatagcttctgacttttcaatctccaatccctattattttttgcgagttaatcggaccgatccgtcgttaccaagtccagactcatcaatatcaattatcttccatcaccgtcgcgatttctgtcgcgatttacaagttcttccactgcgcgtggtacctcttccatctagtatcgtggtccatcatacttccgtccttccaacaccaatccatgccccgttttattggcttcccttggtacatgtttgaactgcaaacttctaaacttggaggttctccccttgatttcttggatcaaacttcaatgcatgatctatcttcaactgcagcgattagtttcccaataacagtcaacgtatctctctcaacacatatgtcttggaaacccatttcttccgccatagtaacagcctataagcacgccctcgcctcag

SEQ ID NO: 13545 - DNA, 508 bp, Gossypium hirsutum
  Clone ID: uC-gsflnu33B006a02b1
ttgtactgatgtttctcaaggtcacatcccgaatcatgttggagagcccaagccgcagtctgttgaatacgatgaaaagtatttgtcttgctggagtgtacttgacattggcacgggaaatggtctgctccttcaggagctttctaagcaggggttcacagatttaactggaactgattatagtgaaggagcaattgaccttgctcgaaccctagctgatcgagatggattttcaaacatcaagtttctggttgatgatattcttgagacaaagttggatagacagtttcaacttgtcatggataagggggactctcgatgccattggcttgcatcctgatgggcctatcaaaaggattatgtattgagatttcagtttcaaaagttgttggcccccggtggaatattaggtgattacatcttgcaaccatacaaaagatgaattggtcaagaggtggaaaatttcaatcaaaggaacattgcaatatcccaggagccaagtgcaacg

SEQ ID NO: 13546 - DNA, 521 bp, Gossypium hirsutum
  unsure (1)..(521): unsure at all n locations
  Clone ID: uC-gsflnu33B006a03b1
ttagctcaagggaggaaaaagaacatggctccgaaatcacaaccggtcaacccaaatcccaacacgactatgaacgagatccgttaccgcggagtcagaaagcgtccatggggccgttacgcagctgagatccggaacccgagaaaaaaggcccgagtctggctcggtaccttcgacactgccgaggaagcagcgcgtgcttacgacgcggcggcacgagaattccgtggcgccaaggctaaaacaaatttcacctacactaacatcaatgacttcacgctaagccccagccagagcagcatccgtggagtcctcttcttcgccgccgttggacctcacactcgctagcggatctatttcgctccccatgacggcgaatatncgggtgtttttgttggatgtctttgcttccgccggtaagcgtctctccgatgccggcggagcccagagcgattcagattcctcgtcctcggttgttgattttgaacgaggggtgcaaccgagagtgtttgaatttgatc

SEQ ID NO: 13547 - DNA, 515 bp, Gossypium hirsutum
  unsure (1)..(515): unsure at all n locations
  Clone ID: uC-gsflnu33B006a04b1
ttttgacagctctctcagtctctcattttgcctgaaaaccatgtcgaggagaaaggttagggagcccaaggaggagaatactacccttgggccggctgtacgagacggcgaacatgttttcggggtggctcacatttttgcttcatttaatgacacatttattcatgtaacagatttgtctggaagggaaacaatggttcgcattacgggtggantgaaggtgaaagctgtgnggatgagtcttccccttatgccgccatgcttgcagcacaagatgtttctcaacgctgcaaggagttgggtattacagcccttcatataaagcttcgagctactggagggaacaaaaccaagacacctggtcctggtgcccagtcagcacttagagccctcgctcgttctggcatgaaaattggacgcatagggatgtcacccccattcccaccgatagtactcgtagaaagggtggcagacgcggaagaaggctgtgattctttgcttcatatctgctactc

SEQ ID NO: 13548 - DNA, 470 bp, Gossypium hirsutum
  Clone ID: uC-gsflnu33B006a05b1
atttgttcgcaacgatgccaagattttccgtttctgtagatcgaaatgccacaagaacttcaagatgaagaggaatccccgtaaagtaaaatggaccaaggcctataggcgtttgcatggaaaggacatgacacaggattcaacatttgagtttgagagaaaacgtaataggccggagagatatgatagaaaccttgcagagaatactctgaaggccattaaaaagattgataaaatcagatcagacagggcatctgaccacatcaaaaacaggcttaagacaggcaaagtccagaggcagaaagaagcaaggaagcaattggagcagggcaattacttggtcaaagctccgctcgcacttggccaagattcatctctttgtcttccaaaaatcaaagtcaatgtgtcccaagcacagacagaagagaatcagccctggaagagtgaaatgggtttgctggtcttcgctg

SEQ ID NO: 13549 - DNA, 471 bp, Gossypium hirsutum
  Clone ID: uC-gsflnu33B006a09b1
tccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggttttttggggtccccatttttctccccgggggtcgcccaattttattttttttttgggggcccaaaaataaaaattttggggcgggtttttaacacagtggggggggggaaaacccctgtgttcccaaataatatgcggttggagaaacttccttttcttccggggtgggatataaaaagagggctcccccccttttcctttttcaaaataggtgccctacatgaagggtatgggggcccccctctttttttatactttaacggggggg

SEQ ID NO: 13550 - DNA, 397 bp, Gossypium hirsutum
  Clone ID: uC-gsflnu33B006a10b1
ttcacgcgtccggctttttgttacctcgatttcaagtgaatcagaatgggtaaggaaaagactcacattaacattgtggttatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccacgaaatactactgtactgtgattgatgcacctggacaccgtgactttatcaagaatatgattactggtacgtcacaggctgactgtgctgttttgattattgatt

SEQ ID NO: 13551 - DNA, 169 bp, Gossypium hirsutum
  Clone ID: uC-gsflnu33B006a11b1
ataatgcaaaagaaaaaaagaaaaaataaaaggatgattttaaaaaaatacaaagaacaaccaaaaaaagaggaattcatgatcaactatgccgttccatgggctcttgactcttgcatggagctgccgtttgccggcattcaacacttgtatggtgtcgccctcgctc

SEQ ID NO: 13552 - DNA, 130 bp, Gossypium hirsutum
  Clone ID: uC-gsflnu33B006a12b1
acgaacacgcgcccgagcaaagggcagtaacaaagacgactgctaataagcaaaaagaaagtaagaatgacaaattaaagatgtaacaaaaagtatcaaacaaaaaaaggaaaaagggaacaacagaagg

SEQ ID NO: 13553 - DNA, 320 bp, Gossypium hirsutum
  Clone ID: uC-gsflnu33B006b06b1
ttcacgcgtacgtccacgcgtccgaccacgcgtgcgtccacgcgtgcgtattttttcactgaattcactttctcactcttcgatttagagcttccaatcaaaattacgtaaataaaaagccaaattttgtatccctaatttaaagaaaaatttgaattatttgctttaaaaaaaaatatagtcctccgccatagaatcttgtttgtgattcattgaatgtatattatttctatatactcacattctttgattacaagctctagggtatttcttttttttaaaattgttcacttttttttcttttaaactatcgttgattg

SEQ ID NO: 13554 - DNA, 478 bp, Gossypium hirsutum
  Clone ID: uC-gsflnu33B006b07b1
ttgtaggggagaacaaaaatgcggaggcagataaaattgttgatagatagattaaagaaaaggctgctaagcaatggaggcatcttgtgaaatctaataagacggatgtgtgttgctagacttatacatgatctatgggcgatcgcataatgggcgacgctatataaccaaattgtatcataattggcctataacatgttaataagctcgttccgttgtacatttgagagatatggtggcaatcctaacccgtgaaaacggggttgtgggagagcattaaaagcgtcgtgctgctaggcgaagcggtgaagtcccaacacatagagggtcgaggtgcagtatccgcaaggattactagcctacgctctgaccctagttgcatggggcacgtggaatcccgtgtgaatcagcaaggaccaccttgcaaggctaaatactcttgcgtgaccgatagcgaagtagtagtgcctaaattttt

SEQ ID NO: 13555 - DNA, 511 bp, Gossypium hirsutum
  Clone ID: uC-gsflnu33B006b09b1
tccacgcgtccgcccacgcgttcgcccacgcgtccgatttgagaccaccaaatactactgcactgtgattgatgcgcctggacaccgtgactttatcaagaacatgattactggtacctcgcaggctgactgtgctgttttgattattgattccaccactggtggttttgaggttggtatctccaaggatggttagactcgtgagcatgctttgcttgcttttacccttggtgtcaagcaaatgatttgctgttgcaacatgatggatgccattacccatcaatacttgcaggctaggaatgatgaaatcgtgaaggaagtttctttctactcgtagaaggttggaggcaaccctgttgagatttcggatcatacctattaatgcatgatctatcttcaactgcagcgattagtttcccaataacagtcaacgtatctctctaacacatatgtcttggaaacccatttctttcgccatagtatcagcctttaatcactctctcgtcttatc

SEQ ID NO: 13556 - DNA, 486 bp, Gossypium hirsutum
  Clone ID: uC-gsflnu33B006b10b1
tggacgcgtggggtaagatataagagcaaaatggaagctgttgtagcatcgaaaccagtgattaaagttgctgccatttgtgggtctttaaggaaagcctcttacaacagaggcttaattcgaaccgctttggagcttaccaaggagtccattgctgggattcaaatggaatacatagacatttcaccacttccaatgctggatacagatctggaagttgatggcaagtttccccctgcggttgaggctttcaggcagaagattttggaggctgatagcatccttattgcttcccctgaatacaactattctcttactgcgcctctgaagaatgcacttgactgggcttcaagaccaccaaatgtatgggcagataaagcggctgccatcgtaagcgccggaggaggctatggtggtgcgcgatcacattatcatcttcgccaagttggggttttccttgatctacatttcatcaataaacccgag

SEQ ID NO: 13557 - DNA, 456 bp, Gossypium hirsutum
  Clone ID: uC-gsflnu33B006b11b1
tgacgacatggggaggagacctgcatggtgttatcgccaaatcaagaacaagccatacccaaaatctcgatattgccgtggtgttccggatcctaagatcagaatttatgatgttgggatgaagaaaaaaggtgttgacgagttccctttctgtgtccatcttgtcagttgggagaaagagaatgtctcaagtgaggcgttggaggctgctcgcattgcctgcaacaagtacatggccaaatttgctggaaaggatgcgttccatttgagggtaagggttcatcccttccatgttctgcggatcaacaagatgctttcatgtgctggtgctgataggctttagactggaatgaggggtgcttttgggaagcctcagggaacatgtgcaagagttgacattggtcaggttctgctttcagttcgttgcaaggacagcaacagccaccatgcacagga

SEQ ID NO: 13558 - DNA, 474 bp, Gossypium hirsutum
  Clone ID: uC-gsflnu33B006b12b1
ttagcttgcagttcgtgtctcggaatgcgggttggctccattgttgtcttctggctctacaagcgagttctctggaagcctttttgtatcatacggttatgcagccccggaaatcgagttcggaagctatacttgccagagtgatgtctatagcacttggcgtcgtaatgttagaactgctcaccgggcgagaatccttcgataggtcacggcctctgggggagcaatttctcgttagatgggcaattcagcagcttcacgatatcgatgcattagttaggatggttgatatcaccctaaatggagtgtatccagtgaagtcattgtcacgctttgccgatataatatccagatgcgagcagtcgctgccgcccatcagaccgtcaatatccgaaatagttcaagaccgtatacacatgattaaaaggtggatcttatattcctaccggctgtacatagaagaatggatgatta

SEQ ID NO: 13559 - DNA, 441 bp, Gossypium hirsutum
  Clone ID: uC-gsflnu33B006c01b1
ttttcttgttttcacagtttcttcactcactggcccaagtctctcaggtgaacggagatggcaggaaaaggtggaaaggggcttttggcggcgaaaacaactgcagctaacaaggacaaggacaaggataaggacaagaagcgtccggtttctcgttcatctcgtgctggaattcagttcccagtgggtcgtatccaccgtcatctcaagtctagggcatctgcaaatgggagagttggggccacagcggctgtttacttggcctctattcttgaatacctgacagctgaggttcttgagttggctggaaacgcaagcaaggatctgaaagtgaaaagaatcaccccaaggcatctgcagctggctataggggggaattgaagagcttgataccctcatcaagggtaccattgtggaggtgggtgttatccttacatttac

SEQ ID NO: 13560 - DNA, 386 bp, Gossypium hirsutum
  unsure (1)..(386): unsure at all n locations
  Clone ID: uC-gsflnu33B006c02b1
tccacgcgtccgtgtctttgtgaagaacactctcccacctactgccgccttgatgtccgcgatttacgaggaaaacagggatgaggatggctttctttacatgacttacagtggagaaaacacatttggttcccctttacttttagcatgattcaatgcaatggaaaagcttatgtatatatagctcaaagaaaaggtgtaaattctatatggtgtttacttgtgtaaatgctttgccctttacgatggtgtttacttttaactgtctggacttggaaccttgtttttctgtaaatttaatgtctgaaactaactttatcactgnaaaaaaaaaaaaaaaaaaaaaaaaaaaaaaatagaaaaaagaaaataaaaaaataaaatgg

SEQ ID NO: 13561 - DNA, 396 bp, Gossypium hirsutum
  Clone ID: uC-gsflnu33B006c04b1
ttgtcccctctgcctatctctctttcctctgcacctgaccctatcaaagaaacccagctttccatctcggtaccagacgacgatgttttgaactccttcttcatcattttctctacttccccttcttcttctgctctccaatggctatccccgccgcaaacgtttaacaaaaaaacacccttttgtttatacccaatgccagtgtatccacgcgcgttatgtctttttaatttgtaaccaagattatcaaggtccctaaaggcttcgattatgagctttacaatagaacgacatcaacaggattttgggtcctaagtcttcttatatctctctcaaggattctgctcgtaggtgctcttggttcatgggttttctagacgaaattcttctttctat

SEQ ID NO: 13562 - DNA, 424 bp, Gossypium hirsutum
  unsure (1)..(424): unsure at all n locations
  Clone ID: uC-gsflnu33B006d01b1
atcagcgtggtggcttatggatacagttccagacatatgcgacagagaaatgcttccaacggacagcctctggacttgtcctggtgatcatgtgttttacgatgcctctgttatctggggtctgattggacctcgaagaatctttggtgatcttggctactactctgccataaactggtttttcttagttggggccatagctcctgtccttgtttggcttgcatctaaggcctttccaaacaagccatggataaaacttattactatgcctgtgctttttggtgcaacagtcaacatgccaccagctactgctgtcaactacaccagttgggttcttattgcctttgcatctggtttntgttgcttatagatattatcgtggctggtggagcccccataattatgtgctctctggggcacttga

SEQ ID NO: 13563 - DNA, 495 bp, Gossypium hirsutum
  unsure (1)..(495): unsure at all n locations
  Clone ID: uC-gsflnu33B006d02b1
tttgctctctttgttcttcgttctctttattcttcgctctacatttattcaaataaagataatgttgtaaagtatacaccagatcagattaggaaaatggaagaatcagataagattcgaagagctagtgaacctatagagcttgttaaattgattaagcgaataaagcatgaattttcaagtgatgaatcgttggccgaattgccacgggcggttaagcataagataactgatgaaatcttacagagattgagaagtttgagaccaaatgccagtatcagtgaccagcaagaagcggttgaaacctggcgcaaggagaaactaaaagaagccaaaacgttggccctcggaggagaggggttgaattcaactcttttgcaagaggaagagnggatgttagtaaaagccttgcagtccaattgggctgcactatcggaagaaatcggcctctggatacccactgaagtcattaatcaagaacatgatgataagcct

SEQ ID NO: 13564 - DNA, 316 bp, Gossypium hirsutum
  Clone ID: uC-gsflnu33B006d05b1
ttattttggagtattggtcagatttttcccatagtccccattcatcgattggatgaaaggcctgaagtgagggggattttgtctgatttaacctgtgacagtgatgggaagattgataagttcatcggaggtgaaacaagcttgcctttacatgggttggaaggtaatggtggtggtagcagtggtggtgctaatgggcggtactatttggggatgttacttgcgtggggcttaccacccaatgcctgggtggagtctacaacctctttggggggacatgtgtcagtagcgagtttgacagtgacggtacatatgg

SEQ ID NO: 13565 - DNA, 295 bp, Gossypium hirsutum
  Clone ID: uC-gsflnu33B006d09b1
ttcaatcccaaactacactttcggttgcctgcaaaagacagcaggcagctcagtgccaccacaaggtgtattgggcttgggccggggcccattatccctcctttcccaatcccaaaatttgtaccaatcaacattttcatattgcttgcctagcattaggtcacctaacttttctgggtcattgagacttggaccaagtgggcaacccgtgaggatcaaatacacctcgttgcttaagaaccctaggaggccctcactttattacgtcaatttgattggaattagggttggaaga

SEQ ID NO: 13566 - DNA, 338 bp, Gossypium hirsutum
  Clone ID: uC-gsflnu33B006e01b1
ttagtcttaccattttcttaaattctcaacagcatcgattttgtgtttctgttgatcatcagtggtggcttgccggctttgcaaggatggtttgtcaggctactatattttactaaatttattgaatgacagttgatattgtttcaggttttagacgtttttgtatgttcatttatttagccagtagagcgagcttactatcaagaaaataaattacccaaggtgtgagttaatttaacaaataaaatgaaagaatatatatttatattttaaagctatatggtgcaacagtcaacatgccaccagctactgctgtcaactacaccaaatggaatctg

SEQ ID NO: 13567 - DNA, 464 bp, Gossypium hirsutum
  Clone ID: uC-gsflnu33B006e03b1
ttcttaatgagctttcagtgattaatcttcgaagattatttgctaacaagggttctactttcatggaccggcaaaagcagatcatagagaagactcctccgaaaaggaagcttacagttgataccatcttctgaatcattttcaccttcctttcatttcaaagttgtccctgtattttaagcgagagcgcagtttaggagatagttgtatgagccatgagtacatagttgcatgatccatgttactcttcattttcatggtatggagatacatacatgtatctggggctgagtccgagtaacataggttcacagtttactttaaaatttgatttagttaggaaaatgttgccccatatatcattcaactgattgtacagcagattgagttgtcatcatgtgaacttcacaatatacagaaactgttggagcagacgaatctttggacaatttcggatggccatt

SEQ ID NO: 13568 - DNA, 369 bp, Gossypium hirsutum
  Clone ID: uC-gsflnu33B006e04b1
tcattcttcagcatcacattaacagctcaggtggacattctcgagtccatcctcccccacgcctacaatcccttctatcaagtttataccacgttaacccaagattatttggtgcttgagcagcctgcttttttcaaggcacttatgacgttggaacttgtttaccaactccctttcgctttgcttaacatctatgggttgttatactctaagccctggttcaacaccacctgcctcctgtttggtgcctctatcgttgcctctacgacagctatggtgggagacattttcaattcccagaaggcatcagccaatttgatggccatgtattatccaccgttttttccattaggggtttctggctattgt

SEQ ID NO: 13569 - DNA, 339 bp, Gossypium hirsutum
  Clone ID: uC-gsflnu33B006e05b1
tcagtaccaggagcaacagtagttcagatgacgaatcttaagcctttgagaagaagtcaaatgaagaaacctgtaatcttggttctgatgcggactcgtatagtaccgaggataagtcagctactgttttgtctgaagaagttctgacggctgctgaaaataacacacttaagaatgttgatagtaattctgcagtggagactgttgctgatgacaatttggtaaagaacatgtcacttgtgccagaggaggtggaattttctgcaaagagttcagtacctgatgtggttgaatcagggatgaaggataatgaagagacataattgtcttcatcaaatg

SEQ ID NO: 13570 - DNA, 94 bp, Gossypium hirsutum
  Clone ID: uC-gsflnu33B006e10b1
tccacgcgtacgttcaaaagccgaatcatgggaagaatgacctacacaactcggataacgactcacacagtgttcgtgaatactatccaaccaa

SEQ ID NO: 13571 - DNA, 266 bp, Gossypium hirsutum
  Clone ID: uC-gsflnu33B006e11b1
tccttatttgcgtataacggtgtgcttaatgtggaaggtgcttaaatgacagtgagtatgaggagaacttttgttaggagatactttgttcagattgatcatagccacatctgccgtagtgcgttgtgcgtcagcatggaatgattgccatggcgagatcgcaaactttctactttgctacccacctatatttccatggctcgactgaaatattttacccttatactgtttctctatcaccccttcaatgtattgtctttgatttt

SEQ ID NO: 13572 - DNA, 360 bp, Gossypium hirsutum
  Clone ID: uC-gsflnu33B006f04b1
tccacgcgtacgtccacgcgttcgatcgtattgaacgctcttgagagcaagtacaagccaagctatagaggggatggagaagaggaaaagagatcgtgcttaacggattacattacacgtcttgaaagcaaatacaagccgggttatggagggaacgatgttgaggtaaagactgctaacgattcattcattaccaccgattacatgagatacatcgtgaaatactatagcgttcacggataatggaagcaccatgatcttaaggtcaaagactctaaaacccttctctttggtgaaaaacccgtcactgttttcggaatcaggaaccctgaggagattttcatgggctgaagccgcggc

SEQ ID NO: 13573 - DNA, 473 bp, Gossypium hirsutum
  unsure (1)..(473): unsure at all n locations
  Clone ID: uC-gsflnu33B006f05b1
ttaatccccaagatgaacaatctgttctcaggctccttctctcgctttcggagcgaagaggcgtnccctgatcaccatgtaatcgagatgactcagtcttcctccacctctggcggtgttaacctcgacaagttcttcgaagacgtcgagtccatcaaagacgagctcaaagaactcgagaggctaaaccacgacctttcatcgtctcacgagcgaagcaagacgttgcacaatgcgaaagccgtgaaagaattgagagcaaagatggatgctgatgtagccatggccttgaaaaaggccaagctattaggtagggttgggaaggcgcttgaccgctccaacgcctctaccgggagtttcttgggctgtggacccgggttcttcttcggacaggacggggcnntcggttgtgaacgggctgaaaaagaagttgaaggattctaatgggagttttaatgggttgagggaaaaga

SEQ ID NO: 13574 - DNA, 394 bp, Gossypium hirsutum
  Clone ID: uC-gsflnu33B006f09b1
tccacgcgtccgcccacgcgtccgctcactcaacattcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgacgtcaccttcggtgcttttcgttggcgggaacatcactttcttgcgcgggattctttactggatc

SEQ ID NO: 13575 - DNA, 521 bp, Gossypium hirsutum
  unsure (1)..(521): unsure at all n locations
  Clone ID: uC-gsflnu33B006f10b1
tccacgcgtccgtgcttagcttaaaaaatcttgaatctgcactctcctacttccctcgttatcgtcaatggcttcggacaagaagattaagatcgggattaacggatttggaagaatcggacgtttagttgccagagttgctcttcagaggaacgatgttgaactcgtcgccgttaacgatcccttcatttccaccgattacatgacatacatgttcaaatacgacagcgttcacggtcaatggaagcaccatgatcttaaggtcaaagactctaaaaccctcctcttcggcgaaaaacccgtcactgttttcggaatcaggaaccctgaggagattccatgggctgaagccgnggctgatttcgttgttgagtcaactggagtgttcactgacaaagacaaggctgctgctcacttgaggggtggtgctaaaaagttgtgatctctgccctagcaaagatgcacccatgtttgaatgggtgtaaacgagaaagactacaagccagagcttgacattgttt

SEQ ID NO: 13576 - DNA, 477 bp, Gossypium hirsutum
  Clone ID: uC-gsflnu33B006f12b1
ttaccattggatccttccctcaaaccttggagctcaggagagttcgtcgtgaattcaaggctaacaagatctctgaggatgattacattaaagccattaaggaggaaattaagaaggttgttgaccttcaggaagagcttgacattgatgtcttggttcatggagagcctgagagaaacgatatggttgagtactttggtgagcagttgtctggttttgcattcactgttaatggatgggtgcaatcttacggatctcgatgtgtcaagccaccaatcatctacgttgatgttagccgccccaagccaatgactgttttttggtcatctactgcacaaagcatgactgcacgcccaatgaagggaatgcttactgggcccgttaccatcctcaactggtcctttgtcagaaatgatcagccccggtttgagacttgctaccagattgccttggccatcaaggacgaagtggaggatc

SEQ ID NO: 13577 - DNA, 368 bp, Gossypium hirsutum
  Clone ID: uC-gsflnu33B006g03b1
ctcacgcgtacgcgtacagctagggcagatgaggaggttgatgaaatgatccgtgaagccgatgttgatggtgacgggcagatcaactatgaggaggttgttaaagtcatgatggccaagtaactttatcaccaaccataaagatgaaccaaacattgatattaaagggaacagggcagataagttcgctaagacttatatctctgaataggaacatccatgcttttaaattatgagcttttgttgttgatttgtatctgttttcgtttgaattattgcggaaccttagtgtcatactcatttgctctgttttttgtttaatatttcgggttgtcaaagcttacactattttttttttctttttttaa

SEQ ID NO: 13578 - DNA, 262 bp, Gossypium hirsutum
  Clone ID: uC-gsflnu33B006g05b1
tcaggacctccacataccacagagcataaggtcgatcatatgcctcaacttgcccagcttttctggtggtctaaatccttggggaacaccaagtggcagaaaaaagaatgaaagagacttgactgcaccttatgtagatgatggccttctggaagttgttggttctagagatgcatggtatgggctcgtgttgctggcttcaaagggacatggaactcgcctggcacaggcacaccgaatccgttttgagtattacacaggt

SEQ ID NO: 13579 - DNA, 133 bp, Gossypium hirsutum
  Clone ID: uC-gsflnu33B006g10b1
tcctgcctggggagttggccaagcacgctgtttccgaagggactaaggctgttactaagttcactagttcttagtttccgtaagtctaaaatgtcaaagaattgtagttttgtataatttattttatttgaga

SEQ ID NO: 13580 - DNA, 332 bp, Gossypium hirsutum
  Clone ID: uC-gsflnu33B006g11b1
tccacgcgtacgtacaggatggagattgaggcgattgttatgtcgtttacggggaatcaggttgatactggctattgtaaagtggagggtatggggcactttccagattggggccgtcggccctttatgggcacgatagggtctcttgacagacaactacgagctctgcataggatgcaacctcaagaaatttaactggtactggataaacatctacgggtacgggagaaccctgtggttctccaagaaaatcgacttgagatgcatcgacttttacacactctactgcatagacaagctgaccgctacaagggtcagggacaacagctggg

SEQ ID NO: 13581 - DNA, 177 bp, Gossypium hirsutum
  Clone ID: uC-gsflnu33B006h05b1
cgccaaaggaggcaagaacccagaatggaatcacgtgtttgagttcgacctcgaaagcttaccccccgaggaatccgatcatcttttcctcaagttcgatttgcgtgcggatggcttggtcaatagaacaatcggcgaggtgcgtgttcctttgaaggctttgatagatgatttttg

SEQ ID NO: 13582 - DNA, 424 bp, Gossypium hirsutum
  Clone ID: uC-gsflnu33B006h06b1
atctgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcagtggagggaagtattcgcaagagctcaatgaaatttctacactataggcgataatgcgtttactga

SEQ ID NO: 13583 - DNA, 452 bp, Gossypium hirsutum
  Clone ID: uC-gsflnu33B006h08b1
tcacgcgttcgtccacgcgtgcggaagatttgtaaaaatccctataaccatgagtattagacgatgaccatggacgagtgtggaacatgaccaaagaggggacgggatacgcacagtttacagtgtattcggcaaaaccgtcatatttacacaccaccatgtgatttgtatttgctacagaaatgggaatggatagaatacgctttgtcgtcccttcatcagacgttaacaataaaaattttgttataaaaaagtctttttttgggttggttccacaatcaaggccacacgtgctactctctatcacttttggctcctaaaaacagactcttatacaactttgcttagctttctttttatttctgtgcgggtttttatatgggctgtttctattttaacaacaacatttttttatctgggaattgctattttggattccttgactccctttt

SEQ ID NO: 13584 - DNA, 458 bp, Gossypium hirsutum
  Clone ID: uC-gsflnu33B006h11b1
tccacgcgtccgcccacgcgtccggccagtggtggaaccggagaagaagaggaacacagagggcatcactaggtacttagagaaggtgccgtattagtgtgcactcgttgtgcccggggtcgaccagcaggcttcaatagcaggcccagaccacccatctttgtcaccagtgatagccctaatgcactgaggagtcacgttatggaaatagctaatggttctgatgtagttgagaccctagctcactttgctaggaggagacatagaggagtttcagttcttagtgggagtggtaccgtcactaacgttacatgtcagacagccttgagctcctgttgcaatgatggctcttatggtaggttcgagattttgattttaactgttgcgtttgtgactggaccagcttttacagggtcaatcgggcttactatatacctagctgtgggttaaggacaggt

SEQ ID NO: 13585 - DNA, 508 bp, Gossypium hirsutum
  Clone ID: uC-gsflnu33B008a04b1
ttaaactggtgtggagcctttagcattgatgtcacaacttgctacagtgataaccgatgttcttgctggcagttatgatttctcccaagaaaggcgcagaaggaagttctttcgacggcagccattgtccaaagaagatatggagaaactacgacaagcattgaaaacgttatctgaggctgaaaaacaactgaggatgtcaaatgacaaattaacatggttaacggcagctttgcttcagcttgctcctgatcagcagtatatattgcctatttcttcttctggtactagttctcgtcatagtccattgcctctaaatgacttgggtggaagagaaattgtccataaaggtggtgagcttgtcgagctgcgtaataacaacactagagtgttgtcaacgaatgctaggcctgaaaatctctatgccggaagttcaggggattttgaaaccagtatcatgaaggggaagagacatgctttagctgggatggctcctcaaagtgttgca

SEQ ID NO: 13586 - DNA, 411 bp, Gossypium hirsutum
  Clone ID: uC-gsflnu33B008a11b1
tgatttctcccttccttctttgctagggcgcaaatggatcagccccgccgctaatccatctcgaacgtgaataacagtggctggagaagcgcataatgtgcctccaccaccgtcgcggtttcaaccagacccacaaggatctgtcaaccttcgaccggaggagccaacgtcgaccaaatcgacaccaaaacagtacgtggtggtgtacagaggtggtacggttgtgtcgacgtggaggcgtgagcgatggtagtgctggaggatgctggaggctgctgcggcgccaaacaaatgaggctagggttagggttcccaagaactgtcaaaggattgggcctatcgggctctattagttgtggggccattgagtattgggctaggattaatttggtttttaggttttatatttgg

SEQ ID NO: 13587 - DNA, 75 bp, Gossypium hirsutum
  Clone ID: uC-gsflnu33B008a12b1
tccacacgaacgaccgaccgtaattgaacacggacggtttaagcaatcgcggcgaactcaccaagtggggataac

SEQ ID NO: 13588 - DNA, 500 bp, Gossypium hirsutum
  Clone ID: uC-gsflnu33B008b01b1
ttcacgcgtccgcaatttttgtaggagaggcttccaaacgatcccgttgtccggcggcgcctcccctgccaagatgtcaacggagttctattcgttcgggccatataagatagaccccaaggaagtcttctactccacccccctttcctatgccatggtcaacctccgtcctgttgttcctggtcatgtacttgtctgcccaaggcgtgaagttaagcgatttgctgatctcactgttgaagagacccaagatttatggctaacagctcagaagattggtggaagacttgagtgcttccataaggcgtcatcactcacttttaccatccaagatgggccaaaggcagggcagacagttccccatgttcacattcatatacttccaaggaaagatggtgactttgagaggaatgatgaaatttatgatgaaatagatgtgaaagagaacgaactgaaggaaaagctcaacttagataaagaaaggaaggacagaagcctgg

SEQ ID NO: 13589 - DNA, 515 bp, Gossypium hirsutum
  Clone ID: uC-gsflnu33B008b02b1
gaccaagcggtcggtcacgcgttcgattatgttccttactttacattccttttgctatggcaggaactggggtggtcgctgtttatgggaacggcgcaatagctgaaacccacaaatcccctttctccgtcaaggttggcctagcccaaatgctccgtggcggggtgattatggatgtcgtcacccctgaccaagctcgcatcgctgaagaagctggagcctgcgccgtcatggctcttgaacgagtccccgccgacatccgagcccaaggtggcgtggcgcggatgagtgacccacaactcatcaaagaaattaagcaagctgtcaccattcccgtcatggccaaggctcgtattggccatttcgttgaggcccagatccttgaagccattggcatcgactatgttgacgagagcgaagtccttaccctcgccgacgaagaaaaccacattaacaaacatagttttcggattcctttcgtctgtgggtgccggaatttgggggaagcgctccgg

SEQ ID NO: 13590 - DNA, 456 bp, Gossypium hirsutum
  Clone ID: uC-gsflnu33B008b05b1
gtagcttcaaacgccaccaggtaaggactgactctagagtgagtaacaatggttgagaaaacaagaggaagaaaggaagaggtggtaaccagagagtacaccattaaccttaacaagcgcattcatgggtgcacattcaagaagaaagctgccaaggctatcaaggagatcaggaagtttgcagaaaaagccatggggacaaaggatgtgagagttgatgtgaagctgaacaagcacatctggagcagagggatccgaagtgtcccgagacggattagggttcgcatcgatggcaagagaaatgacgaggaagatgccaaggaggagctttactctctagtaacgggtgctgaaatctcagctgaaggattgaagggattaggcaccaaggacattgatgactatgaggaataatttatatctgtctcttgcttacttgcattttgttctactaca

SEQ ID NO: 13591 - DNA, 483 bp, Gossypium hirsutum
  Clone ID: uC-gsflnu33B008b07b1
tgtgatgattcagaaagggataaaggaaattcctgagttgttcatcattgggaacccagacatgacaattgtggcatttggatctgctgttctggacatatttgaagtcaatgatatcatgtctggtaaaggttggcatttaaatgcattgcagaggcccaacagcattcatatctgtgtcactcttcaacatgtaccagtagttgatgccttcctccaggatttgagggaagccgtacaaactgtgaaagaaaacccagggccgataagtggaggtctagcacccatatacggtgcagcagggaggatgccagatcgcggcatggctcaagatttgttggtaaattacatggatggttcatgctagtgcccaaatagagccgatgaaggctgattttagatccgtatgattggctcttcccggaatcaagtgcaatgtctttgagttttgcgtctcggctcattattaccttgctatcccac

SEQ ID NO: 13592 - DNA, 483 bp, Gossypium hirsutum
  Clone ID: uC-gsflnu33B008b08b1
tccacgcgtccgctccggttcacacattagcaagtggaatggggttccttcaaggtgttatatgggagattattctcacattcgcattgctgttcacagtgtatgccaccatagtagaccccaagaaaggttccatcgatgggctaggtccaatgctcactggcttcgtcgttggggccaacatcttagccggtggagctttctcgggtgcttcaatgaatccggctcggtcattcggaccggctctagtgagctggaactggaccgatcactgggtttactgggtgggacccctaatcggaggtggccttgctggctacatatatgagaacttcttcatcgacagaacccatgttctccttccccagaatgaagccttttaagcttttaatttcagtaacattagaatagccgctctgtgtgtgactttctatgtatcaactttttagtgtggttgttttctccactatagagctcatctat

SEQ ID NO: 13593 - DNA, 507 bp, Gossypium hirsutum
  Clone ID: uC-gsflnu33B008b12b1
tcttctggaagtaatcttgagcagactatccaacaattgattgatatgggtggtggcagctgggacaaagaaacagtaactcgtgcacttcgagctgcttataacaaccccgagcgagcagtgtattatctatattctggaattcctgaattggcagaagtggctgttccagtgcctcattttccttcaagtcaaaccactgaatccggtgctgccccagttgctcctgtttcaggggctcctaattcatcacctttgaacatgtttcctcaggaaacactctccggtgccgatgctggaggacttggatccctggatttcctccgaaacaatcaacagttccaagcattgcgttcaatggtgcaatctaacccacaaattttacagcccatgctttaggagctgggaaagcaaaacccccagcttttaagactaattcaagaacatcatgccgagtttcttcagctaataaatgaacctttccaggttcttaaggggatttatttg

SEQ ID NO: 13594 - DNA, 495 bp, Gossypium hirsutum
  Clone ID: uC-gsflnu33B008c01b1
tttaaacatctacacacagtgaaattagagtaattgagaaaaacgcaatggctcaaaagatgttgatgatggcggtccttgtgatattggggacgaagatagcgacagttacggttgcggatccgacttgcttgcacagcttgaagtcttgcgctccttacttcaaaaacgccactctccaactgaaaggagattgctgtgaccctctcagaaaaactgtcgctactaaacttacttgcctttgcagcctcattaacaactctactttgcttagttctttcaacatccccatcgctgcagctcttaggatcactcgtggctgcggtgtcactgatcagatgaaaggctgcatctccgctactcccacacctgctccttccccatgagctaattctcccaaagctgctccactcattaccaggaggtgaaagtggaggtgtcaacaagaaaactttgaccagaatcaccaatttgttcttttttttttaaagcatc

SEQ ID NO: 13595 - DNA, 308 bp, Gossypium hirsutum
  Clone ID: uC-gsflnu33B008c02b1
atagtatagacgaggatgccgagattggaccttattcaggattggcaattagcttatgttgaagggctcaaaaaagctggacaagaggttaaacttttatacatggaacaggccacgattggtttcttattgttgccgaatagcaatcacttccatactgttacggacgagataaccaagttcgtgagttctgactgtattaaaacaataggggaaagaatcatgcaatgtatcggagctctattatgcgtagattatgtatgtttattcaaatgttttttaggataagatggaattattaatattat

SEQ ID NO: 13596 - DNA, 376 bp, Gossypium hirsutum
  Clone ID: uC-gsflnu33B008c11b1
ttgtaagggtacccaaaaagactgaagactatttcatcatttattcacattcttcaatcttcagctatagacgaagaaaaaaagaaaagatgaatcaaaacatgagctctttgttgatcggaatagttggagcagcagtgactttatcagcatattcgcagactttcatctccccgactcagtgtgtcactgttggtctcctcgttctcatgtttggtttgctcgtcagggaaggcctcatctctctctaatcttctttttttcttccatggaattgagaatcccagatttgcagtttgacttgtttcaatcttatattatgatgttcttctttagcaagactgagatttatatatatatatacgtatatatatgt

SEQ ID NO: 13597 - DNA, 503 bp, Gossypium hirsutum
  Clone ID: uC-gsflnu33B008c12b1
ttttatcgtttgtgagggagttttttcaaggtattgattacgagttggaagaaggggctgcgaggtactttgtcaatgttctcctaaactatcttgttctgatggggcagataaacagagctcgctgtgtttggaaggttgcctacgagaataagcttttcccgaaggcaatagttttcgatcagcatattgcttggtcacttgacgttagaaatttgtcggtgggagctgctcttatagctgttgtgcacaccctccatagatttaggaaaagaatgttgtattatggagtggtaccgaggcgtatcaaattggttacaggacccactctgaagatcgtggttgcacagatgctgagctctgtagaatccccatttgaagttagtaaggtggttttaagggccaccggagactctgttatgtagtggttcaaaaaaccgattgttcagcagtttcttttgaatgagattccatcaagagctgacatccttatgcacaagctg

SEQ ID NO: 13598 - DNA, 507 bp, Gossypium hirsutum
  unsure (1)..(507): unsure at all n locations
  Clone ID: uC-gsflnu33B008d02b1
tttcacgcgtccgcccacgcgtccgtagaaagcctaaaattttaaagtttcagtatatatattttttctttgcgtctcaatttcaatctccaaaatggcaccccaagctgaattgcaacaagaagaaatcatttatcgttcaaagcttcctgatatttatatccccaaccacctccctttacattcgtattgtttccagaacatagcgaacgtcgcctccaggccctgtttgattaatgggacgacaggtaaagtttatacttacgctgaagttgagctcaccgctcgaagaattgcctctgggctcaacaagctcggcatccaacaacgccaagtgatcatgctcttgttacccaacaccccggagttcgtcttgtcgttcctcggcgcttccttccgtggcgccattgccacggctgccaacccttttttcactcgggcggaagtttcaaagcatgcgaaaggctccaacgcgaggctcattatcacgcangccagttacgttga

SEQ ID NO: 13599 - DNA, 69 bp, Gossypium hirsutum
  Clone ID: uC-gsflnu33B008d05b1
ctcacgcgtccggatcgacagccttggtgttgatgtatttacatacgatgcctcatcttctataagtca

SEQ ID NO: 13600 - DNA, 432 bp, Gossypium hirsutum
  Clone ID: uC-gsflnu33B008d11b1
tctcacgcgtccggagaaagagaaaccctagccagtcatagccacccacaaccacaagattcaacccaaatcaaaacacacagagctcggcagaaatctgctgtgttttagggtttgagttgcaaaggtctcaagaaaaaaatggaagaaatcacccaaggagtcaacaacatcaacttggccgccgattcccacaagaagaaccggattcaagtctccaataccaaaaagcccttgtttttctacgttaatctcgccaagagatatatgcaacagtacaatgaggtggaagttgtctgcccttgacatggctattgcgacggtctgtacgattgtagaaattttgaaaaaccatggtttggctgttgtgaagaatatctcaaccccaacttgttgcatgatggaggactttagcggttttctcggtccaat

SEQ ID NO: 13601 - DNA, 292 bp, Gossypium hirsutum
  unsure (1)..(292): unsure at all n locations
  Clone ID: uC-gsflnu33B008e02b1
ctcacgcgtccgggaagccactgtcaatagaggaagtggaagtggcaccaccgcagaaggatgaagtccgtattaagatactcttcacttctttatgtcacaccgatgtctacttctgggatgctaagggacaaaaccctctgtttcctcgcatactaggtcatgaagctggagggattgtggagagtgtaggtgngnnggggtgactgatctaaagccaggtgatcatgtcccttcccatcctacacggcgtgaatgctaggagtgctacccattgcttgtcactacgata

SEQ ID NO: 13602 - DNA, 488 bp, Gossypium hirsutum
  Clone ID: uC-gsflnu33B008e04b1
tcacgcgtccgctttcaaaccctaaaagaacactcatttaaacataatcaacccccccacccaaaaagctatgagagtccccgtttcttctccacaaagcaaccattgccaaagccctaaacctaacaacaatagtaacactagtagtactaggaacataagtttccatggtgctactattaacagtgtttcaacttcgtgttatgagcctacttcggttcttgaactccggcgaagcccgagtcccgggcatgataatccggtggatcatcatcagcatcaacaacagcagcagcagcatcaagctccacttgagtgggatgaacatgtgttacgaaacatggattgcgattccatcatgaaagatttgggattagacgatgaattagtacccgtcattaaaactttttcaccacaagagaaccatattcagaacctcccttgagatacttcctggagttaactcccccacctgattttacaatctt

SEQ ID NO: 13603 - DNA, 288 bp, Gossypium hirsutum
  Clone ID: uC-gsflnu33B008e07b1
gagaagttctcatcctcattcgatatgcctggcttcaagatgtccgaaatgaagtacaaggattagatctaaataaccatacgatctaattgatgttattatcagcatctgccactttttgggttgcccccatttgatgtcttatgagtgaaaggaaaaagaaagggaaaagagaaggatgcaaatgccttccacgtacggttttaagcgtcttcatttactggtcaatttgatatgatctttgttaagctttttgctgctctgtctttataagagttttgcttataa

SEQ ID NO: 13604 - DNA, 134 bp, Gossypium hirsutum
  Clone ID: uC-gsflnu33B008e08b1
tccacgcgtccgcccacgcgtacgcccacgcgtccgtccacgcgtccgggctgacggcaacgttagggagttcggagacgtctgtgggggccttggcaagagttatattttctgcttaacggcctgcccacctt

SEQ ID NO: 13605 - DNA, 502 bp, Gossypium hirsutum
  Clone ID: uC-gsflnu33B008e11b1
tttgtatcttctcttcagagtagttcccagattcaatctccagcttcaactcaggcagtatcgctttcccctctaacaccatctacgccaataactcctatgtcattacatcagcaacaaaaaaaccacttggtgcctcgtgggcttggtaggagttcccgacctggtgctagtgggttgaacaatcagataggccagcaacaacagcggcagcttcaacaacagcagtttcaacaatctggaaggcaccaccctcagcaacggcaacaaacacaatctcagcagcaagctaaacttttgaagggagcagggagggggaacatgcaggtgcatcagaacctttctgttgatccttctcctctgaatggccttagcatggcctctagcaaccaagctgctgagaaaggagagcagatgatgcacttaatgcaaggtcagggcctgtattctgggtctgttatgagccctgtccaaccatctaaaccttcagtttcttctcagt

SEQ ID NO: 13606 - DNA, 452 bp, Gossypium hirsutum
  Clone ID: uC-gsflnu33B008f02b1
ttattgatgacaaaacatgtgaggagaggctttggaacatgaagcatcgtggagaaaccaatttctacttatgtgaaatcaatcgtgatatggtaattgatgccacatacaaggggaacaaatccagatatataaaccatagttgctgccccaatactgagatgcagaaatggataattgatggtgaaacaaggattggcatatttgcaatgcgagatataaaaaagggggagcatctgacctatgattatcagtttgttcaatttggtgcagatcaagattgtcactgtggttccgctggctgcaggcaaaaacttggggtcaaacctagcaagtcgaagatgtcatcagatgctacattaaagctagtagcatgccaagtggcagtgtccttttcaacattgaaagctgtgctatttggaaaagaaaatggaggtttgcctgtcgggact

SEQ ID NO: 13607 - DNA, 392 bp, Gossypium hirsutum
  Clone ID: uC-gsflnu33B008f03b1
ctaagaagaagaatcagctttgcttcctttttgctgggtgtctatttacatggcagctcacattgccacagcaatgaagcccaagaacaataacagcaacagtaacaacaacagcaactgttgcagcaatggctacagcagcgatgtcagtaacgggagcgacaacaactctcgaagcccacctccatcgccaccgaagcctcgtcttactctgtccctgtcgcagtgccgccgtcggctgcgttccaagaccaagtccttcgtccgccgtgaaaaccttggttccggcctgaacttccggcgtaatctccgttacttgttgctgctgccactttcgtacatttccggcttgttaatgtgtggcgggcccgttttcatgaattttgagaatt

SEQ ID NO: 13608 - DNA, 65 bp, Gossypium hirsutum
  Clone ID: uC-gsflnu33B008f05b1
gtcatacgaacgcccacacgtacgaacacacggtccttttttaaacacccaaccaaacaacctat

SEQ ID NO: 13609 - DNA, 387 bp, Gossypium hirsutum
  Clone ID: uC-gsflnu33B008f11b1
tgccatcactggccgctcaagtggcaactggtgtatatgcaaagatggtgtaagtgatacagtattgcagaagacactggactatgcatgtggtgcaggcgccgactgtaaccctatccacttgaagggatcctgttttaaccccgacactgttaaggctcattgcagttacgccgttaacagttactttcaaagaaaaggccaagctcaaggcacttgcgatttttccggcactgctaccgttaccaccgctgaccccagctacactggctgtgctttcccatctagtgccagtaccgtatgcacccaccacaacactcacatccatacttttatccaccatacccttgttctggatcccaattaacatcacctcaacaagtacaa

SEQ ID NO: 13610 - DNA, 369 bp, Gossypium hirsutum
  Clone ID: uC-gsflnu33B008f12b1
tctgtaaaccacggccctctataatactcttacacacatagaatctcacttttttgttttctggacttctttgacgaaaataggaactcttagaaatggcgatgaaaagcttcagcgttttcttcttcgttctactcctcctcgcttctcctattctccaagttgctaggtgtcaatctgaagcggaggcagatgttgcagaagctgttgaagaaggtgaacttgggattgttggtgaggaagctcaggatttcggttctgggaattttgactcggctccaggagttgaaactctctgtcttttccctaaaaacagtgccaaatttatatcagccggagaagagactgaactccttgttggggtggaaa

SEQ ID NO: 13611 - DNA, 373 bp, Gossypium hirsutum
  Clone ID: uC-gsflnu33B008g01b1
tcacgcgtccggcaaccacaagacaacaatattaaattttgggttcagtttgatcagctattctgtgctgcccttcttcttcttcttcttcttcaaacaagcaaaaaaacaagaggaaaaaaatgggtggagaaagaaaggtctacactttggctgaggtttctcaacacaaccatgctaaagactgttggcttgtcattgagggcaaggtatttgatgtgactaaattcttggaggaccaccctggtggtgatgatgtcttgctgtcttccacagggaaggatgcaactgatgattttgaagatgttggtcatagtagcagtgctcgagcaatgatggatgagttttatgggggtgacatcgatacatcgac

SEQ ID NO: 13612 - DNA, 518 bp, Gossypium hirsutum
  Clone ID: uC-gsflnu33B008g02b1
ttttacgcgtccgccaggccacctaaggtcaccaatcttcacttctttatgcacgaacatacgggtgttacagcagtcgtgctaacccaagctaacatcacaagcaataattcatcaatgccatttgccaccctagttgccgttaatgatcccctcaggactggtcctgagcctgactcagaggtgattggaaatgttcagggtatttccctcttagccggatcaaatgcatcgagcacgcagtacatagaatttggatttaataccggtaagtttaacggcagctctctaagcgtattttcaaggggagaaccagggcttgcggtggtcggaggaagaggacgattcatgatggcaacagggactgcactatttaaccctatccttataaatgccaccaatgtcattatggaatttaactttactgtagttcattactaagatgttatttacagactcagttctcttgtattgtgaaaaagtcatatgattctgctccacttggatagaataaatgg

SEQ ID NO: 13613 - DNA, 69 bp, Gossypium hirsutum
  Clone ID: uC-gsflnu33B008g03b1
gtacatcaatttgggggctgcaacatgggctagggtatcggtgtggcttttgataggggtgcttgtata

SEQ ID NO: 13614 - DNA, 420 bp, Gossypium hirsutum
  Clone ID: uC-gsflnu33B008g09b1
ttccctaggaacaattaaaaagaaccgaaaaaaaaaacacagattaagacagaagcatggccagccagctcgtaggaacaaagagagcttgtgtcgtgggtggcagcggattcgttgcctcattgctggtcaagttgttgctcgagaagggttacgccgttaacactacagtcagggaccctgacaaccagaagaagatctctcaccttgtaacactacaagagttgggagacttgaagatctttcaggcggatttaactgatgaagggagctttgatgccccttatggtgggtggggacctggtcttccatgttgcgaccacccgtaaactttgcttttgaagatccagagaatgacatgatcaaaccagcgacttaaggaggggggaacgttttgaaagttttgtgccaaagcaaaaa

SEQ ID NO: 13615 - DNA, 470 bp, Gossypium hirsutum
  Clone ID: uC-gsflnu33B008g11b1
tccacgcgtccgcccacgcgtacgcgtgggcaggcaattagggaaagtgagcttaattaacaggctggaagtaagaaggatgagccagtgtatgaagcaggtgctgatagggaaagagcagacgatatatgcagcgttgctgaaaatgaagaaacttaaaaggaggccaatgatgaaaaactgtcggcagttgaggccacggatgaagataggaaaggtgacaagactgcaaatgctgattacaaagataagaggactgaagatgactattcaactgtagaaggagcatcattggaattcataccaccagatctaaagtggccagatatgccttcacaggactcgctggcactggattatctacttcttcaggctgctttggttctaccaaaaaggatggctctacaggtgcttgtggttttggcctttcacaaagggacacttatccctattcaacacatcggggactt

SEQ ID NO: 13616 - DNA, 318 bp, Gossypium hirsutum
  Clone ID: uC-gsflnu33B008g12b1
tctacgcgtccgcccacgcgtccgcgatttttgcttttgtataacagatatctgtatgatattctgaccaaggccagtgtggttaagaagaaaattccagttctcatttgttgcaataaatccgacaaagtgactgcacataccaaggtgtttatcagaaagcaaatagaaaaggaaattgagaaactgcgggcatcaagaagtgcaatatcagcagctgatatttcaaatgatttcactctcggagtatctggagaagtatttttattcactcagtgtagtaatgctgataccgttgcatatgctccaggtttgaat

SEQ ID NO: 13617 - DNA, 326 bp, Gossypium hirsutum
  Clone ID: uC-gsflnu33B008h05b1
atccgtcagaacggctgactgctcatgaagtattatgtcatccttggatttgtgaaaatggcgttgccccggataaggcactggacccagcagtactttctcgcctcaaacaattctcagcaatgaataaattaaagaagatggctttacgggtaatagctgaaagcctctccgaggaggagattgctggcttgcgagaaatgtttacggctatggatactgataacagtggtgcaatcacatttgatgaactcaaagctggtttgcgaagttatggttccaccttgtaggatacagacatacggtaccttatggatgccgtttat

SEQ ID NO: 13618 - DNA, 299 bp, Gossypium hirsutum
  Clone ID: uC-gsflnu33B008h06b1
ttcacgcgtccggttggctatgatattggttgtgtccttagcttgatacttctttatgggaattatcatcttcaaataactcaaggaaatcgttttggcctttccgatatcgatcaacagagaaccagtgacgaatcaaggtgctcacatttgatgaacaaatgccgtacttcactagagctgttctttgcattatggttcgtaatgggaaacgttgggccgtttcggtctgaacatatgcccttctgtctggctcctactgtacacgtactcaggctgtctttggtagctggtaatgt

SEQ ID NO: 13619 - DNA, 231 bp, Gossypium hirsutum
  Clone ID: uC-gsflnu33B008h07b1
tgaggagtatgcgaagaaattaaaacccctcgttgaaaattcaaagccacgaaaaagaaaagaaaatcgagggtatcattgcaaatgttttcttttcctttttttttttggtagtgaaatttgtaaaatcttatttgtagtcaattttataagaaaacaaattctcctctctctcccccctctctctctctctcttctttctagttaatcataatttagagttgttattcg

SEQ ID NO: 13620 - DNA, 166 bp, Gossypium hirsutum
  Clone ID: uC-gsflnu33B008h11b1
tccacgcgtccgcccacgcgtccgcccacgcgtgcggtgaaattgagataccactacttttaacgttattttacttattccgtgaatcggaggcggggcacggcccctttttttggacccaaggccggattctgccggacggtccgggcggaagacattgtcgggg

SEQ ID NO: 13621 - DNA, 499 bp, Gossypium hirsutum
  Clone ID: uC-gsflnu33B009a05b1
ttgccaatgacccacttggaatccattgcttcctctgcggtacgagcagcaattaaggtgaaggcatcagttattatatgtttcacatcatcagggagagctgcaagattgattgcgaagtacagaccaacaatgccagttctctcagttgtcatccctcgccttaagacaaaccaattgaagtggagcttcagtggggcctttgaggcaaggcaatccctcatcgtcagaggtcttttccccatgcttgctgatccccgacatcctgcggagtctacaagtgcatcgaatgagtcagttttgaaggttgcacttgaccatgggaaggctgccggagttattaagtcacatgatcgagtcgttgtttgccagaaggtcggggatgcttctgtggtgaagattatagagctcgaagattaaactaatgttactttctctgctttgggattatttttggaatctgatttgtgaaagcgatgaatgactatatatagcacct

SEQ ID NO: 13622 - DNA, 404 bp, Gossypium hirsutum
  unsure (1)..(404): unsure at all n locations
  Clone ID: uC-gsflnu33B009a06b1
attatgtacttaagatatcgccctttagtggatcatgtggagggtggaaggataaaactgctcctgcctgctggctggataacctgcnggatctgcggcctccaggcttgcaatgcttgctggcatgcggcctggcggctggtctgcacagattgtaccccctgcagattgatacttgtgcttgtagcatataccatcaatcgcgtggaccatccttgtcttcttagagcngcttggcatcgccccggtataagctgcagcttttgactgtgagcctgaataggtaaacgtgcttgctgaaagcggctgcaaatgtggctataactgcactcgcaacccttgcaattgcaaatgagaaaaaaaagctaagcatattatggaagctgatctaaataatatatgat

SEQ ID NO: 13623 - DNA, 346 bp, Gossypium hirsutum
  Clone ID: uC-gsflnu33B009a08b1
ttaagatgtcgtggcaaacgtatgttgatgatcacctgttgtgtgatatcgaaggcaaccatctctctgccgctgctatcatcggccaagacggcagcgtttgggctcagagctccaatttccctcagtttaagcaagaagaaatcaatggcatcatgaatgacttttctgaacccggatcacttgccccaaccggattgtaccttggtggcactaaatacatggtgattcaaggtgaaccaggagctgctattcgagggaagaagggactcgcaggtgctactgttaaaaagaccaatcaggccttgatcatcggcatctatgatgagccaatgacctcggggca

SEQ ID NO: 13624 - DNA, 499 bp, Gossypium hirsutum
  Clone ID: uC-gsflnu33B009a09b1
tttaacaatggcgccaaaatcaccattttctactacttctcttatactcttcatcctcaacttttacctgagaaccaccattggtgactatggtggaggatggcaaggtggtcacgccaccttctacggcggtggtgatgcatccggcacaatgggaggtgcttgtggatatggtaacttatatagccaagggtttgggaccaacacagcagcacttagcactgcattgttcaacaatgggttgagctgtggttcttgttatgaaatgaggtgtgatggtgacccaaaatggtgcttgcctgctaccattatggtcactgccaccaatttttgtccccctaattttgctttgtccaatgataatgtgggggtggtgcaaccctccattgcaacactttgatttggccgagcctgctttcttgcaaatagctcaataccgtgctgggattgtacccgtttcattcaggagagtcccatgtataaagaaaggaggagtccg

SEQ ID NO: 13625 - DNA, 453 bp, Gossypium hirsutum
  unsure (1)..(453): unsure at all n locations
  Clone ID: uC-gsflnu33B009a10b1
tccacgcgtccggtttatcttttcactcactctgttggctaaaccgcttttctagggttcatttatctttcgcctccccctcttttcttttttcaatcccctccttctttcaggtagaatgcaacgggcagttcgagctttttcggtgcacggaaatactttgaaaaatgcgatcttgcatcgcattcgggtggtcaatccggttatgcgacccgttatgttttccagatcacttacatctgctagatnggaagaacatggcttcgagagcaccactacttcagacgttttgaaagccaaaggcaaaggtgcagatggatcctggctttggcgcactacggatgactctgtgtacgatgctgtgaaatcgatgactcaacacatgttggtgcttggcggctgctaaacctggagagcagaaatcaattgcgggtatcatcacagagagagatt

SEQ ID NO: 13626 - DNA, 522 bp, Gossypium hirsutum
  Clone ID: uC-gsflnu33B009a11b1
ttgacgcgtgggtgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggtcttatctggtggtggtaaaatcttataaaaatattatcggttgctgctcttggtttgatcaaatcattgtctgaaatatatggcatcttt

SEQ ID NO: 13627 - DNA, 450 bp, Gossypium hirsutum
  Clone ID: uC-gsflnu33B009a12b1
tctacgcgtacgcgttttcctcatcgttgctatatctctagttcttcaagccacggtgcctccaactgcgttagccgctcgtaacgaggttatgtcctctgccgctgtatcgaaagtggctaatgattccaacggtttggctgtggttttcgagaaggtaggccctggctgcaaacctaaaggttcgttttgcttgtttgacctaaccagttgctgtaggccttgcggatgccttgagggtggtgctataactatgatcatgaatgcaatgagtacacataatggtcgctactgagtttaaaaaaaagaaagaaaaacagctctgagtcagaaaacgacatgggattcaattataaatgttctatatataacatatgtatttgaataaagaatctctcgtgttatgtccctgtcttggttgagctctgccattgttgtaagagttcatgt

SEQ ID NO: 13628 - DNA, 75 bp, Gossypium hirsutum
  Clone ID: uC-gsflnu33B009b02b1
gaaaaaatctcccccactccattgggggaaaagtaaacaaaatcatcaatcatcattttcttttatcttttcttt

SEQ ID NO: 13629 - DNA, 366 bp, Gossypium hirsutum
  unsure (1)..(366): unsure at all n locations
  Clone ID: uC-gsflnu33B009b03b1
tccacgcgtccgcccacattaaatattgttgctgaaacaatggcgttttcagctctgacaggtaagcttgaggcagatgtagagattaaggcttctcctgagcagttccatgaaatgtttgcccacaaaccgcaccacgtgcaccatacttgctatgacaagattcaaggatgcgatttacatgaaggtgaatgggngaatagtcggtaccattgtccattggagttatgtgcatgatggaaaagctaaaaaggcaaaggaagtagtggaagcagtagaccctgatatgaatttggtcactttcagagcgaccgttggagcactcacggacgatccttcgagctttgttctcactattcaagtttc

SEQ ID NO: 13630 - DNA, 155 bp, Gossypium hirsutum
  Clone ID: uC-gsflnu33B009b05b1
ttatttgtagtgctctcggatttaaattacgaccacaatcaagggcaccaatgcatatgtagttcatgttgttattgttgtatttatgtcatgctagccctacttgcttgtattccttgttagttggacttgaatgcaaatgttggaattccttc

SEQ ID NO: 13631 - DNA, 500 bp, Gossypium hirsutum
  Clone ID: uC-gsflnu33B009b06b1
ttgacgcgtgggccgaggctgatatctttgtcaccaccactggtaacaaggacatcatcatggctaaccacatgaggaagatgaagaacaatgccattgcttgcaacatcggtcacttcgacaatgaaattgacatgctcggtctcgagaattatcctggtgtcaagcgcattaccatcaagcctcaaaccgataggtgggtcttccctgaaaccaacaccggcatcattgagttggctgaaagacgtctcatgaacttgggttgtgctactggccaccctagctttgtcatgtcatgctctttcaccaaccaggtgatcgcccagctcgagctgtggaaggagaaggcaaccggcaagtacgagaagatagggtacgttttgcctaagcaccttgatgagaaggtggctgctcttcaccttggaaagcttggggctaacctcaccaagctcaccaaggatcaggctgactacattagcgtccccattgagggtccttac

SEQ ID NO: 13632 - DNA, 341 bp, Gossypium hirsutum
  Clone ID: uC-gsflnu33B009b08b1
tttcaatgtccttcacattcaaattggatccaatgtacctaaaacgggtccttcaaacgatatttatatacgagttaatgatcgatttcaaaatttgttaagattatcaagagatttgtcaagaaccaaaaaagattgtttaattgagttgaaaatttatcgttgaatataataaaaaaagcaagatttattcattagggttgagacgtacttaccaattttttgcaaactaagggtgttattgactttaattacaagccaatgaaaaaaagttagaatggtgaacggtttgatttcagatagcaaaatagttttcagaacttagatgaaaattttgatgt

SEQ ID NO: 13633 - DNA, 217 bp, Gossypium hirsutum
  Clone ID: uC-gsflnu33B009b10b1
tttggtgatgcgaccctctcatcatcacattcactttatttaggcttcctctgtatttgttgttcatgttgtctttgatagagtctaagagatagctaggacccacttggttgtctccgctcataccccaaatccccataccccttctgttcaacagcaaagatggcaactgtgcgagttacctcctctagtatcgttcaagcttcgatcccgaacc

SEQ ID NO: 13634 - DNA, 155 bp, Gossypium hirsutum
  Clone ID: uC-gsflnu33B009b11b1
ttttttgtagtgctctcggatttaaattacgaccacaatcaagggcaccaatgcatatgtagttcatgttgttattgttgtatttatgtcatgctagccctacttgcttgtattccttgttagttggacttgaatgcaaatgttggaattccttc

SEQ ID NO: 13635 - DNA, 496 bp, Gossypium hirsutum
  Clone ID: uC-gsflnu33B009b12b1
tttcacaggtgcgcatggtcgaagatgatttgatgtacaacacatttctagaggtatatgagaaccactgtgcaaggaatgatcgagagccggatcttcctattacctatttcaaggagcagttaaaccaagccatatcaggacaaatttcacctgaagctgttgtagatctccgcctccaagcttataacgatataacgaagagtcttgtagcagatggtatcttttcccagtatatgtacaagaccctgcccagtggcaatcatatgtgggcttttaagaagcaatttgctatccagttagctctgtcaagtttcatgtctttcatgctacaaatcggtggaaggtctccaaataagatattatttgcaaaaaacacggggaaaatattccaaacagattttcatcctgcatatgatgtgaatggaatgattgaattcagtgagccggtgcctttccgtctgacaaggaacatgcaagcattcttctctcattt

SEQ ID NO: 13636 - DNA, 386 bp, Gossypium hirsutum
  Clone ID: uC-gsflnu33B009c01b1
tctatatcatgttcaacaatgccggcactcttggtgacaacgaagcaagagtgacacacgccagcacggaggacttcaagagagtgttcgatatcaatgtgttgggtggtttcttgggtgccaagtatgctgccagggtcatggttccggccaagaaaggttgcatactattcacttcaagtcttgcttcaaaaatcagcttcggtagcccccatgcatacaaggcatcgaagcatgccgttgcagggttgacgaagagcttggccgtggagttaggtgagcatggaattagagtcaactctatttcacctcatgcaatttcgactccaatgttccaaaaatcaattgggatacccgttaagaagaaggcagagtagatgattgct

SEQ ID NO: 13637 - DNA, 438 bp, Gossypium hirsutum
  Clone ID: uC-gsflnu33B009c02b1
ttgaaactggatgactctgagtttcgtaatgcattttctcgggcatatgttcgggttaaggaatatgattctaggcgggattcctctcgaagccctagtcgtggccgatctctctcaagaagcagaagccgaagccgaagtagaagccgaagcagaagccgtggtcggagctatagccgaagcaagagccgcagcaagtctccaaaggcaaagccttcgcgcaagtcacctgaaaagtctagatcaaggtctcctcgttcccgctctgcatcaaggtctcgctctttgtcaagatctccttcaaggtccaggtctcctttgccttctcgtcaaaaaggaaggagcaagagtcccaaagacgcagtgttagcaggagtccaagtgggagcaggagcaggagcaggagcaggagcaagagtgtatcccggtcttgatctg

SEQ ID NO: 13638 - DNA, 507 bp, Gossypium hirsutum
  Clone ID: uC-gsflnu33B009c04b1
ttcacgcgtccgaaaaagacttcggttcatctgcttaacagaaatggactcttccaatagctttgctttggcattcttcgtggctgtgacgatttcaagcattgacgttggcctagcatgtcgctaccttctgcaactgccttcgatgccaacattgactacaaccacactaccaccattaccatctatccctaatttcccacagccattcataccatctttcccaaggcccggggcactttctgcattttctaccatgcctgggttgcccacactgccaagtgtaccaagggccacactgcctcctctgccaggcataccctcttgcccacaatccaacctacaatatcctgtattcctttcctttgtacaccaccttctacttgtaccccttaaaaatccctttcggcttatgggacccagtgcagagtcgggacatgctactagtgttctcatctcattcagggttgaaagtggtagttacagactccagtttttaatcagcat

SEQ ID NO: 13639 - DNA, 503 bp, Gossypium hirsutum
  Clone ID: uC-gsflnu33B009c05b1
ttcacgcgtccggttacccaacaccccggagttcgtcttgtcgttcctcggcgcttccttccgtggcgccattgccacggctgccaaccctttttttcactcgggcggaagtttcaaagcatgcgaaaggctccaacgcgaggctcattatcacgcaagccagttacgttgacaaagtaaaagaattcgcccaagacaatgatgccatggtcatgtgcattgactcagccccagagggctgtttacatttctccgagttgactcaagccgacgacaacgatctccccgaagttgatatagcctctgaagatgtcgtagcactgccctattcgtcgggaacgacggggcttcccaaaggggtgatgttaacgcacaaaggtttggtcaccagcgtggcgcaacaggtcgacggagaaaacccgaacttgtatttccacagcgaagatgtgatcttatgtattcttcccatgttccatatttacgccctgaattccatcatgctt

SEQ ID NO: 13640 - DNA, 488 bp, Gossypium hirsutum
  Clone ID: uC-gsflnu33B009c08b1
tttagatagacgcatctgttattttctctctcccaaacagagccccctcctctttttgaaagccggaaaatcaaacaaaacccttttaaaactttccggcaaaaatttcgaagccagcggagaatggtgccccctgaaaaccccagttactggtctcacttcgactactcaaccttgatcgacgatatccctgttcccgacggaccttacaccggtttttcttggtccacgcagccaaccaacgctccttctactgctgtcaatgtggaagttgacaactcgttgggggatctggatggccttacggaatctggttcaaagaagagggggtagatctgaatcatgcaacccttctagctccaatgcatgtagggagaagttgcgtagggataggctaaatgacaagtttatggagctgggagctattttggaacctggaaggcctcccaaacagacaagtctgctttttggtggatgctgctcgaatg

SEQ ID NO: 13641 - DNA, 509 bp, Gossypium hirsutum
  Clone ID: uC-gsflnu33B009c10b1
ttcacgcgtccgctaggttcgaaagaacatacccgggtggtatgcgtcccacttccatggcaccaccagttagagtaagatcaaattgtaccattggactagacattgtttagaagcaatgccattgttcaccaatgcttaaccattttgttttcaactagtctttctttgattgactaaagaaagtgtatgaatttgacgagtttatgaattcaatattgtttctaattatttctttaattgttgttttgtatgttctagagaactaatattgttctagaattgctacctattgattcgatggtgtagtaatttcattaataaaattatacattttatcttcttgaaataggaaaatagcttattgcaaaagatcttgataagatccaaacatgggacataagatattaacattagaatataaaacaaatcactagcaaatatttcattacgaaatagcatagaaatgtagctaaagaatacaacacttgattaagaatctaaatatg

SEQ ID NO: 13642 - DNA, 145 bp, Gossypium hirsutum
  unsure (1)..(145): unsure at all n locations
  Clone ID: uC-gsflnu33B009d01b1
tcatactgttagttcctggctctccatatttgatctcatatgtgagggaaaatcatgcttattataatgcnnctctatcttctcatttatcttgttacctgatgctcnntcgggtttctttttggccatcctccctgttttggtc

SEQ ID NO: 13643 - DNA, 418 bp, Gossypium hirsutum
  unsure (1)..(418): unsure at all n locations
  Clone ID: uC-gsflnu33B009d02b1
tggagcaatgccggaagatcgagagtatattgcccatgaggcctagtaagcatttgacagacatggagcttgatgactgtgaagagactactttgcatgatgtcagtgctgaggaggtaaagaggcggaaggaacgacagcataggcaccgtgaagcttatgatgaagatgacgatgacgatgagtcagcaccaagagtgcaatgtgcccagcagtaagaaatgtttgcgttcaatgttttgcccctcttattttatagcagcagctagcttagataactacatagcccagaacttgatgcgntttttgtctgcaaccagcacattaattggtggttttgtctctttattttttattggtgcgttcatctcagcatcttgcgttattttatcacagttttcctcgacatttcaaggat

SEQ ID NO: 13644 - DNA, 507 bp, Gossypium hirsutum
  unsure (1)..(507): unsure at all n locations
  Clone ID: uC-gsflnu33B009d04b1
ttaagcttcaagtgccaaaatctagggatttgcgggtggagaagacgagagcccatctctctgcttcaaagctcctgtccaggtagaattctcttcttcccttgcgttgtgttctttcctgttcaatcgccatggcttcaaagcggattttgaaagaactcaaggatttgcagaaagatccacccacttcttgcagtgctggtccagtagctgaagacatgtttcattggcaagcaacaatcatgggaccctcagatagcccttatctggagggtgtgtttttagttactatccatttccctccagattatcctttcaagcctcctaaggttgcatttaggaccaaggtcttccatcccaacatcaacagcaatggaagcatttgtcttgatatcctcaaagaacaatggagccctgcactaaccatttccaaggttctgctctcaatctgctcactgctgaccgatccaaaccctgatgaccctcttgntccggagattgctcaca

SEQ ID NO: 13645 - DNA, 316 bp, Gossypium hirsutum
  Clone ID: uC-gsflnu33B009d05b1
ttttgatttgaaaggaattagacaaatagttaacagtttagcttgagttaatgcttcaccaaattcaggaaacaatgatatggcatatgttgtagattccaatgtctactctcatacgttaattcctttgctttccgaaacttgtcgagggacaaactcaagcgaaatcttaaatgaagcacatttcattctagttgtgtttgtgttttcttcatgtttgatatgtagaacaaataaggtgaaaataaagaattttgtaagagaaaattcaacctttattaaattctatataaattacattaaaaatttgtatgcc

SEQ ID NO: 13646 - DNA, 489 bp, Gossypium hirsutum
  Clone ID: uC-gsflnu33B009d06b1
ttgaaataattctaaacatgtccggtggataccctcaacaccctcccggctacggttacggttccccaccagctcagccttacacagccgctccatacacagctggagcaccgccgccacctcaaccgtacggtactccatacgccgctgcaccatacggcgcaccttctgctccctactctgcccctccaggcgagaaaccaccaaaggacaagcaccaagcgcatggcgtcggtggtgctcctccagttcacagcggaagctatcctcccgcaggaggctatgcgagcccgttcgcatctctgttgccgtcggcatttccaccggggacagatcctaacgtcgttgcctgctttcaaatggctgatcaaactggaagcgggttatttgatgataaagagttgcaaagggcgctttcttcgtataaccaaagcttcagtttgagaactgctcgtttgctcatgtatctcttcactaatactaacacca

SEQ ID NO: 13647 - DNA, 363 bp, Gossypium hirsutum
  Clone ID: uC-gsflnu33B009d11b1
tgtgaaggaaagcttgtcaatgccaccatattcagatgttagggtgggaagttaagattaacaacaggaggggtgctattatgatcgtaggaaaaaactactatcgttgagaagataataataacatcagcagcactactacttccgtcgtggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcggcctttttggagcaaccattcttaccgccgggtggaggcgaattatttttttttttttggggccacataaatataatttgcgggccgttttttaacaacgtggggggggga

SEQ ID NO: 13648 - DNA, 451 bp, Gossypium hirsutum
  Clone ID: uC-gsflnu33B009d12b1
tgaactcataactcctcaaaagtcttcttcaatggcagctcgagttcttgttttggcttcaattcttattttctcttgttttgcagagacatgctatggggtgatctctttctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatcgtcaagaaaccctacaccaacgtcaacgaaacccttgaatggaccatcgaacgagacgtgccgacgcttacgttctttatccgagcctacgctctggactcc

SEQ ID NO: 13649 - DNA, 476 bp, Gossypium hirsutum
  Clone ID: uC-gsflnu33B009e01b1
tccacgcgtccgcccacgcgtccgcccacgcgtccgcggacgcgtgggggcttcttctttttccaggttttcccagactttgcttctccttgtggttttctggggaatcaccagcagcagcaatgctcaactttcaaccgattattactcagaatcatgcccaaacttgctttcaactgtcaaattcactgttcattctgctataatgaaagaggcccgcatgggtgcttcactgcttcgactcttcttccatgactgctttgttattggatgtgactggatcattgctactggacgacacgtcgtcgttcacgggagagaaaaatgcagtcccaaatcgaaactcactcggggattcaatgtgattgacgacatcaagtctgcagcagagagtgtttgcccggttgttgtttcttgtgcagatgtaccgtgcattgctgctaggactctgctacattctgggaggacgcgataat

SEQ ID NO: 13650 - DNA, 354 bp, Gossypium hirsutum
  unsure (1)..(354): unsure at all n locations
  Clone ID: uC-gsflnu33B009e03b1
tttcacgcgtccgccatttttatcatcttcaacagaaaaaagaaaggaaaaaaaaaacaaaggaaggaaaaggggaaggatttgagagaaaaaagagaaggatcgaaaatgggtttggttccaccagaactaagcttggattttaggccaaatttcgtaccaaaaacgatcactaattttctagnggaggtttcactggtcggaaatgtttccgataaggtctcgaaactcgatacatttgtgaaagggttnggaatgaagaaatgaaaaagatcgatgcttttaaacgtgaacttcctctctgcatgctccttttgaatgatgcgattttagtattgaaagaggaatcaacgc

SEQ ID NO: 13651 - DNA, 225 bp, Gossypium hirsutum
  Clone ID: uC-gsflnu33B009e04b1
tccacgcgtccgggatgataaggttggttgatacaggatctctgaggtcgagtgattagtttttttacaatggtgtatgtgggttgttgagcttttcttttgtgtttaacttgtgaccgttgatcatgcttactttatcatgatcatcatccaatggctgatgttgtttgtgaatttgtgttaatgctcctctgttttctataattgcttacatttcttttcttt

SEQ ID NO: 13652 - DNA, 493 bp, Gossypium hirsutum
  Clone ID: uC-gsflnu33B009e07b1
tttcacgcgtccgttcgaacttcttctctttcaataaatttttacaacggagatggtcccaatcaatacggtccgaccgttgatttcttgttcttcttcttcttccggtttcgataccggaccgtcggcaccggttcccaagttggattcgttaagttaccaaggtcgaacggcggtaaccatgccaggttgagcttcgttcaggcgacggaggaatccaccgttgcgacgacgaatggtcgtgttgctgcagtttccggtgaaaatgcccatcagatggccactaatggaaaggcaggtaacatagtatggcacaaaggttcagttgataaagttcatcgtcaagagttacttcagcaaagggttgtgtcatatggattacgggtctcagtggttcaggaaagagcacattggcatgcgcgctgtgccatgccttgtattcaaagggaaagttgacttacatccttgatggtgataatgttcggcatggcct

SEQ ID NO: 13653 - DNA, 216 bp, Gossypium hirsutum
  Clone ID: uC-gsflnu33B009e08b1
tccacgcgtacgatttaaatcatacgcgtctgaaggttgtcatcattgcgaatgaattcgagccggacaaaaaggtggctgtttgatcactccgtgagaaggatcgaaattgggtttggttccaccagatctaagcttgcatgacagagcaaatttcgtaccaaaaacgatcactaattttctatgggaggtttcactggtcgaaaatgtttccga

SEQ ID NO: 13654 - DNA, 501 bp, Gossypium hirsutum
  unsure (1)..(501): unsure at all n locations
  Clone ID: uC-gsflnu33B009e10b1
tttagccaccacctcaataagaaattctaattatgaatctaaaaatcctatgcacaacaataaatgaatctgcttaaaaaaggaaagaaaagaacctgatcatatgccatattcaatcataggtggtggctatctagtagcacgagattgcattcatacgttttttctttctttttgggatcttgagtaaccatgtcacagctcattaacgatccaaattttggatcgtgtaatcccccatgaaactgnagtggtcaaacagaaactcttgaaaattgccttggcaaagtattttctcatgttttctggattggctgcatttataggtccaaaccctacactgcaaaataacttggctggagcaaacaggacatattcacctaactcgacaaacagaaacagttcgactgacagcaggatcagacgacccacaacatcccgatatggtagcaatattcacacactaaaacacgatgaggatgacagnccgttctcggatag

SEQ ID NO: 13655 - DNA, 434 bp, Gossypium hirsutum
  Clone ID: uC-gsflnu33B009e12b1
tttacgcgtccgaccgaattgatgtgaagcgggatgagtgtaggcaaaacaatgatgagatgattggtccagattggttagaaggaagccctcctcgacttacctgcgttttaaattgcatatttcttgggatttcaagcattggttaccattcattcatattccacaatggtaggtgctgtgctgacttattgtttaatttgagtctcttgtacctcttagagttttatattgcacagcctatacctgaagcatcatctgtcatcacacagacacagctagattaatagtattactcttccctttttctttttcctccctaagaccagaaatgattttgatttcattgattatcagtaaatcctaatatatatacatacaaaactcctaagtcaactagatgtgtgtttggaagcctttaaaaaaataaataa

SEQ ID NO: 13656 - DNA, 501 bp, Gossypium hirsutum
  Clone ID: uC-gsflnu33B009f01b1
tctcacgcgtccgcccacgcgtccgacttgctaatattgctacttggagtggccgctctagccactccctcttttggcacctatgagtctcccaactatgggaagccccctactcctgtttataagcctcctaaggtgaaacccccaccttatgaacataagccacctgtctatgaacctccaaagaaagaaaaacctgaacataagccacctgtctatgaacctgcaaagaaagaaaaacctgaacccaagccaccgatgtatgaaccaccaaagaaggaaaagtccgaaccaaagccaccagtttatacacctccaaagaaagagaagcctgaaccaaaaccatcagcatatgaaccaccaaagaaggaaaagcctgagcctaagccaccagtttatacaccaccaaagaaagagaagcctgaacccaagccaccagtgtatgaaccaccaaagaaggaatagcctgagcctaagccaccagtttatacaccaccaaag

SEQ ID NO: 13657 - DNA, 490 bp, Gossypium hirsutum
  Clone ID: uC-gsflnu33B009f02b1
tggaaccaactgttacacacagcagcagcagcagcagccatggtgaagtactcaagagaaccggacaaccccactaaatcttgcaaagctaggggttctgaccttcgtgttcattttaagaatacacgagaaactgcctttgcaatccgaaagctacctttgacaaaggcaaaaaggactcggaagatgttattgccacaagcagcattcattcaggcgctttgggtggagttgggcgaaccgcacaggctaagaatcgccattctaatggaaaggccgttggcccatgaaatctgcaaaattcattctcgatttgctcaagaatgccgagagcaatgctgaggtgaaagtcttggatgtagattcacttatcatatctcacatccaagtaaaccaagcacagaagcaaaggcgccgaacatatcgtgcacatggaagaattaacccctacatgtcttcaccgtgtcacattgaactgatcctgtctgag

SEQ ID NO: 13658 - DNA, 424 bp, Gossypium hirsutum
  Clone ID: uC-gsflnu33B009f03b1
tttgctttgccctattagctctcatagttagttgcgcacttggtcaggctcctagctcggccccaaccaagtcaccgccgtcttctaaccctactccggctcccaaggtttctccaaccatgtctgcaaccactacaccaaccgcatctccgccgtcaacatccactcccccgtcttcagcccctgaatcttcaccaacttcgtgtcccaccacttctcccccagctcctcccgctggttctcccgctggttctcccgctggctctcccgctggctctcccgtagcgctgtttctcccacaaactccatcagcgatacaccatgcagctctcccacttctgctacgagtgcagccgctttgaacagggtcaccgctgccgtatctgcgaatgcagccgtttctgctgctctgctgatttagatc

SEQ ID NO: 13659 - DNA, 496 bp, Gossypium hirsutum
  unsure (1)..(496): unsure at all n locations
  Clone ID: uC-gsflnu33B009f06b1
tgttcacgcgtccgctttcccatcttaaacatgctccctcctctgtaaatcctattagacgtcaatttcccctttcataaatctttgggttttcatggaggaaatcaattgggatacccttctgctcgaggttgacttacccgatttcgggaatatcttagataatgaaccggtaacggaacctcctcctcaaccttgttcaacccagaatcccgatgaagaaccggcggtgtcttcgtggatcggggcgatcgagaaggttttgatggaggatgataattttgatcctagggttgagactcaacctgtctccgatgatgatttcttggccgatttactggttgattcacctcctagtagcggcggcgatgtggctggcgtcgacggtgctgatttgcacaaacagagccagacccaccncgacgtcgataaagacgatcccattattaagaaacagagaaggcagttgagaaacagagatgcagctgtgagatca

SEQ ID NO: 13660 - DNA, 482 bp, Gossypium hirsutum
  Clone ID: uC-gsflnu33B009f07b1
ttagaatatgccttgatattctcaaggacaaatggagtccagctctgcagatccgaactgtacttttaagcatccaggcactcttgagtgctccaaatccagatgatccactctccgagaatattgctaagcactggaaatcaaacgaggctgaagctgttgagacagcaaaggaatggacgcgtttatatgcaagcggtgcatgaagaccggtggaaccgtttgctctcataaaataacatttttatgcaatgtgagctattcaatgtcaatttcatatggaaatctggacgaatgacagtttgaaacagtttgatatttgcaaaaaaaaaaagaaaaaaaagcttccaggtgctacccttttattgtaaattcgtcggaagcaatctctaggcttgtatgataatacacatggtttctctaaaactcccaaaggcttcaacatgggattattctctatatggtgatttcagattctgggt

SEQ ID NO: 13661 - DNA, 231 bp, Gossypium hirsutum
  Clone ID: uC-gsflnu33B009f08b1
ttcacgcgtccgggaattttgcatgaattcaattagtagatagaaaccaacaaaattcagcaaaacgaaatgaaaactggtaatagtcatattattacctcagcaatcgatgtggcaacgcttaaaccagccaattcctgataattcacataaactcaaaccactgaagctttaaaacaaaaccccaaaagaaagaaatagaaaaataaaagaatgtaaatttaagaattt

SEQ ID NO: 13662 - DNA, 493 bp, Gossypium hirsutum
  unsure (1)..(493): unsure at all n locations
  Clone ID: uC-gsflnu33B009f10b1
ctttgctggacaagaaactgtcaattcattgcttgcatggatagttttgcatttggcaatccatggagattggcaagagaaagcaaggagagaggtgattgacatatttggtaaccaaaacccgcatctcgaaggcattgccaaactcaaaataatgaccatgatcatcaatgaaactctaaggttgtatggtccgtcaaatggcctgccaagaacagtcgcaagagaagtacagttgggaaagttagtcttgcctgctaatataatatttgctttaaatattggacttaccgtgatcctcacttgggggnatgatgtgaatcattttaaaccagagagattcgccgaagggattgccaaagctaccaattacaccgcagatgcatttttcccctttggattgggacctcgatcttgtgttggtatgacccttgcaaccatagaaaccaagattgctctgtccatgattctacaacgttacaccatcaccatt

SEQ ID NO: 13663 - DNA, 506 bp, Gossypium hirsutum
  unsure (1)..(506): unsure at all n locations
  Clone ID: uC-gsflnu33B009f12b1
ttgcttagatttcaacacctactccctgccatcaaatcttgctcttcttttctgggtttgattttcataaagatgacaaaagataagaaaatcggtgtagcagtggattactccaagggaagcaaagcagctctgaaatggtccatcgacaatttgttaaaccaaggggatactctttacctcatccatgtcaaaccccatcaaagcgacgagtctcgcaaccttctttggtctaccaccggctcacctttgattccattatcggagttcagagaagaggaagtgatgaaacatatgcaggtggaaccctgatcctgtgattttgaacttgggtctgatattgcttccaggcagaaacaggggactcttgtggctaagattactggnggtgatgccagggataagatatgtgcatccgctgaagacttgaagcttgactgtttggtaatgggcagcagaggccttggcaccattcaaagggtactgatcggaagtgtgagcaatta

SEQ ID NO: 13664 - DNA, 493 bp, Gossypium hirsutum
  unsure (1)..(493): unsure at all n locations
  Clone ID: uC-gsflnu33B009g02b1
ttttgcgccagaggaaaaattaagtttatttaattcattacttaagggctaccaagaagaagttgataatcttaccaagagggcaaaatttggcgagaatgcttttctgaacatctatcaaaagctttatgaggctcctgatccttatcctgctcttgcttcaatttctgagcaagatctaaaaatctctgaattggaatctgagaaccggaaggtgaaagttgagcttgaagagttcagaacagaatcaatgcacttaaaaaatcagcaggcaacgataagaagacttgaagagcggaatagacaattagagcagcagatggaggaaaaagtgaaagaaattgtggagatgaagcagcgcagtttagcagaagaaaaccagataacttaagaagtcttaaaagacagggagcaatcttgctagatcaattacgcagctaagaaagtgtatcaaacatgcaaaaactgcatgaactngcacagagcagctgtt

SEQ ID NO: 13665 - DNA, 491 bp, Gossypium hirsutum
  Clone ID: uC-gsflnu33B009g03b1
ttcatttcgccccagaaattatagtaaagcagagacaatgagaggaagtggaacattgatgctgagttgggttctgatcatctgcctctccctagtagcagtgcagagccaatactactcggagaccctaccatatcgtcccaggccagttaaggtcaccaatcttcacttcttcatgcacgaatttacgggtattacagcagtccaggtagcccaagttaacatcacaagcaacgacaataattcatcagtgccatttgcctccctcgatgccgttaatgatcccctcaggactggtcctgagcctgctcggagttgattggaaatgttcagggtattgcgctcctggctggaatgaatgcatcaagcacgcaatcatagattttggattcaatccggtaagtttaacggcagctcataagcgtattttaaggggagaacctgggcttgcgatagtcgaggaagaggacgattcatgatgccacaggggt

SEQ ID NO: 13666 - DNA, 186 bp, Gossypium hirsutum
  Clone ID: uC-gsflnu33B009g04b1
ttctcacgcgtccgggtagctaccttgttgagcatttattttccttttgtttgcaaagagaaattatttcgagacattgagcaggtatttttatttttattagcacttaaaagtttgtaatattgcattgttgttgccaattagccatctctggttcaacttaagacagaaggtgatttttgattt

SEQ ID NO: 13667 - DNA, 495 bp, Gossypium hirsutum
  Clone ID: uC-gsflnu33B009g06b1
tttccacgcgtccgcccacgcgtccggctttctttcgtctgcttaattggactcacatctctagaaaaatggcatctttcaattgctttgctttagcattcgtgatggctttgtcatttgcaagcattgatgttgggatagctgctcgtcaccttctgcagctgcctcaattgcctccaatgccaactttgcctacaaccacactccccccactgccatctatccctaatctcccacagccatccataccggcattgccaaggcctggggcgcttcctccacttcctaccatgcctgggttgcccacattgccaagtgtaccaagggccacactgcctcctctgccaagcatgcccacaatcccaactgcaatcccctctattcctttcctttctccaccaccttctccttctacctcttgaaatacctttttgtttatctgctggatctggattggtttaatgtgattcagtcgtctcttgatttgagtattga

SEQ ID NO: 13668 - DNA, 496 bp, Gossypium hirsutum
  Clone ID: uC-gsflnu33B009g07b1
cgtctttgttgttaaccagggtgggaccctttgcatggaaaattgttccggttgaagttcctggggggaggggaaagccatccatcatagtcgacaaggatgaaggtctaggaaagtttgatgctgcaaaattgaggaagttgcgaccaagtttcaaggataatggaggcactgttacagctggcaatgcctccagtataagtgatggtgctgctgctttaatcctagtcagtggagaaaaggcacttgagctgggattgcaagtgattgcaaagattgcaggatatgcagatgctgcacaggcaccagagtttttcacaacagcgccagcccttgcaatacccaaagccatttcaaatgctggcttggatgcttctcaagttgattactacgaaatcaatgaagctttgctggtgtggctcttgcaaatcagaaactgcttggccttaatccgagaaggttaatgtgaatggtggagctgtatccttgggacatc

SEQ ID NO: 13669 - DNA, 399 bp, Gossypium hirsutum
  unsure (1)..(399): unsure at all n locations
  Clone ID: uC-gsflnu33B009g08b1
ttacagacccctactgtgggactagttatctgaaaaattcactcactagaatgcactactctgtggcggaggctttatgactaaggctcttccttttaccggttcctgtagataaataagcccttttttctgtcctcccgtatgaatattttgaacatttgcctttaggttgcaatttgctatgctatgatctttttgataatgtgcgggatcgngaaggttttgttcagggcgctgtttgtgctgtgtaggaggcagtacttgaacagcttaactgccttcttgctttgtgaaataggaatttttggtttgatcaaatagcagacagtgagattgtattggaatcttatgctcttattttctattattagctntgtgaactaaacatagcatttcatc

SEQ ID NO: 13670 - DNA, 448 bp, Gossypium hirsutum
  Clone ID: uC-gsflnu33B009g11b1
ttcacgcgttcgtatcccattgagcaacggtattgtcagccactgggaatgatatggaaaagatctggcatcatacattctacaatgagctccgtgttgctcctgaggagcacccagtgcttctcacagaggcacctctcaaccccaaggccaacagagaaaagatgactcagatcatgtttgagaccttcaatgtacctgccatgtatgttgccatcaaagctgttctctctttgtatgccagtggtcggacgacaggtattgtgctggattctgtgaatgggtgtatctcacactgtgccaatctatgaagggtatgcccttccacatgccatcctccgtctagaccttgctggtcgtgatctcactgattctttgatgaagattcttactgagagaggttacatgttcaccaccactgctgaacgggaaattgtccgtgacatga

SEQ ID NO: 13671 - DNA, 382 bp, Gossypium hirsutum
  unsure (1)..(382): unsure at all n locations
  Clone ID: uC-gsflnu33B009h01b1
ttctggtggaagctcaataagatgaagtatccaactctttcgaagatggctcgtgacattttgtcaattccagtatcagctgctgctccggactcggtctttgacatcataataaagcaactggatgagtaccgaagctccttacgaccggagactgtggaagcgctaatctgtgccaaggactggcttcatcatggatctgaagaatccaatgcacttgttaaaatggaattttagatgtagctgttttacttatggtaggatgctgatggngacgttatttgactatagnggatttaatttgtacaattaaaatccaattgtatttgattggatgcatggacatgaaaacctttaattgctgagtnnagttgttcctatt

SEQ ID NO: 13672 - DNA, 305 bp, Gossypium hirsutum
  Clone ID: uC-gsflnu33B009h02b1
tccacgcgtccgcccacgcgtccgcttgggttgagtgtagagatgaggaaaatcatgggtgccaaagttctcttcttctttgctttgctttcccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgcttttttttggctgagaaacattttcctgacctgtgctgtcccagcatgtgatgcttcactgctgctggact

SEQ ID NO: 13673 - DNA, 271 bp, Gossypium hirsutum
  Clone ID: uC-gsflnu33B009h05b1
tccacgcgtccgcccacgcgtccggcttattaacgtttgttttccttgcttgttgttttctttttgggggaaccaggctttgatccggcggaggatattgtgttttcaattttttgttctttttggtttgtttctatggaacctttggaactaatggtaacactctttcttagagaatttgattggtgtgtggtacttatgtattctcatattaattattcttgcgtttggacttatattttgaattatataactttctattatctttctt

SEQ ID NO: 13674 - DNA, 134 bp, Gossypium hirsutum
  Clone ID: uC-gsflnu33B009h06b1
tcgaaatatttacgaagtcctaccgccatggggagaagtcctgcaaggcgttatcgtcagataaaaaacaaaccttacccgaagtcacgttattgtcgtggtgtacctgtccccaagatttggattgatgatgg

SEQ ID NO: 13675 - DNA, 292 bp, Gossypium hirsutum
  unsure (1)..(292): unsure at all n locations
  Clone ID: uC-gsflnu33B009h08b1
ctgatttgagggtttattcatttgcagccatgaaattcagaagcttttgtttttgcatcccaggatcaaagcaagaagattcagacagttcttctatcaaagcaaaatcccataaaaagtctgacaaaagtgggaaaaaggaagggaatggggatgatgctgattatcagggtgccactactactactacgacagccagcagtgatgctggaatggctgctgctgtagcagtgggtgccactacagcacatgcctccgctgtggatgaaagtggttgcatnggttgtcatgc

SEQ ID NO: 13676 - DNA, 504 bp, Gossypium hirsutum
  Clone ID: uC-gsflnu33B009h09b1
tttaaccataacttttttggttttgttccagtgaactgttcgctgaactcactgatagaattgtgccggtcgcaatcaacacaaaacaaacagttttccacgggacaacagttcggggacacaaattgttggatccttattttgtattcatgaatccgatgcctacttacgagatcaccttcttgaaccagctgcctacagagcttacttgcaaaggtggaaaatcagccattgaagttgcaaactacatccaaagggtgctggctgggacattgggatttgagtgcaccaacttgacaaggaaggacaagtatgccatgcttgcaggaacggacggtcgggttccatccaagaaagaaaaggaaaaggctctagtactttaaaaaaaaaaaagaagagatgatttatattaatttggccattgtttttcattacgttaaaactttgtcttacaaataaaaaattgtttgtgatgctagttataaaaataacaaatatgtatat

SEQ ID NO: 13677 - DNA, 225 bp, Gossypium hirsutum
  Clone ID: uC-gsflnu33B009h10b1
ttcacgcgtccgcccacgcgtccggttgtcttgttttttcttttgggtgtttcaagttttgatctttttatgttctgttagcgattactgttttctgttttattcagaaaaatgtggtttggattgatatgtaattaaacgaatctgtaaatgttttactatttgggtcatgatgatgagacaaaatttcatgatgaacagaaggcaaaatcttgattcacactc

SEQ ID NO: 13678 - DNA, 500 bp, Gossypium hirsutum
  Clone ID: uC-gsflnu33B009h11b1
ttcacgcgtccgcccacgcgtccgaaaaacttcttctttttttttgtgagctatggagatttagtgaaaattgttctttggatttggaggtaaaagtaaaacatgagagcaattcctggaagtccagggactttgactagcctatttttgaggattatgcagtgtgtttttgcagctggttcaattgcttccatgtctacaacttcaaacttcttcaatttcactgctttctgctaccttattgcttcaatgggattgcaagttgtgtggagctttgcacttgcaatattagacggaattgccttggtgaaaaagaaggtcctccataatccagttttagtcagctttacgttgtcggagattgggtcaaccacttttcaaaccttcaaaccctcttgatattttttactgccaatgaaaactcaacttttatcaaattttacacaggtgacggcgttgtttgtctttggctgccgcatcttcctcgggcggcattgccg

SEQ ID NO: 13679 - DNA, 487 bp, Gossypium hirsutum
  Clone ID: uC-gsflnu33B009h12b1
tttatattgatgggaaggatacccctcttagcaaatttaagggaaaagttcttttgattgttaatgttgcttcaagatgtggtttgacaacatcaaattactctgagctttcccacatatatgacaagtacaagaatcaaggatttgagattctagctttcccttgcaatcaattcgggggacaagagcctggatcaaatcctgatattaaaaaatttgcttgtaccaggttcaaggcagagtttcctatatttgataagcctgatgtgaatggaccgaatacggctcccgtttaccagtttctgaagtcgagtgctgttggttcttttcggtgacctgatcaagtggaactttgagaagttcttggtggataaaaatgcaacagttgtggagaggtatccaccaacgacatcgcctttccaaaatgagaaagacattcagaagctcctcgcgacatgaatctcgaggtcacagtgacatgaaccgc

SEQ ID NO: 13680 - DNA, 440 bp, Gossypium hirsutum
  unsure (1)..(440): unsure at all n locations
  Clone ID: uC-gsflnu33B011a04b1
tttcagcatcaattctcaagctacattcggagagttgaagaagatgttaacaggcccaacggggctacaccatcaagaccaaaaacttttatacaaagacaaagagagggattcgaaggcgtttttagatacggccggtgtgaaagacaaatccaagcttgttttaattgaagacccgattagccaagaaaagagattactggaaatgagaaagaatgctaaactggaaaaagcttctaaatctatctctgaaatcagcttggaggttgataggcttggtaatcaggtgtctacttttgaatctataattactaaaggtgggaaagtagcagagaaagatgtgcttaatttgattgaacagttaatgaatcaattgcttaagttggatggtattatggctgatgcgaatgtcaaattgcaaagaaaatgcangtgagaag

SEQ ID NO: 13681 - DNA, 505 bp, Gossypium hirsutum
  Clone ID: uC-gsflnu33B011a05b1
ttctcacgcgtccgcccaagccaccttactatccaataccgccggtcatctcaccaccaacactgcctccaaagccaccagtctaccccagtccaccaatagtgaaccctccaccatatacacccaaaccgccggttgtgaagcctccgccatatacacccaagccaccttactatccaataccgccggtcatatcaccaccaacactgcctccaaagccaccagtctaccccagtccaccaatagtgaacccaccaacaccgccgattctgccacctcctattgtgaatccaccaacaccgccgattctaccaccaccatcaccacctattgtgaacccaccaacgcctcctatcgtgaagccaccttcaccgggaacaccgtgtcctccaccaccacctccggcacaacaaacatgccccatagacactctcaagctaggtgcatgtgtggacgtgttgggtggcttagtacacatcggcataggtagcagcgccaaagacac

SEQ ID NO: 13682 - DNA, 280 bp, Gossypium hirsutum
  Clone ID: uC-gsflnu33B011a06b1
tttagtggctaatcgcggttgctcaatccgagtcgggcgtgacactgagaagaatggaaaaggttacttggaggatcggcgtccggcatcaaacatggacccgtatgttgtgacagcattgttggcatatactacactattgtatgagccaacacttgaagctgaagcacttgctgctcactagattgctttgaatgtctaaattaaagcagtttagctttattcatagagatggttttctattttatttgctattaagccatgtggtaatgcacaaaat

SEQ ID NO: 13683 - DNA, 519 bp, Gossypium hirsutum
  Clone ID: uC-gsflnu33B011a07b1
ttgaacatctcatgcaatgccattgtgaagttcaaagggcctgaggaattggctggaacataacattatattggaggcctttgaagcgagggctgctcggatgtctgttgcctgggctgaaagccttagcagattttcaacctcaaaagaagggtttggggaaatcctaacaaatctgggtgaggcttgcggtggtcattggcaggtaattattggttccaaggtcattgagaaactgcagcaagacataccaggaaagggagtgaaaacacagttggagaacctctgcaacgtatatgcattgtctcttttacacaaacatcttggtcatttcgtctccactggctgcattaccccaaaacaaggtgcactagcgaacgaacagctcagatcactttactcccaggtccgcccgaatgcgattgcccttgttgatgcattcaatcacactgaccactaccttggctcggctctcggctgctatgatggaaaatgttatcaaaaactgtatgaggaagc

SEQ ID NO: 13684 - DNA, 467 bp, Gossypium hirsutum
  Clone ID: uC-gsflnu33B011a09b1
gagtcgcacacgatttttctcttcttcaaaaggatactaagtggcctcttggatggcctgttggaggattccctggaccacagggtccgtactactgtggtgtaggtgctgacaagtcctttggtagggacatcgtggactcccactacaaggcttgcctttatgctggcgttaacatcagtggaatcaacggcgaagctatgcctggtcaatgggaattccaagttggtccatctgttggaatatctgcaggtgatcaaatatggattgcacgatacatactcgagcgaatcactgaaatcgcaagagttgttcttttttttggatcccaaacccattccggataactggaaatggtgctggtgctcatactaattacagcacaaagccaatgagacatgatggtggcatcgatgttatcaagaaggcgattgagaagttgggtctgcgccacaaggagcatattg

SEQ ID NO: 13685 - DNA, 373 bp, Gossypium hirsutum
  Clone ID: uC-gsflnu33B011a10b1
tgcacgcttgggtcccagcggtcgccaggatcggccaataatgtcttgggaggtcatcctactcctcacagggctaatgcttagccttgagaaagctgaaattccaagcgtcggtggcagaaccaaaagctattcgatcctttgcactgagtgcgataatagaacaggcgtgtcatgcactctaaaacaatctttgaatgcagtcgagaccaagattaatgctccatcatcggaggaatcgaaatcaaatcatggaatgaggagtaagacacactggttgttcttgtcttgtcagtttactacatcataaacaaggcgagtattaaatacatcagcagtgtaggcgttttctgccgtgagcaaagacagatcg

SEQ ID NO: 13686 - DNA, 431 bp, Gossypium hirsutum
  Clone ID: uC-gsflnu33B011b05b1
tctcacgcgtccgcccacgcgtccggcaggaatcaccatcatgggttacgattggggccataaaaaaccaaagtccaaggctgtgatccctaaaaaggccaggtccgacaacccgtacctcaggttgttgatcaagctgtacaagtacttgcacacccgtgtcccctgcgggttcaacaaggttatcttgaagcgcctccaccacagccgttccaacaaaatccccatctccctccagaccctcatcaaaaagatggacaagaagaccgacaaggttgccgtgattgtgggatccatcaccgacgacatccgtgtacaagaggtgcccgcgctcaaggtctgcgccttgcacttcactgaggccgctcgtgcccgcatcatcaaggcgggtggacaaatctataccttcgaccaacttgccatccagaggc

SEQ ID NO: 13687 - DNA, 513 bp, Gossypium hirsutum
  Clone ID: uC-gsflnu33B011b08b1
ttaccttcaaaacgaagagattcttgctcgaaagtatcggattcgactgaggggtatagatgcacctgagatgtcgatgccgtttggaaaagaagcaaaagaagagttggttaagcttgttcatgggaaatgtttgagagtgcttgtctacggggaagatcactatggtcgttgtgttgcagacatatattgcaatagcattttcgtgcaggaagtaatgctaaagaaaggactcgcatggcattatgtagcctgcgaccaacgggttgaattcgcaacttggcaaaaagaggctcggacaaagaaaaccggcctttgggtacaatcaaacccagagaagccatgggaatggaggaagaagaacaaacatgaaggtaggtaacactgtccttaaggatccataacatcttgagaagtgataaaagtacacagttatcatatttgtgtaaagaaccatgtttgatccattcctatatctcttgtttgcatgcaatgcttattattatcaaatga

SEQ ID NO: 13688 - DNA, 174 bp, Gossypium hirsutum
  Clone ID: uC-gsflnu33B011b09b1
ttaataacagtggtagctttgctgagactgcaatttggtagtgtattgcttttgaggattgttgtaacttggtaactttggctagtgccccctttgtacttttgaaccgtcaaaactcagtaattactgtttctagttttaactttttgtaataatgtcaaaatttgatatttt

SEQ ID NO: 13689 - DNA, 471 bp, Gossypium hirsutum
  Clone ID: uC-gsflnu33B011b11b1
ttcacgcgtccggtttatccgaatttgaaccagatgaattttaatttgaattgattttatttaagagaagagtcaagtatctgaagagggagctttgatcaacaaaattccatcaatggcgggggtttctttgaagtgtggggactgcggggctctgctgaaatcggtggaggaagcccaagaacatgccgaactcacctcccattccaacttctcagagtccactgaagctgttctcaatcttgtttgctcttcttgtggcaagccatgccgatccaaaatcgaaagtgatttgcatacaaaaagaacggggcatacagagtttattgataagactttggaggcagtaataccaatcagttgggaggttccaaaggtagctaaggagtcagaggaggctattgctgcaggtagcaccggtgagcctgagagatggttgttccaaggttgacaaaaactgcttgaagactg

SEQ ID NO: 13690 - DNA, 439 bp, Gossypium hirsutum
  Clone ID: uC-gsflnu33B011b12b1
tttatctctaaggaccgacattgccaaatctctttagggcgtttctcataacagagcaaccatgagctccatcattcaaagctttcaaaagaacagctccctccccgtctcccaaactgaatcaaaagaccactttccaccaccaggaggcccagggctgctgcgaagaaggctttcatctctgtctctaaaactacaacccacttcttcaccgacgacgtcatggacattccccagatccaagtccttgtcttccatgggagaatacgccggtagctccatcaggaaatggcgggacgcgggctggctctgggttctctccaaaaagccctcgttcgctaaagacattgaaatgaacgaagaagaaccaggatccttgggtgccacaacaaggcagttggagcatgtgtttatgagtcagactgagatcagaaactcg

SEQ ID NO: 13691 - DNA, 454 bp, Gossypium hirsutum
  Clone ID: uC-gsflnu33B011c01b1
ttcacacacgtgccgtaatgatttaatgctgaggaagagctatgactgcacttgtacacatgacagatggtgacctagaagctttaggcataccaatgggcccaagaaagaagataattttggaattggaatcaagagcctgataatcagagttttagcaagtagtcgttgcctgtttaatctcaagatgtgttaatggccaatcctacaagactgtaaggctgcgttttgggtgataagaacctgcatatgtaccaattctttttggtattgtttttgtttagttttattaacaaaaatatggcttcacgggcctttgtcattgaaatggaaggatggaatattattagattgaaagtagggtcaggatgtttctttggtgccaattagtggcattgggtttagaaaaccttaagtgacatatgtgctgcattgccttcatttatatttttgg

SEQ ID NO: 13692 - DNA, 169 bp, Gossypium hirsutum
  Clone ID: uC-gsflnu33B011c03b1
tctcacgcgtccgtgtcacttggctcgatccgttcatggtgtttgaggatcaattccgtaacaccgatgtataagtacccgtcgatggtagttcgataagggtatgtaaaactccgatttcgagttgttgatctttgcgcatcgagaataaaaggtcatcttacggttc

SEQ ID NO: 13693 - DNA, 374 bp, Gossypium hirsutum
  Clone ID: uC-gsflnu33B011c06b1
tttataaactaaactatagggctattatatagtaattactaatacatggtggccatccgtatatatatacgcactgccgtgactctaacgtaggaaggaatatgtacatcggacagtgattgtcatctttcgctgtgcccgtcactctaacgagctttaacaagttgactgacaacggagcaaccaccccggctggacatagaagccgacgatctagctcatggcttcggggtcggccgctctaaatgcgccaacgccaccatctcaggcgtccacgtcaaccctgccgttatagttgggcgctaattgcagacgactgcaccactctctagaacggcattcttgacagaaccgtgcaactaccaagcttaacc

SEQ ID NO: 13694 - DNA, 413 bp, Gossypium hirsutum
  Clone ID: uC-gsflnu33B011c07b1
aaaaccctagccaacctttccgcagctcgctaatgggggcttacaagtacgtgtcggagctatggaggaagaagcaatcggatgtgatgaggtttttacagagggtgaggtgctgggaataccgtcagcatccagccattgttagggtcaaccaccctactcgtcctgacaaggctcggcgcttgggttacaaggctaagcagggttatgtagtttatcgtgttcgagttagaaggggtggtcgaaagaggcctgttcccaaaggtattgtctatggtaagcccacaaaccaaggtgttacccaattgaagttccagcgcagcaagcggtctgttgcagaggagcgagctggtcgaaaattaggaggtctattagttgttaactcatactggatcaacgaggattctacttac

SEQ ID NO: 13695 - DNA, 515 bp, Gossypium hirsutum
  unsure (1)..(515): unsure at all n locations
  Clone ID: uC-gsflnu33B011c08b1
tgttcacgcgtccggtagagtcaaacagtacctccgaggctacttttggtcggatctttcaggcgtttaagaactcagagcaccaaaagcaagccaaaccaacgctgttcgtccggcacagtcgaaccctggtttcgcttctgctgccctccggactttaatcctcttacatcgaaacagaaatcccaagcgataaataagacagaaaagaagaagaagaagagataggaagagagggagataaaggaaggcatgggagatctattcatatggcttatttctttcttcatcctcattgcccttcttgttctcattgtttatcagctcatgtgcttggctgatttagagtttgattacatcaatccttacgactcttcatcacggataaacaaagtggtcctgccggaatttatcctccaagggattntatgtgtattctatctattaacgggacattgggtcatggcgctcttatgtggtccatatttatactacaatgtgagactttacacaca

SEQ ID NO: 13696 - DNA, 469 bp, Gossypium hirsutum
  Clone ID: uC-gsflnu33B011c09b1
ttccacgcgtccgatcaccactgattacatgacctatatgttcaagtacgacagtgttcacggtcaatggaagcaccacgagcttaaagtgaaggactcaaagactcttctctttggtgaaaagcctgtcactgtttttggcatcaaaaaccctgaggaaattccatggggcgaggctggcgctgaatatgttgttgagtctaccggtgtcttcactgacaaggacaaagctgctgctcacttgaagggtggtgcaaagaaagtgattatttctgctcccagtaaggacgcccccatgtttgttgttggcgtaaatgagaaggaatacaagcctgatcttgacattgtctccaatgctagctgcacaaccaactgccttgctccgttggctaaggtcatccacgacaaattcggatttgttgagggtcttatgaccactgtccattcaattactgctacccaaaagact

SEQ ID NO: 13697 - DNA, 489 bp, Gossypium hirsutum
  unsure (1)..(489): unsure at all n locations
  Clone ID: uC-gsflnu33B011c10b1
cccccgcgtccgcccacgccgtccgaaaaaaagtaaaaattaaaaatnaaaaaaaaaaaaaaaaaannaaaaaaaaaaaaaaaaaaaaatnnttnntattattaaaaatggaaggtgatttaagggggcccagggatagatggaaaggataaaaagaaaaaaaggggggggggggttaaagggaccccaccccccccccccgggtcccccccctccagacccgtaacaccggggccctacaccccatccccgggccgccggttcccccccccttcccccgggccccccccgggggcccccccccaaaccccccggccccccccccccctttgccccccggggtgtaaaggggaaggcccccccccgggccccctccccccccgtggccgacccggttccccccaggggccccccccccttgggccccccccttccccccgggccgggggggtcccccccggcgccccccccccttgccccggccccccc

SEQ ID NO: 13698 - DNA, 465 bp, Gossypium hirsutum
  unsure (1)..(465): unsure at all n locations
  Clone ID: uC-gsflnu33B011c11b1
tccacgcgtccgcaccaagggagatgggcttggtgctgaaattgttggcacctttgtgcttgtttacactgtgttctcagccactgatgccaagcgcagtgccagagactctcacgtccctattctggcaccattgccaattgggttcgcagtgttcttggtgcacttagccaccatcccaatcacaggaaccggtattaacccagctcgtagtcttggtgcagccatcattttcaacaaggacaagggctgggatgaccattggattttctgggtgggtccattcataggagcagcactagcagcactctaccacgttgttgtgatcagagccattcctttcaagtcaaactgatcaaaatcaacggtccatatgatcatatgatctcaacaaaatgaaaaatttcacccatgcancctttcagtttgtgtatttcccaatttatccttttggttttgcatgcc

SEQ ID NO: 13699 - DNA, 491 bp, Gossypium hirsutum
  Clone ID: uC-gsflnu33B011d02b1
ttcacgcgtccgctcacctggaaacttaagcttgcgaggctatgaagctattgatgatgcacaggagcagctggaagatcagtgccctggcattgtctcctgtgctgatattgttgcaatggctgccagagatgccattttctggtcagagggacctgtgtatgatataccaaaaggaagaaaagatggaaggaggtccaagatagaagacaccataaacctgccattccccaccttcaacacctcagagctcatcagcgccttcggcaagcgaggtttcagtgctcaagaaatggctgctttatctggggcacatacgttaggagtggcaaggtgttcatccttcaaaaacagattgagatacgcagatgctaacctggattcgaatttcgcaaagacgttgtccaagacatgcagtgccggcgacaacgcggagcaaccgttcgatgccacgcataacaccttcgacaacttctacttcaacgcattga

SEQ ID NO: 13700 - DNA, 489 bp, Gossypium hirsutum
  Clone ID: uC-gsflnu33B011d03b1
ttcacgcgtccgcccacgcgtccggtaaaatccgacgaaattgccgtgaaggaagaatgggaaggtggagtcaattcgtggttgcggtgactattctggcggtgggcctcctttcggcatcagccaccgctagaccctgcaagacattcttcgtcgcctcctattctttctcttttgaaaaccctaacgacccttcttcctccaccggattcgtcaccgtcttcaccgagatcggtcaattgaacgtcgtaccaccaagacccaagccctccgatgtcttgagctctctccgtgagcgcagtaaggacatccttagcgtggtcgtcgctcttctcttcggcgtcggtagcggcgctctcacggcggctaccctctacttggtctggaccctcttctcggcccggtctgattatcatcgtgcttgtttggaggatgatgagagcgacggagaacttagccctaagaagattgggtatgtaacaattccca

SEQ ID NO: 13701 - DNA, 413 bp, Gossypium hirsutum
  Clone ID: uC-gsflnu33B011d04b1
ttccactcgtgcggatcaattgaactccaaaaaacaggtacaggaagtttcatagatgaaaaggggttccgcagcgctgtatacatgatcgacattggacaaaatgatctgttaatggctttgtatgcatcaaacttgacatatgaaccagtatccaaacagatcccttcttttcttgcagaaatcaaattagctattcaaaacatatactcatatggtggcagaaaattttggatacacaacaccggtccgttaggatgtgcgccgaaggagcttgcattacatcctcataacaagatccgatcttgacagaatcggatgcttccgcgtccactacgatctggcgaaagcattcaatcgaggattacgtaatatctgtaaagaaatgagaactattctaaaagatgcaacca

SEQ ID NO: 13702 - DNA, 503 bp, Gossypium hirsutum
  unsure (1)..(503): unsure at all n locations
  Clone ID: uC-gsflnu33B011d05b1
ttccacgcgtccggaacattccgccccaaaaaaagtgcaccttctggaagtaagggcgcacagcttaaaaagcacattgatgctaccctgggcagtggaaacctaagggaagcagtgaggctacctcctggggaagatttaaatgaatggctcgcagtcaacactgtggatttcttcaatcaggtgaatctgctctatggtaccctgactgagttttgtactcctgagaactgtcctacaatgactgcaggccctaagtatgaatatagatgggcagatggcgtgcaaatcaagaaacctttcgaggtttctgccccaaaatatgtcgaatatctaatggactggattgaaacacaacttgatgatgaatcgatatttcctcaaaaactgtgtgcaccatttnctccaaacttcaaagatgtagtggaagacaatattcaaaagactgttcccgagtatatgcccacatttatcactctcacttttagaaaattgggagccct

SEQ ID NO: 13703 - DNA, 481 bp, Gossypium hirsutum
  Clone ID: uC-gsflnu33B011d09b1
ttccacgcgtccgtaatgatttaatctccaccaaaacctcacaaatccagctcatttaacaagggatgctctcttagtcttattcatcaaatcacatttcaaaattcccatatttttcttcactgttttccctttttcttttcccctgttttttttatgggttgcgctagttccaagcagaaacgatgccgccattgccgggctccttattcgcctgttccaagaagctattcgatgcatgttcatcatccggctcagcacacaggcgatagttaccatgtcgtagcgttaacatccacaacattaggcactctcaagctagaagacaaccaccacagcaatggcggcaccatcaacgttgcagcttttgaaaacggctccaaaatcaatggggatttgaaggaagctgaagaagagagcaaagggctgaatatgaaagtgattgaagccaaaatatggtcgaaaatgctcgctaaaattt

SEQ ID NO: 13704 - DNA, 346 bp, Gossypium hirsutum
  Clone ID: uC-gsflnu33B011d11b1
tccacgcgtccggccacgcgtccgcaaatctgttgtctgtgaagccaccattaagggtgacgtggttaggaaggtcttgaacacaagtgtggaatctctctttgagcttaacatgctgaagaaccttactggatcagctatggctggagctctgggtggattcaacgctcacgccagttacatcgctgctgcagtctacatagctaccggacaagatccgggtctaaacctgaagagctggtattgcatcccaaatgtggaagctgttaatgacggcaaggacctccacgtatatgtcacaatgccttccatcgaggatgggactgttggtggtgaaactctagct

SEQ ID NO: 13705 - DNA, 520 bp, Gossypium hirsutum
  unsure (1)..(520): unsure at all n locations
  Clone ID: uC-gsflnu33B011d12b1
tctcacgcgtccgcccacgcgtccgcccacgcgtccggacctccctccggttacagtccctccaattaacctccctccagggacggttcctccagtaactaagccaccaagtgggaaaccctgcccaacaccaccaaccaaggacacttgccccattgacacactgaaattgggtgcttgtgtggatctgctgggagggttggtgcacattggactaggtgacccggttttgaatcaatgttgtccggttctttcaggacttgccgagctcgaagctgcggtctgcttgtgcaccaccctcaaacttaaggttctcaaccttaaaatttatgtgccactggctcttcaactccttgtcacatgtgggaaaacaccccctcctggttacacttgctctctctaaaaccaaggttgctaggttgatggaatggacatgagaagatgtcgagcttttctctttggttcttagctggattggaaatctgatgcagtgttnattgtaacaccaattaattttttt

SEQ ID NO: 13706 - DNA, 491 bp, Gossypium hirsutum
  Clone ID: uC-gsflnu33B011e01b1
ctcacgcgtccgcccacgcgtccggtggcaagtttacaacactcttggtggcagtcatggtatacctcgagttcactataagggtcgtcaaggtgactattacgttatggttatggatatgctgggtccaagtctgtgggatgtttggaataataactctcatacgatgtccatagaaatggttgcttgcattgctattgaagcgatatcaatattggagaaaatgcactctagaggctatgtgcatggagatgtaaagcctgagaattttcttctaggtcctacaggaacacctgatgaaaagaaattatttcttgctgatcttggattagcaaccaggtggcgagatagctcaactggtttgcatgttgaatatgatcagaggccggatgttcttaggggaacagtccgttatgctagtgtgcatgctcatttagggagaacgtgtagcaggagagatgatctagaatctcttgcatatacacttattt

SEQ ID NO: 13707 - DNA, 390 bp, Gossypium hirsutum
  Clone ID: uC-gsflnu33B011e05b1
ttatggaactcataactcctcaaaattcttcttcaatggcgtctcgagttcttgttttggcttcaattcttattttctcttgttttgcagagacatgctatggggcgatctcattctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatagtcaagaaaccctacatcaacgtcaacgtatcccttg

SEQ ID NO: 13708 - DNA, 440 bp, Gossypium hirsutum
  Clone ID: uC-gsflnu33B011e06b1
ctgcaaaatttctcctctcaactatacttagtaaaagaagaaaagaagaagaaagaagctaagcccattaatataattcatgcaaatcaataataaataagggcaattctatctggcctgcttctcctctgcatcgctgttgcattgtttgtgtactgtactatttgctctgtcatctgctcaattttctggtatctgaaacacccatcaaaagaaaataagaaaactcttcgtttgtctttttttcccccatggcgttttgagcacctcttatcaactcgaggctcaactcacctgcttcaagttccccgagtctactcgttgaccattaagacttggagaagagaatctgataaaagagggtttctcctttttcttcttcgtttgaatttttggttgctttcaccgatgaatcggcgattcctatttgtactatcatc

SEQ ID NO: 13709 - DNA, 274 bp, Gossypium hirsutum
  Clone ID: uC-gsflnu33B011e07b1
tgctttgtgatttgcagagaaaagaaaatgaaggaaagtatgggcaaccctcttcacctcaaatctttgaaccacatctcccttgtgtgtagatcagttgaggaatccatgaacttttatcaggatattcttgggtccgatccaatcaggagacctggatcatttgactttaatggggcatgcagtggtggtattcaggattggaatacatctcctgcaatcgggggatccagagggtatgtccatgtacaaggaaatgcatgtgatcagcatt

SEQ ID NO: 13710 - DNA, 466 bp, Gossypium hirsutum
  Clone ID: uC-gsflnu33B011e09b1
ttatgaacggaacttgggattcgttatatccggaatggatcgatgaggagcaagaagaaaaggtccctgtttgcccctctctaccgaagatcgaagtccccggaatacgtcttgatctggttgctgtcaagctgccttgtagaaatgagggtaattggccaagggatgttgctaggctgcatttgcagcttgcagctgctagtcttgcaacctcggccaagggcttttatccgatgcatgtgcttttcatttcaaagtgctttccgattccgaacatgttcacttgcaaagaactcgtagcacgcgaaaacaatgtctggttatacaaaccagacttgaatgtgttgagagaaaagctccagttccctccaggatcttgtgaacttgcccttccttttgaggtcaagggtcagttcatattcttaaaacaaatgcctcatcctcctgcaagaatatagagagattc

SEQ ID NO: 13711 - DNA, 183 bp, Gossypium hirsutum
  Clone ID: uC-gsflnu33B011f01b1
ttcacgcgtccgctgaaggccatgattgttgatgctgccatattgttgtaatttaccatagaattttggtttggaaatttaagcaataatctcttcatattttttgacacctgtaattctttatcatctctctggaaatttcactgtttggtatgaaggaaaatggaaggaaaattatctttc

SEQ ID NO: 13712 - DNA, 391 bp, Gossypium hirsutum
  Clone ID: uC-gsflnu33B011f02b1
ttgattttaaagctgcacccgaagccaaaagaggaaaggaaaaaggaggattgtttgttttgcgatggcggacaaggcggtgacgatcaggacaaggaagttcatgaccaacaggctcctttccaggaaacaatttgtcattgatgttttgcatccagggaggcccaatgttgccaaggcggagctgaaggagaagctttctaggatgtatgaggtgaaggacccaaattcgatctttgtgttcaagttcaggactcattttggaggtggcaaatctactggatttggtttgatttatgattctgttgagagcgcaaagaagtacgagcccaaatacaggctgatcaggaacggactcgataagaaggtggagaaatcaaggaagcaaatg

SEQ ID NO: 13713 - DNA, 507 bp, Gossypium hirsutum
  Clone ID: uC-gsflnu33B011f04b1
ttccacgcgtccggtttctaattgatcaaggttatagctttaaggtgataacaagcttgcctccttctgatgctggtgccgacttgagttactaccatctcgatgagcagttggctcttttaggaaaggtcttgactgctggtgatgatgcggttggtttggagcagttagaagaagatgcagatgatatagcccttcacaaagctcgtcgctctatgggatccatgagtgcaatgtcgggtgcaaatggaatggcctacatggaatacagcactggaaagcataaacttatggggcatggccagaataagagtaaacctaaggatccatccaagcggcatcatttgtttaagaaacgctttggttgagatgaaagccaaaccatgcagaatgttggttgttttatgacaatctacgaggttacttcccgcattgctttgtttaagagatgctatggtcgagatgaaaagcataaacccgattacgtttggttatatatattatcta

SEQ ID NO: 13714 - DNA, 472 bp, Gossypium hirsutum
  Clone ID: uC-gsflnu33B011f05b1
tcttaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcggtttttggggcccccattttccccccggggggggggggacactttttttttttttgggggcccaaaaaattattccggggggggggtttttacaaccgggggtggggaaaacccgggggggcccccatttttacgggttggggaacatcccccttttcggggggggggtaattacgagaagggccccccccaaaccccctcccaaaaattgcgccccgtgtggggggattggggcccccccttgttggggggttttttgggggggggggggggggggtcccc

SEQ ID NO: 13715 - DNA, 510 bp, Gossypium hirsutum
  Clone ID: uC-gsflnu33B011f06b1
tgttcacgcgtccgcccacgcgtccgcccacgcgtccgaggacattgatctccattctccctcacacagcaaaaacctaaggctacaaggaagaagaaaaagctaacagcagcagcatgagtttccaaagagtacctcaagacccttaccctcctcctgggtatgcctctccttatccacccccacccccatctggatacccttctgctccaccttacgaaggctacccaccaccgccgcctccaggttatccaccgtatcctcagccgcaacgccagccttacgagggttaccaagggtattttgctgaagggtatcccccaccaccacctccacctccacctccaggtcatcctcaatatcaccactgccactacgagcatcaccatcaccacaatcattctgatgatggctggttctctttcttaaaggctgcttggctgctctatgttgctgctgcatgctggaggaatgctgcttttagtgaaagctctacttgcattttgtgga

SEQ ID NO: 13716 - DNA, 382 bp, Gossypium hirsutum
  Clone ID: uC-gsflnu33B011f11b1
ttcacgcgtccgatttgtttagataatatatagaaaggggaagaaactgagaaagcaaaaatggcgactgcacttaactgttgcttgtcttcttcatgcttctctcttcaatctaagctcaattccctttcacttaaaaccaacatcaactcttcttcttcttatgctttcaagactctcagtttctccagtaacctctctcacaatctcttctccaaagggaatctgtcttttagtacagtgactccgaaaccaattcatcgatcttttgttgcttgtgaggctgcaccaaagaagaaggctgattcagctgctaagagggctcgacaagccgagaaaaggcggggtttaccacaaagcgaagaatgccgaagtcaacacc

SEQ ID NO: 13717 - DNA, 413 bp, Gossypium hirsutum
  Clone ID: uC-gsflnu33B011f12b1
ttggacgcgtgggcaaaatctctctttctcgtcaatatggcagcaaatggcgttgtctctgacaagagcttgatcgtcagcttcggtgagatgctgatcgattttgtccccactgtctccggtgtttctctagccgaagctcccggcttcctcaaagcccctggcggtgctccggctaacgtggccattgctgttgctagactcggaggcaaagcgtcatttgtcggaaaacttggggacgaccagttcgatcatctgctgaccgattttcccaagcataacagtgtctccgctgtcgggacctcgtttgaccaaggcgctagaactgctcttgccttcgttacgttacgcgccgacggagagcgtgagttcatgtcctataggaatcctagcgccgacatgctgttgaagcc

SEQ ID NO: 13718 - DNA, 377 bp, Gossypium hirsutum
  Clone ID: uC-gsflnu33B011g01b1
tgcatcgtcaccatcatcctcgattcaatcagcaacagctccgttgtctccttcaacactggattctcccaccagacgtctgaaaatgacaagctctgaatagagcagcatattttactactaataaaaaggatttcaacttttagaagactagaccaaacccctccctgcaattctcccgttaatattttttgacggtttttgttgcgctttgcaaattaatcaaagctcccttatcttcttctttctaagtttttgtactttctgttaattatatttatataatgtaacaaaatgggattccaattactaactcagattaaattatatttattcttctttttttacatatatttgaggccaatttcttttgggtt

SEQ ID NO: 13719 - DNA, 495 bp, Gossypium hirsutum
  unsure (1)..(495): unsure at all n locations
  Clone ID: uC-gsflnu33B011g02b1
tttctcattgactacatccgtctccgcggtgaaggttgctggcgttccctccccaaagctgctggactgcttaggtgtggtaagagttgcaggttaagatggataaactacttgaggcctgatcttaagagaggaaatttcagtgaagctgaggatgaacttatcattaaactccacagtttacttggaaacaaatggtctttaatagctgcgagattaccgggaagaactgacaacgagatcaagaactactggaacacgcacatcaaaaggaagcttataagcagaggaatngatccacaaaatcatggtccactcaatcaacccaccaacaccaataaatccactgaattggatttcaggaacgtacctaaagcttcaaaatccaactttgctccaaacccatctcgggatttcaatttcaatgaatttcaagttaaggccaaagcagaatccattgaagaaggaaactctagcagcagtggaatgactact

SEQ ID NO: 13720 - DNA, 377 bp, Gossypium hirsutum
  Clone ID: uC-gsflnu33B011g04b1
tcacctctgagttttcaacttaaaatttcttggttttcctcaagaaggaagaagatgttgcaaatagctttcagctcgtattcatggctgttgactgctagcaaccagaaagatggaatgttgttcccagtagctttgtcatttttggtagccatattgggaatttcactgtggcacgtatggaccataaggaagccaaagaaagacatcgccccattaccgccgggtccccgtgggttgccaatagtgggatatcttccatatcttggaactgataatcttcacttggtgtttacagatttggctgcagcttacggtcccatctacaagcttaggctaggaaacctgttatgcgttgtcattagctcggcaccact

SEQ ID NO: 13721 - DNA, 506 bp, Gossypium hirsutum
  Clone ID: uC-gsflnu33B011g05b1
tccacgcgtccggcgaaaatgagagagtgcatttcagttcacatcggtcaggctggtatccaagtcggaaatgcctgctgggagctttactgccttgaacatggaatccagcctgatggccagatgccaagtgacaagactgtcggaggaggtgatgatgcttttaacacctttttcagtgaaactggtgctggaaagcacgtccctcgtgctgtctttgtggatcttgagcctactgttattgatgaagtgaggactggtacttaccgtcagcttttccaccctgagcaactcatcagcggcaaggaagacgctgccaacaacttcgcccgtggccactacactattggaaagagatcgttgacttgtgcttggaccgtatcaggaagcttgctgataactgtaccggtcttcaaggcttccttgtttcaacgctgttggtggaggcactggatctggtcttggttccctcctttcggagcgtttgcctgtggattatggcaaga

SEQ ID NO: 13722 - DNA, 500 bp, Gossypium hirsutum
  Clone ID: uC-gsflnu33B011g06b1
ttaaaaatccacagactggtttgtatgctcttttcagggtattatctcaaaggggaattgcaaaaaagatacaggtgattgcaaaagctagcgtgccaataattaagtttgtagaaaagaaaagcggtgccgcatttgatataagctttgatgtggataatggaccaaaagctgctgagtttatcaaggaagcagtactaaaatggcctcaattacgaccattgtgtttgatcttgaaagtatttttacaacagagagacctgaatgaggtatattcaagtggaataggttcatatgctctccttgcaatgatcgtagccatgttgcagaaagttacagcggtggttgatgcagctttggaggcccatctgcactgtccgcagctatatctttatagcatagatgaaagggtcgttccgtataacactgtcccccttctctgttgtcagaaccccacagatgtgatttgtagctcttcccttagcattgatgaccagctc

SEQ ID NO: 13723 - DNA, 310 bp, Gossypium hirsutum
  Clone ID: uC-gsflnu33B011g07b1
tcatgatcttgtcggaccaaaataaaaaaaacggttaattctcgtaaacaggccgacgccgacgcctactccgacgcggctcaggcgctcactcacctacagcatctcccttgaagtagtagtcccacagtggatatattctaattgcatttgattagtgatttctgcagactccaattccaactatatatataataaacatttcgaggtctatatatacctatatatacgaacagatcgatgactatgagctgagacacatgctgcggagggtcgccggtgcacggagctaacgagaaaggtagcttgt

SEQ ID NO: 13724 - DNA, 146 bp, Gossypium hirsutum
  unsure (1)..(146): unsure at all n locations
  Clone ID: uC-gsflnu33B011g08b1
ttggacgcgtgggtagctgggttcttttttattgattcagtactgttttggaacttgaaaaatactgtcactgttatggggttatagttgtgactgaacttggtttttcactgttcatttttatcttnnnnggatttggaattttt

SEQ ID NO: 13725 - DNA, 261 bp, Gossypium hirsutum
  Clone ID: uC-gsflnu33B011g09b1
tgtaacccttgatttgtctagcaatgatctgcatggttcggtcccacatgagttatcaaatcgtgcttatctgaacaatctgatactgtcaaacaataggctttcaggctcaattccataccaattatcaggtttggataggctgaaaaggttttctgtagcaaataatgatctctcgggtgctattccttcatcttttgagaatcgtgataaggcagattcttctgggaacagtggtctttgtggggatcctcttggaaa

SEQ ID NO: 13726 - DNA, 478 bp, Gossypium hirsutum
  Clone ID: uC-gsflnu33B011g10b1
ttcacgcgtccgcccacgcgtccgcccacgcgtccgccttgttctcccccctcctctgtctttctggcaacatgggttcaccaccactttggattctgcttctgggtgtgttgcttatggcttctggaacaatcgcagctccccctaggaagcctgtagatgtcccattctccagaaactatatgcctacttgggcttttgatcacattaagtatttcaatggtggctctgagattcagctccaccttgacaaatacactggtactggtttccagtccaaaggatcatacttgttcggacacttcagtatgcaaataaagctagtccctggagattctgcggggactgtcactgccttttatttgtcttctcaaaactcagagcatgatgagatagattttgagttcttgggcaacagaacagggcaaccatacattcttcagaccaatgtgttcactggtggcaaaggagacagaga

SEQ ID NO: 13727 - DNA, 452 bp, Gossypium hirsutum
  Clone ID: uC-gsflnu33B011g12b1
ttcacgcgtccggaacgccttatggcagacgcttcataagtcaggagttgaattcatatcttgaatacttgtttaaactcattgttgagaggggtcctgatgttggattgaaagtttcattaaatcgatatgatttgtttcatggtcacctttttattgccacagagactggaaggctaggcatattgtttcatgctaaagaataccccctgtatgataaacaagtgtttccatactacttgggttattgccagaaggattctaatgtgacttatgatgattcgataaacttgagaaatattctctggcttgctccattgccaagcaattcaacacaaggctggatagctccaggagtcctgcttgtcctggatgctcatcctggaggaattgtatatagggatctcatacctgagtatgtcaatgctgtgaggaccatatatgaagatgat

SEQ ID NO: 13728 - DNA, 375 bp, Gossypium hirsutum
  Clone ID: uC-gsflnu33B011h01b1
ttttgtctcaccgtttgcatcatttgaaaaagtgaaggaagtggaggagtttctttgccaaccgatcaatgccttcgattgcaaggacattgaagcagagcctggagcgggttaacattaatgccaactgggttaagagcattcaggcagagcaaaatctgggtgaggccatacaggagttagcttacaggaaatactaagggatttgtctctgtttttactagagatctagtatggaaagtagccgtggtggctttttactgttgttatacttttttactaaactgaatactctctagtaatatcatgaataataatcatcctaataaaaacaatgtattaggcattagttattagttatttttaggtgttacc

SEQ ID NO: 13729 - DNA, 371 bp, Gossypium hirsutum
  Clone ID: uC-gsflnu33B011h03b1
ttcacgcgtccgcccacgcgtccgattacctgcaaagctcattaaatccactttcagatccctagaatctatcaacccaaaacctcattcgggtttctcaaatttttatttcgtctatcgaggagaagaaagcttcacagaggagaagcgatagtcaaagtttcatctccatctgacagtggagatggtagatgggggtattcctgattcttgaattttttctttgtgtttctaatattatagggagctttctcttaaagtgaaagtcggtagatgaaaaggtatatagatgggaaacttagttgcaaagcatttaacctttgcagagttcgttaatggtcatatagatgtgtaaactttcgacatgtttt

SEQ ID NO: 13730 - DNA, 395 bp, Gossypium hirsutum
  Clone ID: uC-gsflnu33B011h04b1
tccacgcgtccgctggatttgagggtgataacatgattgagaggtctaccaaccttgactggcacaagggtcccactctccttgaggctcttgaccagatcaatgagcccaagaggccttcagacaagccacttcggctcccacttcaggatgtctacaagattggtggcattggaactgtccctgttggtcgtgtcgagactggcgtccttaagcctggaagggttgtgacctttggcccctctggcctgaccactgaaggtaagtctgctgagatgcaccatgaagccctctctgaggctctccccggtgacaatgttggattcaacgacaagaacgttgctgctaaggatctcaagcgtggcttcgttgctgcaaactctgacgatgatcct

SEQ ID NO: 13731 - DNA, 481 bp, Gossypium hirsutum
  Clone ID: uC-gsflnu33B011h06b1
ttccgtagaactttttattcttgtttttgtttattgtaatgctggcttttttgataaggcgcgcgagactaaattgatccgattataacaaatctgtgattaccggtggcggctgcgccgtcttgattctttcgtccaagggagcgtagatgtcggggccactagatcgatttgctaggccttgctttgaggggatttcaggcagtgatgaaaagagagagaggaagtctgattttgagaactctgaagatgaaaggcgcacgaaaatgggatctctaaaaaagaaagctttaaatgcatctactagatttaaacattctctcaagaagaagagtagtaaaaggaaaagtgatggccgtgtcagctctgtatccattgaggatattcgcgatgtcgaggagctgcaggctgttgatcaatttcggcaagcattaattatggaagaattgcttccggaaaaacatgatgactatcacatgat

SEQ ID NO: 13732 - DNA, 447 bp, Gossypium hirsutum
  Clone ID: uC-gsflnu33B011h09b1
ttcatccacatattatccgccgtcgtcgcaacagccgctttcttcttccgccatcgtgggacccaccgaaaaggtcttatcctcaagccctgacacccctctatccttttgtcccagtgaaccagatgagaagcctcagcctcagcctcagcctcccaagaagaaaacttcggttaacactctcaaaaggaaaaaagaacaaattttagagatggtgaaggattttacccatcgcaatgaattgcttaaaaaggatattgagattaagaggcaattgcttgatcaacaaatagctgagaatttggaattgaaatcgaagaaacaaaagttaaatcagagtcttctcacaccagtaacaaataaaaggttggatcttggggtacaatcagcccaagttagtattggtcaataccatcattatcaacaccaacaccctactagatctaa

SEQ ID NO: 13733 - DNA, 427 bp, Gossypium hirsutum
  unsure (1)..(427): unsure at all n locations
  Clone ID: uC-gsflnu33B011h10b1
ttcccccacactcatctctatttcggattggggattagtggtcctcaacatttgtctgtacttgtactatgagatcttgaactctcctgatcgtgcttgcactctcgcatacaggcttttgatgaagccattgccgagcttgatacacttggagaggattcatacaaggacagcactttgataatgcaacttcttcgtgataacctcactttgtggacctcagacatgcaggatgatgggacagatgaaatcaaagaagcttccaaacaagaggatgagaaacaaccgtgaagtctctaatcttcatggtagtgttntacttctctggttgtttttgatggaagaagtcgcttggtcctactatcgtcttcaattacttgtttttagtagatcaggcctcaatttatgaacctggaagtactcctaa

SEQ ID NO: 13734 - DNA, 469 bp, Gossypium hirsutum
  Clone ID: uC-gsflnu33B011h11b1
ttcccttttctgtgtttgctgttaccaagaaagctgtcgctgttcttaaaggtaattcggaagttgaaggcgttgtcacgttgacccaggaaaatgatggtcctacaactgtgaatgttcgaattactggtcttactcctgggcctcatggcttccacctacatgagtatggtgacacaacgaatgggtgcatgtctacaggagcacatttcaatcctaacaatatgacacatggtgctcctgaggatgaagtacgccatgcgggtgacctgggaaacataattgctaatgctgatggagtggcagaggcaacaattgtggacaatcagataccactaagtggccccaatgcggttgttggaagagcatttgtggttcatgagcttgaggatgatcttggaagggtggacatgacttagtctaccactggaatgctgcggcagattgcatgtggggttgtggcttgact

SEQ ID NO: 13735 - DNA, 441 bp, Gossypium hirsutum
  Clone ID: uC-gsflnu33B011h12b1
ttttcttcaactatcttttctcttcaaagatttcaactcttttctcagaatgggaagtaccgatgggaccagctatggtgcttacacctatgatgccctggagagggagccttactggccatccgagaaacttcgaatttccatcaccggtgctggtggcttcattgcttcgcacatcgctcgacgtctaaagagtgaaggacattacatcattgcttctgattggaagaagaatgagcacatgacagaagatatgttctgtcacgaattccatcttgtcgatcttcgagtgatggaaaattgcttgaaggttaccatggagtggatcatgttttcaacctcgccgctgatatggggtggcatgggcttcatccagtccaaccactcggtcattatgtacaacaacacaatgataagtttcaacatgctcgaggctgctcg

SEQ ID NO: 13736 - DNA, 401 bp, Gossypium hirsutum
  Clone ID: uC-gsflnu33B012a02b1
tgacggtccaagccggtggacgacgcccggtcaccaggaacgacccaatggttacctcttcaacaggaccccaaggccaccagctttcttggatccatctataaatgaggatgttatattggaaaatggggtaaattatgcctctgggggtggtgggattttgaatgaaacaggaacttactttattcaaaggttgtcactttggaaacaaattgaactatttcatgggacaactgaatcgataacaaagaaaggctcaacagtagtggatgaaacatgcaaagcaaatcaaactctcaaatgtgtaatttatatgtttcttgtttaagacggtgtgtattattattataagcttccaaagcatagaccagatgtcatattgaaaccttgaactgatacat

SEQ ID NO: 13737 - DNA, 396 bp, Gossypium hirsutum
  unsure (1)..(396): unsure at all n locations
  Clone ID: uC-gsflnu33B012a05b1
ttcacgcgtccgcaaaaccaccgtctaaccgggngccgatgaagctcccccagacaatgacacattgttagggggtctgattgggacagaaagaaaagaagtgaaagaaatgatctgaaagaaagaaagaaagaagaaaaaagaaggaagaacaaaaagaaagaaaaaaataaaacattcaatgcagttggggcaagctgacccaacccgacccgactgacatccagaaccagcagctccaggtccgaaaaaataggctaagtatacaaaaaaagaaaataaaagaaaaagagaagagccaatacagtagcaataaaaggaataccgtcgacgtcgttctcacgccattggtccaacttggtgacactacactatcggtaactagcaaaacaacca

SEQ ID NO: 13738 - DNA, 208 bp, Gossypium hirsutum
  Clone ID: uC-gsflnu33B012a06b1
ttccacgcgtccgcccacgcgtcgcggcacacgatcgtcaagcgtctcggcgccatatgggccgttggtttttcaaaacatttgccaaagagagctgaaggaagggggtttgcatctttaaatgtggactggcaaatgagaatatatatagccatgcattattactgcttaaaaaaaaacagactctagcaagctcttatggttcgag

SEQ ID NO: 13739 - DNA, 417 bp, Gossypium hirsutum
  Clone ID: uC-gsflnu33B012a08b1
ttccacgcgtccgcttctctattgctacgtttttgaatttttagtgagcgaaaatgagagagtgcatttcagtccacatcggtcaggctggtattcaagtcggaaatgcctgctgggaactttactgccttgaacatggaatccagcctgatggccagatgccaagtgacaagactgtcggaggaggtgatgatgcttttaacacctttttcagtgaaactggtgctggaaagcacgttcctcgtgctgtctttgtggatcttgagcctactgttattgatgaagtgaggactggtacttaccgtcagctttttcaccctgagcaactcatcagcggcaaggaagacgctgccaacaaccttcgcttgcggccactacactattggcaaaagaaatcgttggcttgtgcttggaccg

SEQ ID NO: 13740 - DNA, 430 bp, Gossypium hirsutum
  Clone ID: uC-gsflnu33B012a09b1
tgtctattgcctgcttctccttgagattattagcgaaaaccgagattaagcagggacattaaaaacttgggctgaacttattggcttacagtttttactctctaacagtggttttgtttcattcattaattgcttcagtggttgactgaaggggaagtgctggattggttaatgtcaaatctttataaccgggattccattctagaagttctagtttttatgcgtttaataaagaagctttggttgtctatgaagacatttactgataagagaagaaatgcttcatctgatggggggaacagtggatttaaaatgaagcagctttcatttatgggagttatttgttcagttacattggatattgtttatagaacaacaaattattcaatactatgagacacagatggaaaccaaattgcacccttttgac

SEQ ID NO: 13741 - DNA, 116 bp, Gossypium hirsutum
  Clone ID: uC-gsflnu33B012a10b1
tccacgcgaccgcaaaagccacctgtaaagcattactaagcttacttaccacaacggattgctgaacatagatagactactgtaacctacacgcaatagaatggcctaattgtttc

SEQ ID NO: 13742 - DNA, 389 bp, Gossypium hirsutum
  Clone ID: uC-gsflnu33B012a11b1
ttcacgcgtccgcattaacaaccttaaaaacatcaacaaccttattaaccccaacaatgtccctttcctaacaggtctaacaggtgcacaaaccagtgccatcgtccaaaactcccacaacagcgacagcgttatcaattccgacagcaaccctttcgtcacagcaggccaactcccacccggctctctccaacgtctcatgttcggtaccataaccgtcatcgacgatcagctaaccgaagcccacgagttagattcagctatcctaggcaaagcacaagggttctatttggctagctcattagatggttctagccaaaccatttcgttgacagttttattacatggaggtgaacatggtcacgaaatcgaagacaccattagttttt

SEQ ID NO: 13743 - DNA, 371 bp, Gossypium hirsutum
  Clone ID: uC-gsflnu33B012b01b1
tttagacgccctccaggggtcggcaggcgatgctttcaggacattcgtcgctaccttatgcgacaccaaagtctttgcatttcgctgggagatgggcatgaaggctgaaactgctaagcatagacggtagggcaccagcaggagcgcagcttctactactgttagagtcggcgcggtgaaacttaccaactgcagacatacaaaggattgacagactgagagctatttgttgaatgtatggctggtggtgcatgaccgcacttagttgttggagcaacttgtctgtgagacctcgaccacgaactaggcctcagcttgctgactaggtacacggaggggaacgtccgagcttagatagttagcgggactat

SEQ ID NO: 13744 - DNA, 415 bp, Gossypium hirsutum
  Clone ID: uC-gsflnu33B012b02b1
ttcacgcgtccgcccacgcgtccgggcagagacaaggagaaaatggagaaagcattaactaaagtcgggagcttgaaagttggtgggttatggatctcaaagaaagctaaggaagagttctctaacatcactgcagatctgactactttctcaaacaccgttgaagagaaggcaaaatgggttttcaacaaactgaaaggaaagccaacgaaaagcttgccagatctccttcaagagtacaacttaccgccgggcctctttccccagaatgttatctgttacgaattcgatgaaaccaaggcgaagctgattgtttacatgtcctctccgtgtgaggtcagcttacaaggatttcctcggtcataagatacgcaacacgtgtgaaggggactcttcttcggggaaagctgacagg

SEQ ID NO: 13745 - DNA, 190 bp, Gossypium hirsutum
  Clone ID: uC-gsflnu33B012b06b1
acccgtcgtttcacgcgtgcgagcatgtggagaaaatgggtctctggtattttcagttctgtatgcaatacagggagcctatgcttttatctgtgttcaaatgaatatatgtaagtaaaatttcgtataataaaaagactactttccaccatcaaaaggacaaaaaaggataagctttttactatgatgc

SEQ ID NO: 13746 - DNA, 393 bp, Gossypium hirsutum
  Clone ID: uC-gsflnu33B012b08b1
tttaaaagagagatccaaagatggcaccagaagcagaagacgagatcaaggacgagaaaaacccacgacctctcgacgaagatgatatcgcccttctcaaaacctatggattaggaccttattcaaccagcataaagaaagttgaaaaggagatcaaggagatggcaaagaaagtaaacgatttatgtggcatcaaggagtcagacactgggttagctgcacccagccagtgggaccttgtctctgacaagcaaatgatgcaggaggagcaaccactttaggtggcaagatgcacaaagattattaatcccaacacagaagatgctaagtatgttattaatgttaagcaaattgcttaagtttggtggtggggctgggcgacaaaagttcccc

SEQ ID NO: 13747 - DNA, 544 bp, Gossypium hirsutum
  Clone ID: uC-gsflnu33B012b10b1
tgtttattttgttgaaagcagcccactttgtcccatgttttttgatgtcagaactagttaatgatccaagttgtcagctttgttgaacttcgaattacgtatagaaatcgctgaaagagagagtctgagtgagtgaagttttcctttttcgagcttttgttgaagatatggctatggctatggcgagtgtgcaactcgagagacaaactagcatacaagacagtccaaggagtcctgaagcaaagcttgggatgcaagtggaggatttgtgggatgttcaggaaccagaacttagtcctaatgaaaagctcaacgcttgttttgagagcatccctgtttctgctttccctatttctcctcaagggattgagataaaatcggatgcgagtctggccgaggctgttcaaatactagctcaaaacaagattcttagcgcgcctgttgttgatgttgatgcgcctgaggatgcaacatggatggacagatatattgccattgtagagtttgcaggggattgctgtatggattttgcaacagtcggaac

SEQ ID NO: 13748 - DNA, 306 bp, Gossypium hirsutum
  Clone ID: uC-gsflnu33B012b11b1
tctatgcgaacgcaaaagccatatgtctagaggttatatgctaacttatggctgggggtatctgaacacatatagaatgcctgaacgtagatgatagtagagctggctacactgcctcgcacaatgatgacagatataaacttggaccagctaagcatgcttgtattgcagctcatgcgcatagcggcaggtggggactcttggtagagggcgtatgcgctaccgttgttcaagacatggttatagggactggaagttgtgaatcgcacaggagtgtggcttcaagaacggatgctgtttcgatta

SEQ ID NO: 13749 - DNA, 519 bp, Gossypium hirsutum
  Clone ID: uC-gsflnu33B012b12b1
ttcacgcgtccgggaaagtagagaaaaatgtactcttgtaaataccgatgttatgcaagatggaaagcagcttaaaagatctgaaagtcaagtgcatcctagagttagtggatgcaatagtatggaaattctttccagcgatggaaatcagaaaaaaggagaagctttttactatgataccccattttctgaagaaactggaatttgggtacctgtgtctgtccctcctgtgtctgaaaataaacatgaagaatgggatagaggcctatgtctgaatggaggatactttcctgatgatggtgtgcgatcaaatcagtttattgaagaaagtaaggatctgaccatgtgggatgtgctcagtgagatgttaatagccgctcgaggcaaagtgagttctatagcttcaggtgatgttcaaagatatgggatcacttggttatccagccatcttcttgaacaaacttggaaagagatggctcaaacgcttgcagaagctaatttttgtaacatcaatgaaat

SEQ ID NO: 13750 - DNA, 547 bp, Gossypium hirsutum
  Clone ID: uC-gsflnu33B012c02b1
ttttctagctaaactgctagaaacaaaactactgcagcttctgcgattcaaacatggccagatctactctgcaagtgtttcggaattcattcatggtgatctgccatgtctaaccggagatattggtggtgacattcaaatcgatttttcctgtgatccaaaaatctccttgaagctggttgatatagctttgaatgaaatattacgtcttcaagaggagggaccttcagatcaagatgttgaaaccatactcgaaatcgaacagagagcccatgaaaatggattgcaggagaactattactggcttaatctgattatcggcagttatcagtcacggatttattccggcgatattggaacttctttcaagattctagatgaaacgcgttcgaaagttagaaattcgctaacaccattaacgatgcaattggcgctacggcggataatgcctcgcaacaatccgcacactgttgtgattctaatgccccaaacatcatggcttaagaggataaagtcattttacaatggacccttcatggatcgtttg

SEQ ID NO: 13751 - DNA, 322 bp, Gossypium hirsutum
  Clone ID: uC-gsflnu33B012c03b1
tctacgcgaacgcgaaatttgtggcgatcaagccatacttgttgctgatcactatggtagcatctatgtttaattatgtgtttgacgtagaggcatttgagtgtgtgatcctcctttggaacagaaatgattgtatcgcaggcttgcctgcacggcctgttgcggtgagctagctgagtaagcctgtggttgccctatagtaactggactatgagacctcttcgttcaaactgtcaggtatgggatatgtgttgttgcatcaagtaattgtagatagttacagcaatgcacatcctggtataaagatcccgaaagacaccta

SEQ ID NO: 13752 - DNA, 493 bp, Gossypium hirsutum
  Clone ID: uC-gsflnu33B012c04b1
ttcgaatgctcactcaggttattgaattaaaacgcgagatctaagcaatggcgacagattcatcaaatggggaacaaaagacaacctcaaagccaccacctttgccatctccattgcgcttttctaagttttatcagtccaacatgaggatcctggttactggaggagctggttttattggttctcacttagttgacaaattgatggaaaatgagaaaaatgaggtgattgttgccgataattacttcaccggatccaaggacaatcttagaaagtggattggccatcctagatttgagcttattcgtcatgatgttactcagccgttgttggttgaggttgatcagatttaccaccttgcgtgtccagcttctccaattttctacaaatacaatcctgtgaagacaataaagacgaatgtcattgggcacactaaacatgctgggactttgccagcgagttcgagcaaggatcttgcttacgtcaacttctg

SEQ ID NO: 13753 - DNA, 498 bp, Gossypium hirsutum
  Clone ID: uC-gsflnu33B012c08b1
tgtcttcgcatcatattcactcaggatttaaagatattattttgggagttctgcgcacgtagacatgaagaactttttccgcgtcgtttggttgcacctcaggtaaaccagttacttcaggtagcacagaaatgccagagcacaatatctgaaggtggatctgagggggtttctcagcaggacttgcaaacaaacagcaatatggtcctgacggctggacggcagcttgtgaagagtttggagtcacagtcattgaatgacttgggtttttcgaaaagatatgtcagatgtttgcagatcgctgaggttgtaagtagcatgaaagatctaatagatttttgtcgggaacacatggctggggcaattgatggcttgaaaaactatcctcgtcatgccagtgcagccaagctacaaatgcaaaaaatgcaagaaatggagcagttagcaaacgttcagggtctgccaaccgataggaatacgctgaataagcctatggca

SEQ ID NO: 13754 - DNA, 435 bp, Gossypium hirsutum
  Clone ID: uC-gsflnu33B012c09b1
tttaaaaaagaaagaaaaaatggttctgctagacaaaatgtgggacgatgtagtagctgggcctcaacctgaacgtggtctcggcaggcttaggaagatcaccacccagcctttgtccatcaaagatgaaggagaaaagaaaaagtaccagaggtcgttgtcgctgccgaatagtccagtgtcaggtccgacacccgtgacaccgacgactccgacggcgcgtaaggagaacgtgtggaggagtgtgttccatccgggtagcaacctagccaccaaaagtataggttctgatgttttcgacaagccacaacccaactctcctaccgtctatgactggctttacagaggggagaccaggagcaagcatcgctgagagggtggcgactgacaggcggctagcaggctgctttcgtgagccagggctgcatgttaata

SEQ ID NO: 13755 - DNA, 441 bp, Gossypium hirsutum
  Clone ID: uC-gsflnu33B012c10b1
tctctttgttaacgaataaggatcttttaagatacgccggatccgctaaaatacgccgatccccgttcgtcttccgatcatatggggctgcttgaccagttgtgggatgataccgttgcgggtccccgacccgataatggtctcggcaagctccgaaagcactccactttcactttccggcctaactctgccaaggaatcggatggcgggagtgtaagatcgtacggtgatgaagcgccggaggaagcgacgagagtgacacgtagtattatgatcgtaaaaccgactggttaccagagcggatcgccttcggtttcgccggccggatcgacccctccggtatctcctttttccggaggcagagaatcattatcggtttcggagaaggtccacttcggatgcatacgagaaggctaacgaggttggaccaaggagccctcg

SEQ ID NO: 13756 - DNA, 284 bp, Gossypium hirsutum
  Clone ID: uC-gsflnu33B012c11b1
tgttcacgcgtacgcaaaagccctatgcaacgaggcaataatctaactcagggctgggggaagctgaacacatatagactaccgtaacgtacacgatgtagaatggacaacctgactccaaaagactacagatagaaactggatcgagctaagcatgcttgtattgcagctcctgtgcataggaccagggggggcctattggtaaatgtcgtaaagggtacggttgttcaagacatggtcttgggtactgcaagttgtgaattgtcaaatagcgtggcttcatg

SEQ ID NO: 13757 - DNA, 497 bp, Gossypium hirsutum
  Clone ID: uC-gsflnu33B012c12b1
ttattctgaaattttgcctgccgctccatctctacatcacaggaatggcgacagaagttgcaccccccgccaccaccgcacccaaagaccccacccaacctcaccttgaagtaaaactcttcaatcgctggagcttcgaggaagttcaggttgctgatatctccttgagtgattacattggtgtccaagcttcgaagcatgctacctatgtgccacacactgctgggaggtactcagttaagcgtttcaggaaggcccagtgcccaattgttgaaaggcttacaaactcacttatgatgcatggccgaaacaatgggaagaagcttatggcagtcaggattgtgaagcatgccatggaaattatttatctcttgactgatcagaacccaattcaagtcattgttgatgctattatcaacagtgggccacgtgaagatgctactcgaattggttctgctggtgttgtcaggcgtcaggctgttgatatttctcctctt

SEQ ID NO: 13758 - DNA, 417 bp, Gossypium hirsutum
  Clone ID: uC-gsflnu33B012d01b1
ttcacgcgtccggtggttgctgacagctgcttgcatcaaaacgggaaggccacaaattgcaagacgcgcaatagaccttgctgagacacgcttgttgaaagatgggtggccagaatattatgacggcaaactcgggagatatgtcggtaaacaggccaggaagtatcagacatggtcaatagcaggatatttagtggcaaaaatgatgatggaggatccgtcgcacttggggatgatttctttggaggaggacaaacagatgaagccattgataaagagatcatcttcttggacttgctaaaaaaaggaaaaaaaagaagaaaaaaacagaattgggaaatggaaacagaccaactttcgaattttcattgtaccggtaccagtcttgcttcttttacgttatgtttccaagtcaag

SEQ ID NO: 13759 - DNA, 435 bp, Gossypium hirsutum
  Clone ID: uC-gsflnu33B012d03b1
tccacgcgtccgctttgaatgctatgttccttatcctatatacccttcttaatagccttccatttccttggttccggcttgcatatttcgttcaatggagctgtctgtatgttgttttccaatgggttcttcatgcctgcggttttacatggtggccatatcctttcctggagcttaatacgccatgggctcctttatggtactttgccctggccctggttcatatcccctgctatggaatgtatgcacttattgtaaaagcaaaaaattcgatcctcccaagattgttccctcatgcttttgttagatcatactagttttatttctttgtttcagatcaactggttttgtttatggtaaattctgttttggatgtatgctttctttctttttctggcatatgaagaaggggatatcattcctcagattcattcc

SEQ ID NO: 13760 - DNA, 376 bp, Gossypium hirsutum
  Clone ID: uC-gsflnu33B012d04b1
tccacgcgtccgctgtaaaactccaccgtttctttctatcttcgtcaattgggttttggctcagatcgactcccggattccatttcaaatgatgagacaagtgctagggctagtctatccagaatcgttatgttagttgaagctttatttgaggttctggatgaaatcccccagcagtctgtggttttatcttctcgaccttctgtatcttcaattggatctgttcccgctcctaatgaagttgtggaattgcttcctgtcaaaatttataacaagtcacacaaactttataatgatgaggctggacagtaagtatttattcttctctgctgtttgagaaatgtgaagcacacttgaatccttttttatttgttga

SEQ ID NO: 13761 - DNA, 421 bp, Gossypium hirsutum
  Clone ID: uC-gsflnu33B012d06b1
tccacgcgtccgcccacgacgtccgcccacgcgtccgcccacgcgttcgtccacgcgtgcgggatcatcagagtgcttaaatgttcaagatattaaacgaggggtatggaaagctatccaaaactggagtaatcaagttaaggagagaacatgatgaaggcaacgcttacgtaccatccttggttcttttatcttagagatctattagggtagctagcttgataagtttcaaatttcttgccagcaatttgttatcagtctatcagtagagttgggcatatatatgttgtcaagggtacaccatgtgatacctgatgatcgccaatttggccgagaaaatacaaagactaaagactttgaaatgtcgaatatgtaaacatgtgattttgcgtctgttttatgtggcaagacaaataatggg

SEQ ID NO: 13762 - DNA, 256 bp, Gossypium hirsutum
  Clone ID: uC-gsflnu33B012d07b1
tgaatactatgatgaaaaggtcggttaggatgcatgcttagaagaccgggaaccaagcttttcttaaccttatccccttgcttcagggtaatgtgggtttgatctttactaagggtgacttgaaggaagtgagagaggaagttgccaagtacaaggatggagctgctgctggggttggtctagttgcaccaactgatgtggatggtccaccatgtaactctgtactcgacccatgacagacctgtttttttcatac

SEQ ID NO: 13763 - DNA, 407 bp, Gossypium hirsutum
  Clone ID: uC-gsflnu33B012d09b1
tctcacgcgtccgaatatactacatggtgatgcagtgcttgggagccatatgtggggctggtgtggttaaagggttcatggggaagacaaggtatggtgctttgggtggtggagctaactctgtgaatcatggctacaccaagggagacgggcttggtgctgaaattgttggcacctttgtgcttgtttacactgtgttctcagccactgatgccaagcgcagtgccagagactctcacgtccctattctggcaccattgccaattgggttcgcagtgttcttggtgcacttagccaccatcccaatcacaggaaccggtattaacccagctcgtagttttggtgcagccatcattgtcaacagggacaggggctggtatgacaattggatcttttgggtgggtcca

SEQ ID NO: 13764 - DNA, 384 bp, Gossypium hirsutum
  Clone ID: uC-gsflnu33B012d11b1
tccacgcgtccgcaaattcctcctgatactcgcattcccgccaccataatcatcggcttttcgggatctggctagacaacattactcaatcacatcttgactgcacatcacgggaagcgtatagcagcgatagagactgagtatggtgaagtagacatcgatggctctcttggtgctgctaaagatgctggggctgaggacatagtcatgctaaacaatggctgtctatgatgtgctgtacgggatgatcttgtgaggatgatctgcgagctagtcagtaagaatacagggagatccgaccacattggaatcgggactactgggtgggcaaatagtggaccaagacttaagacattttatgctgaggagcaggttttcaatgat

SEQ ID NO: 13765 - DNA, 449 bp, Gossypium hirsutum
  Clone ID: uC-gsflnu33B012d12b1
tctcacgcgtccggaaagaccgatgaatctcagcaaggaaatcttctttcagaccaaggacttacagatttcgatgtgtacattatggagactagtagccagcaaatgaaatctgagctggatcagtacttagaagagtccttgttgcctcgagtccaagagtttgatgtattaggctggtggaagctcaataagatgaagtatccaactctttcgaagatggctcgtgacattttgtcaattccagtatcagctgctgctccggactcggtctttgacatcataataaagcaactggatgagtaccgaagctccttacgaccggagactgtggaagcgctaatctgtgccaaggactggcttcatcatggatctgaagaatccaatgcacttggtaaaatggaattttagatgtagcctggtttaccttatgggtggaatgctgttgg

SEQ ID NO: 13766 - DNA, 542 bp, Gossypium hirsutum
  Clone ID: uC-gsflnu33B012e01b1
tgttttgggctctcattgtaactactctcacccttcaactagccattacgagtgcacaaacaccagctgcctcaccttccagtacgccaaccaccaccaccaccactccaccttcaacttcgccaccacctacaacttccgcaccacctccttcaacaacccctccacctacaacttcagcaccacctccttcaacagcattgccaccaccatcaccaccaccagtatctcctgcaccagcaccagctcagaaaccaccagctcctgcaccagtaaagctgcccccagcacctgcacccattactttgccaccggctcctgcaccagctcccaccaagcacaagagaaggcacaggcacaggcacaggagacaccaccatgcaccagcaccagcaccaacagttccaagccccccagcaccacctgcagtgccaactacagatgacacgacaccagcaccatcacctagtctcaatttgaatggaggagattcattgttggtggcaggaacaaagctctgtgggcaaggacaggattgacta

SEQ ID NO: 13767 - DNA, 496 bp, Gossypium hirsutum
  Clone ID: uC-gsflnu33B012e02b1
tttacgcgtccgcccacgcgtccgctcaatctctctggaaaccctcgccgcatttggaacctctcagccaatatggggaagacacgtggtatgggagctggacgcatgttgaggacccacaggaggaggcaacggtgggccgataaggcatacaaaaaatccaaccttggaaatgaatggaagaagccatttgctggttcttcccatgccaaaggcattgtccttgagaagataggtattgaagctaagcagccgaactctgcttttaggaagtgtgctagagttcaattgatcaagaatgggaagaagattgcggcattcgtcccaaatgatggttgcttaaactacattgaagagaatgatgaggtgttgattgccggatttggacgaaagggtcatgctgtgggtgatattcctggtgttaggttcaaggttgtgaaggtatcgggtgtttcactgttggcactcttcaaagagaagaaagagaagcctagat

SEQ ID NO: 13768 - DNA, 498 bp, Gossypium hirsutum
  Clone ID: uC-gsflnu33B012e03b1
tgcacactgagcaagaaaaacactggcattatgtcagtacatgcgggtaatgggtttgctgataccctttcggctgaccctgaagccatgagaacatatgaggataatgttaatggaggattgactgtgttctgccctatggatgatccattcaaagcctttttaccaaagtacaagaacttgacagttgctaagaaagcatctttcctcgaatgctttggtgtgcctgagtaccaatctttgtgcatgttgaagtccaacaatggactcatgaacacattagctaccgacggagccagcaagttcgatttcactgtgcaaaacgagggtgaagaggtgacactaaagaccagggttaacactgtcaaaataaccgggactctgatcgacgagcagccgagagcaagctatacaattgataaagtgttgatgcctaaagaattgttcaaggcagctcttagttcagccccagcccctgccccagaggaggcagcagat

SEQ ID NO: 13769 - DNA, 283 bp, Gossypium hirsutum
  Clone ID: uC-gsflnu33B012e05b1
tgaaatacccctttccacacacgaaacactagcatcacattattgtgttagacgtacaatctaagtctacctgcgagaaaatggcatactaccaaaccttagctttcgcagctttgttattgatcttgctacccgcagccgttactggagatttaggtgacttatctgctgatctatctcctttctatgataggtggtgggatgatgaagaatgtgtgaggtcttctgttatgtcagcgcctctcaatcgcttgaacaacctctgcgtctaattgaaagaatg

SEQ ID NO: 13770 - DNA, 412 bp, Gossypium hirsutum
  Clone ID: uC-gsflnu33B012e06b1
tgtcgagacaatcgatgagaacggtgacggtcgtctttcaccttccgaattgaaagcattgattataggaatcagatttgaagagatagacttcgacatggatgacgctgtgatgaaagtaatggcagattttgatacctccctcgactcttatattcaaaaagaagagtttgtaagaggaatcacaaagtggattaatgaagcaaagcaaactgggggtgcttatcttgaacctaatgctggaacgtttaagttgattgaccaatttcaccagcaaaccaagagagaacatgctttgttggggtcagaggaacaaagtgatgaggttgttgaacatgttgaaaacccaaggtggatcttcttaaagcagtactaatgctactactaggcaccttgattgtagctgtatttg

SEQ ID NO: 13771 - DNA, 474 bp, Gossypium hirsutum
  Clone ID: uC-gsflnu33B012e07b1
tttccacgcgtccgaatccttttcaaagaatggaaaaccataggtgacaatctttccaaaggagaggcaatctttgcggtgatcttggtgtgcacctttgtcatgggctttgcctggtcatgggggcctcttggttggttaattcctagtgagattttccctctggagaccagatcagctggttttgcctttgcagtcagcaccaacatgctcttcactttcatcattggtcaagctttcctctcaatgctatgccagatgcaagctggaatctttttcttctttgctgcctgggttatcataatgggagccttcacatggttcttgttgcctgagaccaaaggtgtccctgttgatgctatggatgacacagtctggaagcagcactggttctggcgtactttcatgatcgaggatgacaggtccgatgccacggttgtttgaaccaactacaatgaagttcctagttgtgtt

SEQ ID NO: 13772 - DNA, 421 bp, Gossypium hirsutum
  Clone ID: uC-gsflnu33B012e08b1
ttgttgatctcaacatgttgctcaaacgcgggaaaatagtcagcgccaaagccattgctaacctccccatgttccaccgccaccaggtctcttcatcggcggcggcgccagcccaggagtacgagttcagctgcagcaacacccctaactacatcttccctttcaacctccccaccaagaagaagaacagcattaacaactactaccaccacttgttcgcttgtacccacgcgcctcctactcacgacgacgacaccgccgccatgaacgccttcaaggttgtcttggagatgctcaacaacaacatgggagtggaaagcgatgctgctgttattgcggcttcccctatgttaccagggttcggacaaactccactggtgagacaacttagaataactgactcttcctttccttaagagat

SEQ ID NO: 13773 - DNA, 307 bp, Gossypium hirsutum
  Clone ID: uC-gsflnu33B012e11b1
ttccacgcgtccgcccacgcgtccggttggggttgagaatggatgcaagtgtggagacaactgcacttgcaacccttgcaattgtaaataagagggggggaaaatgaacaacaaagagaagcagagaggcctttgtctttttaactaaataaattctattactttagtatgtatcagcaaatcttcatgaggatttggttcttaattatgtgtaatgtgggcttttctgctatgtcagaatgtattatgatatttaagaaagtttgttttcaattgaaagaatggcagttcctttctctttggctta

SEQ ID NO: 13774 - DNA, 545 bp, Gossypium hirsutum
  Clone ID: uC-gsflnu33B012f02b1
tccacgcgtccgcccacgcgtccgcccacgcgtccgaccacgcgtccgcccacgcgttcgtcactgttttccttcaaaaccctaatagctgtcctctcctcctgaacgtgttcgaaaatggctggttctgagggattgattctacgtggcaccatgcgtgcccacaccgacatggtgacagccattgctactcccatcgataactccgacatgatcgtcacttcctcccgcgacaaatccatcatcctttggcacttaaccaaggacgaaaagacctacggtgtccctcgtcgtcgtctcaccggtcactctcacttcgtgcaagacgttgtcctctcttccgattctcagttcgctctctctggttcctgggatggtgagcttcgtctctgggacttatctgccggtacctcagctcgccgttttgtcggccacaccaaagatgttctctctgctgccttttcaattgacaaccgtcaaattgtttcggcttctcgagatcgaactatcaggctttggaatacccttggagaatgtaaatacac

SEQ ID NO: 13775 - DNA, 262 bp, Gossypium hirsutum
  Clone ID: uC-gsflnu33B012f03b1
tccacgcgtccgcccacgcgtccgcccatgcgtccgatcataatgatcaagatccgacggtccatatggatctgaacaaaatgaaaaatggcactcatgcgccctcagagtgtggttatatacacagtttttgttttgattgattccctttgtatttgcgtgtaagaatttgtaatatattgctccaatttacgtgaaatgcaatatatatattctctttggaggagactactacacccgattacacaccttcacctactac

SEQ ID NO: 13776 - DNA, 391 bp, Gossypium hirsutum
  Clone ID: uC-gsflnu33B012f05b1
tttatgcttaccttaaagaatctggaatgcgtgctctactacttacctcgttatcgtcaatggcttaggacatgaagattaagatcgggattaacggatttggaagaatcagacacttggttgccagagtcgcttattagaggaacgatgttgaactcgctgacgataacgagcccttcatttccaccgattatatgacatacatgttcaaatacgacagggatcacggtcaatggacgcaccatgatcttaaggataaagactctgaaaccctgctgtagggagaacaacccgtgactgtttgctgaatcaggaaccctgaggagattacatgggctgaagcacgggctgaaatcggtgttgagaccactggaatgaccactgacaaaga

SEQ ID NO: 13777 - DNA, 362 bp, Gossypium hirsutum
  Clone ID: uC-gsflnu33B012g02b1
tttagacgttcatcctctcgctgctacaacagcaagagggaaggcacctggccagtctaactatggaggaggtctattatcaacgcgcactgcaagcgttccacctgcctcaaactcacgactgtgaccactacctcctgagcctgctggattgaggtatgagcgtgaggcaacagctgatatccctcttgatacagcttcaggaggatcacgtaatccggatttaaagaggaaagaataggaactccaggccatggaggctgaactgagaaggcggtaacaggaggtgagatggaaagaagaggcagtgtcaagagctggagttgtgctggaagagaaaacttggccacctttttttccta

SEQ ID NO: 13778 - DNA, 386 bp, Gossypium hirsutum
  Clone ID: uC-gsflnu33B012g03b1
ttcacgcgtccgcccacgcgtccgcttctccctcatttgcttgcacggctgggcgtattttaagcggagagggtgtgcaggattaaagggtcaccattgtttccaatatgatgcttaataataagtttttgttcttatcagctttgttttgcattgctgtagctggcgttttaggccaagctcctcctactcctagtaatcctccgacatccacgccggcgccgccgactccacccgcttccacacctccacctactactcaaccacctccaacacccacaactacttctgcgccaccagcttcctctcctcctcctacttcatcaccaccaccagtttccactcctcctccagcgactcccccgcccgttagctccccaccacca

SEQ ID NO: 13779 - DNA, 303 bp, Gossypium hirsutum
  Clone ID: uC-gsflnu33B012g05b1
ttcgatgtttcttcaatggagatgtggtggctgattaatataagagctactctaattgctcttatttttatatccattttttatttttccaagaagatttatgttaaattccttacaatatcgacatctccttcttcttcttcttctttattatcatctactcttcatcttccttctgcttcttcgcccatttccaatcaagattctcaatcaagaaccctagaggttgtgtctgattcagatttgaagtttttaattgataatttggatgagaagcgcaatgaggaccaaaattgggagaat

SEQ ID NO: 13780 - DNA, 378 bp, Gossypium hirsutum
  Clone ID: uC-gsflnu33B012g07b1
tgcagatcaaaattcagagtaaaagatcgacgatgagctgtttttgctcggcgatggcaatgacggtgacggtcgtcttcttcttcttcttgttccttcagcaaactccattaatggcggaggcggcgaaacttgaagaagatcatttcatcattaagaataagccaacgctgtacgagttttcaagcagagatgaaatggtgcatttggccggatacggcgaagagaagctctcgacagttctcgtcaccggaactgttctttgtgaagcttgccaccgccgccgccgccgccgcgatccacaacctcaacttcgttcatggcctatatcaggggctttggtgtctgttaaatgtgaaactccttgtaggaccaatt

SEQ ID NO: 13781 - DNA, 380 bp, Gossypium hirsutum
  Clone ID: uC-gsflnu33B012g08b1
tttttagatgatcccaataatactggccgggctgcgcaacttgctgcacgcaaagagcaatctgcacttcgggctgtcatcaagtgcattgaagagtacaaactcgaggctgagtttccgcctgaaaacctcaagaaacgccttgagcagctagagaagaccaagactgaaaagagaaaaccagttgtagtccctgctaacaagcgaacgcgtgtaaataatggtggtccgatgcctcctgctaaagctggccgtttgacgaatgcatatgtctcatctttcccggcacctcctccatttgtaaggtctccctcccacacccagtaccctgctccagtcccaggatacccatccccacctcccatgtatggaagcaggag

SEQ ID NO: 13782 - DNA, 454 bp, Gossypium hirsutum
  Clone ID: uC-gsflnu33B012g12b1
tttctaaaccctagtccctttgtttctccctcaaccgttcccaaaattccttcattcaaactccaatcaacctccatgaacagcgatcggttcattcaagccttgaagggtgttttttagcctcaagatccccttaaacttcgacttcgacgaagcaagagtgcaccgatggtcaaatcataaggtatcgtcccctttctccttcttttcaccttggctgactaattcccttttgcctaaactccaatcggctaccacagtagcatattcaagccttgatggttgttttttagccttaagatcccctcttagcttcgattttaacaaagcaaaagggaactcatggcattctcgtaaggtgtgcatggcgtggagaggaggctatgcacgcatggaagcttcagcgcgtgtaatggtggctgggggctctgcagaagctgctggtgtatgttgc

SEQ ID NO: 13783 - DNA, 370 bp, Gossypium hirsutum
  Clone ID: uC-gsflnu33B012h03b1
ttttacgccgttccgccaacgcttccgtttttgtttgttttttatacatttttgtttgagaaggcaaatatgaaaatgccattcaaggagaaaccatacatagatgcaaccggtaaacaaagactagaaattatttaaaaggccatcaaagggcacaatccttcacgtaaaaccagaaaacccacattaaggaagaccttaaggcttagaacccaccacgaagacgaagaacaaggggaagaggggactccttttgaatattgtaatcagccaaagtccttccatcttccagctgtttcccagcaaaaatcaacctttgctgatctggtggaattccttctttgtcctgaatcttcgctttcacgttatc

SEQ ID NO: 13784 - DNA, 333 bp, Gossypium hirsutum
  Clone ID: uC-gsflnu33B012h04b1
tcttgcaagtcgcggtgccttccccaacttgagaccagcaaagcaaaagcttcaccaatggggatcgatttagtcgcaggaggtaagagcaagaagactaagaggacagcccccaaatccgatgatatttacctcaaactcctcgtcaagctttaccgtttccttgtaagaagaactgggagcaaattcaatgctgtgatattgaaacgcttgtttatgagcaaagttaacaagcctccactatctgtctctaggctcattgaattcatgaagggaaaggaggataagattgctgtggtagaggggacagtgacagatgatattagggtttat

SEQ ID NO: 13785 - DNA, 443 bp, Gossypium hirsutum
  Clone ID: uC-gsflnu33B012h06b1
tggaaatgatacagatgacatcaatggtttaccgggtgatgaagttcagcttgtgaaggaagagagccaggattcagagaacgtaatgcctgttggaaaagaacaagatcatccccatagtgatcgggcccttggttctgaaccagacattgtgcctggtgagaacctctctgagagaaaaaaaaaaagaagaagaagaagaccacccaagagaatcaagtaagtgcaaatgcatcagtttcacaaagtggagataaggatacttccactttgaagtctgaggagaaacaaactgctggcaaatcttctcaagtgagaacctttccgaatggattggatgtccaagagttagcaatgggcaaaccagatggtaaaagagcatcttgtgggagcaggttagtgtccataccttgggaagcttagaagaatggaaaaatttttga

SEQ ID NO: 13786 - DNA, 375 bp, Gossypium hirsutum
  Clone ID: uC-gsflnu33B012h07b1
ttccacgcgtccggaaaaaaaagaaacaggcctgaccgtggaaagatgaaccaaatgactccgtcgaatccactgctcgcgacggtgatcattgctctaccagaaaggtgatccaatcgaagtgcaagaccgaagaagtcgagcccggaaagttcgttcgaaagtgcgagaaaactgaagaagttcttagagaatgctttggaaggccggtcgaagtgctgcaatcaaccaaggagtctactgaggacgatggcacagagctctggctgaaagggagtttatcatctggatcacacgtagaaggttcgtttgattctcccgggctacgtagtgacatggaggcaattgaacgctagttctttggtgggataaaga

SEQ ID NO: 13787 - DNA, 363 bp, Gossypium hirsutum
  Clone ID: uC-gsflnu33B012h09b1
tttcagtgaaggcactgaggcgcactcctgctacgcctttctgggcccatggaagtgttggcgtaaagaacaatgcttaaggagaagcctgggattttatgcagaaaatgatactacagggagaagggaacagtgcttgaccgatctcctctgttttgtcatactgcaatcctttctttcattctcatttcagcagatggatggtttataaatgttgtgcagatgccaactatgtatatagcttcctaattaatccatgctgcatttctgaaacagacggaacattgtcaatttctattgttttctgtatatcatgtcattcagcaataacttgcaagaaaaaaaaaaaaaaaaagggcggcc

SEQ ID NO: 13788 - DNA, 132 bp, Gossypium hirsutum
  Clone ID: uC-gsflnu33B012h12b1
tgttaatgtctgtcatttagactcttttatggtgctgtttttatcgtcactgggtttggtggttttcaagaacttgctttatgtagtttttatgattaactaccattaaataagatactctttttcatcatc

SEQ ID NO: 13789 - DNA, 553 bp, Gossypium hirsutum
  Clone ID: uC-gsflnu33B013a03b1
accgccgcggaataattgggtggaccaacgcgtcctttctattcgtacgatgactcgtgcgactaataattatgcctgtcatgaacggggaggagctgacagagcatgagacgtgctctctatgatcggcaaattagggtttggggtgctgatgctcaaagaagattgagcaaatctcatatactagtttatggaatgaaagggtctgttgctgagttttgcaagaacattgtactggcaggagttggtagtgtgacattagtggatgaccgtgaagtcaccgaggaagctttgtctgcaaatttcttgatacttcctgatgaaaatctgtaccatgggaaaactctcgctgaggtctgctgtgattctttgaaagaattcaaccctatggttcatgtttctgtagaaaaaggtgacatatcaacctttggtgttgaattctttggaaagttcgatgccatggttatcagctgctgctctcttgcgaaaaaaaaattgatcaatcagaagtgccggaagttatcaaagcgtgtagctttttatacagttgact

SEQ ID NO: 13790 - DNA, 533 bp, Gossypium hirsutum
  Clone ID: uC-gsflnu33B013a04b1
tttttcgtcgagtgcagagatgaggaaaatcatgggtgccaaagttcttttcttctttgctttgctttccttttcagctggctcggcatttgcacaggacgaggaagaccaaggtgatgctaagaaccactgcaaggactcttggcctcacgctgaagacattatcagggaggcaagctagctactgtacaagcgacacagaaacactgctttttcttggctgcgaaacattgtccatgcctgtgctgaccacacatgacatgcttcactgctgctggactccacaagaaggagcttgtctgagaaggagacagacaggagctttggcctaaggaattgcaggtacattgagaccatcaaagaagctgtacacagggaatgtcctggagctgcttcttgcgctgatatccttgttctgtctgctagggacggcatcagtttgtcgagaggcccttatattcctttcacagctggaagaggagacggtagaaggagcaaagcatatgttgtggaggaagatcttccggaccaca

SEQ ID NO: 13791 - DNA, 514 bp, Gossypium hirsutum
  Clone ID: uC-gsflnu33B013a08b1
ttccacgcgtccgatttagatggcgatattgtacgcgctggtcgcgcgtggatcggtgatgctggcggagttcacggcggcgtcgactaacgccagcgcgatcgccaggcaaattctagacaagataccgggtgacaacgacattaacgtttcgtattcacaagatcgatacatcttccacgttaaacgcaccgatggactcaccgttctttgtatggctgatgaaagtgccggaaggcgaattccttttgcgtttcttgaagacattcatcagagattcgttaggacttatggccgagcaatattttcagcccttccttatggcatgaatgatgaattttcgagggttttgagccagcaaatggaatattactcgagcgatcctaatgctgataggataaatcgactaaaaggtgaaatgggtcaggtgcgaaacgttatgatagagaacatcgacaaagtcttagagagaggtgatcgcttggattgctggttgataaaactgctaatatgc

SEQ ID NO: 13792 - DNA, 512 bp, Gossypium hirsutum
  Clone ID: uC-gsflnu33B013a09b1
tcttttagaatcatgggtgttgtcacttataactatgagtctacctctccagtcgcccctgccaggcttttcaaggctttttctcttgaagctgacaaggtttggcccaaggctgctcctcaggcagtcaagagtgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacaagcttgagaaaatcagctatgacaacaagtttgaggcagctgcaggtggaggaagcctttgcaagagctcgatgaaattttacactgttggcgactatgtgatcactgaagatgagatcaaggctcaaatcaaagggagtgaaggagtttacaaggctgttgaagcttacctcttggctaaccctgatgcctgcactaagatatatgttggttgctttga

SEQ ID NO: 13793 - DNA, 545 bp, Gossypium hirsutum
  unsure (1)..(545): unsure at all n locations
  Clone ID: uC-gsflnu33B013a10b1
ttttccacgcgtccggtcttcagatgagattatcttacagtccagttgcacatttcttccttttccttgttcagtggactgattgtcatcttgctggtgccttggggtttctcaggattcttatatacaaggcttatgctgatggtaaaaccaccatgtctattcatgaaaggaaagctagcataagagaattctatggggtgatctttccctcgttattgcaactatctcgaggaattacggatgtggatgacaggaaacagaaggaaatttgtgcttcaaagttctcgaaaagagatgaactgaataaaggaaaggtctccgaaatcgacttagagagggaagaagaatgtgggatttgcatggaggtgcgcagcaagattgtgttgcccacatgcaaccattcaatgtgtatgaaatgctaccgaacctggcgaataggtcacagtcatgccccttctgtagggacagcttngacagagtgcattcaggtgatctttggatatatacaagcanaaatgaaattgttgatttagcttcaatct

SEQ ID NO: 13794 - DNA, 204 bp, Gossypium hirsutum
  Clone ID: uC-gsflnu33B013a11b1
ctagaggtccgttggtaaaccagataaaaagtgatcgttgtcggaaggctatttgtgtaatttacccaaaagaataaatatgataaattataaaaaaaagttatatttaaactagattatggtccacacgcgggtgatattgattatttaataatttttttaaaaaattgatataaatattagggtaaactacaaaaatagtat

SEQ ID NO: 13795 - DNA, 347 bp, Gossypium hirsutum
  Clone ID: uC-gsflnu33B013a12b1
ctttgtccttcaagtagatcacagtttaaacatcggagagatatggccccggatattgatctgaatctcaagcaccagtggcgctgcacttgggctcaatcttagcaacggagaaggtccggtggaattgccggtactatatcaagcacggagcatggcgacccggggacgggtggtcacggatgcagacccggccgacgatctctacaggtgtcctcctttacaagatgtgccagtgcctggtcatgagcactagcggagaggatgcccaggggccgtccatctagcctcagaggaatcaggatgactttgaggacttgtacagagacatgcttccagcgctgagc

SEQ ID NO: 13796 - DNA, 394 bp, Gossypium hirsutum
  Clone ID: uC-gsflnu33B013b03b1
tgtttgatgaagagaaacaagtgaatggagctgtcgaagtgaaggaagtctagagtcctttttcaattcccaacagaagaaagccttaatgtactaaatatcattattagcaatcaataaaaaaatgattttattttatggtaaaaaaaaaaaaagagaaaaggataaaatagaagcaaaaaaaaaaaagaaaaaaaaaaaggaacaatatcagacaaaaacttcgatagaacgaaccccaggattctgcttggggggggcctttttagaggacccacattcatcatggcgggcttgcgaatacatgttcttttttttgggcgacaaaaatcaaataggtgggcgggtattcaacaactcataaacagggaaaacccttggttttgccacatta

SEQ ID NO: 13797 - DNA, 61 bp, Gossypium hirsutum
  Clone ID: uC-gsflnu33B013b05b1
ttcatacacacccgcttttatcggatgggcaggatacttatacagtcaataacgcaaacag

SEQ ID NO: 13798 - DNA, 388 bp, Gossypium hirsutum
  Clone ID: uC-gsflnu33B013b06b1
ccgtcccgctactgatggtcttaatgatggggatggatggcagtacagtgcatctcttcagcattggtatcactttttcagcactctggcaacctattagtgctcttcaaggggttgggaaggtttttgaaccgtataaagacaataaagtagatcttcttggacctaagttgcttttcattgctcttaatttgggtggcttagcacttggtgtttggaagcttaatacattgggactccttcctacacatgcatccgactgggtgtcatccttgtccccagctcaggaggttgaatattcagggggggggtattcctctgtaatatcgtctttgagcgtgtgattctcagacaaatttctggtgccagtgatgggaagttgcaaaga

SEQ ID NO: 13799 - DNA, 309 bp, Gossypium hirsutum
  Clone ID: uC-gsflnu33B013b07b1
tccacgcgttcgggcaaggggtctcttggttgttattttccagactgtggacccgaaactgaaaaatctctgacatattacgctgagttgcccgaccttgatgctcgtgtagaaggcaacagaatgtattgtactaagctatattactagagattccaacaacatctagtctggtgattgctggcataatggtgaaggtacaaatttttgagtgtgcgtattcaagaacctggcatcctgttgtgtttagacattctgagattctgcctatgtggctcaagtagatcgatgcaagttacaagaggggtg

SEQ ID NO: 13800 - DNA, 159 bp, Gossypium hirsutum
  Clone ID: uC-gsflnu33B013b08b1
ttcacgcgttcgggtttagggtatgtttcttgtgattttccaggatgtggacccgaaacagacaattctgagccatattacgatgaactggacgatctgtgtgttcgtggtaacgaatactgaatatccagtattgcggcacacgattatggattccgt

SEQ ID NO: 13801 - DNA, 512 bp, Gossypium hirsutum
  unsure (1)..(512): unsure at all n locations
  Clone ID: uC-gsflnu33B013b09b1
tgaatgccgttacagaaggcattgatgctatagccaccacccgcgttctaattcgtgctgagaaaagccgcatatcaactaatattttgaccggtgaaattgttcagcgaacattcagtggaaatggggcaggaatggatatcgttgtttccagtgtcaaggcttatattggtgcattaaataagatgttgggtttcaaggaacaatatcagacaaaaacttcgatagaacgaaccccggtttctgcttaaggcgggtatcgatcccgtacgtgcatgcatcatgtcagttttgtgaatacatgtgctctccttttagtgacaatgctttgaaaggtacttgtgtatacaagtttcataaacagatatgtttgttttttttgctacatcatagacagaaatgtcaagtaaagacaatgttggttttttgttatttcttgtgaatttgtagtaagaagttgtcaaaacttagtgaagcgtcagttgttatattaaagacanacaagtttcttt

SEQ ID NO: 13802 - DNA, 468 bp, Gossypium hirsutum
  Clone ID: uC-gsflnu33B013b10b1
ttctccacgcgtacgcctcagtggaaccattgaaggtacaaaactggatgcttgctgaaatgcctgggctaataacagactttgtaatctgtcttgatgatcgggtcttgtatttcgacaactggcttcatggggatgtccgacaatataatatcgaggaccctaagaatgcggacttggctggtcaagtgcgggttggtggactggttcaaaagggaagccctatagtggctggtactgcagatggccaaacatggcaggccaatgatcctgagatccaggaacgtagtctgagagggggaccgcagatgatccaggtgagcttagatgggaaacgcctatacgtgacgaactcactgttcagcacatgggatcgacagctctatcctgaactcatggagaagggttcccacatgttgcacatcgatgttgacaccgagaaaggaggccttaagataaaccccaact

SEQ ID NO: 13803 - DNA, 496 bp, Gossypium hirsutum
  Clone ID: uC-gsflnu33B013b11b1
ttcttcacgcgtccgcttttatcggatgggcaagatacttatactgtcactggtgccggtgcaaacaagtctcaaccaaattaccagttgcttgtccctctgtctatgcatgggagtgataacacaggattccagattccagtacatgcttttggttttggtgcagatcatgatgcttcatcaatgcattcaatttcagagatctcaggagggacattttcttttattgaaactgaagctgtactccaggatgcatttgcgcaatgcattggtggtcttttaagtgttgtagttcaagagctgcaagtgggtgtggagtgcatgaatccaagtctttgccttggcccgcttaaagcaggcagttatccaagccgagtagcagctgatggaaaaactggagttattgaggttggagatctctatgctgatgaagagagggattttttggtgtcggttaaagtaccagctgagtcttctgaatgtgaaacctcgttgc

SEQ ID NO: 13804 - DNA, 518 bp, Gossypium hirsutum
  unsure (1)..(518): unsure at all n locations
  Clone ID: uC-gsflnu33B013b12b1
tctaatgcttggtactgtggggcctccagtaccaaacatagatgtacgcctggaatctgttcccgaaatgaattatgatgcccttgctagcacaccacggggggaaatttgtatcaaaggaaatacattattctcaggatactacaaacgtgaagacctcacccgtgaagtattgattgatggatggttccacacaggggatattggtgagtggcaacctaacggaagcatgaagattattgatcggaagaagaacatttttaagctttcacaaggtgaatatgttgctgttgagaacctggagaacatttacggtctcgtgtcagctattgattcgatatggatttacggaaacagctttgagtcgttccttgttgcgggtgttaaccccaataaggaagcacttgaaagctgggctgctgacataacgtaagtggtgacttcgagtccctctgtaaaaaccccaggccaaagagttcatacttggngagctcgcaagactggcnagagaaaagctg

SEQ ID NO: 13805 - DNA, 454 bp, Gossypium hirsutum
  Clone ID: uC-gsflnu33B013c01b1
ttcttgccgcagtacctgcacaaagacatcaaggacatcctgagcaggatgctgaccgtggatccgaagcaaaggatacggatgcacgaaatccgagagcacaactttttcaagagcaagcgatggacgaaactacctcccatcctttccgtcgaggagcaattgcggactacgattccgatcagtctcgacgaagatgtggacgcggatattgtgaagagtttagtgagtttgggctggggatcggaacaagaagtgcgagaggccctcttgtccggagactgcaattatgaaactgtattttatcgacaactggaggagaggaaaaggtttccctaccactcttctccgcgaaaggcaaaggtcaagacgaggggaagaaccaacaccctcacaaccctcagcagctctgcacctattcccttcgagattccctctgctttcgccaggtgtc

SEQ ID NO: 13806 - DNA, 529 bp, Gossypium hirsutum
  Clone ID: uC-gsflnu33B013c03b1
tttctccaatcagctgtccgccttgaccgaccgtccggcatcgtcttggccctcgatttttcccttttgtaaaccttttttcaccaattcccgaaatggcagtgaaaccctccaaggccgaaaagaaaatcgcgtacgacgcgaaactgtgccagctcttagatgagtacacgcagatcttgatcgccgcagccgacaatgttggctcgaaccagctccagaacattcggaaaggtctccgaggcgactcagttgttttaatgggtaagaacactatgatgaaaagggtctgttaggatgcatgctgagaagactgggaaccaagctttccttaaccttatccctttgcttcagggaaatgtgggttctgatctttactaagggtgatttgaaggacagtcagtgaggaagtagctaaatacaaggttggagctcctgctcgtgttggtctggttgcacctattgatgtggttgttccacccggcaacactggtcttgacccatcacagacctctttctccaggtgctc

SEQ ID NO: 13807 - DNA, 131 bp, Gossypium hirsutum
  Clone ID: uC-gsflnu33B013c05b1
ttcacacatccggagcggcgtccattagattgttttttctttgactgctgaccagatactggtgaggttttcttatatgattaacgcgcacccgcccatcatgcctactttatcatgaacataattcaacg

SEQ ID NO: 13808 - DNA, 487 bp, Gossypium hirsutum
  Clone ID: uC-gsflnu33B013c10b1
ttttaaaaaaacagagaatactcccccacccctttttctcttggagttagggtttcaacacccatcattgtcggcgattcaccgtgtcaaacggagaggggagctctgacgacgcggccacggtgtagatccggtaagactctcttcccctcctctttcctttgtctattttcgtataaaaataaaaataaaaaaacaaataatacaaaaaataaatgaaatcagaacatagaacaagactagaaataaaatcaaccttcctgtttttttgctattgtgattttgtttgctaaagttcgtgtcccccaaaaaaaaaactacaaatggatgtttccacttttataaccgaattacatagattcgtttttttgtttttttcttcttgtctgctattttttcttcttcgtttcttgtgtttcgcgtgctagtttcgtcttgcaggtgtcagacgcgtggaaggccgatggttggtgccccaagcgtggtg

SEQ ID NO: 13809 - DNA, 412 bp, Gossypium hirsutum
  unsure (1)..(412): unsure at all n locations
  Clone ID: uC-gsflnu33B013c12b1
ctccaaaatcaaaatgtttgttgcttcaatctctatttggtgggtgatccgagttgggtgttgctagtggctattttttatctttttgaggtggttgtgtggtgtctcttgactggcaattgaggatgtttggctagtcttgtgctccattgttttctcactgtcttgtaagcaaggtctttagtggaaataaaggctcgataaacgagattagacgcattaattttttcattagtggttgacaccaaaataactagtgatgattccttctttttttccttttttttatgtggtttgacggtttatgcttgagatcatggtgtaattggctttggctatatgtcattgttgctatgtctgtgatgattgttgttatatgaaatgaaacttctttttatcaaanaaaaaaaca

SEQ ID NO: 13810 - DNA, 347 bp, Gossypium hirsutum
  Clone ID: uC-gsflnu33B013d04b1
tcctatttaccttgcgctctgggaacgaggtacatccacaccagctgagagatcagagctctagtgcaggctctgcaggcctgtatgtcgcacgagcctaagagcatggcgacttgtgcaacctgcgccaagacaaacatggggatggcatttggagagatcactaccaacgctcccgtagactaccatacgatctgtcgtgacacctgtcgagtcgctggttcgacatctgccactctgacatgcgatgcctacgcttatataagaactgctagctgttgccttcccttggcatggacccacaccttgccatgaaatccatctcagttagcgtgctgaggaaatct

SEQ ID NO: 13811 - DNA, 503 bp, Gossypium hirsutum
  Clone ID: uC-gsflnu33B013d06b1
tcttcgcctgcggctgaccaggctgaggcttcgattattgaaccaaactgctcagaagctcagaaatctttaccgcaatctggcaatactgatgatgaagagcagcttgctcagaggcctgaggttgaccttgttgaggcctgcaatgaggaatctaatcctgcagaaggaccatcctgggcacaagccatctgtgatgaatcaatcaggcctgagaatgatccagggcttacacatgcatgctgactggaatctgaaaagcctgaggttcatcaggttgagacctgcaatatggaatcgaatcccacaggaccatcctcatcacaagtcatctctaatgaatctaccaatccagagcttacacaaaacgagctgcaatctgaagatcccgccgaggcttctcagtcacccaagactgaaactgttgatgtctttgatatggacatacaccttaaagaaacacaagatccttcacctgaactggaagatgatgctaaagtttc

SEQ ID NO: 13812 - DNA, 140 bp, Gossypium hirsutum
  Clone ID: uC-gsflnu33B013d07b1
tctcatgcgtccgcgcgtgcgatttgggtgtgactttgtctgggtgtgcctaggggcattaccgtttgtgacccatcattcccctttgtgattaggaacattaagaatagaatactcttaaactgaatgacagtttattc

SEQ ID NO: 13813 - DNA, 317 bp, Gossypium hirsutum
  Clone ID: uC-gsflnu33B013d09b1
cacggtaccgagcccggacttactggctggacccacccagcgcttcctccacacgtacgaattgaaatgaagtgacttgtggttttaaaggttgcagaacgggaactccttttgcattatatgcccattagaatttgcagctttcattccatcgatcaagtgggcactgccaattgaagagtccatcttataaatgatgatttaggagctatttataatgttcttgaaagcgctgaattaattttaactgccgagtgtgttataaaattatagaagctaaatccttggtgtaaccaaatttaactccttggaatact

SEQ ID NO: 13814 - DNA, 521 bp, Gossypium hirsutum
  Clone ID: uC-gsflnu33B013d11b1
tcttatatccccgtctccacaggcatggctaccaagcagccaaatactggcctctttgtaggactgaacaagggccatgttgtaacaaagaaggagttggcaccacgcccctctaatcgtaaaggaaaaacgagcaaaagagtccatttcgtgaggaacttgatcagggaagttgctggttttgcaccgtatgagaagaggatcactgagcttttgaaagtcggtaaggacaagcgagctcttaaggtagctaaaagaaagttgggaactcacaaaagggcaaagaagaagcgtgaagagatgtccagcgttctccgcaagatgagagcccacggtggaggtgcagaaaagaagaaataaagctttattttcttggtttctcacccttgtcgtgctcgagtttcttgtttaggagcagctagaggtttgtttagcatatgtttcattttggtgctttgagactgaatcagtgctttggaactttgtttatttgagttagagatgaaaaattgaagagtaat

SEQ ID NO: 13815 - DNA, 515 bp, Gossypium hirsutum
  Clone ID: uC-gsflnu33B013e01b1
tctcatgcgtgcatttccattaaaccaacaacatcaacataaaaccaaacacccagagttaaccaaaagagaaaatggtcaccaaagtctacattgtatactattccatgtatggacatgttgagaaactggcccaagagatgaagaaaggagctgaatctgtcgagggagtggaagtcaaactttggcaggtagcagaaacactaccagaagaagttcttgggaaaatgggagcaccaccaaagacagatgcccctatcataacaccagatgagctgacggaggcagatggtgtgctatttgggtttccaactagatttgggatgatggctgcacagtttaaagcattcatggatgcaactggtggtctatggagaacacaagcccttgctggtaaacctgctggcattttctacagcactggctcccaggtggtggacaagaaactactcccttaactgcaatcactcaactggttcaccatggaatgctatttgtgcccattgggtacactt

SEQ ID NO: 13816 - DNA, 318 bp, Gossypium hirsutum
  Clone ID: uC-gsflnu33B013e02b1
ttgttcctgtcaaaaaagagcctgagactcaattggcagcaagcaagtccaagaagtcccaagcttcttcttgagtgaacaaagtttgaaactttatcaagtcagttaatgtagtgatttctggtctttggatttcatacattatttttgaagtttttgacgttaagatgtgttggatggttttttatttcaaagcatgttttagtcaaatgttgtcttgagttatgtttttcttggagattttgtctcaattacagtgttctatgttatgtttcatttatatgacttttaatataaaacaagggttcgttaattggt

SEQ ID NO: 13817 - DNA, 108 bp, Gossypium hirsutum
  Clone ID: uC-gsflnu33B013e04b1
tgatacgacccagagctagaataacgagatacttggttctatgccgacagaccagatacccgacacatttcttgatacgtgttgggcggccggctctatctacatggt

SEQ ID NO: 13818 - DNA, 139 bp, Gossypium hirsutum
  Clone ID: uC-gsflnu33B013e08b1
tcccacgcgtacgggccccgggtctctgtgaggtgcttatacaggcaaaaggtccgaaacacaatattttggggaacatgaggatcaactgaagccacaaagagaacgcagtaactcctagtctgtggcttgcatacat

SEQ ID NO: 13819 - DNA, 194 bp, Gossypium hirsutum
  Clone ID: uC-gsflnu33B013e09b1
tcccacgcgtccactcatacgggaattgtgaagctattatccagattaaggacccggtgcacaaaattccaagccaattgaagaaaaccttaagcgtcagaaagaactcggtcacgactactgagcatcccgaattgcctcacaacattttggatttggtgcgcatcgaggatcttgattactgacaacaatgg

SEQ ID NO: 13820 - DNA, 510 bp, Gossypium hirsutum
  unsure (1)..(510): unsure at all n locations
  Clone ID: uC-gsflnu33B013e12b1
tcccacgcgtccgcttaaagcctgccatataatcatataaccaggctccgtcgtggtactcttcggccaccacaatgccgaaaatcgccttgggaacaagccaagaggctgctcagcctgactgcatcaaagcccttgtggtcgagtttatcaccactttcctcttcgtattcgttggagtaggagctgccatggccgccgatgagtcgggggcaaatgcgctggtgggattgtttgctgtggcggtggctcatgcccttgtcgtcggcgttatgatatcggccggacacatatcaggcggccatcttaacccagccgtcacgcttgggttgctattcgggtggtcacatcacnggtggtccgtggcgatcctctactggatcgatcagttgttggcatcttcagctgcttgtatacttctcaagtatctcaccggaggattgaacactccggttcacacattagcaagtggaatggggttccctcaggtgttatatgggagattattct

SEQ ID NO: 13821 - DNA, 359 bp, Gossypium hirsutum
  Clone ID: uC-gsflnu33B013f01b1
ttggttcgtgatgggaattcattgtcctctgtggcaatagatgaaggatactcaactgttgcaggaccttctaaacttccggtgactgaaataacggagatagatggtcctagttcagctgagaattatattaaagcttctagtcctgttgctcctgtggctacaactcgtaagagtacagtccatgctgatcgacaaaattcagaaatctcatattatgcagatgatgaagacggaaatcgtaaaaagtattctaggaaggggtccacttcgtcataagtttctcagagcattgattcctttctggtcaagtgcattaccaactctaaccggtgactgcaccttcgcgtaaagatgca

SEQ ID NO: 13822 - DNA, 281 bp, Gossypium hirsutum
  unsure (1)..(281): unsure at all n locations
  Clone ID: uC-gsflnu33B013f03b1
gcttcatgcgtncggttatccttaggtttaatatttggttttgtgcctttttgggaggttttgttagtgattttggagaaagttcttaatgataattgctgttctgtttctggattgtttatactggctgatgcgtaatacgtgttaggattgtatattataaaataaaaataatgacataaccgattatggacatggtggaggagtttatgacaacatctgggggcggccgttttagaggctctaagtttttccacgcttgaatgcgatgtattagtttt

SEQ ID NO: 13823 - DNA, 71 bp, Gossypium hirsutum
  Clone ID: uC-gsflnu33B013f06b1
gacccacgccgtcttccacgcgtccgcgcacctgaaattgaattttattttctctcagaaaggccagacag

SEQ ID NO: 13824 - DNA, 186 bp, Gossypium hirsutum
  Clone ID: uC-gsflnu33B013f07b1
tcccacgcgtccggtcaccggtccactgtgaagtttttacgcaggagaaaggccagaaacgcgagtatgttattgacaagagaaacacttacgggcatgaaaagcacgctataacacctacaaaggttctagaacaccctgacaacagcttcgatgctttacacagcgactaatcgatttgctgac

SEQ ID NO: 13825 - DNA, 362 bp, Gossypium hirsutum
  Clone ID: uC-gsflnu33B013f09b1
ttcttattggtcccaagttcggggtgctgagctaggccatatgctaagggccatgcgcaattctagccgaaagggagagccagaggtggcgccggaaatgttgactgatgccatggccaacatgagctgacaagtgatactgattaagctagtatatttgaccaaaggaaccagagactgaacaagattcaaggacataggtggcggcagctcatgacgacctgtcgggctctcaaatataagcgatctttataccttgacattgcatgcatggatttaccaggcatcgattgcgagacgtgcaaatgacataacagatggtatgtgctattgactatgatgatgagagagcatgaggaaac

SEQ ID NO: 13826 - DNA, 516 bp, Gossypium hirsutum
  Clone ID: uC-gsflnu33B013f12b1
ttccacgcgtccgcgcacctgaaattgaattttattttctctcagggaagtaagttatccggtttgactgtttataagcattacaaaatgtttttcgatagatatggttaccatgggacgtcatttgagcagagttatcgatgttaccctgcatctttcattgaaaagccacaaattgaaagcggtgataaaattatcatgcctccatctgcacttgatcgcttggcatctctgcatattgattatccaatgttatttgaacttcggaatgatgctgctgagcgtgcctctcattgtggagtgctagagtttatcgcagaagaaggcatgatctatatgccatattggatgatggagaatttgctcctacaggagggagatattgtgagggtgaaaaatgtaactcttccaagggtacctatgtgaaattgcagccccacacgaaggactttttggatatttcaaacccaaaagctatcttagagacgacactgaggaattattcctgttaactac

SEQ ID NO: 13827 - DNA, 242 bp, Gossypium hirsutum
  Clone ID: uC-gsflnu33B013g01b1
tttcttatcaaaaaaaaacttctgactccagagtttcaaccttctatagaggaaaagatacaatttcttacaacaaatcgacaaatggtgatgttttcagccacattcactgttactgtcaaggacttcaaagacaaatacctaaaaaaaccttatattattaatctaatggatgagcttactctgaagggtattacacaatattatgcttttgtggaagaaagacagaaagtttccatgag

SEQ ID NO: 13828 - DNA, 502 bp, Gossypium hirsutum
  Clone ID: uC-gsflnu33B013g02b1
ttcttcgcgttcgaccacgcgtccgctaatttgacagctctctcagtctctcattttgcctgataaccatgtcgaggagaaaggctagggatcccaaggaggagaatactaccctagggccggctgtacgagatggcgagcatgttttcggagtggctcacatgtttgcttcatttaatgacacatctattcatgagacagatttgtctggaagggaaacaactggttcgcattactggtggtatgaaggtgaaagctgatagggatgagtcttccccttatgctgccatgcttgcagcacaagatgtttctcaacgctgcaaggaattgggtattacagcccttcatataaagcttcgagctactggagggaacaaaaccaagacacctggtcctggtgcccagtcagcacttagagcccttgctcgttctggcatgaaaattggacgcatagaggatgttacccccattcccaccgatagtactcgtaaaaagggtggca

SEQ ID NO: 13829 - DNA, 529 bp, Gossypium hirsutum
  Clone ID: uC-gsflnu33B013g03b1
ttctcttctacttttagctctaagccaagaaagcaggccactaacatcaaaatggcttcaaaacaatcagcttccatggccctccttttggcactcaacattctcttcttttccttggtcagtgctactgccccatgccctcccaccaaacctaaccataaaccaaagccaaaccccaaccccagcaccccatcttcacagggcaagtgccctagagatgcccttaaattaggtatatgtgctaatgtgcttggcctagtcaagcccgtcattggttcacccccagtgatgccatgctgttcccttctcgatggcctcgtcgatcttgaagctgctgtttgcctttgcaccgctatcaaagctaacgtcttaggcatcaaccttgacattccagtttctcttagcttgctcctcaatgtttgctcaagaaagttccttctggcttccaatgctaatttaagtcttcatgtttcccctacattctttctcaacttctttatggcttgtgtttggctctttataagctatg

SEQ ID NO: 13830 - DNA, 521 bp, Gossypium hirsutum
  unsure (1)..(521): unsure at all n locations
  Clone ID: uC-gsflnu33B013g04b1
ccttcctgcactcttaactctaagccaagaaagcaagtcactagggttttaagagaagatcacaaatggcatcaaaaagatcagcttccatggccctctttttggcactcaacattctcttcttttccctggtcagtgcttgtggttcttgctattcacccacccctaaaccaaagccaaagccaaaccccaaccccaaccccacccccactccatcttcacaaggcaaatgccctagagatgcccttaaattaggtgtatgtgctaatgtgcttggcttagtcaagcccgtcattggttcacccccagtgatgccatgctgttcccttcttgatggcctcgtcgatctcgaagctgctgtttgcctttgcaccgctatcaaagctaacatcttaggcatcaaccttaacattccagtttcccttagcttgctcctcaacgtttgctcaaagaatgttccttccaacttccaatgctaagtcttcactgttcccaatattctntctagtcttccttattgg

SEQ ID NO: 13831 - DNA, 173 bp, Gossypium hirsutum
  Clone ID: uC-gsflnu33B013g08b1
tccacgcgtacggtcaccggttaattgtgaatttcttttgcaggaaaatgtcaatatactcaagaagccaaatgacttgagattcaactaatgctacaaatggattgttttaacagctactaagtttctttgattgcttgacaatagtttcgatttaaaggtcaccgactatc

SEQ ID NO: 13832 - DNA, 379 bp, Gossypium hirsutum
  Clone ID: uC-gsflnu33B013g09b1
tttcacgcgtccgggccgaggagaagcttggcacgcagttggaagttatttctccaatcgagtattgattcatctgggtttaagtttaatgcatctttctgagtagctcataattttattgttcttttgaagtagatgttaatgcttacatgcgtttggaggagacctttttttttttcctttgaaaaacatgtccttttactgcaaaaacaccactcagattttggtatctgattagaacagtattctcagacataagttttggctgcttgagttgccagtgttacactcgttctggattatatggttatctaaatatatgactcaaacttaagtctgccttggcaccgttatcaaagctaacgtcttaagcatcaac

SEQ ID NO: 13833 - DNA, 502 bp, Gossypium hirsutum
  Clone ID: uC-gsflnu33B013g10b1
tttttaaaccagcaagggggatatatgctttaatctcccattaaagaacctataagcaaaaatcaataaacattcatggggctgagctgatatttaggagattgagggacatgctgactttgctcatgtctggtgatcagtatggacaagcaactattcatctctgaagactaggttgagatgcactgggtatctactcaggaccatgacagggtacggatgtctcttggcaaactcctgggtgttcttcggattatttggacagatgtgcttctaatggatgaagtgttaagtgaggctgctctacctggcttttatctggaggctgcccaagttgctcttaacagtatgttgccagcacgtttagttaccttttaacggacatatcagatgccctttgagagtaaatgttagttcaaaagaggcagcagaggagctcccctgcaagttgctttggaagccagcaaaaagctgtgctccagggcagcatggatgtcttact

SEQ ID NO: 13834 - DNA, 422 bp, Gossypium hirsutum
  Clone ID: uC-gsflnu33B013g12b1
gtcacgcgaccgattttgggattatcaacggggttgtattttttagcaaggaatggatgaccgccagagtaagcgtggggaagcacttggcgaattaacctaggaagatggatattaagtccttacgttgtaacttaacaagattcccaatttctccttcttttcggcttcttacagcacaaaaggatgctatgattttgttaaacagcggagaaaacagtatgggaagtgggtcaaaacaagaatactagtacagactcacgtgtacgttactagtgaagagggggcaaaaacgattctagccaatgattttgttcatttcaacaagtcatatgtgaagtcaatgacagatgcaactggcgcaatgagtgtgttctccgtaccgcacaagatccacacaagaatcagacgtcttctctccg

SEQ ID NO: 13835 - DNA, 438 bp, Gossypium hirsutum
  Clone ID: uC-gsflnu33B013h02b1
gtttccctttttgtccctagtttatttgatactcccccctcatggctgccgctgatgtcgagttccggagcttcgtcggagggctcgcatgggccaccgacgaccgggcccttgaagaagccttcagtgcgtttggtgaaatcgtcgaatcgaagatcattaatgatcgtgagactggcagatcccgatgctttggattcgttactttccgtgacgagaaagctacgagggacgcgatcgaaggaatgaacggtcaaaatcttgatggaaggaacataactgtcaacgaagcccaatcgcgcagaagtggaggcggtggcggaggattcggaggaggaaacggtggttacagccgtggtggaggcggcggcggatatggcggtcgccaaggaggatatggtggcggacgccgtgaaggtggatactgaaacggtgggg

SEQ ID NO: 13836 - DNA, 534 bp, Gossypium hirsutum
  Clone ID: uC-gsflnu33B013h03b1
tatttttcgcccttttccccttccggatattaatttacaatccaaacatcagataagctaagcgaagcttaacatccaacgctagacctagaattcagattcttcgaactcaagggagggagaaatggcggtctctatctccgcatcagcaactgttccttcgctgagtcgacgaagctcaactcagttatccccttattattgttcgtccaagctatctttctcatcttctcttcgatttcaacccattcgaatcgttaatagaatccgtttcctctcgctatcgtcctctgcaagttgaagcaaagaagcaaacatttaactcctttgatgatttgttggcaaattccgacaagcctgtactggttgacttttatgcaaccttggtgtggaccttgtcaattcatggttccggtcctaacgaagtgagtgctactctgaaagataagattcaggttgtgaaaatcgacaccgagaagtacccaagcattgctgataaatacaatatacaaggattacccactttcatcatat

SEQ ID NO: 13837 - DNA, 519 bp, Gossypium hirsutum
  Clone ID: uC-gsflnu33B013h04b1
tttcaagtttaatgcaccacgagtcccaccaaccgtaaagctgaattatagttcagtattgggtcagtgcttgagatttgtcaacagtgaggagataccagacgctgttcttcaagtgttggctcgatgcactgctttctatttagatcatcaactcaacatcaccagtctatcagagtttgggaatggcacgattaacaagttgaaatattgtataataagtgaatgcccacggcttggaactgttgtagaaagcgaggagggaactgaggctgtatttccatgcctggagcacttgagtattcattattgctggagattagcatgcatttggaggggtgttgtccccaaaggaagctttgcagctctaagaagtctgtccttgtgtacatgcccagagttgacatatgttttcaaaagctcaatgctgctgttcttttctaacttggaagagttgaaggttgatgactgtgaagcaattgaaaaaataatttctgatgatgagattagtgaagctcg

SEQ ID NO: 13838 - DNA, 380 bp, Gossypium hirsutum
  Clone ID: uC-gsflnu33B013h05b1
tgcttctcatcacctccctccccacctgttagaaaagagttgccactattgagcttgactcccactcccacaaggtgtgagaaagaagaggaggagcatgatgacggtgttgaagaccaatatcaggatctgtatatttgcaatgggatgagcaaagggaaagagggaggggggctggttttgagtagtggtgcagcggaggatgaggatgaagatgaaactgctacggttgcactgcatatagggttaccaagccctaccgcttcagagttggcttcagttttatcatcatcatcatcattctcggagatgagagacaaagatggggatgagtacccagtcaacactctcagcaagggacaatattggatccctacccc

SEQ ID NO: 13839 - DNA, 453 bp, Gossypium hirsutum
  Clone ID: uC-gsflnu33B013h07b1
tcggacgcgtgggcggacgcgtggggtaaagctaagccatgaaaccccaatcgctttgcatcttttttcttctccatttcttcgctttactatgcacggcggcgtcggagtatgaagatccgagcaacggcggaaccatcgtttttactacacttggccgatcaaattatgcttgggacatctatactcttccaacttccgacccaccaagtccttccaatgaacttcgggttaccgacggcgaatctgtcaacttcaacggccagttcccttcgacctcaccgtcctctgttctctctctgctacataaccgaagcctaattcgaaccccaggtccacaagctccgccgcccctccagctcgtctacgtgacggaacgcaatgggatgccgaatatttactacgacgcgctttattacagtgcgccgggaagtactagatcgagatcggcac

SEQ ID NO: 13840 - DNA, 369 bp, Gossypium hirsutum
  Clone ID: uC-gsflnu33B013h09b1
ttccacgcgtccgcttctgtctccagagtttcaaccttctatagagcagttgatacgatttcttccagcaaatcgtcaaattttgatgttttcagccacatttcctgttactgttaaggacttcaaagacaaatacctaaaaaaaccttatattattaatctaatggatgagcttactctgaagggtattacacaatattatgcttttgtggaagaaagacagaaagtccattgcctgaatacccttttctctaagctgcaaataaaccaatcaatcattttctgcaactcggtcaatcgagtggaagctgttggcccagaaaattaccgaacttggctattcttgcttttatattcatgcgaaaatgc

SEQ ID NO: 13841 - DNA, 433 bp, Gossypium hirsutum
  Clone ID: uC-gsflnu33B013h11b1
ttcttttcaatattgatgatgcagctggggggctgtagatcaagaagatacaaatgtcgccccacaccaaagagttccgttacttggatagggcagctctcaaggacccacctcttaatgatcaggcaaataaaaggaacttggctacattaacagatgctgaagaagtgaaactggaactaatgatgttacctatatgggcaaccactgttatattccggaccgaatatgcccaaatgacaacattttcagtatcacaagccacaaccatgaaccgtaacatagggaaatctcagatcccaccagcgtcactaactgtatatgtcgtcggaagcattctcttgacagttccgatttacgacaggctcatcgctccaatcgctagaaaattacttaaaaacccacaggggttaaaccctttacaaaggatcgc

SEQ ID NO: 13842 - DNA, 331 bp, Gossypium hirsutum
  Clone ID: uC-gsflnu33B013h12b1
tggccgccctttttttttttttttgattaaaatgtttgttacaattcaattcatggagacaatggcaataaacattaatttaaagccagagttaaatctggtcaatgaagcctttaaaatttttgaaagaagacccaccttcagccacactttttctagcaactcccttgagttgaaatgaatttgcttttatttcatcagaagagagcagtgtattgatcttggaactcagttcattccttgtatcattaccactagattgtagtggcatttttatttatgagatgtttccgtaattttcaattccagtgaataagttaattaagatttt

SEQ ID NO: 13843 - DNA, 546 bp, Gossypium hirsutum
  Clone ID: uC-gsflnu33B015a02b1
cacagaccaaaaagctccatgttatactatcctaccagggacaaaattatcctattagaaaggatctacaatgtgaaacggacaagctaactcacttttacacatttattctaaggcctgatgcctcttatagcgtcttaattgataacagagagagagaaacaggcagcatgtatactgattgggatatccttcctccacgaaaaataaaggatgttaaagccaaaaagcctgcagattgggatgatagagaatacattgaggatcctaatgatgtcaaaccggagggatatgataaaattccagctcagattccagatccaaaggcaaaagagcctgatgactgggatgatgaagaggatggtatttggaaaccacctaagatcccaaacccagcatacaaaggaccatggaagcgtaagaaaatcaagaaccccaactacaagggaaagtggaagactccatggattgataacccagagttcgaagatgatcccgacctctatgtgctgagaccaataaaatatgtgggtattgaaagtctgc

SEQ ID NO: 13844 - DNA, 546 bp, Gossypium hirsutum
  Clone ID: uC-gsflnu33B015a03b1
tttccactcagctatgtcagcatcagctatgggagccgatgaaaaagcaattccacaagtttataagggacatagaaattgtgagacggtgaagggtgtgaccttctttgggcccaagtctgagtacgtggttagtggatccgactgtggccgaatatttatttggaagaagaaagatggacagcttgttcgtgttatggaagcagataagcatgtggtcaactgtattgagtctcatcctcataccatggttctggctagcagtggaattgagagggacatcaagatatggactccaaaggctattaataaagctactcttccaactaacattgaacaggtcccaaaacgcggcctctttcgtttgttgtcctttgctgccttcaatgaagatgatgatggttataatttttttcttggtggtggtgttgaggatactgatgatgaggaagatgactctgatgatgaatatcttgatgtttatgatgacattgatgatggtgatggcgattgcgatgataacgatgacagtgacaatgatgatgg

SEQ ID NO: 13845 - DNA, 91 bp, Gossypium hirsutum
  Clone ID: uC-gsflnu33B015a05b1
gcgtgtggatataaacttaaggctgggatattcaggtgttaaatagaatatgcactgtctaaacctccttttattacaaaaattttgtact

SEQ ID NO: 13846 - DNA, 536 bp, Gossypium hirsutum
  Clone ID: uC-gsflnu33B015a08b1
aaaatattttcctttttcccaacactgaatgggcaaagctccaaatttccatggcaggtcttcactataatttcttccctactgatttctactatcctcgtccggcacaatctacgccgtctccggccgtcgattctactcctccggcagctctgactacgccgatcgaggagaaaaacatcgtcgacgatgataataagaagcctgtgatcgtggtttaccgtggcaataagacgagtgtttccattaggaaacaaggcgaacagcatggtaggagttatgtgcgtaatcgagttgagcaaattaagttatcgcgaaactagatttgttttccttcgttgattttttattgccgaagagaattcgaaccgtttttgaatgtttaatttagtctttgaggatctattttatgtaattaattcgattttgtgttgtttttaactatttttccagttatggtttaaattctcaacgaatgatgttggattctgagtttatgtgcatatgaatcgaattttcctttccttttcttttgg

SEQ ID NO: 13847 - DNA, 485 bp, Gossypium hirsutum
  Clone ID: uC-gsflnu33B015a09b1
ttcgtcctccctcaccaaatcaaaatgtctgtggtggcgaacgaagactttcagcacattttgcgtgtactgaacaccaacgttgatggaaagcagaagattatgtttgctttgacctccatcaagggtattggaaggcgtttcgctaacattgtttgcaagaaggctgatgtcgacatgaacaagagggctggtgaattgactgcacaggagctggacaatctcatgaccattgttgcaaaccccaggcagtttaagatacctgactggtttttgaataggcagaaggattacaaggatgggaagtattcccaagttgtgtctaatgctctcgacatgaagttgagagatgacttggagcgattgaagaagatcaggaaccaccgtgggctgaggcattattggggtcttcgtgtacgtggtcagcacaccaagaccactggtcgcagaggaaagactgtaggtgtctctaagaagcgttgaat

SEQ ID NO: 13848 - DNA, 526 bp, Gossypium hirsutum
  Clone ID: uC-gsflnu33B015a10b1
tccacgcgtccggttcgtcgagcactactacgggacgttcgatgcgaaccgggccggtctagccaatctctaccaggacggttcaatgttgaccttcgagggtcaaaagatccaaggctctcagagcatcgtcgataagctcaccagccttactttccagcagtgtcagcacagcatcaccaccgtcgattgtcagccctccggcgctggcggcatgctggttttcgtcagtggtaccctccaactagccggcgaacagcatgctctcaagttcagccagatgtttcatttgatgccaacaccgcagggaagcttctacgtgttgaatgacatattcaggttgaactatgcataaagatgcaatccaaggatacaaaacaaacaatgttttggcactcagctccctgatcacgcataggcgttctcaaatgtgaaaacggaaaatgctttttatggtttaatcattagttccatgtgccttaaaaaatttaaagctttatttgatgcatgattggcggggttagtg

SEQ ID NO: 13849 - DNA, 511 bp, Gossypium hirsutum
  Clone ID: uC-gsflnu33B015a12b1
ttttatctgcagaatcagagtgtaaaaaaggggggggaaaatggctaaaagaatggttttgcgaatgatatcgcggccgttgttggctaaggtgaaggagacaacggggatcgtcggattagacgttgtacctaacgcaagggaagtccttatcggtctctacaacaagactctgaaggagatccaggccgtacctgaagacgagggttaccgtagggccgttgagagcttcacgcgccaccgtctgaaggtttgccaagaggaagaagattgggaaatgattgagaagcgccttggatgtggccaggtcgaggagctcatcgaggaagcgcgtgacgagctcactcttatcggaaaaatgatcgagtgggatccatggggtgttcctgatgactatgaatgtggggttatcgaaaatgatgctcctattccaagcatgtttcttagcaccgacctggtcctttttcagaggaggtttacatgacgctagaagcttttttaaagaaagacg

SEQ ID NO: 13850 - DNA, 544 bp, Gossypium hirsutum
  Clone ID: uC-gsflnu33B015b03b1
atttgagaggcgaagggtcacaaaagatgatgtgacaagagctaattttccgtgagatactggagtaccatcctcagctgcggaaagatcatatgaatggaactgagagggcaaactttctctatccaagtgcggttgatcaattcaaaaagcagtttgcacatctcgaggaaaatggtggtaaaagtgcaccagttattccactcgaaagaaagcatgtctcccttccgaggtcaacaattgtacattccaataccattgcccctaaagagcagcagccaagcctcaagtccttaaaagagagacaaaatgcagaggaggcatatcaagcctcaaaatccttgcaggcacaacaaagaatccctctagctaaaccgggaaagatagtaggccccgttgcgctgtatgagaatggaacaatcatgaaagatgcctatgatacgagaacgttcataagaagcacaggtcttccaccacaggctgtccaccctgcatatacttattcaaaatctaacactggaaatcaagaaagaagcgaaaggga

SEQ ID NO: 13851 - DNA, 498 bp, Gossypium hirsutum
  Clone ID: uC-gsflnu33B015b04b1
ctcacacttgctaatattgctacttggagtggtggctctcgccactccctcttttggtacctatgagtctcccaactatgggaagccccctactcctgtttataaacctcctaaggtgaaacccccaccttatgaacatcctgtttataaacctcctaaggtgaaacccccaccttatgaacataagccccctgtctatgaaccaccaaagaaggaaaagcctgagcctaagccaccagtttatacacctccaaagaaagagaagcctgaacccaaaccaccagtatatgaacctccaaagaaggaaaagcctgagcctaagccaccagtttatacaccaccaaagaaagagaagcctgagcccaaaccaccagtatatgaacccccaaagaaggaaaagcctgaacctaagccaccagtttatacaccaccaaagaaagagaagcctgagcccaaaccaccagtgtatggaccaccaaagaaggagaagccaccggc

SEQ ID NO: 13852 - DNA, 408 bp, Gossypium hirsutum
  Clone ID: uC-gsflnu33B015b06b1
ttcacgcgtccgcacccacttcttcttcttcgtcttcttcatcttcttcacttgccgttccttcttggcatgataataaccaggagcttcctgagtcatggaatcaacttctcttgggtggattggtgggagaagaagaaaaggggggtgatataggacagttataagcgttacaccaagcctgaaaggctaattctgtagtggatgtgaaacaagaaaactctgcacgcagctatgcgtctggacatgcaagcgaagattgtcatcatcacccgtcgaataaaccagcttggtttcaccggatgccgttagctgctacatcacctaagtccagcgtgacatgcttcagcagtaccatgttggatttttcctgaaccaaagctgagcatgggaggcaaccacagccag

SEQ ID NO: 13853 - DNA, 539 bp, Gossypium hirsutum
  Clone ID: uC-gsflnu33B015b09b1
tttttagcaatccatggagattggcaagatggggcaagaagggaggtgattggcatatttggtaaccgaaatccacaaccggaaggcattgcaaaactcaaaactatgaccatgatcattaatgaaactctaagattgtatggtccatcaaatggaatgttgagaagagttggaagagaagttcaaatggaaaaggtagtcctccctgctaatatagatattctaattgcaaatgttgcacttcaccatgaccctaaactgcggggagaagatgtgcatctttttaaaccagacagatttgcggaagggattgccaaagctaccaattacaatccggctgccttttttcccttcggattgcgacctcgaacttgtgttggtatgacctttgcaaccacagaaaccaagattgttctctccatgatcctacaacgctatgctattacactgtcccctgcctatgtccactcaccaatacctataatcagccttaaaccacaacatggaattcaagtaatactcatgtcactgcatagcga

SEQ ID NO: 13854 - DNA, 443 bp, Gossypium hirsutum
  Clone ID: uC-gsflnu33B015b10b1
ttacgcgtccgctttatgttcagggaaaagaggtaaatggcgctggaattaatgctagttctgctgtccatcaggatgttgatggtagagctacagatgtggccttgggatggtcgggtgcccttggttctccggttacattcgccaccacattagagcaggaatacagaagcgacatttttggggagagaggcatcttgctaggtgctgttcatgcggttgatgaatgcttgtttagaaggtatgtggaggatggaatgagtgaagaattggcttacaagaacactggtgcgtgcataacaggaattgtgccaaggccaatttagcacatggtctgctagctagatacagctcattgaccgaggaaggatatagactatgtgaggacgtttacagcgccgcatgttgtcctcgcatggcaatcctatatgagtgttacgaag

SEQ ID NO: 13855 - DNA, 291 bp, Gossypium hirsutum
  Clone ID: uC-gsflnu33B015b12b1
ttcacgcgtgggcagacgcgtgcgcccacgcgtgctctgaaacccacaagtgtgttcatggctaacaagctgctacgcatgtaaaaaggacgacttcatgttaaataacattggtcgttaaattaacgtgtatgaatcaaatgtgcgtggactgtcacctttatatattagaggaccaacaccctgcttgttttgatggcaaagtatgggaccaactccaaaatgaggcactcaggtctaagttctcttcaatatatccaaaatggaatcataccaacataattctataaa

SEQ ID NO: 13856 - DNA, 544 bp, Gossypium hirsutum
  Clone ID: uC-gsflnu33B015c01b1
gttctttttcttattttcccgtactttctctagggtttcattcttttaatgttttagttacctcctttaggatttgggatctgggtagttctcagctttagtagtttacatttgctgattctcagaagttgtgtttttttttggggggtatagagaaatagatcatggcaaaagtagatgaaccacagccacatccaccaaaggagcagctgcccaacatttcttactgcattacaagtccacctccatggcccgaggccatccttcttggtttccaacattatcttgtgatgcttggaacgacagtgatcattccaacttcacttgttccccagatgggaggtggaaatgaggagaaagcaaaggttatccagactctactctttgttgctggtttgaacacattattgcagtcactgtttgggtctagattgcctgctgtgatcggagggtcttatacctttgtcccaacaacaatcttaattatttttgctggtcggttcagtgacaggtcagatcctattgagagatttaaaggataatg

SEQ ID NO: 13857 - DNA, 542 bp, Gossypium hirsutum
  Clone ID: uC-gsflnu33B015c02b1
gtttaaattacctgcaaaaactatgggaatgggttgggttcccatcgttagagtcccaaactgagagcagccttaacatcgagcctccatgcaaatccgccaaagctcatcttccacacatcgcaaggaaccattttcgattgctttttctttccctttccatctccgtaccgtaaccctacccggcacgagaatgcaccctgtgggaatttaaacccttctttcaccaccaaccccaccgcggtttcagccccttctccgcccaccatgctcttgaacgcctcgttcacccacaaaacacggtgccaaccgtccgatatgaaccctggatacgtgtccttatccagattcctcattctatccacgtccgtacagctccccatgtctccttcatccatgcagctgtctgttatgctctccaccgtcacccatgactccacaacactcactttcctccccgtcgcctgatccgacaaccccatcaccgcagccgccactttttgatctgttgcaaccattttctgcaacttcaagcacagcag

SEQ ID NO: 13858 - DNA, 394 bp, Gossypium hirsutum
  Clone ID: uC-gsflnu33B015c05b1
tttttctgaggatggatttgtgagcttgctgggtgatagtggtgatactaaggacgatctcaggctcccaactgatgagaacttgttgaaacagatcaaggatgggtttggtgagggaaaagacctggtggtgtctgttatgtcggccatgggggaggagcagatctgtgctctcaaggacattggtccgaaatagtttgaggtttggtgattctaagtatgttattacaaatcttaaatggaattatttttataagtggcttttaatatcttgcctttccaagacttggggtagggtataaatgttgtttgaatgggtttgttttgtttggtgtggatgctaaagataaaaaggaaaaaaaaaacacctttactagttcataaaaagaaaaag

SEQ ID NO: 13859 - DNA, 518 bp, Gossypium hirsutum
  Clone ID: uC-gsflnu33B015c06b1
tttgttgcacacaaaattgaattcaaagaaggccctgccatgcctgttcttgataaattggtggaagatgaaaagaatcatgggtcgtatgatttcatctttgtggatgctgataaagacaactacctcaactaccacaagaggctgatagagttggtgaaggttggtggtttgattggctacgacaacacactgtggaatgggtcggtggtggcaccgcccgatgctccacttaggaagtacgttaggtactacagagacttcgttttggaactcaacaaggctcttgctgttgaccccaggattgagatttgcatgctccctgttggtgatggaatcaccctttgccgccgtgtcaaatgaaccaccaccgtcgccgccgccgccacagccgcttctaccacccaagattgacaaacttataagtacttcaaaatttcataaatttttttttgtgcaatttcaaatatggtgtaaatttaatttggtatttataaaagcaaagcaatgcccatcta

SEQ ID NO: 13860 - DNA, 259 bp, Gossypium hirsutum
  Clone ID: uC-gsflnu33B015c07b1
ttggctcacaaccctggtgggaaagagaggaccgcaaaggaattcaaggcactagcaacgggtgcgggatttcaaggcttccaaatcaaatgctccgcttttggcaccaacatcatggagtttctcaaaagtgtttgaatcttacatgcttttggattctgaagcttggtgattgttgtctcaaaggtggattttctggaatttcatactttttgtttgacagaaaacaataaagaacgaaatttcatggtttttacgt

SEQ ID NO: 13861 - DNA, 545 bp, Gossypium hirsutum
  unsure (1)..(545): unsure at all n locations
  Clone ID: uC-gsflnu33B015c08b1
cccacgcgtccggagattcttcacaagatggctgattcatattttggagagggtttaactcttctgggtgaaaggtctgttagaaggaatttagttggctgttccaagtaacttggttgacgaaaattggtttcatatatgacagaaaaaaattgcagaaattagagcaatttacacatgagatggaagatgggtggggactggcaactgatggcaaaatcttatatggaagtgatgggacttcaacactgtatcaaatcgatcctcaaacattaaaagtcacaacaaaaaatgtcatcaagtttaatggtcaaaatgtacgctacctgaatgaattggaatatataaatggtgaaatatgggctaatgtttggcagactgactgcattataagaatctcacctaataatggtacaatacttggatggattcttctccaagtttaagaagaggactattagcggccggattaacggtattgatgttntaaatggcatcgcttgggatagcgacaataatcgcatttatgttaccggaaaactctg

SEQ ID NO: 13862 - DNA, 542 bp, Gossypium hirsutum
  Clone ID: uC-gsflnu33B015c09b1
ttaaaaccgaaaaaagggagaaacccaagtatgttgttggagtgaaacactgtctgtttgtgaagttaagaagtccagtgtgtagctgagtacggaaaaaaaagcatggtttctgcatcagagattgcatcaaagttgaatctggcttcccaccctgaaggtggctttttttgtgaaacttttagggatagttctgttatgctctccacatttcaacttactcctcaatacaaagtcgatcgtgccgttagcacatctatttacttattgttaccggctgggagcgtgtctgaccttcaccgtataccctgtgctgagacctggcatttttatttgggagaacctcttacggtcttggagctggatgagaaagatggtcaagtaaaactaacatgtcttggacctgatttgttgaataatcagaaggtgcagtacacagtgcctccaaatgtttggtttggtgcatttccaacaaaagatttcaacatttcgactgatggtgcagtgacgaaaaatgatcccagggatgctgagagccatta

SEQ ID NO: 13863 - DNA, 562 bp, Gossypium hirsutum
  Clone ID: uC-gsflnu33B015c10b1
gtccaatattcccacactagatgttgttaaagatataaacggagatgggagaatcacacaagtgaaaatcgatacaaagaggtccatacgctggtttcttgcaatcaatactgaggaaatagaagatttcacgtttaatgtgggtttggaggagttagttgcagcagatggtaagcgtagcatagacggatggcatactattcaagcttcaggagggaagaatgcaccaacaaagtttgaactcacactcttctggctgcaaaattcaacacgccgttcagacaagatggtgcaatcggagcagcgaccactcttgaggatcagaactgatcttcctggagtggtgacaccgaaggttgaaacagtccttgagaagcttccaccatggtattcattatttgggaagtccacatctcctcacactttatcatttttgagtagtcttcctattgatttctagataagatttggaactctttgttagcgtttttggtactggaaaaggttgtacattagtcccactaccaccgagctacacaaacaaaacaccctaacatttatt

SEQ ID NO: 13864 - DNA, 300 bp, Gossypium hirsutum
  Clone ID: uC-gsflnu33B015c11b1
tttactcacaaggttctagatccgggtcaggggcataagagaatccatactgctgtacacgtgcatactagtgcgtagatttcctagggagacgccgaaggatggtctactgtccgaactttcaccacgatctgcctggtctatcgtttgcgaaacaacactgattaaactggtggtagattgcctttaaaggagttgatggatggctcaacatacatggggaactcggcatttataaccgacacgaactatagaggatgattgtaacgcactgtgaagatgcgcattaaggttactatg

SEQ ID NO: 13865 - DNA, 416 bp, Gossypium hirsutum
  Clone ID: uC-gsflnu33B015c12b1
ttgtgtgagaaggaaaatcagactatctcggcactatggaaacaaaaggcgtggactctgacaagagcttgaacgtcagcttcggagagaagcaaatcgattatgtccacactggctccggtgaatctgtagccgaagatccccgcttcctcaaagcccatggccgggctccggctaacgtggccatagctgttgctagactcggaggcaaagcgaaatttgtcggaaaacttggggacgaccagtgcggtcatatgcgggccgatagtcgccagcaaaacagtgactccactgacaggatcttgtttgaccaaagcgctagaactgctcttgccttcgctacgcaacgcgccgactgacagcgtgagctcatgtgctataggaatgctaacgccaacatgctgtggaagccccag

SEQ ID NO: 13866 - DNA, 529 bp, Gossypium hirsutum
  Clone ID: uC-gsflnu33B015d01b1
tgttaatttcccttcaaagaaaagaagaagaaaataccaacaactatcagctaacgatgagttattacaatcagcaacagcctcctgttggcgttcctccttctcaaggttatccaccggaaggttatcctccaaaggatgcttatccaccaccggggtatcccccacaaggatatcctcaaggttatcctcaacagggataccctccgcagggatatccacctcaatatgctcagcctcctcctcctcagcaaaagcagagttccggtgtcatagaaggctgtttggctgctctttgctgttgctgtcttctggatgcttgtttttgacgaccttttctccaatggcagcttagaaaaatattgaatttataggaggagagttgaattcaattaccattttcaaacttcaatttcaaatgttcttctttctcttcatcgctttttttctttttaataattgaacccttcattggatttgaactcttgttgacatacacagtaatattaggatcttttttctttgttct

SEQ ID NO: 13867 - DNA, 523 bp, Gossypium hirsutum
  Clone ID: uC-gsflnu33B015d02b1
gttgctaccaaggacagtctttctcgacattggaataagtttggagacgtgctaaaagttattatagttacagatgcggcgacagggcaaccgaaagggtcagcttatgtggagttcatgcggaaggaagcagcagacaatgctttgtctctggatggtacctcattcatgtcacggattcttaaggtcgtgaagaaaagttcagctcctcaagaagccgctgctcctgtcatgacatggcctcgtgtagctcggggctctccatttgttgcagcaaggtttggtagagcttcatttgccagaggcatgccaggtgcttttaggcctcaccttccaattaaacccggtgccagaagctttcaatggaagcgtgatgctcagacgaccaccacccgaaccgacgccgtcactgggacaaacgtttcttctcccactttccgcagtctcacctatgtccgaacagaacctaagtcagcagggaatactagctagtcaagaggtttgctaccgcagtcacattcct

SEQ ID NO: 13868 - DNA, 534 bp, Gossypium hirsutum
  unsure (1)..(534): unsure at all n locations
  Clone ID: uC-gsflnu33B015d04b1
tttcacgcgtccgagatgcctcacttgtaccctgatgataggattttgacttcaactgttgaagtattggctaggaagcgtgaattaaaattgcccgtcaacttggagaagttcacgagctcgaccaatcgtagtctgattgaggcaatgttgaaaggatttgttaaaggtggaagcttgaaccttgcatggaagcttctttcggttgtgaagcaaagtaaaagaatgctggatccaggcatttacgcaaagctaatattggagcttggaaagaatcctgataaacacatccttgtagaggagttactgngtgatcttggagaaagagatgatttgaatttgagtcagcaggactgtacagtgatcatgaaggtttgcattaggcataggaagtttgagattgtggagagcttgttttactggttcaagcaatcagggcgtgaccccagtgtggtgatgtacacaacattgcttcatagtcgttattctgagaacaagtacatggaagcattagctctggtttgggaaatggag

SEQ ID NO: 13869 - DNA, 531 bp, Gossypium hirsutum
  Clone ID: uC-gsflnu33B015d05b1
ttcacgcgtccggtcttcccatcaccccaggtgtccacatctgttgttgagccctacaacagtgtcctctcaactcactcccttttggagcacactgatgtggctgttcttcttgacaatgaggctatctatgacatttgcaggcgctctcttgacattgagcgacccacttacaccaatcttaaccgtcttgtctcccaggtgatctcctctttgactgcttcacttaggttcgatggtgccttgaacgtggatgtaacagaattccagaccaacttggtcccttacccaagaatacacttcatgctttcttcatacgctccagtcatctccgctgagaaggcttaccatgagcagctatcagttgctgaaatcaccaatagtgcctttgagccctcatctatgatggccaagtgtgatcctcgccatggcaagtatatggcttgctgtttgatgtaccgtggtgatgttgtgcccaggatgtcaatgctgctgttgccaccatcaagaccaagagaactattcaattcg

SEQ ID NO: 13870 - DNA, 534 bp, Gossypium hirsutum
  unsure (1)..(534): unsure at all n locations
  Clone ID: uC-gsflnu33B015d06b1
gttttgttccaagctctgggttatggcttcccaggcgttttatcttcttgtttcaatcattgttctcttatccgccattgttgtctcaggttcgggttcggtcgggattaactacggtcgtgtagcaaacaacttaccgtcaccggaaaaagtcgtggaactattgaaatcacaaggaataaacaaagtgaagctttacgacaccgacgcgacggttttgacggcgttagcggattccggtataaccgtggtcgtcgcacttcctaatgaactactttcatccaccgctgctgatcagtcgtttgcagacaactgggttgaagcaaacataacaaagttttacccaaagacaaaaatcgaagccatagctgtcggtaacgaagtgtttgtcgatccggccaacacgaccaaatacctcgtaccggcgatgaagaacatccacgcttcgttagttaaatccaagcttgattccgccattaaaatctcttctccgatagctttcagtgctttaanaacctcgtatccttcatcggc

SEQ ID NO: 13871 - DNA, 513 bp, Gossypium hirsutum
  Clone ID: uC-gsflnu33B015d08b1
tttttagctcacaggttccattgtttttcaggagtaaagagcaaaaaacagaagggaaatcaatggaagggaaagaagaagatgttagattgggagctaacaagttctcagaaaggcagcctattgggacagcagctcagtcccaagatgataaggattacactgagccaccaccagcacccttgtttgagcctagtgagttgacctcatggtctttttaccgagctggaatcgctgagttcgttgctactttccttttcttgtatatctcggtattgactgtgatgggagtccttaaggacaaaaccaagtgtacaactgttgggattcaagggattgcttgggcttttggtggtatgatctttgctcttgtttactgcactgctggtatctcaggtggtcatatcaatccagcggtgacatttgggctgttcttgggaaggaaattgtcgttgacaagggcaatatactacatggtgatgcagtgcttgggagccatatgtggggctggtg

SEQ ID NO: 13872 - DNA, 533 bp, Gossypium hirsutum
  unsure (1)..(533): unsure at all n locations
  Clone ID: uC-gsflnu33B015d10b1
ttctaatgcagaaggggctgatggaggacgcagttgaatatttagagcgtgccatttcaaagctgtctcttgctggccatccaacagaggttgaaaatgttgatcttttaattctatcgtctcaatgggccggtgttgtctatatgaaacaggggaagaaggcagaagggcttgcacacctggaaacaattgcaagtttgaaagagccagaagatccaaagagcaaagctcattactttgatggattgttgttgcttgccagtgcattatttgactttgggcgcaaggctgaagctttaaagtttttgaagttggttgttgcttataatcctaagtataactatttactcgaagaattaaagaacgaagaagatgattttgcgagtaatcttgcaagcagtaggagacgaggttactaatttgcctgcataattatntccttgtttgagttatgaatgttaggcagctaggcaatagcagctagccttttagggactccataatntctgttttcaaataatctctaaaacttt

SEQ ID NO: 13873 - DNA, 491 bp, Gossypium hirsutum
  Clone ID: uC-gsflnu33B015d11b1
ttttggaatagcccagtccaagggcgttctggggtatggaccacctggcacaggaaaaactctgtgggctagagcagtggcccatcatactgattgtactttcatcaggttttctggttctgaattagttcagaaatacattggtgcgggctctcggatggttagagagcttttcgtcatggccagggagcatgctccatcaatcatatttatggatgagatagacagtattggatctgctcgcatggaatctgggagcggcaatggtgacagtgaggtgcagaggaccatgttggagcttctcaaccagctggatggatttgatgcttccaacaggatcaaggttctgatggctacgaatcggattgatctcttggatcaagctcttcttacgccaggccgtattgacgggacgattgaatttccaaacctcagcgaggagtctcgacaggacatattaaacatacattctagaagattgaatttgatgc

SEQ ID NO: 13874 - DNA, 427 bp, Gossypium hirsutum
  unsure (1)..(427): unsure at all n locations
  Clone ID: uC-gsflnu33B015e01b1
ttcacgcgtccgcccacgcgtccggccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaacggtgnggggtttgggggag

SEQ ID NO: 13875 - DNA, 544 bp, Gossypium hirsutum
  unsure (1)..(544): unsure at all n locations
  Clone ID: uC-gsflnu33B015e02b1
ctttctcttgccaattactttccattctccctccctttcattgctggtttttttttccgttgcttcaatgggtttctttgtagaagatccagggctaattgtaacccatcttctttacaaaacagctgttgttttagcagttttaagatgggtctggtcttgggctcttaggtttaaagacacgagtttatttagtttcattttttcatctgactcccaaaacaacacttcttcttctttggtttcttcacaaatgattagagacagcctggtgttgacaaccttcgaagatgctaaggaaagggtgccttgggtttctgacacctgtgcagtctgcttgaatcagctgaaggaaggtgacgaggtcagagaattgaggaactgttgtcacgtgttccacaaagattgcattgacagatgggttgactatgatgaagatcaagatcacgaccatcatgattatgatcatgatcaagatgatagtaacaatcacangacttgccccctgtgcagggcccctttactcacttcttcacaatgctcg

SEQ ID NO: 13876 - DNA, 516 bp, Gossypium hirsutum
  Clone ID: uC-gsflnu33B015e04b1
gtgcagagcagatgttgtggaggagtatcttgcggaccacaatgagaccatctctggcgttcttgacaggtttgccgccatgggtattgacacccctggagtcgttgccctcctaggagctcacagtgtcggcagaactcactgtgtgaagctggtgcatcgtttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatactggacaacaagggtttgttgattgtggatcaccaactggcgtacgacaaaaggaccagaccttatgtgaagaaaatggccaagagccaagactatttcttaaggagttctcaagggccattactctcctctctgagaacaatcctctcactggtagcaagggtgagatcaggaagcaatgcaatcttgcaaacaag

SEQ ID NO: 13877 - DNA, 538 bp, Gossypium hirsutum
  Clone ID: uC-gsflnu33B015e05b1
tgtgaaggtgtatggcccagcctttgcttctccgaagcgagtgattgcatgtcttattgaaaaggagattgaattcgagactgtccctgttgatttgcttaaaggagagcacaaagaccctgaatttctcaagctccagccttttggaacagttcctgtcactcaagatggagattatgttttatatgaatcccgtgcaatcataaggtactatgcagaaaaatacaaatcacaagggactgatctactgggaaagacagtagaggaaaggggtcaagtggaaaattggctagaagttgaggcacacaatttcaacccatcaatttacgccttgaccctacatgtgatgtttgcttccaagatggggttccctcctgatgaaaatttgatcaaggaaagcgaggaaaagctaggcaaagtgctggatatttatgaggagaggctgtcaaagaacaagtacttagccggtgatttcttcagccttgctgacctgagccacctgccatttactcagtacttggtgggtcaaatgggaaag

SEQ ID NO: 13878 - DNA, 531 bp, Gossypium hirsutum
  Clone ID: uC-gsflnu33B015e06b1
tttacgcgtacgattatctttaacaacagtgggtccaaagaaaaaaatggggcttaaacctggtttatcagctttaatcaccggcggagcttccggcatcggtaaagcgttgagcttagctttggcggggaaaggattatttgtgacgatcgtagatttcgctgaagagaaagggaaggaagttgcttgtttagttgagaaagagaattctagatttcatgaaaagctggagtttccttctgctatttttgttaaatgcgatgttacgaatccaagagatattagcttagcgtttgagaagcatgtggcgacatacggaggatgggatggttgtattaacagcgccggcatcaatattccagtaccatttcagaacgatcaaagtgatggggctaagacatggaggcacaccattaatgtcaccctcgtgcagttattgattgtactcgccttgcaattaagactatgcaagctctgcaaaagccaggggtgataatcaatacaggatcctatgctgtcttttcccatttt

SEQ ID NO: 13879 - DNA, 546 bp, Gossypium hirsutum
  unsure (1)..(546): unsure at all n locations
  Clone ID: uC-gsflnu33B015e07b1
tccacgcgtccgcacaacaccatcttcagctcgacataaacgaggatgcaactgcaagaaatcaaattgcctgaagaaatattgtgaatgctttcaggttttccgcaaaaaaacctctctgcttatgttgttatgttgtcctacataaactgatttagaacacgttttttgtcgtcttcaagggcggtgttggatgttccatcaactgcagatgtgaagggtgtaagaatgcattcggtcggaaggatggatctgctatcgtggaaaccgacggggagccaggagaagaagaaatggatccttccgaaaagaatgcactggacaaaaacttcgaaaagcccgacatcttaaataatgaagagcaaaatccagcttctgctctcccaacaactccactacaactttgcaggttccttccttgaactttttcaagttgtttcaatgataaaatcgatatccattgttgctataaattcaataatatttctctgcgcagacctttggtccagctgccattntcatcgaaaagcaaaccgccacggtcct

SEQ ID NO: 13880 - DNA, 550 bp, Gossypium hirsutum
  unsure (1)..(550): unsure at all n locations
  Clone ID: uC-gsflnu33B015e08b1
ttcattttcaagtctgcaaaacccctagccagccacttccccgccgcctctccgaaccatgggccgagtccgtaccaagacggtaaagaaatcctctcgccatgtgatcgagaggtactactctcgcatgacgcttgatttccacaccaacaagaagatcatcgaagaagtggctatcatcccttccaagcgtctccgcaacaagatcgccggcttttccacccatctcatgaagcggatccagaagggtcccgttcgtggcatctctttgaagctccaagaagaagagcgtgaacgtcgcatggatttcgtccccgacgaatccgccatcaaggttgatcaaatcgaagtcgataaggaaactctcgatatgctttcggttctcgggatggctgatattcccggccttgttaaggtcgatccggttgctgttgcggttcccaaatcgggttcggtcgcggtggcggacccggaggagatttaaggggtgggtatccatggatttgatgggttcttaaatcttaagtttgttatgcttatntttgatagt

SEQ ID NO: 13881 - DNA, 535 bp, Gossypium hirsutum
  Clone ID: uC-gsflnu33B015e09b1
gtgagccagagagatgggttcaaaaagaacggcatcactagccctcttctttgcactcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtcccactttccctcagcttgcttcttaatgtctgctcaaagaaagtaccctctggcttccaatgtcgctaaatcagttctctaaattctttctcttcttagtgctgcgtggttttgatgttcttaaggtctagtttgcagtgatcaatgttttcttggtaactgggttgttaatttacg

SEQ ID NO: 13882 - DNA, 543 bp, Gossypium hirsutum
  Clone ID: uC-gsflnu33B015e12b1
cgttatgcgtccgagatgcctcacttgcaccggggggattttaaagagacttgtgctttttaaccaccggctcggaagcgagacttaaaattgcccgtcgacttggagaagttcacgagctcgaccaattgtagtctgattgaggcaatgtagaaaggattcggcaaaaggtgggacgccttgaacctttgcatggaaagcttctttcggttgtgaagcaaagtaaaagaatgctggatccaggcatttacgccaagctaatattgtagcttggaaagaatcctgataaacacatccttgcagaggagttactgtgtgatctcggagaaagagatgatttgaatttgagtcagcaggactgtacagtgatcatgaaggctcgcattaggcataggaagtttgagattgtggagagcttgttttactggttcaagcaatcacggcgtgaccaccgcgtggtgatgtacacaacattgcttcatagtcgttattctgagaacaagtacatggaagcattagctctggtttgggaaatgaggccag

SEQ ID NO: 13883 - DNA, 526 bp, Gossypium hirsutum
  unsure (1)..(526): unsure at all n locations
  Clone ID: uC-gsflnu33B015f01b1
ttttaacaccgttcaccaaatccttgctcccggggtagagtggtggttccacgggccacccactcaccagtttttgatgcgcttactcaccggcgcttcatccgacgatcctttccgtttcgaggtcgaccctgtctcagtcaccacctttggatccaccgtcatcgttgaaggctgtgataacagccgttcgatctcctgggttcacgcttggactgttcgtgatgggataatcacccaagtgagggagtatttcaacacttctctcaccgttactcgccttagagactctccaccgtcagcttgcagttcttcgacggcggagattgcgccagtgtattgcccttacgtttgggagagtagtctttccaaccgggtggggaaatcggttccaggtcttgttcttgcaatttagtttcctcctcccacgtgtggctaagataacagatgttagttccatgagttgagtttggtctggtgttaaaaattattgtgtctggactgtcaattnggtaacttattagta

SEQ ID NO: 13884 - DNA, 541 bp, Gossypium hirsutum
  unsure (1)..(541): unsure at all n locations
  Clone ID: uC-gsflnu33B015f03b1
ctcacgcgtccgcatttccttctttcctctgggggtctctcaatttttcctctggttggatagagagaaagcttttaagtaccgaagaagcggagaaaactgcaatggcggcttccaagaaatggtttttagcttctttagctgttctgtttttgtttcttgttggagcaatggccacagtacagaccaacaacgattccagcactgtggagatagagaagctgcagaactcaaaaaactcaacaatggcaactaggtcagaagaggttaaggtcttgaatgaacatgctgtggctgatccagaggccgtagcagccgaggttgagaccatcattgacatgaatattcgaaatgtgacggaaaggaggaagttggggttcttctcgtgcggaactggtaatcccattgatgattgctggcgttgtgaccccaactggcagaagaaccggaagagacttgctgactgtggcattggttttggaaggaatgcaatccggnggcgtgatggacgcttctacgttgtcactgaccctaatgatga

SEQ ID NO: 13885 - DNA, 533 bp, Gossypium hirsutum
  Clone ID: uC-gsflnu33B015f04b1
ttttgcatcttttgcaaaattagcctgtgctgatagtaaccaattccatgcagtctgcttggatacgttgccacccatattctacatgaatgatacatctcacaggataatcagctatgttgagaagtgcaatcgttctgaaggaacccctcaggtggcatatacatttgacgctgggccgaatgcagttttaattgcacgagatagaaaggcagctgctcaattaattcagcggctgctattctacttccctccaaagtctgatactgatctggacagctaccttctcggtgataagacgatacttaaagatgctggactcgagggattgaaggatgtggaagctttgtccccacctcctgaaaatggttcagctcagaaataccctggggatgtcagttacttcatctgtacaagacctgggaaaggccctattctgctttcaaatgacaaactggctcttcttgacccagaaactggacttcccaagtaagaagtgccatactttctctccgcaacattggtaaaactta

SEQ ID NO: 13886 - DNA, 527 bp, Gossypium hirsutum
  Clone ID: uC-gsflnu33B015f05b1
tcctacgcgtccgggccggtgcgggtgtgatgggggtgcaagctcatcaagaggaatttgtggggtctaatgatcatcaagccttggtcatcaaaggcaaacgtacgaagcgccaaaggccgtcgtccccgttcggtgtcacggtgacttgtaactcctcaagtgcttctattggtggtggaggagtggcggaggactacaactccatttcctctccgacgacctctggtgagattcatgagagcactgaggaggaagaagatatggccaattgcttaatcatgttggcccaaagtgatggtcccaggaagaggatggatgaagggaaattcaaggttggtagcctaaagttgtctgagattgctaccaccactaataaggctggcttttctgtttacgagtgtaaaacttgtaaccgatctttcccttcctttcaagcactgggaggccatagggcaagccacaagatgcccaaggccaccatggctgaagacaaaaaaccacttcgtttagcagttaaagatgat

SEQ ID NO: 13887 - DNA, 423 bp, Gossypium hirsutum
  Clone ID: uC-gsflnu33B015f06b1
aaggcgggtcccccggcgggtcccggcccggatttccgggtcggcccaagccgtccttcaaatgaaaaagttcgacacccgtgaatggagggcagagtacaccatgtgggatacaatgcccgtcgccggtgccttcaaaggctacgcctacagtttctggatcagacaccgttagaccctgcaagacattctttgtcgcctgctatcatatgtatctagaaaaccctaacgaccctagttcctccaccggttgggtggccgtgttcaccgagatcaggcacattgaacgtagtaccaccaagacccaagctgtgagatggcttgagcaatctacgtgagcgcccgaaggacatacctagcgtggtcgacaatcttttctgtgacctaggtagaggcgctctcacggcggctaccttacaccag

SEQ ID NO: 13888 - DNA, 346 bp, Gossypium hirsutum
  Clone ID: uC-gsflnu33B015f08b1
tccacgcgtccgtgtggatcaaactgcaaatggaatccatgcaactgctgaaaagcttgatgaaagccatagattatgaaaaaagaaagcagcaaaataacaggcctctgtaatgatttattttcaaggatggatgcgtgcaaggtctataattatgtctctgtctgtcttgtgtaatagaagctttgtttgtggtaaaaataatgtataagccatttggttgggagcaaattttccttttgtccaaaggatttttgctgctcattcatggtgacttggtttatggttttatctgttgttgttaaaatcttataaaaatatatatcggttgctgcttttggtttgt

SEQ ID NO: 13889 - DNA, 554 bp, Gossypium hirsutum
  Clone ID: uC-gsflnu33B015f09b1
tctaagagtagcaccagccggtagccaccacgccagccccttcccgacgttcaccctctaccggagggcctccgacgtccaccacgtcattcatccgccacccgctccccgacgcctgttgtgttatggatccagaagctgcacgaactgcccgagaatctctagatctggcatttcacatgtcaaatattctcgatacgggtcttgatcggcatactctttcggtcctcgttgctctctgtgatttgggtttaaaccctgaggctttggctgctgttgtcaaggaacttcaaagagaacctccaccatcaaccccgttttcatcttcttcatcacaagtaccttaacttcggagttcggtattttctagtaaacttacgagtaatgccttagaagtttgagttttaatttgttttgattgatgtctttcagtagaaactttcttaggttttctcatctcgaacactattgtgcttagtgttcaccttgtgcgtagtctctgtatctaattcgatcttacctactatgtttgatcaattatatattcactctgg

SEQ ID NO: 13890 - DNA, 538 bp, Gossypium hirsutum
  Clone ID: uC-gsflnu33B015f10b1
ttactcgatagaactcagggtaactggaaacttataaactattttaaagggaaggccctcacctatgatatacgccttgtgtgacagatgtggggttagagttagtacgtgggacttatcgtaatcggtacatatgcttatttaattatgtgatgggaaagtattgatgtgggatctaagaacagcggtatcattttgtattttctgcatgcttataatttaactatatattgtttttgtggatatcgatttgatgattactctgtgcgtggcaatagctcttttatgttgtgagtggtggcaaatggaataggaaaaatcaactacactagattgctgtccaagaacaatttgcagaaggcacataatgactagctcctacctctacgaatgcttgtgggaggcattgcagcagcgaataaggatgatattgatcaacatgcagttgagaccgtatgtgctctgaatttgaattcagatgtgacttttagatattttatgtgcaaaaaagtattagagtgccttatgtttgtatgta

SEQ ID NO: 13891 - DNA, 481 bp, Gossypium hirsutum
  Clone ID: uC-gsflnu33B015f11b1
tttggtttgcagacagcttcccctttatgggatgcattctacgacgggcgctgatccgttttattggatgcgtgttatccttgcatccaaccgtggaaccgttatggaactcgggattacccccattgttacttccggatcggcgatgcaactcttggctggttcaaagatcatcgaggttgacaacagtgttcgtgaggatcgcgcactcttgtgagtgttttaacattactattttctccattataacttgaagcactatatgtcctccataatctttggttctttgatgtttgctttgcagaaatggggctaaaaagctgacggggatcctaattgctgttggtgaggcaatgacatacgacctgtctgaaatgtacggaagcgaaggacagatcggtggttgaaacgccaatcttattattatccaacttttgctctgtggaattattgtgatctgcaacatgaacatggcaaaggg

SEQ ID NO: 13892 - DNA, 192 bp, Gossypium hirsutum
  Clone ID: uC-gsflnu33B015f12b1
tttaaaagaaaaagtttgaaacccggaaatgggggacgaggaacaccattttgaatacaaggccgacgccggtgcctccaaagactacccctacagtttttgtgtttcaaactatagactcttccaagaaattcttactcacctggtaaaggatgtttttttggaatgtacaatcgaacttgagttttacat

SEQ ID NO: 13893 - DNA, 425 bp, Gossypium hirsutum
  Clone ID: uC-gsflnu33B015g01b1
attttctcacaacaaaactgaaaatgtcttgcggggcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttgagggtggatgcccgtgtggagacaactgcaaatgcaacccttgcacttgcgggaagtgaacaacaaagagaagcagagtggcctttgtcattttaactaaataaattctattactttagtatgtatcagcaaatcttcatgaggatttggttcttaattatgtgtaatgtggcttttctgctatgtcagaatgtattatgatatttaagaaagtttgttttctattg

SEQ ID NO: 13894 - DNA, 467 bp, Gossypium hirsutum
  Clone ID: uC-gsflnu33B015g02b1
ttttcatgtggataacatgcttgagtctgatgggctgctattccatgatgaacggcggaatgcaagagagcattcaaatgaccagcaaacgaatagcaatgccacaaagttaggtggcagccgatttgacagggcctctgcttctcatacatatgaaggcaatagcgaaaggaaccatcaccagccaactaggtggagataatgctatcaatgactaggtaactagcagatttaagcctctcatgaagcattttctttctttctttatttatctgtgtattagttccccagtgttttgattgtatatgctccatttaagcaaacaataatcagcatttatctatgccttctatacaatatgcatttgtaaataaaaaaaaaattggatgaactcataattgttataccatttgtaattgattgtcttcatttatttataagaaaaaaaaaaaggtttctggtttggt

SEQ ID NO: 13895 - DNA, 541 bp, Gossypium hirsutum
  Clone ID: uC-gsflnu33B015g04b1
gtttaacctcaaagccaaatggatctcctcttcgtggagaaggccctcctgggccttttcgtggcggtggtactagccatcaccatctctaagcttcgtggcaagcggttcaagctccctcctggaccattacccgtgccggtgttcggcaactggctccaagtgggtgatgacttgaaccaccgcaacttgacagatttggccaagaaatacggtgacatatttttacttcgaatgggacagcgtaatctagtggtggtgtcttcacctgagctagccaaagaggtgctccactcgcagggagtggagttcggctcaagaactaggaacgtagtgtttgatatattcacgggtaagggtcaagacatggttttcacggtgtacggagagcattggaggaaaatgaggcggatcatgacggtaccattttttaccaacaaggttgtgcaacagtacaggtttggatgggaggacgaggctgctcgtgtagtggaggacgtgaggaaaaatcccgaggcagccaccaacggaatcgttttga

SEQ ID NO: 13896 - DNA, 531 bp, Gossypium hirsutum
  Clone ID: uC-gsflnu33B015g05b1
ttctcttgcaaaagttctggcattggctcaatgtctttatcttcgctctcatgtccattgcagcaacgattgcatctttgaggctcatagctgttgattccaaagaataccatgtgtttgctgatgtgtgatatctacaagggctgagaaaaatgcctaaaattagcagaaatccgattcgaatttagccttcgcttcggtttttgattagattaataatatcaatgtaatgtattcattcggttctcggttcataacttaaaaaaaaaaaaaaaaaccacaaatattattaaaacagaacagaaaagagccgaaccaggccagaacatcggcttgcagaatcaggttggttaccagatgagaataatggtcccaactactgatgttggaagctgaccaagattctagtatgatggagttggggaatcctagttctctatgaacaggggtatctttttagttacccttaaggtgctgaatgtcagtcttgtattttggaattgtcaaggagtataatacagaattccagca

SEQ ID NO: 13897 - DNA, 525 bp, Gossypium hirsutum
  unsure (1)..(525): unsure at all n locations
  Clone ID: uC-gsflnu33B015g06b1
tttaccgctggccttgaaggctatgctagacggggtgttgacagaattgatgctgaaaaccggtttagtcttcgactctataggccttctacagttagcacggagtaccgggagcatgtgaaagacctcacctgcatatctaaggatttatgccgaactgttattgtcgacaacaatcctttcagtttcctgttgcaaccggtaaatgggattccatgcattccgttttctgctgggcggccacatgatacacagcttctcggtgttctccttccacttctcaagcacctttctcaggaaaaagatgtgagaccagttctttatgataggttccgcatgcctgaatggtttcagaaacagggtatcccctcttcttgttgggcactgtaggaaaaagatagtaggcaatgccttaggttcttctgggtacttttcgtgcaagcctcttatcttccaaaggcagcatcttatcataggattcatgatcnttgtgataacatttgaattctagaggtgtctatgaat

SEQ ID NO: 13898 - DNA, 490 bp, Gossypium hirsutum
  Clone ID: uC-gsflnu33B015g07b1
gtcacgcgtccgcctgcatttaccatactcgggtgtgggactcacctacgggggtcacgcttacatggtccaaaacccatttctcccattccttaacagtctatgctgctgattccttttctattaccatttccctttttccttccaccttctccttcttcagaaaccgaccaggctccaaatctgtctacttgactcaccaccatcgtcaaagaatcaagctgtattgggatttcaccagggctgactttgctgaaaactcagctgagcctgagtcttccttctacattgccatttcatgcaatgggaagctagaattcatccttggtgatctcatggatgaactcgccaagaggtgttctgggttgtctatggctcgacaggtactccttgaaccaacgctcttgtctaggagaggacatgtttttgggcataagagttatgtttcgagggctaagttcttggggtctaaacatgagataggggtaga

SEQ ID NO: 13899 - DNA, 511 bp, Gossypium hirsutum
  Clone ID: uC-gsflnu33B015g08b1
tgttttttacagaagaacaatgatgggttcgggaatcaatatctcggctctgggtgttattatgcttctgctgttgattgccccagcttccaacgctgccatttcgtgcagtgttgtgataaaggacctgaggccttgcgtgaactatcttacgaaggggagcggaaaaccaccgtccgcttgttgtgcgggagcctccgctctggcatccgccgcctcgtcgtctgccgacaagaaggctgcttgtgaatgcatcaaatcagcgtctaagaatattaaacccaataaccaattagctcaggctcttccttctaattgtggaatcactttgcccgtcgccatttcaccaaatgtcgattgttccaaggttggttgagagcttggaagctgaaactgggagtgcttggatgggcatgaagtaattaaaaaactccatgatagaagctcaattgttttgcttatcaataaactggaatcctccggtcttggaatttggattccttgggtgaat

SEQ ID NO: 13900 - DNA, 532 bp, Gossypium hirsutum
  Clone ID: uC-gsflnu33B015g10b1
ttgagaggcaccactaccagcgccaattcccgggccttctttttcagttgtgcattctcaaatcaaatcaaatcaaatggggcactgaacaaagcttaacgaaaatggtgcgtatagaagaaaagcaaggcacgatagggcctagttcgatgccccagcaacaaaaccctctgcaggaattgcaagctaagttcaaggaagtggagaacggtttcagggcttggttatccaagcaacccttgccagtcgaggcgactgttgtaaccaccaccggcgcagctcaaggcgctgctatcggtgctttaatgggtaccctgaccaatgatatttcggcctctcttcagactcctcctcaagctgtcctaaatgctcaagctatggcttttctcaaacatgcccaggctctatcagggggtcctttggtacaagctcgcaactttgcggtgatgaccggtgttaatgccggcatatcttgtgttatgaaaagattgatagggtaagaggatgtgcaatctatcatggcggcagcttt

SEQ ID NO: 13901 - DNA, 357 bp, Gossypium hirsutum
  Clone ID: uC-gsflnu33B015h01b1
tgctctatctaagtcgacgtctaagtcaccatcgggtgctttgtcatcctcggcggctttcaccgataaaccatcgaccggcacaccatttactacaactacaacaactaaagccccggactcctcatcctcatggagtctctccccatttatggctgttgtcacaacttgtcttgcgttgttgggtttggtcatttcgtaataagctttcggcaaagagtgttggccagccatggtcaggatagaggcagtgctgctgatcttatctctgtgccttttcttattccttttttatcatattgtttgtggtgaggatcattgatatcttcatgaatgagatggttgggctttcatggc

SEQ ID NO: 13902 - DNA, 254 bp, Gossypium hirsutum
  Clone ID: uC-gsflnu33B015h03b1
tttttgcgtccgaagaggtcctaatactgattggggggttagtaactgggatggtgcgattcatcaaaattaatgagaggttagaggttgggaatgtatattcactcgatacattggttgttgcagtcgtagcggagaaaaggtgcataggtgcagtcagaatggacacggtgaatggattcctttcaatgagcgtatgctggatagcactgcaaatattgataatgggtgaaggaaatggatacgccctgggg

SEQ ID NO: 13903 - DNA, 116 bp, Gossypium hirsutum
  Clone ID: uC-gsflnu33B015h04b1
gttctttctcggaggaaagctgataatctccggatccttttaaactgatatgtgaaggaacatgtaatgaacagctaacagaagctatgtgttaattccctcaatcttgaactagg

SEQ ID NO: 13904 - DNA, 436 bp, Gossypium hirsutum
  Clone ID: uC-gsflnu33B015h08b1
tgtaaaccataaactctctttgtctctctgtggggactttcactttgcattttgcttgattccttccttcacgacctcaatctctagtgtttgtaataaatggctttggtgacaactgctgaagtctgtgatgcaaatccacagctaattgtgagcggtgaacttcgagcccttcaaccaatattccaaatatatgggcgtcgcccagtattctccggacctatagtcacacttaaagtgtttgaggacaatgtattgatccgagagttccttgaggagaaaggtaacggcagagttctggttgtagatgggtgggagtataaaggtgtgccatacttggaggcaaccctgtagttcaagctcaaaacaatgggtgggctggaatagaggttaatggctgcgtagggatgttgatgagaacacggttgggacattg

SEQ ID NO: 13905 - DNA, 513 bp, Gossypium hirsutum
  Clone ID: uC-gsflnu33B015h09b1
gtatgaaccttgcaggtgctgccaagaaccgggttgaattcctcgctgctgtcgataggaaccgttggctctacgatggccctactctccatagagccatttacaggtacaatgcttactggcttcccttgctagccaaatgttatgaagaacccattttggaagggcctttggttgttcctcttgattgtgaatggatttggcattgccataggctaaacccagttcgatacaagtctgactgtgaagaactctatgggaagatccttgacaatactaatggtgtgtcttcccttcgaggcgcatgtaaacggcaaaccgaagaaatttggaacaggctttatccgaatgaagcttatgactttgatttcaccaaagccttgtctgaaaatgcctctgaaacactttctggacttgaaaaacacactgaatatgatctagtttcagctggtaaaaggcagagtcctttcttttatcaggtatccagagcgcatatgaataacaatatcttta

SEQ ID NO: 13906 - DNA, 525 bp, Gossypium hirsutum
  Clone ID: uC-gsflnu33B015h10b1
ttcagaagaacaatgatgggttcgagaatcaggatctctgctctgggtgttattatgcttctgctgttgattgccccagcttccaacgctgtcatttcgtgcagtgttgcgataaaggacctgaggccttgcgtgaactatcttacgaaggggagcggaaaaccaccgcccgcttgttgtgcgggagcctccgctctggcatccgccgcctcgtcgtctgccgacaagaaggctgcttgtgaatgcatcaaatcagcgtctaagaatattaaacccaataaccaattagctcaggctcttgcttctaattgcggaatcactttgcccgtcgccatttcaccaaatgtcgattgttccaaggttggttgagagcttggaagctgaaactgggagtgcttggatgggcatgaagtaattaaaaaactccatgatagaagctcaattgatttgcttatcaataaactggaatcctccagtcttggaatttggattccttgggtgaataaaagtttaatgctaccatct

SEQ ID NO: 13907 - DNA, 366 bp, Gossypium hirsutum
  Clone ID: uC-gsflnu33B016a01b1
aggcaagatgcttgaagtggcgtgcaaaatgcttgtggccattggtcaagattctaattttagcacatgccagatataaaaatcacaatcatcatttccccatatcataaacacaagacttcagtgaattggaaggtgaagcatcatagtttaaaactcttcgaatatggtgtgatgcattgctctctacaataggattttaggtttttctttttaaagttgggatcatgcaggtgtacatggtaagatatggaaaacgggtaccaaaatatatatactattttccattcccacatgctgaaatataatgattcaccctggttagttgctgataccctctaaatgtacaagaattttttttttttt

SEQ ID NO: 13908 - DNA, 344 bp, Gossypium hirsutum
  Clone ID: uC-gsflnu33B016a02b1
cgtacgatcacacgtgcgtgaaaaaaggggtaaaatatcaaaatcgtaaggaagacccaaagagggtcctccgcatgtgaagggatagtgcttgaggatttattacctaccggacaactaagtagtgtaaagtgtgctcaatgcgttaggcaaattggtgtgagatctggggttcacccgacatgttaggttacatcgcaatcgggatgctttgtttctcaaccagtgaccgagggactggtgattctggttaagggatcttagttggacgagctaaaactggcacatgaggacacagtgcctggtcaaataattgggtggatccaacttcggtatagcgatct

SEQ ID NO: 13909 - DNA, 221 bp, Gossypium hirsutum
  Clone ID: uC-gsflnu33B016a05b1
ttgtatgaccctagcatgctgctttgtcttagggggcctaaggcaccccttaataccgagaacgggtagcctggattattaatggatttactgtcgctgtctaccaatccgcgggaccactatcctatgctacatgcttggggtagcaattacattaatgaagaacgcagatgagcttgaaactaaatcgactttgtgaaaaaaaataagaggagtaggat

SEQ ID NO: 13910 - DNA, 377 bp, Gossypium hirsutum
  unsure (1)..(377): unsure at all n locations
  Clone ID: uC-gsflnu33B016a06b1
tttacgcgtccgaccacgcgtccggttgctgacgtgatcaagggaaagaccccagaagagatcaggaagactttcaatatcaagaatgacttcaccccggaggaggacgaagaggttcgtcgggagaaccagtgggcattcgaatgaagggtcaatttcgagtgccggttcaattgtatcaaactcatctatatataaaaatgtagtttgttgctctgacttttcatttgtactcttggatattctgtgagctcttttgaaactcttcaaagtgtcttcttctatgttctttgcctgtcttcactaaaaaccagtctgttgtatccaagtaatgtcctttaatcgtggtctgtgatatgaatgangaatggttgtct

SEQ ID NO: 13911 - DNA, 510 bp, Gossypium hirsutum
  Clone ID: uC-gsflnu33B016a08b1
tttgggtatgctcagaatgctaagcctagagaagcattggagtttttcgagaggatgctaaatgaaggggttgaaacagatgaggttactttggttggggttatttctgcttgtgcacaactaggtgctgcaaagtatgcgaactggattcgggatattgttgagaatttggggtttagtcctactcgttgtgttgtagtgggatcggctttgattgatatgtactcgaagtgtggtagtgttgaggacgcatataaggcttttaaggtaatggaagaaaagaatgtgttttcgtacagtttgatgattgcagggtttgctatgcacggttatgcttatgcggcattggaattgttccatgaaatggtgaaaattgggatcaaaccaaataaagttacgtttattggagtgcttacagcttgtagccattcaagaatggtagaacaaggtcgtcaaatatttgaatcttatggggagaaattcgggatttctccaggtgttgatcattat

SEQ ID NO: 13912 - DNA, 454 bp, Gossypium hirsutum
  Clone ID: uC-gsflnu33B016a09b1
cccggggggcccctgtgcggaattcccggcgacgacaccacgcgcgtgtgttgagtgcgagaagcatgagaaaggcgggggtactgtaattggagtattggacacatactatgatgctacagaaaaagctgaggctcctgtaataacataacattactaagccttcacgatgctattgacagtggaaaacagtgacttacacaccagggccgactttagagcatgcttgcccatagtaccggtcctcaacaatgtgaacgccgtcatgaatgtgatagccaatttgcacaatgagaatcatatgaatctctttgatgtcatcaattctagcttgggaattgcttctgaagcttgcaattagatcattattggctacattattttttgatcgtacattgttagctgtcttgtctttatgcggaagctctcttttttagtgttattatatgatgaa

SEQ ID NO: 13913 - DNA, 504 bp, Gossypium hirsutum
  unsure (1)..(504): unsure at all n locations
  Clone ID: uC-gsflnu33B016a10b1
ctcacgcgtccgagatgcacctatcgaaacacccaaaactgctgggctacaaagcaagtgcagagatcagatgaagatcccatcctctttgaggtcacatacagaggaactcatacatgtgcaaatggcaaccccgcagttccatccccagaaaaacaacataaatcaaactcaaacggccttaataataccaattaccaaccattgcaatcacaagataccctctcagagtttcgagcaggcctaagagtcaatactgagggcttagacaataaagagatggcacccccattctcttttgcttcaacatcatttngggtgtataaagagcgaaaaccatagcttttcaccttcaggagtacttgattactacaatatcttcggcagcttttatcgccgttcatgtctcccgatacaccagaattaaactacttttcagtttcccagatgaacaacttncaggngtgctcaacacacagcattctaaatctgatctcaccgagt

SEQ ID NO: 13914 - DNA, 518 bp, Gossypium hirsutum
  unsure (1)..(518): unsure at all n locations
  Clone ID: uC-gsflnu33B016a12b1
tttcacgcgtccgtccacgcgtccgaccacgcgtacgtccacgcgtccgtccacgcgtccgcaaaatccaaaacctctcgaaccgagcctaagcgtctccaaaaccactcaaagtaagaaatgatatatactggctaggcttgaatgtttgaaacatctccgccgcacccccagccgtccagtttgactctgcctcttgctagtttactccctcatcgcctccccttcggccaccactgttgcgataaccgttagatcgacgagatctcctgtttcaaccgcagtcaaatcatgtccaaatctcgcgtttatgctgacgtcaatgtccttcgtcctaaggagtactgggattacgagtccctcattgttcaatggggtgatcaagatgattatgaggttgttcggaaagttggaaggggaaaatacagtgaggttatcgaggcataaatgttaataacaatgaacgctgtataagtaagatcctcaagcctgtacgaacaagagatcangagagagat

SEQ ID NO: 13915 - DNA, 358 bp, Gossypium hirsutum
  Clone ID: uC-gsflnu33B016b03b1
tttttgcctacgctctcacctattcgacttagggggtattgtttatcctgctactgtcaattgctttgattccttcccaaaatttcattactctcacgctttttagtgtgcggggtattgtcatggagatacagacatgtggtaaaccgattgattcgctgctagagaaggtgctttgtatgagtatatgatcctgtgatgatttcaaagagctttaccgtttatagacttaccatgaagctattgatgaaattcacaattaagttgatcatgtggaaccgtggatgactgggaattgacgaggtgcttacactgcattggcactgctctacaggttcattaccatgaagacttactg

SEQ ID NO: 13916 - DNA, 507 bp, Gossypium hirsutum
  Clone ID: uC-gsflnu33B016b04b1
tttatgtcaaaattctctatctgagcttcaaatgcaaccgtctaataaaagtaacaaatctatgttactaaaatttgggtgttagtgtattgatatatgttagagacggatgtgtttagtttatgtttttctaagatttatatgtatttggagggtcacgtcaattccagatatgtaatgacggtgactgaaaaaatgacattcagtaagtataagcctgaagtttgaaaatcagtagtgtatacgcaagaaacggtcgcatgagaaaggggttcattaagcaattcattaaaagatgtatactgtgaaacttatatagtttatgccgtgaacttcaattatcattcataagctgcaatcttcattgtattatatgtacgagtttatatgagaaagacgacgtctctacttggagctcgaatgagcacatataagcgttgttgtctggtggaattccattcaacaaggcctatggtatgactgcatttgagtaccatggcactgata

SEQ ID NO: 13917 - DNA, 412 bp, Gossypium hirsutum
  Clone ID: uC-gsflnu33B016b05b1
ttcacgcgtccgatagacagtacgtttctatcggcatatatatcatcaacgggtgggaattcatttgctggagaactttcgacacggagagtagcaagtaaacatcattctttgatttccatagttacagtctctaatgtttttgaggtgaataaagtagtcaatttatttgtctttttcttttcttttattttatttttactagattcatagaaaccaaaagaattattccaatgtctttatacatcaaatagttgttctaacatgagaagggtgaaagattcaagtcatagattttgtcattggagaagcttaaagtcgttgctgtaatttttcttttagtatttctcactgtgcttcttcaactgggttcttttatcctatatttattggtattctttttggggtttaa

SEQ ID NO: 13918 - DNA, 542 bp, Gossypium hirsutum
  unsure (1)..(542): unsure at all n locations
  Clone ID: uC-gsflnu33B016b06b1
tggttaaggctttcatgaagcatccatacaactcccttggcggtggtgcaaacacggtggcttctggctacaacaacggaactgctttgggagctgagattattggaactttcgtacttgtctacactgttttctcagccaccgaccccaagagaagtgctcgtgactcccacgtccctgtattggctccccttacaatagggttcgcagtgttcatggttcacttggctaccatccccatcaccggtactggtattaaccctgcaaggagtttcggtgctgctgtaatctacaacaacgacaaagcctgggatgaccactggattttctgggttggtccatttgttggagcacttgcagcagctatatatcatcagtacatccttagagcagcagctatcaaaagcttgggatccttccgcagcaaccccaccaactaaaaaaaaatcaacccaaatagctttgtctccacttcactctttttctatnttctccaatttgtccgttggtgtatgagaagattatattatgaatgatgtgat

SEQ ID NO: 13919 - DNA, 534 bp, Gossypium hirsutum
  Clone ID: uC-gsflnu33B016b07b1
ttaaacttttgcctctgaaactatggctccggtctctttacgtagccgtcttcaggcttctgcgctaagcaagaggcgtctcaaatccaaagccaagcatgggaggaaagggatgaagaacatggcggaaagcttcaaaagattgaaatctgaaatggaagaaataagcgaggaacaaaagaatatcagggaagggcaaaggcaagttaaagaaaaattcggaatcatcgaatccgagtgcgaggaattgaagagggaaactaggctcataatccagcaaagtgcgagaactcaggttaaacttgctcttatgttccgcatactgaaagcaagggaagccggcgagttgaataccgctgccactctcactgaaatgctccgtgaaatagtaggaagagagagggaggaaagcaaagctgacatctgaatgactatgataagcttctcggtgcagctgctccaaatgttaagagataaaagtgtgtgacaattaagcgcgtgttattaagtactgcaacttatatttcctatcta

SEQ ID NO: 13920 - DNA, 470 bp, Gossypium hirsutum
  Clone ID: uC-gsflnu33B016b08b1
tttttgggaaagcttttttttttttctctttgggcaacttttagatttggaaatggtataatctcatcaagccttctatatccaaaatgcatttacaaaaaatccagctaaaaatcaaagaaaaaaataatctacgaagaagaagacgaagaagaagaatgaaagtagagtagctacttagagcttcaaagacaagtcaagcttcaactcatcttttttattgttgaaatggttaactgtatcccaccaatgtccattcattccctccgtggctggaccaaacttccctacactaccttggaatttagcagtaccatttatcccctgcagatcggaaacatgcccgactgcccttgtgtgatcaacagctcgtctagaccatacattgtgcccataaacatgcgccgatggaactaacgatggctcgtggatcatggagtgctcgcgaataccatgtgccttattgaaag

SEQ ID NO: 13921 - DNA, 507 bp, Gossypium hirsutum
  Clone ID: uC-gsflnu33B016b09b1
aaagcgagttgaatctatggcgtcctggaagttacaggctctgtggaaccaccctgccggacccaaaaccatacacttttgggcaccaacttataaatggggcattagcatagcgaatgcggctgactttgctgaaccaccggaaaaactttcctaccctcagcaaatagcggttactgcaactggaattatctggtcacgctacagcactgtaatcactccgaaagattggaatctcttgagtgtaaacattgctatggctggaacaggcatataccaactaacacgaacaatcaaacatgatgacttttcggaggcagagcacagccgttgcatctgaatgatgactaaatcttctgaaattctttgtttttaatgcaacagattatcaggtatcttgccttgttttgtgctaatttgtgccattgagatcagaggattacagaagatggcgtcctccagatacaggctctgtggaaccaccctgccggacccaaaaccatttac

SEQ ID NO: 13922 - DNA, 506 bp, Gossypium hirsutum
  Clone ID: uC-gsflnu33B016b10b1
tccacgcgtccggtgaaactcaaatgacacccacccaagtctcagatgaggaagccaacttattcgctatgcaacttgccagtgcatcagttctccccatggtcctcaaatcagccattgaacttgacttgctggagatcatggccaaagctggtccaggtgctttcttgtccccaaaagaagtggcttccaagctccccaccaccaaccctgatgcacccgtcatgctggaccgtatcttgcgtctcctggctagctacaacgtcctcacttgctccttgcgtacccttcctgatggcaaagtggaaagactctatggccttggccctgtctgcaaattcttgaccaagaacgaagatggtgtcactctttccgcccttagtctcatgaatcaagacaaggtccttatggagagctggtactacttgaaagatgctgtgctggatggtggaattccattcaacaaggcctatggtatgactgcatttgagtaccatggcactgat

SEQ ID NO: 13923 - DNA, 510 bp, Gossypium hirsutum
  Clone ID: uC-gsflnu33B016b11b1
ttatcgacttgacgactgaatgcgcttcaacggtgttcagctacattaatctttacgggaaataccctcctggtctttttgctagcgagtgccgtgaagggaaagaagggctcgcttgccctgcgttatcgccatcagcatcagcatcagcatcggagaatgctaatggtagtcaacagctgatacgtaatccttggatgctggtaatggccgcaatcatagctgcagctatgttgttatgaactcctggaaatgaattccgattattccattatttgatttatatataatatttatattattttcccacttttaacgctgaagaagagtacagtattttgatttcatacaccaggttctttcttggtgcatccttttatttgtacttccagaagtgttgtagaaataatatacttcatttggttttgcgtggacaagcatcatgtctattagtattaggagatttcaagttggtttctaccacataagtcaagttgggaggttatattc

SEQ ID NO: 13924 - DNA, 463 bp, Gossypium hirsutum
  Clone ID: uC-gsflnu33B016b12b1
ttcacgcgtacgtgacagcagtctagccggggtaactctcgacgacgttttgggacacgctaaacggtctgaaccgccgcccagtcataaccatacgcctccggagactgtacgagatgatccagctaacaaggacaagaagagttggaaattgtttcgtgagaagcttaagctcaggaaaaccggttcgggttggacctcctcgatttcgatcccggcatctgatgttaacattcaagctaagaaaccccaaaacccgcggagtgtttgctttgctgaaaccaaccgcattgccgaaataggtgatcgtgctccggtcaggaacctcagggcggagcaattgtgtcggaggagttccgtacggtacgcacaagatcaccaagatcccgtcgatactcgtatgccctgcgacggtccaccatcaagaagctgtaagccacaaaatattcatgacgacgacgat

SEQ ID NO: 13925 - DNA, 262 bp, Gossypium hirsutum
  Clone ID: uC-gsflnu33B016c03b1
ctccacgcgtccggcacaaataggagttccttacttgtgttgtagaagccgaagaaaaaaaaatggggaagatagcttttggtagcattggtgattcttttagtgttgggtctctcaaggcttatttggctgaattcattgctactttgctttttgagtttgctggtgttggatcagctattgcttacggtaagctaacgtcggatgcagcactagacccaccaggcttggtggccatagcggtagctcatgcatttgcgtt

SEQ ID NO: 13926 - DNA, 420 bp, Gossypium hirsutum
  Clone ID: uC-gsflnu33B016c04b1
ttctctcgtccgttttttgtttgtaacgggccgggcaaatttggcccactacaagtaaaattcaaaataattaagaacctcaaaatgaagttaattttttgaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaggggggggcgtttttaagggactaaaattatacgccgcgggcaaataaaataaaaagctttatttaaggggaccaaaaataaaataatctgccgcttgttaaacaacgatataaatgggaaaaccccgggggtaccccaattaaatgccttaaaaaaaaatgcccttttaccgaaggggttaaaaagaaaaag

SEQ ID NO: 13927 - DNA, 316 bp, Gossypium hirsutum
  Clone ID: uC-gsflnu33B016c05b1
gttcaagtcactttctaggtggcttacaaaatgatttatttatcctctgttttcatcaagttgtttattgttgatgaaaccaggaaaaaaccatcagtcttagaaatgtaaaaagttattgttgttgattcaatatataggctacttaattcttcaaaaaaaaaaaaaaaaaaaaaaaaaaaaaaaaaaggaagacttaaaaaaaggaaccaagttacatccgcatacatgcaaaaaaaaacctttcaaatagggcaacctaaattaaattcactgtcaagggatttacagggcgtggactggaaaaaccttagag

SEQ ID NO: 13928 - DNA, 526 bp, Gossypium hirsutum
  unsure (1)..(526): unsure at all n locations
  Clone ID: uC-gsflnu33B016c06b1
ttttgacttctttttattctaaaatgcaaaagggtgaaggtaattgcaaggaaaaaaagaaataaaaaaaataagggaacaaattgaaaaaaacccgaaaaatcacccttcaagaaattcgtttcgaaaatttttgtactcttctctgcgtatagtgtgcttgcgtaagtatctgttttgtgtgcgtaaaaaattatggattacatcactggcttttatatccatatttccaaaataaataaaatctaaaaaatcctattttcctactgtcatttgctgtgaaatctgttattgactccttctaatgtcttcttttgcagtctcagttgtacggagaagatgatccggggatctcgcgtggaaaaccatccctttggtattcttccagtatattctaggagctactgctgaaattctccttcttttgggttcttttgggtttaggctaggatatggatttattagagttgggttttaggacatgggttattttgtattttgaacatngtaatggacctttttagtc

SEQ ID NO: 13929 - DNA, 67 bp, Gossypium hirsutum
  Clone ID: uC-gsflnu33B016c07b1
tcgtgcttataaaaaaaaaaaaaaaaaaaaaaagagagaggagaattttaaaaaaaaattcggtgtt

SEQ ID NO: 13930 - DNA, 472 bp, Gossypium hirsutum
  Clone ID: uC-gsflnu33B016c08b1
gcaaattgaagaatactctgaaatcttcaatccaaaatgcctaagcagattcatgagatcaaggacttccttctgactgctagaaggaaagatgcacgctctgtaaagatcaagaagagcaaagatgttgtcaagttcaaggtccgctgctccaagtacttgtacacactttgcgtgtcggatgctgagaaggctgacaagttgaagcagtcccttcctccaggtttgagtgttcaagacctgtgaaaatatggcagcctcaggtttgtcacctgatttataggtgatgaaagctagattttagttttgggtttattgtatttctggtcattctgcaacagggaagctcaattttctgtaattggatctatgctgttttgctgattaacgatgttagagatatatgcacttttcaattacaatgaatgctatttgtaatgaaaaacacagaaaaatttgatgttgcttcgct

SEQ ID NO: 13931 - DNA, 374 bp, Gossypium hirsutum
  Clone ID: uC-gsflnu33B016c10b1
ttgaagcagaggtccaatgcgttcgaacaactaacaatcagtatgtcgaagagaatgaaagactgagagctattctaggagaatggagcactcgagctgcaaagctcgagcgagcattggaagttgagcggatgtcgaacctcgaattacaaaagaagatttcaacatttagaaaccaaacatgtacatcttcaactgaatcaagcgagcagcgtggagcctaaatttactccttccacaccaatatgtatagacaaatcccaacacttttggagtggaattagttttttttttcttttttgttctatgcttaaatgaagaattcaagacgtttttagaaaaagaccaatcttatatcagtaaattacaccatt

SEQ ID NO: 13932 - DNA, 510 bp, Gossypium hirsutum
  Clone ID: uC-gsflnu33B016c11b1
tttgccatatgtttggttatgccactgatgggaccccagaattcatgcctctcagccatgtccttgcaactaagcttggggcacgtcttactgaggttaggaagaatggtacctgcccctggctaaggcctgatggtaaaacacaggttactgttgagtactacgacgataatggtgccatggttccggttcgtgttcacactgtcctcatctccacccagcatgatgagactgttacaaatgatgaaattgctgctgacctcaaagagcatgttatcaagcctgtcattcctgagaagtatcttgatgggaagacaatcttccacctcaacccatctggccgctttgtcattggtggtcctcacggtgatgcaggtcttaccggtcgtaagatcatcattgacacttacggtggctggggagcccatggtggcggtgctttctctggaaaggacccaaccaaggtggacaggagtggagcttacatcgttaggcaagctgccaagagca

SEQ ID NO: 13933 - DNA, 369 bp, Gossypium hirsutum
  Clone ID: uC-gsflnu33B016c12b1
tgtacttttacttcacgggtcccattgttaggcagttttcgagctcacaatgctgttagaaaatcaatggtagggtgagataaatattaattatggggagctaacctgtgctcataaaggcagcacccttgtttgagcctagtgagttgacctcatggtctttttaccgagctggaatcgctgcggtcggtgctactttacttatcttgtctatctcgggattgactgtgatgggagttcttatggacaaaaccaagtgtacaactggtgcgattcaaggcattgcttgggcttttgaagccctgatctttcctcttgtatactgcactgatggtatctcatgtggtcatatgaatccatacgtgacat

SEQ ID NO: 13934 - DNA, 515 bp, Gossypium hirsutum
  Clone ID: uC-gsflnu33B016d03b1
ctcctggataaagtctgctgatggaaaacatcgggccattgataaagtagatgagagatcaaaacgtcatgacaaaaagcatttagcatctggtgaagctcagcctcctagaggaggcaggtcttcaccaagaagttctgaagacaatgattcgaggcacagaaggcattcaaggtcaaagtcagctgaaggggatgatggaatgctggtttcaaaagaggaggcttatgacttgaaagtttcagtgaatgatgatcaggagctgagaagcaaatatttaccaaaatttgacagtgatgaagggcactcaccaaatagcaaattgaatgcagatgaaccagacagacttgaaagatcaagtagtaagcagtggcttggtagtaatgggtcaggagatcaatccatttctcctcgtcagaaatgagccgtgggcttaatgtgttactgaacctggggattttatagactaaagctgttcccagctgtctgactcagtcttcactttagcctttgat

SEQ ID NO: 13935 - DNA, 530 bp, Gossypium hirsutum
  Clone ID: uC-gsflnu33B016d04b1
gtatgagctgtcctttttctctctctatattggctcatctccttttccaccgccgttgatctcgatccgtatccccgttttcaaaaaagctccaaaaagatggccaatgctgcatcgggaatggctgtgcatgatgattgcaagttgaagttccaagaacttaaggcaaaaagaacccaccgctttattgttttcaaaatcgaggagaagcagaagcaagttatcgtggagaagcttggtgagccaactgagagctatgaagattttactaaatgtcttcccgctgatgaatgtcgttatgctgtgtacgattttgattttctaacagccgagaacgtcccaaagagcagaatctttttcatcgcatggtctcccgatacatcaaggatcaggagcaaaatgatatatgctagctccaaagacagattcaagcgagaactggatggaatccaagtggaattgcaagcaacagatccaaccgagatgggtcttgatgtcttcaaagccgtgcaaactgaatacagttcttt

SEQ ID NO: 13936 - DNA, 539 bp, Gossypium hirsutum
  Clone ID: uC-gsflnu33B016d06b1
cgctgaaaaggtgcaagaaattatgcttattgctgctactggggctgcagctgatgtgggctctgttgacatgaagaatgctgcaaccgattatgccaccatttcacctgctcttacaaggtgaccttcactttaaagtactgcaactgcctcggcttcgacacaggcacagttgtatactctccccaggacatcttttagcaaactgcaagctgaactaccaattgcaaggagacactcacttcagcgttttcttgagaagcggcaggacaggctggtgaacaagaacccatattctggtccatcaacaccaaaaatggctgatgacgtcaacgctgacgtgagtgccacaacttcaccagagtctggctacttcaaggcatcacccattcgtcaagaagatatccaaccaaaagctccagctcatgttgcctaaagctaagcatataggattccttatatatatatacatatttcgataaaactgaatctagctcatgtattgaaagtgacatagtgcagaggaatacatctgatct

SEQ ID NO: 13937 - DNA, 436 bp, Gossypium hirsutum
  Clone ID: uC-gsflnu33B016d08b1
ttcacgcgtccgcgatactacaccaagaattggcgtggggcagtcgatgctttccatgtcaataccgtggacacaactggcgccggtgactcctttgttggtgcattgctatgcaagattgttgaaaacccaaccattcttgaggatgaagcaaaattaagggaagtgttgaaatttgcaaatgcatgtggagccatcacgacgaccaaaaagggagcaatccctgcactaccaaccgtggccgatgcccttgccttaatcaatggagcttagattttaagcgacttgaataatttgcacgttgttttgccttccgtgattgttctttcatttcaaagaagtctcaattgattcctctttgatatgcgacctttgatccccccacacccgattgcttgtgttgtaatgatggaaaaggctttgtggttttaagcgt

SEQ ID NO: 13938 - DNA, 53 bp, Gossypium hirsutum
  Clone ID: uC-gsflnu33B016d09b1
gttcatcggtgccgattcaaacattttcggtggcttcatgataatatcgcgag

SEQ ID NO: 13939 - DNA, 547 bp, Gossypium hirsutum
  unsure (1)..(547): unsure at all n locations
  Clone ID: uC-gsflnu33B016d11b1
tttttcaccattttcatcgtttcagctttagctggaaacggcagtagcttcgcgagatccatggacaagaaggtgttggggatgaagaaggaaaagctcagccactttaggctatactggcacgacattgttggcgggaaaaacgcgacggcggttccggtggttttcccatcaaggaattcaacgacggcgttcggtatgatcagtgtaatagacgatcctttaacgatgggacctgaattaagttcgaaaatggtgggaagagcacaagggttttactcggcggcgtcacaacaagaaataggattgttgatggcgatgaattttgcttttatggaagggaaatataatgggagtacgataacgatattggggaggaacacggtgttttcaaaggtgagggaaatgccggtgatcggcggtagtggactatntaggtttgctagagggtatgtcgaagctagaacgcatcgttntgatcctgctactggtgatgctgtggttcagtatgattggtatgttatgcattactgatttaaaatatggt

SEQ ID NO: 13940 - DNA, 225 bp, Gossypium hirsutum
  Clone ID: uC-gsflnu33B016d12b1
cggacgcgtgggtttatgttttgtatgagctcctagagcatgcatatgtgatatcattgctgtcttggttgtatgaaaacagtttattggtacccatacaattttgcttaagcgactccagctgcgtgtattttgtgttcgttagtttcagtcaatacattctacctcatcaggacttagggtgggtttggatgggagattggtgaggtgcggtgcgtttagctt

SEQ ID NO: 13941 - DNA, 513 bp, Gossypium hirsutum
  Clone ID: uC-gsflnu33B016e02b1
tcttctcgtccgcgaaaatatatccaaagccaaaggaaaaagaagaggttgaatgttcgtcaatgtccggtttatggttcatcaaaactagtcgtccctcctaagttttggatatacttaagagcatgctcttgttgttgaagaactcactgttgctgagtatcttcgtttcaaggaagagcttgttgatggaagttcaaatgcaaactttgttttggaactgtattttgagtccttcaacgcgtggttccctagcccgactctatcgaaatatatcgggaacattgtacatttccataacctgcaactttcggacttactgtttcatggcaaggttaggctgccctccttgctatattgacgggtgctcttaagttaggcgtctgcacagccattaaatgctggaacatattttcattaaattttaagatttagatacttttgctaactggccttcacggcctattgcctcctcaatgactctggaacttttaacactggtatcatgggagg

SEQ ID NO: 13942 - DNA, 555 bp, Gossypium hirsutum
  Clone ID: uC-gsflnu33B016e04b1
gttgttggttacggtgggttaattaccttcaccctggtctcaaaagggaaaagatgtctccccaagaacagcgccttgtccttgaacttcatgccaaatggggaaacaggtggtcaagaattgctcggaaattaccagggcgtactgacaacgagatcaagaactactggaggactcatatgagaaaaaaagctcaagaaaagaaaaaggctatgccaaagtcattgtcaccatcatcatcatcatcatccatcactctttcttcatcatcatctactaccactaccaccactactactaccaccgtggattccttgcccttctcaggcactgggaaggtcagtttttacgacacaggaggaccaaaaatggctgctttgggagacaaaagcagtacagatttcaaagatgaaaaggggtactattccatggatgacatatggaaggatattgacatgtctgaagaaaacatgataaagcctttgtctcataactacagtgaagaaggttgcaacattttctgcccttcaatggctttctcttcattggattact

SEQ ID NO: 13943 - DNA, 551 bp, Gossypium hirsutum
  unsure (1)..(551): unsure at all n locations
  Clone ID: uC-gsflnu33B016e07b1
ttgaaaaccgtggggttactgtaactgattcgggagtcccagatttaaaacctgctaccacttccaacgggcttcagtctcaagtcttgagcaaagcaaatggaactgtggcttctgcaaaaagcagcccagcatgggatgaagactggggtcctactaccagagcagctgccaatgccagtcacactgcccaccagcctcccaaggacaatttatcctttcactttattttggatgataagtcaattcaatcggcacccacacaatctcaatcttccttaatatccactatatctagccagcaaacatccaattcttgtcctgcagttgacatagagtggcctcctcgtccatcttcaggtgttactgtagagtcaggcattggcgagaagcaattaaatgctggaacatctttgtcatcaaattttgaagatttagatccttttgctaactggcctccacggcctagtgcctnctcaaatgactctggaactnttaacaatggtattatgggaggaccaggcatgaacaattatggatcagttctatac

SEQ ID NO: 13944 - DNA, 560 bp, Gossypium hirsutum
  Clone ID: uC-gsflnu33B016e08b1
ttgacgcgtgggattttttgaaatactgaaagccagtcaggaagccatcgtgttgccgccgtgggtggcgctggccgtccgaccaagacctggtgtttgggagtacattagagttaatgttcatgctcttgttgttgaagaactcactgttgctgagtatcttcgtttcaaggaagagcttgttgatggaagttcaaatgcaaactttgttttggaactggattttgagcccttcaacgcgtcgttccctcgcccgactctttcgaaatcgatcggtaacggcgtcgagttccttaatcgccacctttcggccaaactgttccatgacaaggagagcatgcaccctttgcttgaattcctgaaagtccattgtcataagggcaagaacatgatgttgaatgataggattcaaaacttgaattctctccaacatgttttgaggaaggcagaggagtatcttgttgcgctgccagctgagacttcttatgccgatttcgaacacaagttccaggagattggtttggagagaggggtgggtgatacagctgagcgtgtgctcg

SEQ ID NO: 13945 - DNA, 537 bp, Gossypium hirsutum
  Clone ID: uC-gsflnu33B016e09b1
gtcctcgtttcttctactttcataacaaaggcctcaaatatatctcttcaatcgaaatactcctcccatttctttaccgattctctctctcggtcccttttgacttcttttcctgtcatttctttagctttgggtcaccaaaggccaaaacacacacatgctagaatctgtgacttgtggtttttgaaatccactacttcattggagactgattttaagtggatttatttctctgacgtttctttgttgcgatttttgtaacccctgcttcatcggaggctgatttcagaatcccgtgcaatcataaggtactatgcagaaaaataaaaatcacaagggactaatctactgggaaagacagtagaggaaaggggtcaagtggaaaattggctagaggttgaggcacacaatttcaacccaccaatttatgccttgaccctacatctgatgtttgcttccaagatggggttccctcctgatgaaaatttgatcaaggtaagcgaggaagagctaggcaaagttctcgatatttatgag

SEQ ID NO: 13946 - DNA, 518 bp, Gossypium hirsutum
  Clone ID: uC-gsflnu33B016e11b1
ttttccacgcgtccggaattacttaaacaacaggggctacctatgaaggtaaagttttcactgaagaacaagaagctttggtggtcaagtcatggactgtaatgaagaagaatgcagctgaattgggtcttaaattcttcttgaagatatttgagattgcaccatcagccaagaaactattctcattcttgagagactcaaatgttccattggagcaaaacacaaagctgaagccccatgccatgtctgtctttgtcatgacatgtgaatctgcagttcaactgcgtaaagcaggcaaagttacagtgagggaatcaaatttgaagaaattaggagctacccattttaagtatggggtagttgatgaacattttgaggtaacaaaatttgctcttttggagaccataaaagaagcagtaccagatatgtggtcagatgagatgaagaatgcatggtgtggagcctatgatcgttggttgcagccattaaatagaaagaagcatgctcctagctgatga

SEQ ID NO: 13947 - DNA, 451 bp, Gossypium hirsutum
  Clone ID: uC-gsflnu33B016e12b1
ttctttgggtttttaaaatttccatctctgggggtctccaatccaaccgggagagtcagaaaaaaaaaaaatggcttcttggaattcaattccactggaaatcacgtacgaaacttttggttggctagcctttttttcgtggtccattagtttctaccctcaagtcatattaaattttcgaagaaaaagcgttgttgggttgaactttgatttcgtgctgctgaatttgacaaaacactcctcttatatgatctacaacgtttgcctctacttcagccctgttattcagaggcaatactttgagaaatatggctctggagagatgatcccagtagctgctaatgatgtcacgttttcaatacatgctgttttgttgacggctattacttatgttcaaattgtgatttttgatcgtgggacgcacaaggtatctaagatttgtgtgggaatc

SEQ ID NO: 13948 - DNA, 521 bp, Gossypium hirsutum
  unsure (1)..(521): unsure at all n locations
  Clone ID: uC-gsflnu33B016f01b1
gcggttttacaaatgttgccaactttgatggacaggcgggggctgtgacagccatatggttctcagaaaacggttacttacttgcgactgctgctcatgatggtgttaagttgtgggatctacgcatattgaagaactttcgatcttttgaattatatgatcaagacacaccaaccaactcagcggatttcgaccatagtgggagttaccttgcaattgctggctcagatataagagatttccaagttggcagcgtaaaagctgtatggaattgcatcaaaactttacctgatctgtccggcacaggtaaatcaacttgtgtcaaatttggtccaaatgcaaagtacttggcagtgggatcaatggatcgtaaccttcgcatatttggccttaccgaaggtgatgatgcttcaacagaatcataaaaaggaaccgcgtctgttcttcatatatgataagcagcgactgctcgggttcgnggttaaagaactgtcagatttttaggtgggtttaaatcttta

SEQ ID NO: 13949 - DNA, 510 bp, Gossypium hirsutum
  unsure (1)..(510): unsure at all n locations
  Clone ID: uC-gsflnu33B016f03b1
cggacgcgtgggtcagagtactgcatctggttaggccatttctttcatttctgcctgaggttcagagtgctgacaggaaaattccttttagagagaaggtcatctgcactgtcgtctccctcttcatctttttggtgtgcagtcagcttccactatatggaatacactctacgacaggtgctgatcctttctattggatgcgtgttatccttgcatcaaaccgtggaactgttatggaacttggtattacccccattgtgacatctggattggtgatgcaactcctggctggttcaaaaatcatcgaggtggacaacagtgttcgtgaggatcgagcactcctaaatggggctcaaaagttgttgggcatcctgattgctgtcggtgaggcagtggcatatgtactgtcaggtatgtatggcagtgtcagtcagcttggtgttgggaatgctatcctaattattattcaactntgctttgctggaaatcatgtgatctgcctggatgaac

SEQ ID NO: 13950 - DNA, 489 bp, Gossypium hirsutum
  Clone ID: uC-gsflnu33B016f09b1
ctctttcttccttccttccttcttcttatacggtaccatcgccggcgacccattaaattcttctctaacacaggttatcatccgttttggatctttgtccaagatggggttggacggtccaactggaaacgaaggtgtgaggagacgaggatgttcatgcaccaaagatgattttcttccagaggagtcatttaagagctggggtaattatgtccaagcactccagcaaactccgagaaggtttatggatcgggtattcacccgatcacttgactcaacggagctccatgaaatcaaggctcggagccagcatgaaatgaagaagaccctctcctggtgggacctcatatggttcggtatcggaggcgtcatcggcgccggcattttcgtacttaccggacttcaagctagagaagtttcaggccccgctgtggttatatcctacgtggtgtccggtatctccgccatgctttctgtattttgctacac

SEQ ID NO: 13951 - DNA, 501 bp, Gossypium hirsutum
  Clone ID: uC-gsflnu33B016f10b1
tttccacgcgtccgctctcttctttcctcctagcgccaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcgagcccttcgttgatgttttgaaggaaggtgtgtgtcctccctggcatcaaggtcgacaagggtactcgtgagcttaacggaaccaatggcgaaactttcacccagggtctagatggccttgcacagcgatgccagaagtactatgaagctggtgc

SEQ ID NO: 13952 - DNA, 413 bp, Gossypium hirsutum
  Clone ID: uC-gsflnu33B016f11b1
tttttgagaagttcttggtatcgaaattgaacggggataattcacttatgagctgtgcctttgctcaccagcacaacgccaaactcgtcctcgatgcggctttgtgtttgataacagacaacatggataagctaactaaaagggaagaatatattgaacttgtggaaaaggatcctcggcttgtagtggaaatctatgaagcttacctctctaaacaggttaatacagctgctcataaagattgttcaatgaaatcgtagtcatttctgatcaaatgatattgttgttcattgatattggatgaaattttagtatatgtatgtagaagaagagtttgaatgtttgatggtattgggttggggaaatatgtgatacgaagttacaatgaattccataaccatttagtttttttt

SEQ ID NO: 13953 - DNA, 256 bp, Gossypium hirsutum
  Clone ID: uC-gsflnu33B016g02b1
tttggaaagggtctgcctgcaatatctaaggggtttttctaaacaaatcggggtgtctatgtgaatgacatccctgattttattagttgacgggtgtcagtgattcccacagatccaaaataaagttttagttatgcctattagtattctttatctcgtaatagtatatcgctttactaaatggcatattacttgacaagtaaaaagaatgaaggactagtgcctttcgggttaattgcatataaagggcaggaaa

SEQ ID NO: 13954 - DNA, 461 bp, Gossypium hirsutum
  Clone ID: uC-gsflnu33B016g04b1
ttttgcaatccttatggctaccttacaactcattacgagaaggtgcagatgctcttaagtgataggttccttgggttttatatgattcctgacaatggtccatggaattacaatttcatgggagtgaagcatacagttagcatgaaatatggggtgaagctagggacacctagagaatactacaacgaggaccacaggccgactcatttgcttgagttcagcaacttggaggaaggtgagactgcataaggagatcgggaggatacattcacctaagtctgggttcatgtcaaccttgttcgttgttgattctgtagcttacgcctgttaacactttgtgcccgaaatattagtagaggcctgacgtttttgtttgaatagctgcgtgtactttatataccatttgtaacaatgctgggagttgtaaatatacgagcaaaacccttgtgattatgccctct

SEQ ID NO: 13955 - DNA, 349 bp, Gossypium hirsutum
  Clone ID: uC-gsflnu33B016g05b1
tttgtgttatgctcgtgtgcacccacgtgccgggaactgcaggaaaaagaagtgtggacacagcaatcagttgaggccaaagaagatgatcaagtagattacatatatcgacggaggaattctacttttattatcagatctctggttggaaactattgttctaataacagacatctttaattgcgtgtatcttgaaactctctagtagttgatgttctttcatttgtacttgaatgcaagttcttcgtttttggagcaaaactggacaaacataaatatgacgccgaatatctgctttaacagctatttcgtgcgaagaatatacatgtacaggagggggaaactttaa

SEQ ID NO: 13956 - DNA, 478 bp, Gossypium hirsutum
  Clone ID: uC-gsflnu33B016g06b1
ttttaacctaagaaccctaaatcttatttcctgggggtctaagaagacagacggtgacaattcttcggttttctttccccgagagaaaatatatcgaaaacgaaattcaaaatcaaattatctgatctccaaagcgctgcgtcatgtttcctaatccccaacgcttgacggatcgaagttaaccgatcaggccggtttacttatttgtttatcttacgactgttctgccagttgtgaagggaaggggggttgataaggtgatcggacggtggaagagaatagaggatgccatcacagggagacctagaacgtcagatcgagcagctgatggagtgtaagccgctgtctgaggcggaagtgaaggcgttgtgctagcaggcacgaacagtgctggtggaagaatggaacgtgcagacggtgaagtgtactgttacagattgtggagatattcacggacaaatttatgatctaatagagc

SEQ ID NO: 13957 - DNA, 473 bp, Gossypium hirsutum
  unsure (1)..(473): unsure at all n locations
  Clone ID: uC-gsflnu33B016g08b1
ttcacgcgtccgcacaaatgttgcctatgaagggctgcccttggaagaggatggccaactgcaggtgcaaagtggcggtgctgggaataacatgtttgctgattcgggagctggtccagggggtttgcctttcttaaacttgccacttaatatgcagcctaatgtccagttaccgttttgagaaatttgggtcaaaatcttgatgaggaaattcaagctctgttgagaaacatgattcttgcatataaaggtcaggaaaattcatggaatcgtcatgcttcttcttcctcctcctctgatattaatgttaatttaggtttttcctcctccttttaatctttgttttagtagttattatcttcttcttaattttcggatgtatgggatctaagatttctggaaatagttcttcattgttcatggtggtacaagtaatttctttntctatttaatactttaatgttgtgtaaaaa

SEQ ID NO: 13958 - DNA, 346 bp, Gossypium hirsutum
  Clone ID: uC-gsflnu33B016g09b1
tttgtagcttggtatgctggcaagcgtatggctgatatctacaaggccaaagtgaagaagaatggctcacactatcgctgcatttggggaaaagttactagacctcatggtaacagtggggttgttcgtgctaagttcaagtctaaccttcccccaaagtctatgggagatagagtcagagtcttcatgtaccccagcaatatatgagtagtgtagatcgacgactcgaatgacgctctaccatttcacttttgtttttatgaacttagtcaagattttgtgtgctttgaatcagtcattttgtttctttgggatggtgaaatataagacttatttatctttacat

SEQ ID NO: 13959 - DNA, 481 bp, Gossypium hirsutum
  Clone ID: uC-gsflnu33B016g11b1
aaaactcagaatcaacagatcgaaggggaaatggagtgtgtgttcggtttagtgggcaacgactttgccatagtggcggcggacacgtcggctgttcacagcatccttgttcacaaatctaacgaagacaagatcatgatcctcgattctcacaaactcatcgccgccagcggtgaatccggggacagagtgcatttcacggagtatatacagaaaaacgtgcccttgtatcagtttcgaaacggtgttcctttgacgactgccgccgccgctaatttcactcgcggtgagcttgccactgccttaaggaagaatccatactttgtgaacatgcttcttgctggctatgacaaagagacaggcccatatatggtctatatcgactacattgctacacttcataaggttgataagggagcatttggttatggatactactttgctcttgctatgatggacaggcactaccacagtggcatga

SEQ ID NO: 13960 - DNA, 480 bp, Gossypium hirsutum
  Clone ID: uC-gsflnu33B016h05b1
tctcacgcgtccgcccacgcgtccgatctcgaggggcaacacaaaatacacaggtgaatttcgaattctcaaaatcaaaattatttaccatttccgatcccatcatttcccttcctttccacttctcagttcggtctgaatcaaatcccaaacgaagatggaacttgacatggtgactatggcggcatcgatcggggtatcggtgccagtgattcggttccttttatgcttcgtgacgactataccggtgagttttctatggcgacttgttccgggtccactagctaaacatctttactcagcctttacagggagcgccgctttcctatctgtcatttggattttcttcaaatctgcactttttggtgcccatgttgatggattatgctgcactggctctttatcggcccaagtgtgggattatcacttatttcttgggtttcggttgtttgattggctgccatgtatattacatgagcg

SEQ ID NO: 13961 - DNA, 557 bp, Gossypium hirsutum
  Clone ID: uC-gsflnu33B016h06b1
tttttgcgtccgcccacgcgtccggtctgcaggggcttatattggcaatggtgggggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttttcctttatttctttttatgtgctgcgtttcgattggtatcttatagtcctgtgatttctcaccaataatcatatattagtattgtttccaccacgcactacgttgcttcaattaatttttttaatcaaaatatgttctacatttt

SEQ ID NO: 13962 - DNA, 424 bp, Gossypium hirsutum
  Clone ID: uC-gsflnu33B016h07b1
ttttatcttctgaatacgggccacaatcaagccggggggtttaattaaacttggtgggtttatctcatgtagaagaaggtggagaaacaatgttcccttttgagaatgacatgagagtcaaaggttacgactacagacagtgcgtcggtttaaaaataaaaccacgaaaaggggacggacttcttttctattcactctttttgaatggcacaatagatccgacatctctgcatggaagctgtccagtgatcaaaggcgagaaatgggttggtacaagtggattagagaccaagaccaaaatgactgactattcaatgtttctgtaaaaaaaatggctcattatcggtgtttattatttgtcgttaatcatcatataaactctgcctttgataggattattctttatgaattcacttccactttc

SEQ ID NO: 13963 - DNA, 107 bp, Gossypium hirsutum
  Clone ID: uC-gsflnu33B016h09b1
tttacgcgtccgtccacgcgtacggaaaaggggtaatatcggtctaaccggggtttttacggttataaaaaaaataccttgaacttaaaaaaatataatttagttag

SEQ ID NO: 13964 - DNA, 430 bp, Gossypium hirsutum
  Clone ID: uC-gsflnu33B016h10b1
gtgtaataccatgcacatgatgtctaggatgggggggattttcaggtcggaccgtggcaacgattatgatcctaatgcaatccttggtatacaaaatatcaattttcgcgacgtcagtgccgataatgtaaccatggcagctaggactggacgggaattccagtccatccattttctgggattggcatatacaatacaaccatcggattaacacaaaagccaaagaacatttaatggaattgcactgagattgctggtgtatcaagtaaatgtacacctaagccttgcaatgctgcatgaccgatcaagggccagataatgcctgcaattaaccagaggacagcttcacaagggcacatagagtagtctatatgtgtttatacagaaaatttgtgattagatacacgcatgatattaatttctattatgt

SEQ ID NO: 13965 - DNA, 487 bp, Gossypium hirsutum
  Clone ID: uC-gsflnu33B016h11b1
tttgaatttgcagctagagaatcttcaaaggggcaataaggaacaggagagcagactagcaaaaactgagcgagctctaaatattgcagaggaagaactggtaaaggcaaagtttgatgccacttcaaaggcaaatgagttgatggaggttcacagcgcatggcttccaccttggcttgctacacagataattcgtggtcaggccttcattcagacacattggaatcagcatggaaaaccaaacatggatatggtgatccagaaggctctagagaaaaaggccttagctaaaaagtgggctgaaccccacatggaagcaattaaaaccaaatgggttccagctgctaaggatcagtgggtggcggtaactacatatgctgaaccacatgtgcaatcgctcactgcaaaaactgttgaaatttatgaggtatcgaaggctacaataactcctcatattatcaaagttcaagaaacagttgatccttac

SEQ ID NO: 13966 - DNA, 522 bp, Gossypium hirsutum
  Clone ID: uC-gsflnu33B018a01b1
tcgttctcgcgttcgcccacgcgtccgaaaaacccgtcaaattttcaccacaaattgaagaacccttgtttatcttctattaaaacccaccaaatacaatccaaatcaggtctatttccaattttctgcacatcgaaacccagcaccaagaacctgaaaacatgcaagaattgcaaaacccaattcgacccattgctcaatcaccctcgagcatgccattttcacactgcccatttcggaggggaaacaaagaggaaatttgagagtgtatatgcagggggcaccatggatacacctgaatctggtaaagtatttcaatactggcattgttgtggctctgaagatccatttgatcctggatgtactgctgctcctcatgcttcttacgacgactaatgccggttcgccgctgtcttcaaagactgatgccgggtcggtttctttataaacatttaactttgtatgtatttattattggaagtacatttcattcacattttgtaggaaaaaaaaaccatgtga

SEQ ID NO: 13967 - DNA, 436 bp, Gossypium hirsutum
  Clone ID: uC-gsflnu33B018a02b1
tcggtgacgcgtgggtttcaaagctcttgaaaggatcccatccacttgaaagctgtcaatgtcattcaaaaataccagcttaggtgacaagagccagaagtattcaaaattttctggaacaaagcaagaaaatggttaccttaataactcatctgggcataggagtgcaaatgagcagctcccaggaaatgtgagctttgtgaagctggcggacatgaatgaggaggaatggaatcttttcctagagaagttccaggagttgctgtacccgggatttgaaaaacgaaaatcggttactttaggccagaagcagatacagaggctagctacttggtgccagtttagatatagagatatctgtgtgtcgataccagatagctgaaacgagttataggattgctcgcactagaatctgaaggactgttaggagagattt

SEQ ID NO: 13968 - DNA, 413 bp, Gossypium hirsutum
  Clone ID: uC-gsflnu33B018a03b1
tcacgcgtccgttctacgatcaaaagccaaaaatgatgcatatgacgttttactggagccgacaggtgactctgttgttcacctactggcgaaccgattcatggccgagttacgcgttgactctcctagcatgttttttggcttctgctttttacccgtacttggagtacgtaaggtatcgcgtcaggcgtggcgggaagccgacggactggacgactgaagagcctttcttgttgcggccgaggggagccgggatggttgtgaagatcggttcacttgggttacttgtcatcttactcggatgtattgtatattttcaggtacggatttattttgagttcacttttttatgacaattatgactctgtcactaattatcgttttcgctttgaatatggtttaaacacctcttt

SEQ ID NO: 13969 - DNA, 127 bp, Gossypium hirsutum
  Clone ID: uC-gsflnu33B018a06b1
cttccttatcaacaaaaaaaaaaaaaaaaaaaaaacaagaaaaaaaaaaaaactaaaaaaaaaaaaaagcaaaaaaaaaaaaaacaaaggggtgctctccctggaggatccaactttattgcatgaa

SEQ ID NO: 13970 - DNA, 430 bp, Gossypium hirsutum
  Clone ID: uC-gsflnu33B018a08b1
tgctggatggggtgtgatggccagccaccgcagtggtgaaacggaggatacttttattgctgatctttcagtcggtttggccacgggccaaattaagaccggagctccatgcaggtctgagcgtttagccaagtacaatcagcttctgcgaattgaggaggagcttggtgcggaagctgtctatgctggagccagcttccgtgctccagttgcaccctattaagatgcttgtttagatgataatttgctgagactggatgcgtgcggcagagcttcagtggtttattgtgaccctaaaacatgtttcaataattttgatagcaattttgtacttgttcagaattatatcaatctccgtgttatttttgttggactttgcctgcatatatgctcgctattttcataaatatttgatgcttggaaaaaacaa

SEQ ID NO: 13971 - DNA, 525 bp, Gossypium hirsutum
  Clone ID: uC-gsflnu33B018a09b1
tttaaactccaaacagcaaagaatcagaataaaaaaaaaaagccaaaggaagatgaagaggtggttcgatccatggcccgtgttcttcaagagagagttcaatcgcacttggcctttcctcgttggtttcgccgtcaccgggaccatcatcacaaagttctcccttggtctaaccgaggaagatgctaagaactctccctttgctcagaagcacaagaggtgatccaactgatttcaaaagcctatatggttgcagtcccttggtatgagaggctcagttgttttcctttttccttttcccaatgaacaatgaaaataacagaagacatcatcctgagtacactttattttgtgaattatgattttgtcatcaattaatgattttgctttgaataaggttaaaacacccttccagttagtgattatgtttgacgcccttgattctgggtttatgatattgagaatcaaaacatgaaaatttgtgccattggttgccaattattagttaatgaacttaatgatggt

SEQ ID NO: 13972 - DNA, 476 bp, Gossypium hirsutum
  Clone ID: uC-gsflnu33B018a10b1
tgttttcgctggatcgggctcaggaatggcctttaacaagttgactgacaacggagcaaccaccccggctggtctcgtagccgccgctctagctcatggcttcggtcttttcgtcgctgtctccgttggcgccaacatctcaggtggccacgtcaaccctgccgtcaccttcggtgcttttgttggcgggaacatcactctcttgcgcggcattctttactggatcgcccaactcctaggctcaaccgtcgcttgcctgttgcttaagttcgctaccggcgacctggctgtacccgcttttgggttgtcatcaggtgtgggcgtgtctaacgcattggctttcgaaatcgcgatgaccttcggattggtgtacacagtgtacgccacagtcggtgatcccaaaagggaagcttgggaacaattgcctattggcatttggtttcatcgcgggggccaacatttggcaggaggtgcct

SEQ ID NO: 13973 - DNA, 167 bp, Gossypium hirsutum
  Clone ID: uC-gsflnu33B018a11b1
tcccacgcgtccgcggacgcgtgggcagaattcgtggcaatgtagaccagtattacaggagaaaaaaaaaaaaaaaaaaaaaaaaaaaaaaaaaaaaaaaaaaaaaagggggggaaatttaaaggaaacaaggttaaattcgcgtgtatgcaaagaaaaaacttttt

SEQ ID NO: 13974 - DNA, 525 bp, Gossypium hirsutum
  unsure (1)..(525): unsure at all n locations
  Clone ID: uC-gsflnu33B018b01b1
tttgtgtacatcgcgtggctttcctatcttcatttcatcgcactctccgacgaaagaaaccagagaaaaatgaccaagtgttacccaaccgttagcgaggagtaccaaaacgccgttcaaaaggctaagaggaagctaagaggtctcatcgctgagaagaactgtgctccactcatgctccgtctagcgtggcactcagctggaacttttgatgtcaagaccaagaccggaggtccattcggaaccatgaagcaacctgctgagctcgctcatgctgctaacaacggtctcgatattgcagtcaggcttctcgagccgatcaaggagcagttccctatcctttcatacgctgacttctatcagcttgctggtgttgttgctgttgagatcaccggtgggcctgaagttccattccatcctggaagagaggacaagcctcacccaccacctgagggtcgtcttnccaatgctactgagggagctgatcacttgagcaggtgtttagtcatcaaatgggtcttagcg

SEQ ID NO: 13975 - DNA, 505 bp, Gossypium hirsutum
  Clone ID: uC-gsflnu33B018b02b1
tttcacgccaccaactgaatccacacttgtaattactgggcaacccggatacatggagatctatctggcagatgtcaccatatactgaccgattactaggcgaagtttgaacacatgttcatccattggacatcgatctaattgacagaatgaaaccatttgatcctaccagaaggataactggaaagtgctacattaacaattaggctgttattaatgactaaatggcatttattcaatacaattatctgacctatggtatagaagaaaatgaactttggaagataatcactatgaaaccgctagctattgtgtacgatgtgagcgtattgccgcgacgaattacacaattcttatacttggtttatacacagatgaagaagcattggcacattcttacctcgaaagattacacgacatatcttatgaaccggtctgccccgaaccattttctttcgattttgagcagcaaccattgggagaagaacagatgaaggacatgatt

SEQ ID NO: 13976 - DNA, 513 bp, Gossypium hirsutum
  Clone ID: uC-gsflnu33B018b03b1
tttctatttggtgacgccacaatggatgatgtgcttgccaactttgataccaaccttggcatcccctatagttccctgcttaatgatgctgaccgtgtcagctatgctgctcacctcatgctcgtatttcccattgtcttctatccactgcgactcaacatggatggcctcctcttcccttattcaaggcctctagctcagtctaatacaaggtttgcttgtattactgccggactcgtagcagttatcttcttgggtgcgaatttcatacccagcatctgggatgctttccagttcactggagcaactgctgctgtttgccttggcttcatttttcctgctgcggttactcttaggaatcaccacttcatagcaacaaagaaggacaagatgttagctcttttcatgattggccttgccgtattctcgaatgcggtagccatatacagcgatgcatacgccctgtttaagaagaattcaggagcaggacccaaggcatgatccatctagcag

SEQ ID NO: 13977 - DNA, 380 bp, Gossypium hirsutum
  Clone ID: uC-gsflnu33B018b04b1
tctaattgtaaacaaggagtgggaatattcttataagaagggatggaaatgcacattcgaacgtggaattgtgcatgcatgttttaacttcaagcgatatcgctaccgtaggtaatatgtggttgagtgaacaacttcaactttgcaagcttgagctgcctgccatgaaactatactccgataaccgttaaggtaacttcagggctttcttgtattacttaaaaaaaaaaaagaagaagaaaactgtgaagtaggaacttttctcatattttaacctgtagtgttttcctcaatgctttcaatttatgaccaatatatttgccttggtctctggcactatacttttcacactaaaatgttgcacttggtacaatgaagaa

SEQ ID NO: 13978 - DNA, 331 bp, Gossypium hirsutum
  Clone ID: uC-gsflnu33B018b05b1
tgcttttggtcgcgtacagtctcagtcctaatcacaccgctgcttcctagtctaaactaatctcaggatgggtgaaatgtaatgttgatactgcaacgtttgaggctaatcaggccaccaatttttgctactatattacgtgatgatcgtggcaattttatacgtgctttatcaggtcatttactcgctatattggaaccacatattgttgattcgagagacactctcttagtttatggacgatggcatcaataatgttatggtagagacatcattaatgctcttgcttcttcaaaaaaaaaaaaaaataaaaataaaaataaaaaaataa

SEQ ID NO: 13979 - DNA, 525 bp, Gossypium hirsutum
  Clone ID: uC-gsflnu33B018b06b1
tggacgcgtgggttccttgagcttcttagtgctgttcaacctagatccgtaaattggagtcttgttacggaaggagtaaccgatgagcagaaaaagatgaatgccacctacatcatcagtattgccaggaagcttgggtgctcaatatttctgcttcctgaagacataattgaggtaaatcaaaagatgatcctcacattgactgcaagtatcatgtattggttcttgaaacaacctgttgaagagaaaccagcagcaacttcagatagtgaaaatggaagccaactggagactctctctaattctactactgatgactcagcatctgaatcatctgttgagtagagaccgaagctggaatgtataatcaagtgccttaaacttgtttctcctccctctctgcatagacacccagttttggattaaatttcatttgcaaagattgttggtcttgcatttacatgaataggggtgtctcaaataaatgattttgcttttgttgaatatgtttgccctcatgtattg

SEQ ID NO: 13980 - DNA, 415 bp, Gossypium hirsutum
  Clone ID: uC-gsflnu33B018b07b1
tgtttttaactctccagttctccacgaatccatagaatttcaccaagaagaagaagaagatgtcgtggcaaacatatgtagatgagcacttgatgtgcgaaatcgatggcaatcatctctcctccgccgccatcgtcggccacgatggcagcatttgggcccagagctccaatttccctcagttcaaacaagaagagattaatgccatcatgaatgactttgctgaacctgggtcacttgctccaactggattgtaccttggtggcacaaaatatatggtgatccaaggcgaacccggatatgttattcgagggaagaagggatccggaggtattactattaaaaagttcaatatggctctgctcatcggaatctatgatgagccaatgacttctggccaatgcaatatggttgt

SEQ ID NO: 13981 - DNA, 267 bp, Gossypium hirsutum
  Clone ID: uC-gsflnu33B018b08b1
tgcagtggcagcagcagcagcagctgggcaaagctatcaagcaaagaagaagaagaggaaaagatggtttcaggctcagggatatgcgcgaagagggtggtggtggatgctaggcatcacatgctaggaaggctggcatcgatattggccaaggagttgatgaatgggcagaaagtagtggtggtgagatgtcccaattcaatagtttattgtagatttttgaggcagaggtctgattgcttcacactggtttatgcttctttggaa

SEQ ID NO: 13982 - DNA, 459 bp, Gossypium hirsutum
  unsure (1)..(459): unsure at all n locations
  Clone ID: uC-gsflnu33B018b09b1
tttaaaacagaagcaaatcttttccgtgaaaagattcacagggccggggacggggaagagagccagcagttcttgggatgaaccctaaacaccttccaccgtagtactattactgtttacctgatcaaacacaagccatggctacaaagagattgtaatctgttaatgaaagatttagatagcttagaatttagatagtttaggcagagccctcccttcggccttggttctactctccggcacttgaaatccagacaaaaacaaagtccaagttgaaaaaagaaaatcccacagagataaccaaaacaccaacccttgttttcatttttgttttgttaatggattctgcttctgtangggggtgctgcaaccgatccgaatagcgtcaacgagggtccatcatctgctgtagttacagcttcagcaacgccgcccacggttccacaacagggtggagct

SEQ ID NO: 13983 - DNA, 428 bp, Gossypium hirsutum
  Clone ID: uC-gsflnu33B018b10b1
tctcaaacaaactttttagttctcaactctctcaaattcaccatggctgacaagtgtggcaactgcgattgcgctgacaagagccagtgtgtgaagaaaggaaacagcttggtcattgagactgaggagagctacatcagcaccgtagtggtcgagcctctggcagagaacgatggcaagtgcaagtgcggaactagctgcagctgcacaaactgcacatgtggcagtcactaagcagacatatagaatgatgaagtttgggacctaaaaagaataaaagttgggttgaataatttgtgtcttttgttgtagtttgagtgtgttttcttgtctatctgtccgatgattgtctatgtctctcattttatacaatgatggaatgaccatgtcaatggcctttgtctgattaatgaactattattagtatt

SEQ ID NO: 13984 - DNA, 384 bp, Gossypium hirsutum
  Clone ID: uC-gsflnu33B018b12b1
tcgcagtacatagattttggattcaataccggtaagtttaacggaagctctctaagcgtattttcaaggggagaagctgggcttgcggtggtcggaggaagaggccaattcgcgatggcaacagggactgcactatttaaccctctccttataaatgccaccaatgtcatcattgaatttaacgttactgtaattcattactaagatgttatttacagagtcaatcgtcttggattgtgtgaaaatcatatgattatgctccacttgttagaataaatgtatgagaaatatataggtttttagtattaaaaattaaaattctcatacttgcagtcattgtactttatcattatacgagaaataaatattaaattcttagctact

SEQ ID NO: 13985 - DNA, 525 bp, Gossypium hirsutum
  Clone ID: uC-gsflnu33B018c01b1
ttccgataaacttgatgacactaaaggtgaaccggcgaatttagttgctgttgactcccctcgagtagaacatgaaccatgcagattatccccagaagcctctcctaggagccatatgacggttccggaatcccaaggaacgccttctagtcaagtatctataaaaagtaaaaagaagaaaactgaaaagagcggtcaaaagcgcaagtctttttctactgctaagggttctccaactgcaaatcgtgatagtggtgcaaaaagtagtacggaacaaccatccaaagatcaaagaagcgggaagagacacaattctttcggttcaacaaaacccgataacatcgatgaggaaccaagagatagtaacagtagcatttcttttccccgtttcatgcaagccacggaatctgcaagagctaaagttaatgcaaataactcaccaagatcaagtcccgacgtgcaagatggagatctttatatcaagaagagacgttccttacctggtgctaatgggaagcagcattc

SEQ ID NO: 13986 - DNA, 519 bp, Gossypium hirsutum
  Clone ID: uC-gsflnu33B018c02b1
ttcacgcgtccgcgtcaagtgccggctttcagattttttacacgatccacttcctcaacaactcaacaaattgtacccttttcctctcgatgatgctgcggagttgcccatggggatccaattcaatactttcctttgtggtggaatcgggattggtgtgtgtgtttcacataaaatcggcgatgctttatccttttttacgtttttgaatacgtgggcagccattgctcgtggggatacgaagagcgtggtctggcctgagttggtatcggccaagctttttcccccgcggaacgtatcagtgcctgaaccagtaatggaaaaaagtgaaaagaatatagcgacgaagaggttggtgtttagtgcttctaaaatagaggaaatcagagccaaatacgctgtcgatcatgaaatccgcccttcacgtattgaggccttgtctgctttcatatggagccgtttcattgcttccactaaggaaaaaccaagccctaatgcattctacgtgattttcataca

SEQ ID NO: 13987 - DNA, 278 bp, Gossypium hirsutum
  Clone ID: uC-gsflnu33B018c06b1
tccacgcgtccgcaacagagaagaagaagaaagccaacccagcaagtcattcaaattcaaccctccccaaactcctaacttatatccctttcccttcccttcacttataactttccctattttgtaacatttcacatgcaatccattcatttttttttcatcaatcatcaatcatttctgcgattaaaaatcatatcttgctattcaaagtcttcatcttttttttcttttgatatataaaaaagaaagctctctttgtacttttttttgtgaagatc

SEQ ID NO: 13988 - DNA, 518 bp, Gossypium hirsutum
  Clone ID: uC-gsflnu33B018c09b1
tttgttcgttcataaaaattaaaagcctcttttttctctctgttcttcgccatttttttcaatcctaaaccaatcccagattttctgctgaaaaacaaaaacaccctctaagtaactttccgggaaaatgtcggggaaaggagcaaaaggattgattacggctggaaaatccaccaaggacaaagataaggacaagaagaaacccgtctctcgctcttctcgtgctggtctccagttccctgtgggtcgagtccaccgactgctgaagacaagggttagtgctaatggaagggttggagctacagctgcagtctacacagctgccatactggaatacctgaccgcagaagtcctagaactggcaggtaatgcaagcaaggatttgaaggttaagcgtattacacctaggcatttgcagctcgccatccgtggtgatgaagaacttgacaccttgatcaaaggaaccatcgcaggcggaggtgtcattccacacattcacaaatcacttatcaacaaat

SEQ ID NO: 13989 - DNA, 533 bp, Gossypium hirsutum
  Clone ID: uC-gsflnu33B018c10b1
ttgtattccataaggtcaatcataagatcattgtatctgatgcagttttgcaaaaccggtggagcagtgtaagttcatccgacctgatgttcttgagctcagagatgcttaacgacttgtcgagcaacagatttgtgtccctggacataaacaaggagcagtgtacgaaaacaaggacaattgaaaacgaaggaattacaaagatcaaaagggaattggagataaagagactgttaaacaagccagtttcaactcctgatgtggctttcacatcggattcagcagctagtacgagtcatgctgcatcaaggattactaaccaagttgagaaaagatcaatgtcggatatcactgctttatcgaggtttcgagacgatggtaggaggaacagaacaagtgagtgttcattgcctgaaaggtacacagaggaggaaaggagaaggctgctttggttgccaatagctagaagaacagtgcaatggtttgccaatagagaaacgtgtgaacaacatattcaggggtcaacacaccat

SEQ ID NO: 13990 - DNA, 417 bp, Gossypium hirsutum
  Clone ID: uC-gsflnu33B018c11b1
ttaatcttccattctttgcatctaggatcaagctcggaaggaatggggttgaggcacttattccatctgacctcatagggttatccgagtacgaagataagacattggaagctcttaagccagaattaaaggccagcatcaagaagggaattgcattcgtgcagaagcaaccagttacagcttaaaaacccaagttttcgacataccaaaactaagcctcctctcgagagagagccaggcctgcatcagtagtttcagttttgcagaatcgaagttttttcggtttctttttccaattacatcacagaaatacaaaatttagaagggcgtatcgatgttgtaaacgacaaaaacataaacatttctgaatcagaacttttgaaatctaaaataaaggctacatttcaactttctttt

SEQ ID NO: 13991 - DNA, 527 bp, Gossypium hirsutum
  Clone ID: uC-gsflnu33B018c12b1
tccacgcgtccgaaaaaaaaaaaaaaaaaaaaaaaaaaaaaaaaaaaaaaaaaaataaaaaaaaaaaaaaaataaaataaaaaaaaataaaaagatataactatttatatggttaaatcttattttaatttactggactttgttttattacttttggattggaaaatccatgggtgtgcttttctttatttttattgcatttcattcttttttctcctgctggttttttttttttttggtctcttacatattgtttttttttcctcttttttttctctgtttgtggagttgtttttttttctgtttttattctttttgcgtggtttgttgttctgttttttgttttgttttgcttgttcatttgagtgtgtttttttttgctgtttttggggtttttgtttttttttttttggtcgttttcttcttttttttattgtgtattttttttgcggtggttttttttactgttttctttttttttttttctgtttcttgcctttctttactttttttggtttttttttttt

SEQ ID NO: 13992 - DNA, 351 bp, Gossypium hirsutum
  Clone ID: uC-gsflnu33B018d01b1
gtcttgttttatttatgcaatgagctttttgccagcatgggagcaaccaccatcccaggggtatgaaaagccattctgattctacaattgtgcaaaatatgcgaagaaatactgcttagtatgtttacattagtcactcattgttgtctgttccatcctatggcaagttgcttttgaatttatgcttgtatatctctgctgctgataggaatttacgacatggtgaatgcatttctttcatttggctgttgcactacatcacaaaaggaaagaaagttcatcatgttcatttctaaagtatatttcttctccttttttgcttggattggattgagatctagaatgatattc

SEQ ID NO: 13993 - DNA, 526 bp, Gossypium hirsutum
  Clone ID: uC-gsflnu33B018d02b1
aatatacctcgtccagttaatggaccctgatagtgggatggttgacaaggcagttgcccttctctcaaacctgtcgacagttgcggaagggcgtgtggcaattgtacgagaaggtggtgtcccattactagttgaaattcttgaatcaggatcacagaggggtaaggagaatgctgcatctgtattgctgcaactatgccttaatagtcccaagttctgtaccctggttttgcaagaaggggctgtgccaccccttgtcgcattgtcccagtctggcacgccaagagcaaaagaaaaggcacagcagcttctcagtcacttccggaatcagagagaaggtgccactgggaagagcaagtaaaagctgactaactttgttatatttttcttgtatgattttttgatatcgtactccatgtaagttgttctatctcaattggtccttttggagctcacttattatacattctttagtcatccagctatatgcattagaatatgaactctattttttaatacccttttt

SEQ ID NO: 13994 - DNA, 259 bp, Gossypium hirsutum
  Clone ID: uC-gsflnu33B018d03b1
ctcacgcgtccggaaagaatacgacgagcatgatttggctaacattcagaaaaagaaagaagaagagaaggcccttagagagctgagagcaaaggcatcacaaaagggatcatttggtggttctggtcttaagaagagtggcaagaaatgagtttcttaaaaacccgagctaaaccgaacttatcgagtcctgtcttgggattaaaacatctattatgctgatgtctcttgtttctattgcgatagttgggatgatttg

SEQ ID NO: 13995 - DNA, 460 bp, Gossypium hirsutum
  Clone ID: uC-gsflnu33B018d04b1
tccacgcgtccggcgtcatcttcttcagctgccaacattgccaccgttgccatcgattccaaatctcccacagccaacgatgcccaccctgccgcaaccatctatacccaaccccgtcgctcttcctccactgcctaccattcctaccctgccacccttgcccagcttgccttcaatccccactttgccaactaccattccatccttctccccaccacctgctagaactaccccttgaagttttccacttccaccaaagtgtttggactgtgcacctttgctctaccgtgcctcttcgctttttgcatattgggcatatattgtgctcctcttttcttttctttttttcattttttccaccacacttgtttgctgcattttcctttttatagagtttcctatatggggtttattgtacgaccagcaatcagtttatgttaatgtattaaatgtaattctt

SEQ ID NO: 13996 - DNA, 376 bp, Gossypium hirsutum
  Clone ID: uC-gsflnu33B018d05b1
ttcgtgtttgtctattgaattctttccttcactttctctagaaaaagaaaatgtcttcaggttgcaattgcggatctaactgcagctgcggtgacaactgctcatgcagcaggaaccttaaccttggatactcggagaagacaaccagcactcagaccatcatctccggagttgcgccagtaaagatgacctttgagggaccagagatgagcactactgaatcaggacatggatgcggctgtggatcaaactgcaaatgtaatccatgcaactgctgaaaagcttgatgaaagccatagattatgaaaaaagaaagcagcaaagtaacaggcctatgtaatgatttattttcaaggatggatgcgtgcaaggtcta

SEQ ID NO: 13997 - DNA, 520 bp, Gossypium hirsutum
  Clone ID: uC-gsflnu33B018d09b1
tttaatttggaagattttgggaatcggcgcttaattaagattcgggttgtttttaagcctacctgcttgcttccatgaatttgatgttgaaggcgaaccctaaccctaaccctaaccctaaagatgacgctaaaaagacccgaactgtcgatcttggaaacggaagcagtgtaatttacgttcccaggtttttagcatatgatgtcgcctgggaattcttcaattacctcgacaatcacatcccttggaccagacccacccttcgcgtctttggccgatcttgcactcagcctagagacacatgttatgttgcaagtgcagggttgccggacttgatttacagtggatatcagcctcatgcttattcttgggatgatttccccccacttaaggacattttggatgcggtccataaaatgcttcctggcagtacatttaacagcttgcttttaaatcggtataaagggggtaacaactatgtaagttggcatagtgatgacgagaagctctatggatcaac

SEQ ID NO: 13998 - DNA, 446 bp, Gossypium hirsutum
  Clone ID: uC-gsflnu33B018d10b1
tcccacgcgtccgtgagaaggttgagaatgaacctgaaatgattgaagattggccaccagtgcctggatcaaaaagaaggcttgttttgacaacacagcttttgcagcaactaatttgtgctcctccaagagtagttctttctgcagatgccagcaaaaactatgagactctggcctattttgttgccagatcagtcttaggagatgcatgcagcacagcatatatacctgaaagtgacacagctgtacctcctcacagtggaagcatcctccctgaaaagcttagggagcagcgaaaccaatccatcttaaaggctgcagaagagtttatcgtcagggcaaagatgttggaaaatggtttacaaagtctggtcaacagagcctcaatcttggacttaagactggaatgtcaggatcaagagaaggtttcagtcattactcgtttt

SEQ ID NO: 13999 - DNA, 531 bp, Gossypium hirsutum
  unsure (1)..(531): unsure at all n locations
  Clone ID: uC-gsflnu33B018d11b1
ttcctctgtttctagttccgttctcttaatttgtttcttattgtttgctcattttcgttagtattagatcagagagagagagggtggagatctggacaggtctggctgtggccgaaatcaaagaagaatatttgagggaggaggagaaaacatcgaacaagattaaaccgaaacaaattaggaaaattctatggattggtggcataagatgatcttccctgttcgaagactctggtttgttgtttcttctcgcgttaaggctcgcaaaaatggagccgggttgttgaagcttcacgatgatgtacaaacatgtggatacgaagatgtgcaggtgatgtgggaaatgctgcgaagatcggaatcggagctgttggctgctaacaacaatcccaagcgcaagcaccgcccagctttctggagagttttcgtttggtcttctaaccacacttcatccttctcgcccaattatgcctaacttcacaccatttgcatgcatacttcctaatatnntataatataatgataatgatg

SEQ ID NO: 14000 - DNA, 454 bp, Gossypium hirsutum
  Clone ID: uC-gsflnu33B018e03b1
tgataaaacgagcaaaagagtccatttcgtgaggaacttgatcagggaagttgctggttttgcaccgtatgagaagaggatcactgagcttttgaaagtcggtaaggacaagcgagctcttaaggtagctaaaagaaagttgggaactcacaaaagggcaaagaagaagcgtgaagagatgtccagcgttctccgcaagatgagagcccacggtggaggtgcagaaaagaagaaataaagctttattttcttggtttctcacccttgtcgtgctcgagtttcttgtttaggagcagctagatggtttgtttagcatatgtttcatttttgtgtgttgagactgaaatcagtgctttggaacttttgtttatttgagttagagatgagaaattggaagaagtaataacttttacattttatgggtttcgaattatattacacgccatttactaat

SEQ ID NO: 14001 - DNA, 294 bp, Gossypium hirsutum
  Clone ID: uC-gsflnu33B018e04b1
cttcgttagacgcagctgaggtgtttgaggacattggtcctaagtaatttgagattttattttcggactttaattgcaattatagattacacgctttttattcttttcaagaactttaatagctttgcgtcttggaatttgggtgttttttttttttatatatatctggatacgagaaacacaccatggctgctattctaacgctgtgatatgagtctctgcttgtactacaagaagacaaaaccaaaccagtatcctagcacttcatttatccaaattgccggatttcacacc

SEQ ID NO: 14002 - DNA, 525 bp, Gossypium hirsutum
  unsure (1)..(525): unsure at all n locations
  Clone ID: uC-gsflnu33B018e08b1
caacactcggcatcttctctccattggcatgtttcaagcggatcgattccttaagatttacatccgccttatccgttgctctagcagttgtgtttcttgtcattactgttggaatagcaattatcaagttgattagcggaactgtaatgatgcctagattgcttcccgatgtcactgatttgacctcattctggaaactcttcaccgtagtccccgttttagtcactgcatatatctgccactacaatgtccacagcatagataacgaactggaagattcaacccagataagaccggttgtgcgaacagctctggctttatgctcaactgtttacataatgacaagctttttcggatttcttctatttggtgacgccacaatggatgatgtgcttgccaactttgataccaaccttggcatccnctatagttccctgcttaatgatgctgtccgtgtcagctatgctgctcacctcatgctcgtatttcccattgtcttctatccactgcgactcaacatggatg

SEQ ID NO: 14003 - DNA, 79 bp, Gossypium hirsutum
  Clone ID: uC-gsflnu33B018e11b1
tatcttgctttactgccacttaatcatctttggtataaacttaagtcagaaggtatttaacatgttttcatatttgttt

SEQ ID NO: 14004 - DNA, 518 bp, Gossypium hirsutum
  Clone ID: uC-gsflnu33B018e12b1
tttcaactcactcctcttttacgccttggagctggagcatgtgctggaataattgccatgtctgcaacttaccctatggacatggtacgaggcaggatcactgtacagacagagagttctccttatcagtatagaggaatgttccatgctctatccactgtgttgcgggaagaaggtccacgagcattgtataagggttggcttccttcagtcattggagttataccatacgtgggtctgaacttttctgtgtatgaatctctaaaagattggttaatcaaaagtagaccatttggattggttgaagactctgagttgagtgtgacgaccaggcttgcttgtggtgctgctgctggaactgtaggccaaactgttgcttaccctcttgatgtgattcgcagaagaatgcaaatggtaggatggaaagatgcagcgtcagttgtatctggtgatgggaggaacaaggcctctcttgaatatactggcatgattgatgctttcagaaaactgtaggcatg

SEQ ID NO: 14005 - DNA, 96 bp, Gossypium hirsutum
  Clone ID: uC-gsflnu33B018f04b1
tccacgcgtccgaaaaaaaaaaaaaaaaaaaaaaaaaaaaaaaaaaaaaaaaaaaaaaaggaaaaaagatatagaggatccaaagttaacgacggc

SEQ ID NO: 14006 - DNA, 525 bp, Gossypium hirsutum
  Clone ID: uC-gsflnu33B018f06b1
ttcacgcgtccgaccggagataacaaaaatacagcagaagctatatgccatgaaataggtgtttttgggccgatggaagacatcagttcaaaaagtttaactgggaaggagtttatggcactttcagataagaaagctcatctaagacaaagtggtgggcttctattttctagggctgaaccgagacacaagcaagagatagtgagattgctaaaggaagatggagaggtggttgctatgactggtgatggagtaaatgatgcacctgccttgaaactagctgatattggaattgctatgggcattgctggaacggaggtagcaaaggaagcttctgacatggtgttggcagatgacaatttcagtacaattgtttctgccgtcggtgaaggaagatccatttacgacaacatgaaagcttttatcaggtacatgatctcgtcaaatatcggtgaggttgcctccatattcctaacagcagcattgggtatacccgagggcctgattccagttcaacttctctgg

SEQ ID NO: 14007 - DNA, 296 bp, Gossypium hirsutum
  Clone ID: uC-gsflnu33B018f07b1
ttaccatcgttacggacagtgtgacttcagacgggcttacttcattcattgaaaagaaacttgggggaaagcaccatagattcaaaagaggctataagaatgtcattgacgaggcgattcgattgaactctataggagaggaatcacatctagctatagaaaccagtggccatggagctctcaaagagaatcactggcttgatgatggggcatacttgatggtcaaactcctcaataaacttgcttcagcatgggctttcggtaaaggtgctggaatgccaattttaacccgatct

SEQ ID NO: 14008 - DNA, 448 bp, Gossypium hirsutum
  Clone ID: uC-gsflnu33B018f08b1
taatgcccttgttgccaaagctcagaaaatgcctgaagaaggttggacaatgcaggatggaacgccatggcctggaaacaacccgagagatcatccaggaatgatacaggtgtttctaggacatagtgggggactcgatactgatggaaatgagctacctcgccttatctatgtttctcgtgagaagcgacctggcttccaacaccacaaaaaagctggagccatgaatgctttgattcgagtttcagctgttcttaccaatggggcatatttgttgaatgtcgattgtgatcactactttaataacagtaaagctctaaaagaagcaatgtgtttcatgatggaccctgcctattgaatgaatgcattcttatttcattttttttaatgtttttatgtctttaatttcttcttttattctttacttattattttttattattttcta

SEQ ID NO: 14009 - DNA, 528 bp, Gossypium hirsutum
  unsure (1)..(528): unsure at all n locations
  Clone ID: uC-gsflnu33B018f10b1
ttttgcgatctattaatatcccttctgggaaggactcgtctggtgggtcaggtttagccgccggtaagattttgagggcggtgccgaaggatgacacccagcaagatgtaaaaagcggtgtccagaaatttcgtgttaagttgttgtctgaaagtggagcacatggccccatggacgtactttgccagattggtttagatggtattcgtatgcttgagcctagcagcagtcgaatattgagaatatatcctcttgagaacatcacaagatgtgaagtgttggactcatctacctttgcattctggtccaaaagctctgttgacattgaaccaagacggatcaggttgcaatcaaacagttacactaccaatacccttctggatattgtaactgctgcaactgtacagatcaaggagatgggttggaaaagtcggcctcctgaatctgccaaggctgctgaacaacctgcagaaaagaagaganggattgctgattggatgaacattataaaacctggtgctgaggaga

SEQ ID NO: 14010 - DNA, 524 bp, Gossypium hirsutum
  unsure (1)..(524): unsure at all n locations
  Clone ID: uC-gsflnu33B018f11b1
tcaaatttgggacactgctggccaagaacgctttaggacaatcactagtagctattatcgtggggctcacggtatcatagttgtttatgacgtgacagaccaagagagtttcaacaatgtcaagcaatggctaaacgaaattgaccgctatgccagtgacaatgtgaacaaacttttggttgggaacaagtgtgatctaacagcaaacaaagttgtgtcatatgagacagctaaagcttttgctgatgaaattgggattcccttcttggaaacaagtgcaaaggatgccactaatgttgaagaggctttcatggccatggctgcttcaatcaagaataggatggctagccaaccaggcatgaacaatgcgagacctccaacggtgaatatcaaaggacagcctgttaaccagaactctggttgctgctcttcttaaatgaaaatttagttntagttggtccatgtgatgatatttgtccttttgtgttatttgttgcatgtagttgggggaaaaaaaaactagt

SEQ ID NO: 14011 - DNA, 520 bp, Gossypium hirsutum
  Clone ID: uC-gsflnu33B018g01b1
tttacgcgtccgcccacgcgtccgtaagtttaaagcttttgacttgggtggccatcaaattgctcgccgagtctggaaagattactatgctaaggtggatgctgtggtttaccttgtagatgcctatgataaagagaggtttgcagaatcgaagaaggaactcgatgcactgctttcagacgaggcccttgccaatgtcccgtttcttatcctaggaaacaagatcgatataccatacgctgcctcggaggatgaattacgttaccatctgggcctcacaaactttaccacaggcgaggggaaggtgaacctagcagactcaaatgtccgtccgctagaggtatttatgtgcagcatagtccgcaaaatgggatatggggacggctttaagtggatgtctcagtatatcaagtagggtaatggctagaaagatgcattaagacgatcttagacttccaagccccaattcaggtataaaaaaaatgtattcttttaaactgtttgagctgacccctagtgg

SEQ ID NO: 14012 - DNA, 273 bp, Gossypium hirsutum
  Clone ID: uC-gsflnu33B018g05b1
ttcttggaagcagtaaacgagggaagtaccggcttgactctgtctccaccaaagtttgaagatgaggcattgaaatttgaattatgttcatgttttgacattttgttccctgttttgcctttaaacctgactcacttactgtatatattagtaggtcagcaatgtaatttttgacattcgttttctttctttccctacatgaatgccatttgctaaaaaaaaaaacaaaaaaaaaaataaaatatgaaaataaaaacaacaaaaaaaaatatg

SEQ ID NO: 14013 - DNA, 107 bp, Gossypium hirsutum
  Clone ID: uC-gsflnu33B018g07b1
tgtcacgcgtgcggccacgcgttcggccaagcgttcctaaaaaaaggtttcaagcatttgaaacctggttattttaaaaagatactaatatcactctacataaaact

SEQ ID NO: 14014 - DNA, 533 bp, Gossypium hirsutum
  unsure (1)..(533): unsure at all n locations
  Clone ID: uC-gsflnu33B018g09b1
ttccacgcgtccggatcacatgacattaaaaagtgtgctgcggtgacagagcgtgttcttgctgcttgctacaaggctttgaatgatcaccatgtcatgctagaaggtactcttttgaagcctaacatggtgacccctggttccgactccccgaaggttgccccagaggttattgctgagtacactgtccgtgccttgcagcgtaccgtccctgctgcagtccctgctattgtgttcttgtctggtgggcaaagtgaggaggaggctacccttaaccttaatgccatgaacaagctccagaccaagaaaccatggtcactctcattctcatttggacgtgcccttcagcagagcactctcaaggcctgggctggaaaggaggaaaacgtgaagaaagcacaagatgctntccttgttaggtgcaaggctaactcggaggccaccttgggtacatacaagggtgacgcaaagattagtgagggtgctgcagagagccttcatgttaaggactacanatactaagaattagtctt

SEQ ID NO: 14015 - DNA, 528 bp, Gossypium hirsutum
  Clone ID: uC-gsflnu33B018g10b1
ttccacgcgtccgcccacgcgtccgcaagctccctctaatctaggcacccaaagtgagcttattgctgttgacttgagcaataacgagctacaaggctggttacctcctttcttgccattaatgccaaacctgtcagctttatccatggaaaacaacaagttttcgggtatgatccctatccaatacgcattgagagccgctctgcctgcctccggaattgccccgtttgcaagactgttgcttggggggaactacttgttcggaccaattccagggccattgctggtactcaaaccagacactgcaaatgtcagccttgctgacaactgcttgatcaggtgcccatcgcgtttctttttctgccaaggtgctgaccagaaatctttaatggaatgcaagagttttggttctgtaatcccttgaatcatgttatttcagcaatgtttttagttgcaacatccatgtgtctttcttgtctaaaattctttctctattggtcttagttttgggcttgttagttttcagtt

SEQ ID NO: 14016 - DNA, 518 bp, Gossypium hirsutum
  Clone ID: uC-gsflnu33B018g11b1
gactgcaaaaacgccaccgcaacactaaaaacccgccgtctcaaatcaaacgaagaaaccaaaagcttcgatggccatcgccgccgccatttccctctccctcccgccacaaactcgccgttcctctgcctccatcgccgccccttttcgatcaacttcttctcttcatttcgattctcttcgttccaacttttcttctcttaaaaaccctaaccttcgagtctctgcatcttccatgagcatcggaactccagagaaaatctccacgacgtcgttccttgaccgaagggaaagtggatttcttcacttcgttaagtaccacggccttgggaacgatttcattttggttgataacagggactcgacggaaccgagggttacgccggagcaagcggtgaagttgtgcgataggaacttcggtatcggagctgatggagtgatttttgcgatgcccggagtcaacggtaccgattatactatgcgaatcttcaactccgatggcagcgagcccgagatgt

SEQ ID NO: 14017 - DNA, 533 bp, Gossypium hirsutum
  Clone ID: uC-gsflnu33B018h02b1
tctttaaacatctacacacagtgaaattagagtaattgagaaaaacgcactggctcaaaagatgttgatgatggcggtccttgtgatattggggacgaagatagcgacagttacggttgcggatccgacttgcttgcacagcttgaagtcttgcgctccttacttcaaaaacgccactctccaactgaaaggagattgctgtgaccctctcagaaaaactgtcgctactaaacttacttgcctttgcagcctcattaacaactctactttgcttagttctttcaacatccccatcgctgcagctcttaggatcactcgtggctgcggtgtcactgatcagatgaaaggctgcatctccgctactcccacacctgctccttccccatgagctaattctcccaaagctgctccactcattaccaggaggtgaaagtggaggtgtcaacaagaaaactttgacccgaatcaccaatttgtctttttttttaaagcatctatagctctctactatggtgacatgttttctacatgag

SEQ ID NO: 14018 - DNA, 505 bp, Gossypium hirsutum
  unsure (1)..(505): unsure at all n locations
  Clone ID: uC-gsflnu33B018h06b1
ttgaattgcaattggaaatgcttggatagatgataacatttgtacaaagggactgtttgattatttatggacacacgctctcaactctgatgaaaccaatgaaggggttaacaagtactgcgactttgctagtcaagatttagttaccaacaaggcagttgcaaaaaacgctacagaccagtgtgatcagtatcaaagtcgggcactaacagagatgggagacattgacttgtacggcatttactcccctttatgcaattcatcggcaataaaacctggctcagatggtaatgtgttgaattttgatccctgctctgacgtccacgttaagtcctacctaaatcttgccaaggtacaagcagcccttcatgccaaagctacaaaatggtcagcttgcagtggtgttggatggacagacagcccaacgtctactctccctgaaatacgggacttggcaaaagtgattagggtgtggatatacagcggngacacagatggttgagtt

SEQ ID NO: 14019 - DNA, 501 bp, Gossypium hirsutum
  Clone ID: uC-gsflnu33B018h09b1
tttcacgcgtgcgcttttgtacataagaaatctgtgcatgaaaaacaccaaaacaataaaaaagaagaaggaacaagacaattccaaaggaacaagagagaaaatgagtcgaggaagtggtggcgggtacgatcgccatattaccatcttctcccccgaaggtcgtcttttccaagtcgagtatgcgtttaaggcagtgaaagccgctgggatcacatcaattggtgttcgagggaaagactccgtctgtgttgttactcagaagaaagttcccgacaaacttttggatcagactagcgtcactcatcttttccctattactaagttccttggattgttggctactgccatgacagctgatgcaaggaccttggttcagcacgcatggaatgaagcagctgagtttcgtttcagatatggatatgagatgcctagggatgtattgtccaaatggatcgctgacaaattacaggtttacactaaacatgcttatatgagacc

SEQ ID NO: 14020 - DNA, 450 bp, Gossypium hirsutum
  Clone ID: uC-gsflnu33B018h10b1
tcctacgcgtccgataaaataaaaaaaaaaagtaaaaattaaaaaaaaaaaatagaaatataataaaaatagagaactatattaatttgctggattctttggagaaattgtgtggtggatgttgtggtttttgcgttcgccctcttttttttttgtctttcgtttttttctgtgtgtcctctgtgtttcttggttggtggggggttttccgttttttttttgggttctcctttttgctgttctggttcttttttgcttcgcgtctttcctctttttttccgtgggggttttggctcttttttctcttcggttcttttttttgtatttgtgtgttcctttttttggggggtgctggcctccctttttttgggcttttgttgggcctgttgggttggtttgtccccccttgcttttcgttcttttttcggcccctggctgcctttttttttc

SEQ ID NO: 14021 - DNA, 284 bp, Gossypium hirsutum
  Clone ID: uC-gsflnu33B018h12b1
tccacgcgtccggccgttgattagtgaagaaaatcttgtaaccatgaaaaatatattataagaatggttaaaattactatggaaaaaaaaaaaaaaaaaaaaaaaaaaaaaaaaaaaaaaaaaaaaaaaaagggcggccaaaattaaaggaaccaaaatatacatcacttaaaatgaaaagaaaaagatctattatagtgtaatcaaaaaacaatttaatggccgtcattttacaaattttagactgggaaaaacttggaaaaacccaaattaaatgacttgta

SEQ ID NO: 14022 - DNA, 503 bp, Gossypium hirsutum
  Clone ID: uC-gsflnu33B019a01b1
gttcctgctcgttcaccaaaaatcaatgatttaagttgggcttttacaccatcatcaccagctggaccatttcgagatgaaataactcccacacctactccaactcccacatccacttccacacctactccggatcctgctgttacaccaactcttactcccactccaacgccaacgccaacgccaacttccacatccacacctactccaacgccaactcctacacccacacccactccaacgccttcatcatcatccaactcttcatccaactcctcctcctcctcaacaggtggcactcctactggtgttaatactgcttcctccttctttttctccttctccactttctctgcagctggcgtggtgactatgttgctggtggtattggcttttgtcgctcctcaataaattgtgtgtgtgtgttcttttccaacttgtcaaactcaatcatgtattgacttgatccctactggctttcggtcggttggattggaaacatg

SEQ ID NO: 14023 - DNA, 554 bp, Gossypium hirsutum
  unsure (1)..(554): unsure at all n locations
  Clone ID: uC-gsflnu33B019a02b1
ctacgcgtccgcggacgcgtgggtgcaggtagcaccacattctctcgtcatggcagtggatagtaagtttcaatctatggatattgatgtaaaaataaagaagttcacatggaggattcagaatttctccagtcttgaagttaaaaagctctactctgaagtttttactgttgatggctacaaatggcgaattcttatcttccccaaggggaaccatgtggatcatttgtcaatttatttagatgttgcagattcagctactttgccttacggatggagtaaatatgcccaagtcggattcggagtcatcgatcaatttgatcgtgaaacttccagtacaagagtcactcagcattgtttcaacgcgagggaggctgattggggcttcactacattcttatgtcttactgaattacacaaccctaaaagaggctatctccttaatgatgaatgcttggttgagtatacgtttgtactgataagactctagatnttatttcccgtgatttatagtcgaaactgaatgggatgacctaatgccaaggaagctgatt

SEQ ID NO: 14024 - DNA, 331 bp, Gossypium hirsutum
  Clone ID: uC-gsflnu33B019a03b1
gtgggttgatgatgatgatgaattgtagtcatatataacatgtactcgcatgtcttggttctggctttgtttccactttgtatgatataattggtatataaagctcttgttttgtgttgcgtcaaaaaaaaaaaaaaaaaaaaaaaaaaaaaaaaaaaaaaaaaaaaaaaaaaaaaaaaaaaaaaaaaaaaaaaaaaaaaaaaaaaaccaaaagaccaaacataaaacatattccccaaatctacatctaaaacgggcggccgtgtaaaataccaatggatatcgcaaaccaactttcagaactggatatccttctatgatgctccccaaa

SEQ ID NO: 14025 - DNA, 499 bp, Gossypium hirsutum
  Clone ID: uC-gsflnu33B019a05b1
ttttcaccagaccaccagggttagtgagagtacaaagaggtatcagctacaacatctttgtcgacaataaagcatgccgagagttcttgaactccaagttcaatgcaacagcaatcgacatggagacagctgcgatagcccttgtttgccaccaacaaaacatgccttttattgcatttaggtccctgtctgatttagctggtgggggttctgccttgtctaatgaagctgcttcatttgccactttggctgctcaaaatgctgttgatgttctacttaggttcatttccctattatcttcataaaacatataaaaacaagtttctttcaaggcataatctctcttggaatttaaaaattataaaatttgattggtaattgctagtttattgatacgataatggaaaatccaaatttgataggaatattgggttatattggttgtctttgatcacgatgaatatttggtggtatagaatgcattttatagccttctttc

SEQ ID NO: 14026 - DNA, 362 bp, Gossypium hirsutum
  Clone ID: uC-gsflnu33B019a07b1
gtaaggcggccaggcacaccgccgcccacgggcgcgcactatggaggtgatcgcgtcagttactccacaaaaaaagtgtggatcaggaggacgtaccgtgactacaagcagctgtcacaacaactgagcacacgactggaacctaagagaaggatatgcgcaggagacaaccagcaatgataccaacgtgttacatgtagctaacggaaaaaagaccgaaggaggaccagagaggatgagtactcatggaagacatgctagcaggaggacaagatacggcggtagtgaacgatgcaagggtagaaaaggtagacgacagcaatggtttatgagaaagagaacggagcaaatataacaggact

SEQ ID NO: 14027 - DNA, 443 bp, Gossypium hirsutum
  Clone ID: uC-gsflnu33B019a10b1
ttcatcgcgtccggaaggctgtggttcatctcatatgttgtgccatgaagtaaaaagtctttcatgctcgccgtcctctgtagaagatgtttctactcagcattctaaattctctgggaaagaaccagtttcaactaacagcatagttattctgttagatacaatgcataacctgtcgaaattgcttctgcatcactgctccaatgagtcatctgaattgaaggaacaagatcgcaagtcacttgaaaaagtaataaaaaatcttaatacatgcatgtcaaaaaatgttggacaagaatcatttttaagcgatctacatgaggggacaagcatgggaacgccccaggtggcggctattgatgtctggagtcagcatgtacaagagaaaacgaagcattctggtaagaaagatgagaaatgttcttgtttcatttctttcgaga

SEQ ID NO: 14028 - DNA, 496 bp, Gossypium hirsutum
  Clone ID: uC-gsflnu33B019a11b1
atcactcgggctgttggtctgccaggcatgtctgtgttatatatctcagcatcatgtaatgctgatgatcaaggaaagaagttaattcatgctgtcgtgaacacgcttcttacagttcctctagattctgaaagtaatgctgcagttcaaagtgagactgcagaaattggtagtgcagatcaagatgagacttcataaagtagttctggaggtccaagtgattctggagaagaaaaacctactctactttggagtgcgttgtatagtcaggagctaactttgggtcaagttgattttatctgttcaactaccatgccagatggtaaactgaactacaatgatctcatagatacgactgttaagatatttcaggagattcaccctgaggaagaattctttccggagacatacttagagaatcctgaagttgatggtgatgcttctgcggagacataaagatttactgaatggaatataatctttacctaatggagca

SEQ ID NO: 14029 - DNA, 550 bp, Gossypium hirsutum
  Clone ID: uC-gsflnu33B019b03b1
atcattcttcagcatcacattaacagctcagttggacattcccgagtccatcctcccccacgcctacaatcccttctatcaagtttataccacgttaacccaagattatttggtgcttgagcagcctgcttttttcaaggcacttatgacgttggaacttgtttaccaactccctctcgctttgcttaacatctatgggttgttatactctaagccctggttcaacaccacctgcctcctctttggtgcctctatcgttgcctctacgacagctatggtgggagacattctcaattcccagaaggcatcagccaatttgatggccatgtattatccaccgtttcttccattaggggttctggctatagtgcgaggggttggttggacaatcgagcaaggctgctccatccattggcaatggaccttcgtcggctgtgaaaaagagggcttaaagttgatccccgatcagttcaaacgttttctttagagaccctgctatacaataataggggggattttatctgttgatccgaactaaataggataaaaa

SEQ ID NO: 14030 - DNA, 355 bp, Gossypium hirsutum
  Clone ID: uC-gsflnu33B019b04b1
tttcggcgacgctcggtcccattcattatcccatgaatctttgcctgatactttgggggcttggttagggactgcatatgattctgcgagagatacgacgaggacttctgctgagaatgatggatccattgagggatccctagtgggtgactcagcagtcgactattcagtcttctaagatgtgtgcagagaggagggcactgaggaagtggctgcagcaattgatatcaacagctgtatgactagagagacgtctaatgagccgtacaatggacagaacgtggaagagagcgtgggaaagggcacttgattgggcttttcattaccctatgcactgccatgtacgctgcaaagg

SEQ ID NO: 14031 - DNA, 431 bp, Gossypium hirsutum
  unsure (1)..(431): unsure at all n locations
  Clone ID: uC-gsflnu33B019b05b1
ttcaatccattttcacatttccgatagtttcggctgcgattttctcaattctttagagattttaacttaatttacaatctacattgttcttcgatatcccgatctgccgccgtagataaatggagaaagtgattttagaggaaaaggatgcagttgattggatctatagaggagaaggagctgctaatcttattctcgcttacactggatcgtctcccgcatttattgggaaagtgctgcgaatacaaaagtcgcaacggaacggcaacagtggcgtgaaagaaggcagagctttaacaacgcatgaacggcttctttggcgagaaaataaggagctaacggcgtcgtcaacagagagattctagaacangcttacgtcaaacatgttatgatcccattgttaggccccaaacatgtcgatgttgggattc

SEQ ID NO: 14032 - DNA, 441 bp, Gossypium hirsutum
  unsure (1)..(441): unsure at all n locations
  Clone ID: uC-gsflnu33B019b06b1
cttgcttcagctgagagtcttgacacattcacactaatttattcaaatattcttgagcatcaacctgactgcccgcctgatgttgttgagaagcttgtttcactgcgggaaggcatcccacgcaaagatgcaaaggaggtggtgcaagaatgcaaagaaatctacgagaactcacttgttggtgggaagcctccaaggacaggatttgtgtttccaagggtcaaatgtttgacggcaactaaaggttatatatggcgtaaactcacttaaacattcccacttacccttctttttagattaggggttccttgccgccttttctaatttcttgcttcttgtttatgcatattgtatgctgctattatttgtagtaataaatttgcttttttttttggtagtcaacggngatgaaaaatttcattattttgttatggaattttt

SEQ ID NO: 14033 - DNA, 409 bp, Gossypium hirsutum
  Clone ID: uC-gsflnu33B019b08b1
tttcaatgtgaaatcgaccgtttgtgacatcccacccactgggctgaagatggcatcaacatttattggcaattcaacatccatacaggagatgttcaggcgtgtgagtgagcagttcacagctatgtttaggaggaaggccttcttgcattggtacacaggggaaggcatggatgagatggagttcactgaagctgagagcaacatgaatgatctggtctccgagtatcagcagtaccaagatgcaacagctgatgatgaagagtacgaagaagaagaagaggaacgcgaatatgaggactaaggagaaggaaagatattgccattttggcaattcaaaatctcaactcccagttgctggtgcttttttttttcctgtttggatgtgaaagattagccatttactttt

SEQ ID NO: 14034 - DNA, 540 bp, Gossypium hirsutum
  Clone ID: uC-gsflnu33B019b09b1
ttcaacactactttttagaaattaaaataacacctctattctcttctgtaacagcttaataaaaaatggcggcttcttctagaaggtctagtggtccggttctccgatctcattccccatcttcccggtttacttctttctacgcttcacagtcacactctccatcttcttcttcctccgcttttgcctattccagttcaggtttctcttcacgttcaactttcttcaatcaaccaagatctacttctccaccacgtgttaacctgcacagaaactcttcatcagcgtcatctgtgcggttctcgctcgacaaccgtccgatctcaccgaaccgttcaatcaccaccgtccggagaaccactgaggcgttgaagaatttacagagcaaacagacgaagcggacttgcatgtgttcacctacaacgcatcggggatcgtttccgtgcagtcttcataagagcttcaatacttcgcatgccgggacaggttacgcgccgagtaatcggcttaacgcgcgtagatctgcgatgacgaactcgc

SEQ ID NO: 14035 - DNA, 445 bp, Gossypium hirsutum
  Clone ID: uC-gsflnu33B019b10b1
tctatatttggtggttcaattgcagggttgcactctccttctcagctgtttctcctggatccttcggaggagaaaccatcatggaggacactgaatgttcctgggcaaccaccaaaatttgcttggggacatagtacatgtgtggttggagggaccagggtgttggtgttgggcggacacacgggggaggagtggatactcaatgagttgcatgagttgtgtttagcaagcaggcaggactcggactcaagctgaggtaatttctcccatactattgaatcatatttttgacatgtttcgcctgatgcattgcgttttagttcatattgcataaatttcatttggtggcgccagttctggttgaacaatgtaaaacataaatcgagtgttgagtgattcatcattacttgatttatgtcatttacaaatcaaaatgcccagtcat

SEQ ID NO: 14036 - DNA, 175 bp, Gossypium hirsutum
  Clone ID: uC-gsflnu33B019c01b1
ctacgcgtccgcccacgcgtccgcttaaactcaatttttatggtgactatggctgtgcttactgttttcccattagaacctagcgttagaagagcacattggatgcttctttaacttgttgagacatgaaagattcaaaacctagttatctggaatgttccgagttttctgattt

SEQ ID NO: 14037 - DNA, 415 bp, Gossypium hirsutum
  Clone ID: uC-gsflnu33B019c02b1
attggtgaggagagagcagcaaccatggagttaatcaaagatgcatgcgagaattggggcttctttgaggtgctaaatcatgggattccctatgatttcatggacaaaattgaaagcttgacgaaagagcattacaagaaatgcatggagcaaaggtttaaggaattggtggcaagcaaggcccttgagggtctccaggctgaggttactgatatggactgggaaagtaccttctatttgcgccatctccctgaatcaaatatggctgaaatcccagatctaaccgatgaatacaggaaggtgatgaaagaatttgcattgaaattggagaaactagcagaggagctgctggacttgttctgtgagaaccttggtctcgagaaagggtaccttaaaaggctttctatggggcaaa

SEQ ID NO: 14038 - DNA, 412 bp, Gossypium hirsutum
  unsure (1)..(412): unsure at all n locations
  Clone ID: uC-gsflnu33B019c04b1
ngtcacgcgtccgattttatctaatatatattgtccaaaatgaaagcaatattcctcatattatgcattctcttggcttccattctcgcgtttcccacttccacaatggctcgagaactggctgagaaggaggcaatcccatctccaactcactgtgcactagatcctaatcggagctgtattccaaagagtactccagctcctaagtgcccaacttacagtcgaaactgccattgatattatgttctggaatattatgtttaataaatttgccaacttttgtgttttattggtaaaggaaattagaatctaaagtttcatgtatggtttgtgtgtttgattgatgtgattgtgatgttatttctactgcttgagatatgaaaataataaagaaaagcttgcatattaaaaa

SEQ ID NO: 14039 - DNA, 407 bp, Gossypium hirsutum
  unsure (1)..(407): unsure at all n locations
  Clone ID: uC-gsflnu33B019c05b1
ngtcacgcgtccgcccacgcgtccgcccacgcgtccggtttattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcacgaaaaataacaggcctctgtaatgatatattgtcaaggatggatgcctgcaaggtctataa

SEQ ID NO: 14040 - DNA, 463 bp, Gossypium hirsutum
  Clone ID: uC-gsflnu33B019c07b1
ctagtttcaattttctcacaacaaaactgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttgagggtggatgcccgtgtggagacaactgcaaatgcaacccttgcacttgcgggaagtgaacaacaaagagaagcagagtggcctttgtcattttaactaaataaattctattactttagtatgtatcagcaaatcttcatgaggatttggttcttaattatgtgtaatgtggcttttctgctatgtcagaatgtattatgatatttaagaaagttttgtttctattgaaagaatggcagtttctttctcttggact

SEQ ID NO: 14041 - DNA, 331 bp, Gossypium hirsutum
  Clone ID: uC-gsflnu33B019c08b1
ctttgccagaggccattatacaattgggaaggaaattgtggatctttgccttgaccgtgttaggaagttagctgataactgcactggtttacaagggtttcttgtgttcaatgctgttggtggtggaactggttctggtctgggatctttgttgttagaacgcttgtcggtggattatggtaaaaagtcaaagcttggtttcaccatctaccctttaccacaggtcttaacagctggtggggagccttacaacaagggtctggctacttattcccttcttgagcacaatgatgtgggtgggcttttggattatgaagcaatttattacata

SEQ ID NO: 14042 - DNA, 313 bp, Gossypium hirsutum
  Clone ID: uC-gsflnu33B019d03b1
attggatcaagccgaaaattgctatcactatcacaaaactttgcaacattgctgatcgtcctgttggctaccagtgtggagaatacactttgacttgagcacgaaagctgaactcatggttcccagttttgtcgttggctgaagtctgagctttacgttagctagttcatctagctgatgaattaaccgtgaaatctagctattaggatgataaatagaagcttaaagcttgcgttaataatgaagtattgaaggctagacaggaagcgatcgaattgaccaaatcggttgcaaaataataggggcgcaacgt

SEQ ID NO: 14043 - DNA, 543 bp, Gossypium hirsutum
  Clone ID: uC-gsflnu33B019d04b1
ttaacgcgagtggtagatctaaaaattagccaaaagctgcgtttaacattgagaaaactagataacgccgcggagcggaatatccacagatcggggaatggggtcaacatctttcggtattccagagcataggtttggttccaatggcgagaaaatgccagttttggggttcggaacggcggtcttcccacccgtaggagctgaagctacaaaaatggcaattctccaattaatcaaacttggttataggcattttgatactgctgccaagtacgggtcagagcagccattgggtgaagcaattcaagaagcactttcgattggattaatccaatcccgagacgagctcttcatcactactaagctatggtgcggcgatgctcatggagaccttgttgtccctgccctcaagagaagcttacaaaatctcaagttggagtacctggatctctttttgattcactggcctgtcagctgtaaacccgggacttatgaattcccaataaaggagggaaaacttctttcctatggatttcaattcta

SEQ ID NO: 14044 - DNA, 367 bp, Gossypium hirsutum
  unsure (1)..(367): unsure at all n locations
  Clone ID: uC-gsflnu33B019d06b1
ngtgaatctgaaggcaacttgaagggaattcttggttatgtagacgaagatttagtctcaactgacttcatcggagacaacaggtcaagcatttttgatgccaaggctggaattgctttgaatgacaactttgttaagcttgtgacttggtatgacaacgaatggggttacagttcccgtgttatcgacttgatccgacacatgtctaaggcttaagtgagtgagtgattgtgcttggtgtatccaagctttagcaattttaatttagaagagatgttatgagagaataaacgaattgtacggagcatatttttgtgtgaagaagggttgtttcagttttattacccaagtactcgaatgctttaag

SEQ ID NO: 14045 - DNA, 519 bp, Gossypium hirsutum
  Clone ID: uC-gsflnu33B019d08b1
ctcacgcgtccgcccacgcgtccgcccacgcgtccgggcttacggtggatacctaggcacccagagacgaggaagggcgtagtaagcgacgaaatgcttcggggagttgaaaataagcgtagatccggagattcccgaataggtcaacctttcgaactgctgctgaatccagggctaaaaccattgatctctgcaacaatccaatgacaaaagaaccaaaacttcagggtgctagaagaatagtttctgagtggacagatcttgactttgaggctagaaaattcactgccaaaatattaggtgatgaactggttagtgtgtaatatacctatgggttttgtatgtcgtcaaatgttttacctttagcaggcatgttttcttgaagggaacttgtcattgtgttttcatactttggatcagtgttgaaatattgtctttggtccactctactttctaagtgcgtactgaatgggctgacttattgtataagagatatatgccacgttcttttgttttttt

SEQ ID NO: 14046 - DNA, 521 bp, Gossypium hirsutum
  Clone ID: uC-gsflnu33B019d10b1
tcacgcgtccggtcgtctccttttccaaacaatcaaatgattcagaacccactcttttcgaccatggcagtatcaacattctcttttgctttgagccttgccattttctcaatctgggccgttgatgcagctcaccaccatgcgacagcgccgtccccttcttcttcttcttcatcctcctcttcctccactgtggactgctcgactctgatactgaacatggcggattgtttgtcgttcgtgtcaagtgggagcgaggtgtcgaaaccggaaggaagttgctgttctggattgaaaaccgtgttgaaaacgggccctgagtgtttatgtgaggcatttaagagcagtgcttcaatgggtgtttcattgaatgtcactaaggcctccactttgcctgctgcttgtaaagtttctgctccttcttctactaactgcgctgcatctgtcactccagctggtgccccagatgtggaaccatcagcaacagcaggtgcacccacaacattctctgcagcaaatga

SEQ ID NO: 14047 - DNA, 482 bp, Gossypium hirsutum
  Clone ID: uC-gsflnu33B019d12b1
ttaaataagcgtttgtctcagatttttgaagatggcccgtaccaagcagacagcccgtaagtcgactggtgggaaggctccaaggaagcaacttgctaccaaggctgcccgtaaatctgccccaaccaccggtggtgtgaagaagcctcatcgctaccgtcctggaactgttgctcttcgtgaaattcgaaagtaccaaaagagtactgagcttcttatcaggaaattgcctttccagaggcttgttcgtgaaattgcccaggacttcaagactgatttgcgtttccagagccatgctgttctagctctccaggaagctgcagaggcataccttgtgggtctttttgaagacaccaacctttgtgcgatccacgccaagcgtgtcacaattatgcccaaggacatccagttggctcgtaggatcagaggagagcgtgcttaatttccatgtgtgtggaacagtcgcttagaaagaagaaact

SEQ ID NO: 14048 - DNA, 310 bp, Gossypium hirsutum
  Clone ID: uC-gsflnu33B019e02b1
ttttagcgtccgtgatgaaagccctagattatgaaaaattaaagcagcaaaatcacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaattttccttttgtccaaaggattttttgctgctcattcatggtgacttggtttatggctttatctgttgataaaaccttataaaaatatatatcgattgctgctcttggtttgtctc

SEQ ID NO: 14049 - DNA, 381 bp, Gossypium hirsutum
  Clone ID: uC-gsflnu33B019e03b1
gtcacgcgtccgaccacgcgtccgctctatccgtactcataactgtcactgccgccccactctgaacagaaccccgcattgctatgcatgaaagaagacagtgatgataccaaactaagcctaaaccaacatgcagctggtggccgacagacgcacacaaccacagaggaagatgccccacacgtggaccaccacgtctacatgtagcagccgactaaggacgacctgagctagatgcctccgttgaactttgctatagctgacaatggcatgttgacgtctggctcccctgaccctgccaacttctatgatcttgaaacgcttaagctgacctccatgatgtatctgcggccctgaaccatacccagaagccagacactg

SEQ ID NO: 14050 - DNA, 411 bp, Gossypium hirsutum
  unsure (1)..(411): unsure at all n locations
  Clone ID: uC-gsflnu33B019e05b1
gtcagagaaaaaattcttgatgccattgaagatctaaagcttgattctttggttatgggaagccgtgggcttggaactgttcgaaggattatattggggagtgtgagcaactatgttgtgacgcatgctacttgccctgttaccatcgtcaaggaacaatcaagctccagcaagcactgagtagtttacataatattttctagtttgatttcccaaacaataatttgatggacgagtgtatgttgcttgatcatgttttaccaagtagcttacgcagttttacgtttgtttactgaatcttaaagatatatggtactttgtgagttaatgcactgttatggggacgattataataatgataataatattgctttgtcgaaaaaaaaaaaaaaaaaaaaaaaanaaaaaana

SEQ ID NO: 14051 - DNA, 514 bp, Gossypium hirsutum
  unsure (1)..(514): unsure at all n locations
  Clone ID: uC-gsflnu33B019e06b1
gtagttgcaagcaaaaattaaagagctgaaggaagagaagaacgagcttcgcgacgagaagcagaggctgaaagcagacaaggagcaattggagcagcaagtcaaagccatgagtgcacagccaggcttcttgacgcaccccccttcaatatctgatgcattagctgctcaaaggcaagctgctggaaacaagtagatgcctgatatcggatttccaagtctcgccatgcggcagttcatgacacctgctgcagtcgatacatcacaggatcacgttcttcgccctccagtcgcataatatgaagcttgttgattgatgatttgattcttgtcaccagtctctttatgattgctgcttgttttacttattgctgtcatgatctttggtatattgatataatgttatgtgtgaatgtgagattgtcgagtagccgcatattctatcacgaaaaccggaacttntgatagtatcccttactaagatgcaaattcattaaaccatatttcatgacct

SEQ ID NO: 14052 - DNA, 402 bp, Gossypium hirsutum
  Clone ID: uC-gsflnu33B019e09b1
tcacgcgtccgctgttttcttcaatttgcttctccaaaaagctctttgtttttgtagtagtggtagtagttcagatcttcgtcatcataagtattatatttacgcttttgtttttgcagataaaaaacctacgctgatggctggtcgttacgataaaaatcctttcgacgaggaagaagaagaagttaatccttttgctgatacaacagcaagagggaaggcacctggccagtctaaatttggaggaggtctattttcaacgcgcactgcaagcgttccacctgcctcaaactcaagactttcaccactacctcctgaacctgctggttttagttatgagcgtgaggcaacagttgatatccctcttgatacagcttcaggaggatcacgtaatcaggattt

SEQ ID NO: 14053 - DNA, 327 bp, Gossypium hirsutum
  Clone ID: uC-gsflnu33B019e10b1
tttgttttccccaatatgaggcatgtggcaaatagctgtggaaatggaataagtagccagactgcttgctgtgatgctatggatagctatgtctctcattgcaaaagcagaccctcatcaccaacttacaagctttggattgtgctaccgcactggggttgaagctacagacatataatatcaccaaaaatgtttatagcctatgtcatataagcctcaaggatttctctcttcaaggtggaaggcaggtatctggatgccttctgcccagcttgccctttgatgcgacattcgataaagttttctggaatcagttttatttgcgat

SEQ ID NO: 14054 - DNA, 451 bp, Gossypium hirsutum
  Clone ID: uC-gsflnu33B019e12b1
ttgacgcgtgggcggacgcgtgggcggacgcgtgggcacaatctggctccggttacaaatattaatggtcataattcttaattatgaaaagcctacttcatgatttaagcattttatcttttttcaaaattctctacaaatagcccattaaaacaggagacttgaccgagacgagacagacgtgtgtgtgtaaataggaccatagttgctatatttttcaagttcaacggctgtgtcctaactttggatctaatttttctactcaagttttgtcttatttttattaatgttatgttttttttttcatttttattcttggttataattttcctattttaaaatccatccttccacggatttatttgattgtattgactattattgatgctaaaaaattgtattcggatttaaagaccgttcattgggtggaggatattctattgtatttctc

SEQ ID NO: 14055 - DNA, 423 bp, Gossypium hirsutum
  Clone ID: uC-gsflnu33B019f02b1
gtacgcgtacggcgaatcacgaacggtatctggtgggctgatctaatgagaacgcatgaggtgagggtgggaagagagaatcaaaagacgggctctgttatttaataacgctcggagaagaaggaattttatggggggttaaagctgcgctgtcgagagagatggtgcagattcaagaccagtacctgcgagctctcctccagccaaatcgccgggcggtggtgcatcgacgaccacaccatcgagctcgggctttccaccggatattgttgctgtaccaactactgatgaggatccagtgccagctccaagccagagcaagagctggagcaacaaaggcgagacacaccatgctcgggctgctgcacatgatatgcttggaccttgcggtacaccaaaagaagctcctggacctagccttta

SEQ ID NO: 14056 - DNA, 243 bp, Gossypium hirsutum
  Clone ID: uC-gsflnu33B019f03b1
gtttttagtagtagggaggtctcaagggcaaccctaaagcttgatgatcctcaaactggggactctgaagagctgcgaggatctactgagcatacacgtactcagagcaacttggactggctcatgacttcttatggacatagcatgaaagcacaacaggatccatatggacatgccatcatgctccacaggtactataagaggatgagggcttaatatggcccctatcatgatgagagtgct

SEQ ID NO: 14057 - DNA, 487 bp, Gossypium hirsutum
  Clone ID: uC-gsflnu33B019f04b1
gttttagctgccctattagttactactctagaactgagaaaccagaaatcaaatacaaatactatccgagcgttgttgagctggctgccaactgcgatatcttggttgttgcttgtgcactgactacagagacccaccacatcatcaacagggaagtcatcgatgcattgggtccaaagggtgttcttatcaacatcgggagaggccctcatgttgatgaacccgagctggtttctgcattggttgaacaccgattaggaggtgcagggcttgatgtgtttgaacatgaacctgaagtaccggaagagctttttgggcttgataatgtggtgctcttacctcatgtaggtagcggtacggtggaaacccgccaagctatggctgatcttgtcattgggaacttggaggcacactttctgaagaaaccactattaactcctgtggtttagttgtgcctatattagttgattgccatcttcagatcgat

SEQ ID NO: 14058 - DNA, 363 bp, Gossypium hirsutum
  Clone ID: uC-gsflnu33B019f07b1
tcagccctaatcgggcggtaaattccgtccaaggctatatacggtcgagagaccgatagctaacaagtaccgagagggaaagatgaaaaggatctacgggaaaagagagtatggatgctgccgagttgttacatgaaggtgaagagggcaatttttggaggggaggatcggattcagatgcgaaaaagaggaagaaaaaggagaagaagctcaaggagaaacattatggtggtgctgatgagaaaggaactgttgaaaaggtggggaagtgtgaggaagtcaatgagatgtgggaatgggttaatcctgagaatgatcaagacggtgctaggactatggatgatgaggatttgatagatgaca

SEQ ID NO: 14059 - DNA, 405 bp, Gossypium hirsutum
  Clone ID: uC-gsflnu33B019f09b1
tcaggagggagaacacacttcgtggaatcatgtggtttgcctttaagcacttattttagtgcagtgaagctgctatggttgatggagaacaaggaagaggttagagctgctattaaaaaaggggatgccttgtttggaactatagacacatggttaatctggaacttaactggcggtgtaaatggtgggatacatgtcactgatgtctctaatgcatcacggacgatgctcatgaatctccaaactctcgattgggataaagcgacgttgaaaactcttggaataccagctgaaattctgccaaaaattgtaagtaatgctgaggtcattggtaaaatcgccaaagggtggcctctttttggtgtcccgattgcaggatgtcttggtgatcaacatgctgcaatg

SEQ ID NO: 14060 - DNA, 380 bp, Gossypium hirsutum
  Clone ID: uC-gsflnu33B019f12b1
gtcattaccgcgtcgactctttcttaggttcattgcctttaaataactgaaacgtaccttagttgggaattaaagtaaactatggtgctataaaatatcaattactgaagcatgagtcgtatacgtttacatgcaggttcttgagggtcaaatgtattatagcggatatggggttcccggggatgcccaaaagggaagaatggggatgacatgtacaggaaccgatgttaccttctgtttggaaagacagcgataagctttcatggtgtaacgcaagtgaattagattgggctgaaattaacggcgattctagagggaaacatactgggtctctgaatttagaacatttagaatacatccacatggtggagatgcctgat

SEQ ID NO: 14061 - DNA, 449 bp, Gossypium hirsutum
  Clone ID: uC-gsflnu33B019g04b1
gttggagagcggacgcccttaatttttttattggtttttatctagggaactcacatgcactaaaacattaaaggatggatacattagggtaggcgagagtcatcattgttaacatctaaacataaactacataacattccttagccaaatggtaaaaccattatttagtatctatacccaaggggcattcctagtctgtccaacctacccgaaccggggtaagctttgctggcgaagttggcatgcatggcaaacctttgggtagttgatttcaattcaccaaaaccatgaatggagtacctctttgtggaactagaactttcataatgaggcctctgttatggagcactgcaagaacttaccttaggttttgacgataagtgttagacatgatatttggatggtatgagaacccattaggcagcttctatgccaacaatttttaccgg

SEQ ID NO: 14062 - DNA, 398 bp, Gossypium hirsutum
  Clone ID: uC-gsflnu33B019g05b1
ttacgcgtccggacatagaaagccaagagatgcttagacaaggatacactcatgccttcttgatgacgttcgaaaagaaagaagattacactgcatttaccagccatcccagtcacattgaattctccgccacttttgttactgccattgacaagttcgtggtgcttgatttcccttcggttcttgcaaaatctccggcttgatctgcaagaaagaaaaaagctacccaggaatttaagtgttttgagtatttgttatgtttaatctctctgttgcttgcatctctatgttttctgcttatgtgatatggctttctgccattgctatcaattccccaataatcacaatttgtattattgatatgcaaaaattcacatgccatttgctttttttctttg

SEQ ID NO: 14063 - DNA, 360 bp, Gossypium hirsutum
  Clone ID: uC-gsflnu33B019g08b1
ctcacgcgtccgcccacgcgtccgaaaaaaaaaaaaaatttaaaaaaaataaaaaaaaaaaaaaaaaaaaaaaaaaaaaaaaaaaaggtcggttttttaggaggaataaaactttcgttcgcgggggggggaggttttgaggtattaaagttgggcacccttaatcagactaaactgtcaattgggggggggggtttttaggggaaaaaacttggcgccccctgaccgagttggcttgtggtttattttggggggagccagatgattttcgggggggggggtttgcccctttggggcttggaaaaagttggggaaccccgatttatgttgtttcacacaattttttttttaattaagggg

SEQ ID NO: 14064 - DNA, 53 bp, Gossypium hirsutum
  Clone ID: uC-gsflnu33B019g10b1
tcacgcgtccgcccacgcgtccgactagagatacatagcgagcggtctatatg

SEQ ID NO: 14065 - DNA, 456 bp, Gossypium hirsutum
  unsure (1)..(456): unsure at all n locations
  Clone ID: uC-gsflnu33B019g11b1
ttctagtgtcctggaggaattggcaaaggcaataaatttggtccatattcgacaggatcttgttgaaagtggtcatgcactattgaaccatgcttaccgtgctcaacaagaatatgcaaggacaacaaattattgtttgaatttggcagctgagcaagataagattgtcatagagaaatggctacctgaacttaaaactgcaattttgaatgctcagaagtgcttggaggactgcaaatatgtcaggggtttgctggacgagtggtgggagcaaccggcatcaactgttgtagattgggtcacagttgacagacaaaatgttggagcctggcattctcacgtgaagcaacttcttgcattttatgatatggaagttttgtgaactgttatngntaaatattcattctccctttgtcaatggttgggtatcactttttttttttttacactaaagcc

SEQ ID NO: 14066 - DNA, 454 bp, Gossypium hirsutum
  Clone ID: uC-gsflnu33B019h01b1
tcttttttactcattcattctttagtttcaatatcaaagcaaaaatggcttcttcttgtaatgttgtttcaatggctttactggcttgtttggtgttgaactccttggtttttgttgcccatggtggtgacttttaccaggatttcgacctaacatggggtgacaaaagaggcaagattttcaatggtggcaagctcttgtctttgtctttagacagggtttcagggtctggttttaaatccaagaaagagtatttgtttggaaggattgatatgcaactcaagcttgttgctggcaactcagctggcactgtcactgcttattatctgtcatctcaagggccaacccatgatgagatagactttgaatttttagggaatctgagtggtgacccttacattttacacaccaatgtcttcacacaaggcaaaggcaacagaggacaacagtttta

SEQ ID NO: 14067 - DNA, 339 bp, Gossypium hirsutum
  Clone ID: uC-gsflnu33B019h02b1
tcgaataatcaaagaaacagaggaaagtgaaagaaaatcgagagaaaaaaaatggggcttgaagaaaatctcaaatcaatgaacatcaacgaagaagagaacaagaaccctaaccctaacactaaagatgaagaagatggtgaacttgaagaaggggagatcgcaggtgaagaagatgatacgacgtcgtcttcgttaaagaaaggtggcgcctaacaacctcaccagtgggggcattcatggaccttttggcttgataacacttgtgctaatcaaaacaagttcccttggggagaattatgctgctttttaacgctttcttctccaacctaacaattt

SEQ ID NO: 14068 - DNA, 488 bp, Gossypium hirsutum
  unsure (1)..(488): unsure at all n locations
  Clone ID: uC-gsflnu33B019h04b1
tttatttggtcttttcttggccttgggatgaccacttatacagcttggtacttggctattgccgccctcgttcacggccaggctgagggcgtgacgcatagcggtccgacgaagcttgtgctttatttcaccggagccaccaacattctctacactttcggcggacatgccgtcaccgtggaaattatgcatgcaatgtggaagcctcaaaaattcaagtacatatatttattggccacactttacgtttttacccttacacttccgtcagctgctgccgtttactgggccttcggtgacgaactcctcaaccattccaatgccttctctctcctccctaagaatggcttccgtgacgccgccgttatcttaatgcttattcaccagttcataacatttgggtttgcttgcacaccgctgtacttcgtgtgggagaaagtaatagggatgcatgacactaaaagcanttgtttgagggcattggcacg

SEQ ID NO: 14069 - DNA, 417 bp, Gossypium hirsutum
  Clone ID: uC-gsflnu33B019h05b1
ttggtaacaatgagtacaacaatgttgagaagcaaggtatgagtgatactaggtacttggagaatgggaagtactactatcgtgtgggttctgagaacaactactacccgaaccggttcgagaactcgaggggagtcggttcgaggaacgagttcaacgagaaccgttacaataacatgggaaagtacaatcagaatcaagaggagttcgaagaagagttcgagccatgaaaccatacgtatatgctaattaattagcaaaatgagagtaaagaattaaaggctttatttattgggttttgtgttttactttgtgatctttttttattttatttgcagggtttgatagcatcctttgcttttgatattgaaatgctaaaagatattgatatgggagcctaatggctttacttttctt

SEQ ID NO: 14070 - DNA, 489 bp, Gossypium hirsutum
  Clone ID: uC-gsflnu33B019h08b1
ttcacgcgtccgcttcctttgaggatgacactagcaatccatgtggagttgccttgaagaggatggctggcctactggacaagtcggaaaggagcatacagaggcttatcaaactgagaaattcagtaatccgttcttatcaggagtgtaagattccagttgattggatgcttgattccggaatggtgtataaaataaagcaggcttctatgaagctggtcacaatgtacataaagagagtgggaacggagcttcaattggtacgcagtttagacaaggaatctgcacaagaggcactgcttcttcaaggcatgcattttgcaaatagggctcaccagtttgctggagatcttgattcagaaacactgtgtgcttttgaagagatcaaggaatgcattccaggacacctggtaggatccaaagaattgttggcaggaatatcatcagcctgagtcgcattgttagttaatagaattgatttatcatcag

SEQ ID NO: 14071 - DNA, 457 bp, Gossypium hirsutum
  Clone ID: uC-gsflnu33B019h10b1
tttaacctcccctctttgtgctccttagccgaatcccaagagttcctcttgactccggtctaccaccatgaatggagactaagccgttcgaactttggagtccctgtttcagtcttaagaccccctctacagttcgattccggcgaagaggaagggatctcgtggcgcgttttctagggaaggcgttacccttctttttttttgatgtaaaatgaaaacgaatcaactgaaataggtataagaacaggggattaaaagaagagggaaaaccaccttctctgcttttcgattgattgtgttctatgcgtgttcttacaatatgtctttgtatttttgttttttttttttggttgcttcaaaaaaaatacctaggctattacatggcttttatagccgaaacagaatcaaaaagatcccaaaaataaaaataaaaattcgaatacaattctttttccta

SEQ ID NO: 14072 - DNA, 420 bp, Gossypium hirsutum
  Clone ID: uC-gsflnu33B019h11b1
ttacctgaaccgcacgctcataaagattttggtatgtttggggatacgagtgctgtataagaagctacgtcatcacagagacgctcggaaccatagccgcaaatactgcttgatagaggcattcaacggctgaactgcctataacgaaggatggtgttgatctatggcttacagatgggatgagtgctgagcgttgcggaacatgagcttacatacacatagccgccgtatttgaatgtggtggctctgtgggatgagagctagatttgatcgtcatcagatgccacatgagatcctagatgtgtccgcagaccttgcagcttgacgtgtggaaccacatgaagacacacacgctaatgtgacatgtgactatcacgaactgtggtgagatgacaaacatacacaggctcttagtacata

SEQ ID NO: 14073 - DNA, 482 bp, Gossypium hirsutum
  Clone ID: uC-gsflnu33B019h12b1
tttttcttacggtgattttaacattagcaatagagttcatggtagacgctcagagtctggtggtgagcgcaaagagactggtgcacaaagtgcacctgattatataaaaaatgttagtgagcctctcactgcttcgttatatgtaccgagaaatgataagcttgtgaaaattgatggcaatctgataattcattcagttctagccagtgagaaagctttggcctcacataaggcttctgaaagaaagaataaggagacaggtttggccattcctaagaatttctctccagcactggccattcctaatgccagagagaatggaggaaagcattcacgtgaatatagaaatcctgcagaaagaccgatggctctttcttcaggctctgctgatgctttgaaggaccatatcaggtcaactgctgccgatggtaagatgcgcagtggttccgggaggagtggcaggaccgatgtgagttcggcat

SEQ ID NO: 14074 - DNA, 527 bp, Gossypium hirsutum
  unsure (1)..(527): unsure at all n locations
  Clone ID: uC-gsflnu33B022a01b1
tcaggtaacacggcttagatgcggtggttttatcttcgcccttcgcctgaaccacaccatgagtgatgctgctggcctagctcaattcatgtctgctgtaggagaaatggctcgtggtaggcttaccccatccattccacccgtatgggaaaggcatctgttgggggctagagatccaccgagagtcacatgtaagcattgtgagtacgaagaagtagagggaaccattgtcccctacgacgacatggtccatcggtcctttttctttggcctcacggaagtctcagcacttcgcaaacttgtgccaaaacaccttcgtaagtgttcaacatttgagctattgactgcttgtttatggcgttgtcgaaccatcgcaattcaagctaatcccgaggaagaggtacgtattatatgcatcgtaaacgcacgttccaggtttaatcctccattaccttcggngtactatgggaatgcattcgcgttcccagtggcagtagcacaagcagggaaactttgtcaaaacccat

SEQ ID NO: 14075 - DNA, 159 bp, Gossypium hirsutum
  Clone ID: uC-gsflnu33B022a02b1
acgcgtccgcccacgcgtccgcccacgcgtccggaaatggcagtaactttctgtttaggtagctttatgttaaaactagcttttattcctgtttcgtcctttgtacatcataatgtcagcttcaacttctagtctaataaaagcttgtttgagggtccc

SEQ ID NO: 14076 - DNA, 405 bp, Gossypium hirsutum
  Clone ID: uC-gsflnu33B022a05b1
tttggacaatggtagctggaggaggtgcaagtgtcatctacgctgacacggttggagatcttggttttgcttctgagctcggaaattatgcagaatacagtggagcacccaacgaagaggaagtattgcagtatgccagagtagttattgattgtgcaaccgcagaccctgatggtcgcaaaagagccctcgtaattggcggaggaatagccaactttactgatgtcggtgctacatttaacggcattatccgagccttgaaggagaaggaatcaaagctcaaagccgctcggatgatgatatacgtgaggagaggaggtccaaattaccagagaggcctcgcgaaaatgcgggcacttggagaggaaatcggaatccctatcgaggcttatggtcccgaagcta

SEQ ID NO: 14077 - DNA, 347 bp, Gossypium hirsutum
  Clone ID: uC-gsflnu33B022a06b1
gcaaagatatcaccgagctaattgcatctggatgggaagagttggcttcagtcccttcaggtgggggtgctgttgctgctgctcctaccgcaggtggcggtggtgccagtgctgtaccagctgctgaggccatgaaagaggagaaggtcgatgagaagtaagagtccgatgattatatgggtttcaatctttttcttttatcctctttctgctcatcttatcggtctctctattcgcagatatgcaatatataatcatgtattttttgattaatttatattatttttcatcttcctaatttcatcttttttattttattctttcctatttctctttttctattctta

SEQ ID NO: 14078 - DNA, 138 bp, Gossypium hirsutum
  Clone ID: uC-gsflnu33B022a08b1
ggaagacagtgcttattatggaacttatcaacaatgttgctaaagcccacggtggtttctcagtgtttgccggtgatggagaacgtactagagagggtaatgacttgtatagggaaatgactgcgagcttttatctct

SEQ ID NO: 14079 - DNA, 308 bp, Gossypium hirsutum
  Clone ID: uC-gsflnu33B022a09b1
ctaaagaggtcatcgtaaattcgagtacaaagcgctaaccgagatgagagccaagtggaagaagaagcgtatgaggaggctgaagaggaagcgccgaaagatgagacagagatccaagtagatgcgccttggactgaattagttttgccctgacaatcccttgtcttcataattatcctgcatatgttgcatgaagttgtgaagattgaagggtattttcaggcaaccttatctgttttgtcttctatatctcggttaaagttttaagactgtttgagatgtttgcctagtactattagacatttatg

SEQ ID NO: 14080 - DNA, 532 bp, Gossypium hirsutum
  Clone ID: uC-gsflnu33B022a11b1
acgcgtccgcgagctctctcttacagcttggatatgcttgatgggaacgatcgaaaatgcagtagcgtcccttatcatggtccggggtataagtgcttggaaactaggttgggattcaaggctccttgctgcgtcttactctggaatagtttgctctgggattgcgtattacgtgcaaggagtggtgatccgggaacgaggaccggtgttccttacgtcattcagccctctatgcatgataatcactgctgctctcggtacctttgttttatcagaacaagtccaccttggaagcattcttggagccattatcatagtctcagggctttacactgtggtgtggggtaaaagcaaagatgggaaaagcccagaaagtgatgagaaaagcaaaggcctgcaagaattgccaatcacaaacaatgctaaatcaatcaatgttgatgagagcattgatggagatgccaaaattgttaagattccagcttcaaacagaccctttagcacttaaggaaacatataacatttccttaat

SEQ ID NO: 14081 - DNA, 504 bp, Gossypium hirsutum
  Clone ID: uC-gsflnu33B022a12b1
acatcgaagggtaggcgggctcgatcagacatgatggacaaacgtgaacgaggcgtccagcaggtcacactgcttaacaagaatcgtcatttctcgacgtggggatactccggaagctaaaccgaaaataagcaaattatggatggttgatcttggagggagtgaacggttactcaaaaccggagcaactggacaaacccttgatgaaggaagggctataaatctttccctttctgctttaggcgatgttattgctgctctaagaaggaaaaagggccatgtgccatacagaaatagcaagttaactcaaatcctcaaagattccttaggtgttcggttcgaaagttttgatgctcgttcacataagcccgtgtcaggaaagatctcgaggaaaccatcttgtttttgagctttgcaaagagggcaaaagcagtggactcttgcagaagactacctgaggacttgaagaagctaagagaaaaacgggatattgagcttggagag

SEQ ID NO: 14082 - DNA, 494 bp, Gossypium hirsutum
  Clone ID: uC-gsflnu33B022b01b1
gagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttcgttgggaggcccttatattcctctcaaaactggaagaagagacggtagaaggagcagagcag

SEQ ID NO: 14083 - DNA, 510 bp, Gossypium hirsutum
  unsure (1)..(510): unsure at all n locations
  Clone ID: uC-gsflnu33B022b02b1
acgcgtggggtcgcagatgcctccaactatgattctgttaacaactttgctcaacttatgtggcctaatggccagccacgctttactgacactatacataccctagcgacgcaaatggaggagctgaacaagttaatttggttaatgctaactgatagttacggattacaggaggattcactgaagatgaactacaaaacgttggtgcggatgatgaaatacctggcccctccgcctggggagtatgagagaggattctttgctcatactgataaaccaattagcacactcatttgtgaggacaaatcagggctggaaattgaggtcaataatgaccaatggattaagttgactaatttatctccttcttcctttgtttttattggtggagatcctctcaaggcatggagtaatgggagattgaaaccagtgaatcacagagtgatgatgagcggagacanagatcgatattctatagcagcctttatcattccaaatgaaggtacaata

SEQ ID NO: 14084 - DNA, 278 bp, Gossypium hirsutum
  Clone ID: uC-gsflnu33B022b04b1
gtttcacctcatgcgatgctcaaatagaaggaaagaagaaaaagagaggaggaggaagaagaagaagaagaagaagaagcaataggtttcattgttgatggatttaactgaaggagttggagagagttcatcgccgccgagaagcttcggtaactttaacaactacgatatcagaactgacgttttcaatcgcttagttgaaatcggctacgaagaagctatttcgaactctgactttcgcaacaaagaaacaacaagtttcacctcatgcgatgctc

SEQ ID NO: 14085 - DNA, 153 bp, Gossypium hirsutum
  Clone ID: uC-gsflnu33B022b05b1
ttttttcccttctcaatcatgtgttttgcaactgttgaagttttagttttatggagttttagttttgttttgtttttatgttatgaatgagtaatacaatgaggaatgtgggatttggtaggcttgataatgctatatgttggttttgacttt

SEQ ID NO: 14086 - DNA, 538 bp, Gossypium hirsutum
  unsure (1)..(538): unsure at all n locations
  Clone ID: uC-gsflnu33B022b06b1
ggacgcgtgggttttcccctttgattctccttctcttccttattctttgtttcttttttttttgattttggggttcctctatttcctgtaaagcttgaatttttagaaccaaaaaaatattactatatttttttgcataaacaaataaataaaagagacagctttggagcagaagggtagagagaaagggagtttttctgcaaagcatcatgaaccagaaggctaatgtttctaaagaacttaactctaaacacacaaagatattggatggacttcttaagttgcctgagaatcgagaatgtgcagactgcaaaagcaaggcgccacggtgggctagtgttaatcttggaatattcatttgcatgcaatgttcagggattcatagaagtcttggagtacacatatctaaggtgagatcagccactttagatacatggcttccggaacagatttcatttattcaatccatggngaacaagaaatctaatatttactgggaaagcgagttgcctcccaactatgacagggtnggaatcga

SEQ ID NO: 14087 - DNA, 332 bp, Gossypium hirsutum
  Clone ID: uC-gsflnu33B022b11b1
accggacagtctgaagggtacggattcgtggagtttgagctctcgagcaacgggtgaaaaggttttacagagctgtaatggttctctgatgccaaatacagagcagcctttccatctgaactgggcctcgttcggtgtgaacgaaagacgatctgatgctggctctgatctgtctatattcgtaggagatttggctgccgatgtaactgatacggtgttgcatgaaaccttttctagtaaatttcaatcggtcaaaggagcaaaagttgttatcgattcgaataccggtcgttcgaaaggttatggcttcgttcgattcggcgatgaaaatg

SEQ ID NO: 14088 - DNA, 449 bp, Gossypium hirsutum
  Clone ID: uC-gsflnu33B022c01b1
acgcgtccgctgtggtgtccttgagttcttctccaacaacaccaatgagcccatttgttggtttctctgagcttgcagggaaagcaggtggtgagaggcgcactactgcagtctcaatgcccagtctatctgagaatcaaaaacaggatggtgatgctggggctaagtttacttcttccaatgcgcagttgactccaaccgctgatttcattccaacttcgggtttgggatgtactcatctctggctgcagagtcgagtaccactaggatgtgttcctgctcaatctacggctaccattaagcttgagctacttccgttgactgatggcataatcactcttgacacattacagatttatgttaaggagaaaggtcttatatatatccctgagcactcattgatgataaatgcgacttctagcatcttcacagggattatttaggatgga

SEQ ID NO: 14089 - DNA, 127 bp, Gossypium hirsutum
  Clone ID: uC-gsflnu33B022c02b1
cgcgtccgcccacgcgtccgcccacgcgtacgcccacgcgtccgcggacgcgtgggctgagacccattttagaccggccacaacgacgacgactgcgtctcgactgcgcgctaccaccgataagaac

SEQ ID NO: 14090 - DNA, 493 bp, Gossypium hirsutum
  Clone ID: uC-gsflnu33B022c03b1
agcagaggttaaataaggaatggaaggtgaggaattcgcagtgggttgcttcctttcaattaagacaactttgggcgacgaatttgaaggtcaaattatcagtttcgaccgcctctccaacatcctcgtacttcaggagggtttggaatcaggacccagaaggaacattcggctgctgaaggctaattacattaaagagttctctttgttgcgccaagatgaagatcctcttgatgttaagaaatgttttttagaccttactagccttcaagcaagagaagattctgctattaggcaagctgaggccgattcagagagatttggggttggagttaccagtgaggcacagactctttttgatgccttgtctaaaacgctacctgttcgctgggacaagactgtatttggtgaatgaatgaggtgcgtgtgagcagtccatatctccccgagtttgtagtggaggaactcctgcaggcaatgaacgagtgagaaa

SEQ ID NO: 14091 - DNA, 440 bp, Gossypium hirsutum
  Clone ID: uC-gsflnu33B022c04b1
acgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaacacgaaaaattaaaaaaaaaaaacaaatataaaaaaaaaaaggggggggctctttttagggggtatccctgatcattccgcccccgcctgttttcaaacccttacattttttcttctgcttggggccgccgtaaaaaacactcctctgttttggcgatttccacgtactggtgtggggccccccttgcgttccccttttttaggggtttaaccggcctctccccctttttcttctgggctttaaaacgaacctgtcccccccgtgggcctttttaaaaatgcgccccgcccggctggtttttcggcccccccccgttccgggtctttttattggc

SEQ ID NO: 14092 - DNA, 146 bp, Gossypium hirsutum
  Clone ID: uC-gsflnu33B022c05b1
cacgcgtccggacagagaacaggaggggtctcagtgaattggttttagagccgttgagagatgaacaatattacgagattagggaacctttctccataatgtcggttgtgaaaagcccaatgggtctcatggtgggatttatgctg

SEQ ID NO: 14093 - DNA, 448 bp, Gossypium hirsutum
  Clone ID: uC-gsflnu33B022c06b1
aaaaagaaaggcggaaacttatcgaaggagcggaaataaaagatgattcaccggaaatggagtttgctaacaggcccagttgtcatcctcggcggcgttgtgggagccaccgtcgtcgctcactttctctttgttgacgatccatatcttaaaccaaagaagaatactgattcaccaccacaaaccaagtagaaagaagccgacggtcgctgttggcatttggagcaaagaaatgcctaggtcgctgtttaaaacatgagttgtttgttgaataatgtcaaatctgtttgttttgtaatttgggttagcttctgttttctctttcttaaataacaactcaactacaaagttcttgaacacttgcattgaatctcagaacattgcttaaagttgcaccagacagactactttgcaaatagactttgataaagcaggttccacctattgg

SEQ ID NO: 14094 - DNA, 386 bp, Gossypium hirsutum
  Clone ID: uC-gsflnu33B022c09b1
gaccatctctggcgttcttgacaggtttgccgccatgggtattgacacccctggagtcgttgccctcctaggagctcacagtgtcggcagaactcactgtgtgaagctggtgcatcgtttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatactggacaacaagggtttgttgattgaggatcaccaactggcgaacgacataaggaccagacctttatgtgtagaaaatggtcaagtgccaatactatttctttcaaggagtt

SEQ ID NO: 14095 - DNA, 409 bp, Gossypium hirsutum
  Clone ID: uC-gsflnu33B022d01b1
cgcgtgggtttgaactttgaagcactgagttgatcatctagagagtttatattgtgttctctcatataacatatcaacatgcccttttttggacataactacccatctagttcttcagttttcagaccatcgatagcatatctttgtcatgtgtctgtttctgtagtacaagacctttttggtgttgtggtggttaatgcagagaggtatagacaatttctgcaaatggcacccttttaggttatggatattacaacattataatatggattttttaatgcataaaactttgccttttcatggtttcttcctttttgcatttgtgttgaatatgaatatgatccctgtgttgcaattaactaacaccaattgattcgtcctatttaaagccatcttataattcttcctc

SEQ ID NO: 14096 - DNA, 299 bp, Gossypium hirsutum
  Clone ID: uC-gsflnu33B022d02b1
ttttagaagaaaaatcccaaaattttcagcttttcttctcttctagaaatggcccaagttagcatgttgaaggcttttttattggcttttgtaatggcaatcctaaccgttgcctcggcgcaggttagtgaggcgccgtcaccgtcgccagacgctggagctggattctcagtcggagtttctaccgccgccattggcttctctttgatcgtttcccttcttgctttcttcaagcattaaattgaagggcttgtttggctctcctctctgtgtggctctcttttatatatatatatatg

SEQ ID NO: 14097 - DNA, 425 bp, Gossypium hirsutum
  Clone ID: uC-gsflnu33B022d03b1
acgcgtccgcccacgcgtccgaaaaaaaaaaaaaattaaaaaaaaaaaaaaaaaaaaaaaaaaaaaaaaaaaagaaaaaaaaaaaaaaaaaaaaaagaaaaaaaaaaacaaaaaactaaaaaaaaaataaagaggaaaaaaaggggggggccgttttatggatcccgattttcagtccggggccttgccgccgacattgttttttttggggcacctaaaattaattgcttggcccggctttaaaacgaagggcttgggaaacccccgggtgtgccccacttaattttctttgcacaaatacccctttatgcaggtgggtataataccaaaaggtcctcgccaaatcccttttcaaaaaattggtcaacccgatagggtgatgggcccccccccttacccccgcttaaaaggggggggggggtggg

SEQ ID NO: 14098 - DNA, 284 bp, Gossypium hirsutum
  Clone ID: uC-gsflnu33B022d05b1
tgacttgtcggtctcagaatatgtctgaccattttggaattattgctgtgtctacgctcgttaaaatgttgggggttttcatgttcttatgcttctagcaaactttgtcatttgttcttgtagattaagaatcattgataaaattctcactttacattgaatgccttggccgatggaaaaatacaatgttatccccaatctcgaggccactcctttgttgatcgtctgtccctctgctagatgaatagaactgggcgtcctgactatgcgagccagtctttctg

SEQ ID NO: 14099 - DNA, 279 bp, Gossypium hirsutum
  Clone ID: uC-gsflnu33B022d07b1
ccctggagtttttctcatggcctacgtcgagggaggtgttttgaaatcaaagcgttcaatatggcgactgagaactatcactgattttttctgggcaattatcaatttcattggagtgttcttctcgaccatgttctcgatggaaaagtccgatgcctacagaaaaggctttggttcaagcaagaaatgggatgatggtccaggaggacctggaagtggaccatatggtggaggtgcccttttcatatttattcatctcttttatatttatctcttttt

SEQ ID NO: 14100 - DNA, 286 bp, Gossypium hirsutum
  Clone ID: uC-gsflnu33B022d09b1
ggataccgtcttaataattcacgacggtatccatcaggccgcgtgggaaagccaagaaagaggtgatcatgcaaagaacatgttcaccatacaaaggattctatagtagtggccttatttataacttaaaagactgatgcaaaaaacaggggatacaaattcacgaagcataaatgttttagttagctgccgaagagctgtgaaattaactgaacatcaaatatggatgtagtctttcttatcgttaccatattgaaccatgacccttttcttttttatgtaccaa

SEQ ID NO: 14101 - DNA, 313 bp, Gossypium hirsutum
  Clone ID: uC-gsflnu33B022d12b1
cacgcataatggttgtggattcgatgagaggatctaaaggaccgtgagtcaccttcatcgatgcaaggtgggctgagagttctgactcaaggatcatatcgcatgccgaggtttataatgttaagagatgtgtaatttgctcattcaactatgaaagcattctagaatttgattcttgtgtttgacatgtagcgttgcctttgtctgattacctttacatgtgaccctctgctttatgtttggaattctctatcttaatgttgctcgattgctctttgacagagtgcattgaatacaaacgcttttattatct

SEQ ID NO: 14102 - DNA, 253 bp, Gossypium hirsutum
  Clone ID: uC-gsflnu33B022e01b1
attctcattacaaagcatgtttatatgctgggattaatatcagtggcatcaatggagaagtgatgcccggacagtgggaatttcaagttggtccggcagttggcatttctgccggagatgagttgtgggttgcacgttacattttggagaggattacagagattgctggagtggtgctttcttttgatcctaagtcaattcagggtgtctgtaatggcgccggtgctcacacaaattactgttctgaattcca

SEQ ID NO: 14103 - DNA, 390 bp, Gossypium hirsutum
  unsure (1)..(390): unsure at all n locations
  Clone ID: uC-gsflnu33B022e05b1
acgcgtgggcttcaccaaagaaatcctctccttaattgtgtactataagtaatgattctccactaaaacctgtcacaatctagccactcttctgatgattatcaattacatatgtatatctttttgttcattacgattataaattatatatacagttaaataatctacctaaacagtgtgggctttctcttggttgtttgtagagtgattgactgtaccattgtcaataagaagctcccgtgaatgtgacacaattattgtactatataataaatccaatcctggggtcatctgattccaacaggtttattctctttaaaaaaaaaaagaaaacaaaaaaacaagtaaaaaaaacccccannaaaaaaaaaaaaaaaacaaaacaagcaa

SEQ ID NO: 14104 - DNA, 523 bp, Gossypium hirsutum
  Clone ID: uC-gsflnu33B022e08b1
cacgcgtccgctcctatactcaacttcttccacttaaaagcaagttagctagctagggttttgtgagccagagagatgggttcaaaaagaacggcatcactagccctcttctttgcactcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtcccactttccctcagctggcttcttaatgtctgctcaaagaaagtaccctctggcttccaatgtcgctaaatcagttctctaaattctttctcttcttagtgct

SEQ ID NO: 14105 - DNA, 523 bp, Gossypium hirsutum
  Clone ID: uC-gsflnu33B022e11b1
cacgcgtccggaaagaatcacaaatgaaatcccgtcctgctaaaagtggcaagactattgagctggatgatgttactttccatcaatgtgtaaatcttacaagattcaactctgaaaagactgttagttttgtgccaccagatggtgaatttgaattaatgaagtaccgtatcactgagggagttaatcttccttttcgggtattaccaacaatcaaggaacttggtcgaacacggatggaagtaaatgttaaggttaaaagtgtctttggagcaaaaatgtttgctcttggagttgttgtcaaaattcctgtccctaaacaaacagcaaagacaagtttccaagtaacatcaggtcgagcaaagtacaatgcggctattgattgcttggtattggaagataagaaaattccccggacaaacagagccaaccttgagtgcagaagttgagttaatttccaccatggcagataagaagtcttggacaaagccaccaattcagatggaatttcagggtccgatgt

SEQ ID NO: 14106 - DNA, 515 bp, Gossypium hirsutum
  Clone ID: uC-gsflnu33B022e12b1
cacgcgtccgcccacgcgtccggaaaaattctcttccttttttttattccttcctttttcctttcatccaatcgaccaaattcagagcttacaaaagaaaaatggccggaatcggacctttaactcaagactgggagcccgtcgttattcggaaaaagcccccaaacgctgccaccaagaaggatgagaaagtcgttaacgccgcccgtcgagccggtgccgagatcgaatccgtcaagaaatcgaatgctgggacgaacaaggcagcatcgagtagcactactttgaatacaaggaaacttgatgaggaaactgaaaatcttgctcatgaacgagtgccaactgaactgaagaaagccatcatgcatgctcgaatggagaagaaactcacccagtctcaacttgctcagatgatcaatgaaaagccccagattatacaagagtacgaatccggaaaagctattcctaaccaacagattataggtaaactcgagagggcacttggtgcaaagctg

SEQ ID NO: 14107 - DNA, 60 bp, Gossypium hirsutum
  Clone ID: uC-gsflnu33B022f01b1
acattagggattgaattgaacccgagcttttatgttgcacaatacaaagtattttggcat

SEQ ID NO: 14108 - DNA, 515 bp, Gossypium hirsutum
  Clone ID: uC-gsflnu33B022f02b1
caatctctggttttgagggtgacaacatgatcgagagatctacaaacctcgattggtacaagggtcctactctccttgaggctcttgaccagatcaccgagcccaagaggccctcggataagccactccgtcttccacttcaggatgtctacaagattggtggtattggaactgtccctgttggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaaaaacgttgctgttaaggatcttaaacgtggttttgttgcttcaaactccaaggatgatccggccaaggaagctgccaactttacctctcaggttatcatcatgaaccaccctggccaaattggaaatggttatgccccagtcctcgactgccacacctctcacattgctgtcaaattttccgaactg

SEQ ID NO: 14109 - DNA, 499 bp, Gossypium hirsutum
  Clone ID: uC-gsflnu33B022f03b1
gcaccattggcaattggtttcatcgtgggggccaacattttggcaggaggtgccttcgatggagcctcaatgaacccagctgtttcattcggaccagccttggttagctggacatgggacaaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttgaaaccggattttctccgatcacatttgagtctcctatctctttccttgtattttgtgtttaatttgtggccgtcgatcttgtttacttttttgttttttttcattcccatcctctatcatgatcatcatgaatggcagatgtttacaattgcatgccctgaaaaaatggtatatgagtgactcactgtaattcttttttcttatattattgaaaaccagcgtcagggc

SEQ ID NO: 14110 - DNA, 407 bp, Gossypium hirsutum
  Clone ID: uC-gsflnu33B022f04b1
gtatcttcctgctcctactgtttctctccggcctcctcttgcagtcagtgctggagctatttccaagttcttctatagctgccctgataatgctttccaggttgctcttcctggtacttcatattcacttatgcagagattaggagcagtaatgcgtaacggcgcaaagctttttgcagtgggcaccacttcttcgctggttgggacagccatcacaaatgctttgattaatgctaggaaggccgttgataagacatcggcagctgaagttgaaaatgttcctatactatccaccagtgttgcctatggtgtatatatggcagtttcgagcaaccttaggtaccaagtgcttggctggtgaaattgaacaaccgattctggagcctttgttgtaccagcactagctt

SEQ ID NO: 14111 - DNA, 232 bp, Gossypium hirsutum
  Clone ID: uC-gsflnu33B022f05b1
gattggctctgctcagcctcgttagacagcattcgaagttagttttattattgtcctcaattgtgccagctggggcagtccacttcatctgccttttatctttatctttcattttgatgtatgatgatatggttcagattgaaattatagattttgttgtaactgaataccagtggaaactgaattttggggatgaaccccacacccaacactcataatttagtctaattcc

SEQ ID NO: 14112 - DNA, 468 bp, Gossypium hirsutum
  Clone ID: uC-gsflnu33B022f06b1
tttcctagcaagcacctctcttcttaactgtaaatttcaaatctctcttctaccttaaacatggctactatttaccgccttgccactctcatgctcttctgctttatccaactcagcttctccgagttggttcaagagcaacccttggttttgaagtaccacaacggtccactcttgaaaggcaagatcaccgttaatctcatctggtacggcaagtttacacccatccaacgctccataatcgttgatttcatcaactctttgagttccgataaggccacaatggttccttccacgtcgtcgtggtggaaaattactgaagagtacaagggtggatgttataccttagctgttggcaaacaaatccttctcgaaaattacccgctcggtaaattcctggaaaacctacatttattggcattgaccagtgagttcaacggcgttgataccatcgacgtgatccttact

SEQ ID NO: 14113 - DNA, 400 bp, Gossypium hirsutum
  Clone ID: uC-gsflnu33B022f10b1
cacgcgtccgcccacgcgtccgaaaaaagttcattttttcttttcgttagttgaaccacttgaatcttttcacaaatatcaccaaatatgccttcaaagtgcgaaatttgttgtgagctcctcatcgccattttgcttcctcctttgggtgtttgcttaaggcacggttgttgcagcgttgagttctgcatctgtctgctgttaacgattctgggttacatccctgggataatctatgccctttacgccattgtttttgtggatcgagacgagtactttgacgagtacaggcgaccactttattattcaagtgcctagtctagtcaagtcttccttaattatgtgatatgaatacgatgatgatgcagcaactccttctgggctttaattttaatttgat

SEQ ID NO: 14114 - DNA, 531 bp, Gossypium hirsutum
  Clone ID: uC-gsflnu33B022f12b1
ttgagattagatccaaaattctcctttcctcttatttccgattccccaatttttcctgaaaccctaatcctaatcccagattcctcctgtctacatcgtttagcaaatggcaaccgaggacccggcagtcgtggcagaccccgcacccgagacggaggaggacaagactgctgagaccaaagctacttcaaaatccggcagagcaaagaaagccaaagaacccaaaaccaagaaagctgcagctcctaggaaaccacgggctgctcctactcatcctccttacgaagagatgatcaaagatgcgatcgttactttgaaagagaggacaggttcaagtcagtacgccattgctaagttcattgaagagaagcagaagaatcttcctggaaatttcaagaagcttctgcttgtccatttgaagaagcttgtggctgctgggaagttggttaaaggtaaggcttcgtataaacttacttctgctaggtcttcgaagacggttactgctgcttctgctcctgcaaaaagaaaccg

SEQ ID NO: 14115 - DNA, 515 bp, Gossypium hirsutum
  Clone ID: uC-gsflnu33B022g01b1
actgccttatggcatgccagaattacaaggagcattgcattgaacgaatttcttcaatttgcgatttcctttttgcctttcccttgtgaggatcgagacttaaagatggatcatttgattcttgtttgaaagaaaaaaataaggccatgaaaagtttcggggtgcatctattcttgctgctctttcttgctgcgatcgcatttgagaccgtgcaagcattcacaggaacgtatgggattaattatggaaggattgcaaataacatactttcacctgatgacgttgtaacacttcttagggcagcgaaaataaagaatgttcgaatttatgattctgatcagagtgtccttaaagcatttagtgggacagggctggaacttgcggttggactcccaaacgaaaatctgagagatgtgagtgccaatgcagatcatgctatgaattgtgtgaaggacaatgtattggcatatctttcccgatcacatattcgtgggatcgctataggggatgaagtc

SEQ ID NO: 14116 - DNA, 444 bp, Gossypium hirsutum
  Clone ID: uC-gsflnu33B022g02b1
tactctttgtgtacaaaaagggcgaacgggaatggccaccgaggaagacagcacggtgaaggagcccttggatctgataaggcttagcctcgacgagcgtatttacgtcaagctccgttccgaccgtgagcttcgtggcaagctccatgcatatgatcagcatttgaatatgattctgggggatgttgaagagattgttacaacagttgaaatagatgatgaaacctatgaagagattgttcggactacgaggcgtacagttccattcctctttgttagaggagatggagtcatactggtttctccacctttacgcactgcttgattgggaggacggagtttcaagcacacgaaggaattaccttgtgctaaatttactactaagctattgctcgtttataattgaccctatagctacgtattaagggaacagtggagtatttg

SEQ ID NO: 14117 - DNA, 328 bp, Gossypium hirsutum
  Clone ID: uC-gsflnu33B022g03b1
tttcggacatatcgataatgttttggttggtgatatgtagttcggagccctttagctcactccactgaaggaaccaccggaaaccctagtccctacttcctttaattgtaccattgtgagagtatgccgatgatcgttgaaggccgcggtacgtatagactatgttaactaacatgctatacccaagtgttgaaccgaatagcttcaatgaaatatatctctcgtttgtggactcacgaagacacaaccctgctaagcttagcgacatctctgatatttgaggtcaagagctatggcacacccatgaatatcatcccttgccctattg

SEQ ID NO: 14118 - DNA, 464 bp, Gossypium hirsutum
  Clone ID: uC-gsflnu33B022g05b1
tctctgggcagctaattcggtgatcccaaagattcagcccgagtcataaactcggagctcgaactcaatcacagagagagaaagagagtcgatttccttttcacaaaacaattaaaagaagaaatcttttattttctgtgaatttctctttcggcactctctgcaactgcaatcatgacctcaattgtgcaaggcttttccaagtctttggccatgactgtgctatcggagatcggcgacaagacgttctttgctgccgcgatcttggcaatgcgccatcccaggaaacttgtcttgttaggatgcctggcagctttaattgtgatgactattctttctgctgttgttggctgggctgctccaaatcttatctctaggaaatggacacatcacattacgactctgcttttctttggatttggctcgcggtctttatgggatgcatttatggagaatggggaggt

SEQ ID NO: 14119 - DNA, 542 bp, Gossypium hirsutum
  Clone ID: uC-gsflnu33B022g08b1
ggtcgggtcaagtagaatgcaacggactcggtgctgctccgccggtgactctagctgagttcactcttggaaccaccggtggtcaagatttttacgacgttagtctcgtcgatggttataatatgccgatgatagttgaaggccgtggtgggtcgggcctttgttcttcgacgggttgtacgactgatttgaaccgaaaatgcccgtcggaactacgggtcggtaatggtgatgcttgtaagagcgcgtgcgaagcgtttgggagccctgagtattgttgtagcggtgcgtatggtacacccgccacttgtaaaccgtcggtttattccgaaatgtttaaggcggcgtgtccgagatcttatagctatgcgtatgatgatgctacgagtacttttacctgtaccggtgcagactatacggtgacgttttgtccctcctctcctagtaaaaaatcttccaaagatgctacaccggttccggcagtttcggaagaaactaccccgacgacaggttcaacaccacaaggatcagggtcggaatcg

SEQ ID NO: 14120 - DNA, 221 bp, Gossypium hirsutum
  Clone ID: uC-gsflnu33B022g10b1
caacgactcaaaatctctgttctaaatgttatcgcgatcttcaacttaaagaacaacaatcttcctctgccaaacaagcctttaatcacactttagttccttcgtcgtcttcattgccatcgtcatcatcggcccgatcttcgttttcggcatccttgccggcgaaggaggaaccatcggcgggaacgaaggaaacgaaggtggtggaggaggatggaagt

SEQ ID NO: 14121 - DNA, 379 bp, Gossypium hirsutum
  Clone ID: uC-gsflnu33B022g11b1
atttcttccgttgatctttgttagagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacctacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgtcgttgagtctactggtgtttttactgacatggacatggctt

SEQ ID NO: 14122 - DNA, 518 bp, Gossypium hirsutum
  Clone ID: uC-gsflnu33B022g12b1
ggaggcagtgactgccttacttggaggtggaattcgtgttggggtactacttcaagggaagaaggttcgagatgacagccgaactttatcgcagactggtatttcctgcgaagaaaatctggattctcttggtttcactttggagcctggtcctgcgaaagctcctccgccagtgtgctcggaagaaccacatcttctgatgtcatgtgaaaaaggccctcaacaactaacaagccttccagccactccggttgtagatacagcgattcccgatgccacacctgacccactgttactaaccgatacagcacatcctgtggatagtaatcatgaaccggtttcctcccaaactgacgttctaactgatcaaagtctatcggagtctagagctatagttcctgttccagcaatgaatgttgaggcactagctgtcatccctgccagcccaaaagtccgaaaaaccgaacttgcacagcgtcgaactaggagggccgttttcagttttagaagtagaagca

SEQ ID NO: 14123 - DNA, 439 bp, Gossypium hirsutum
  Clone ID: uC-gsflnu33B022h02b1
gcgtccgtgagatcctaattagattcttttaggcttcgttcaccaaccagttacattacaattgacacaaataggtaattatctttactttttattttgcagggttcctacaaacttaagatgacattatcaggtgcgggaattaaactgctaacttgcatttccttcgatttcaaaatcagttctggtgcttctgaatcttcagtctctgatagctgatcagcccaccaagtatatatatgaaatatggactgcagtaggatgttatatcttatttattgcgaacagatctcacattctacaatatattgtacttgtattccgtattatcgttcttgtgaagatgtcatgagacaaactacgattacatggaagtcactccaatctgatgaatcatgttaacaatgttaatttcccttaatatcaaaacattttacat

SEQ ID NO: 14124 - DNA, 239 bp, Gossypium hirsutum
  Clone ID: uC-gsflnu33B022h03b1
gcgtccgcctaatattaacagcaatggaagcatttgcctagacatcttgaaagagcagtggagtcctgcactaactatttgcaaggtattgctatcaatatggtcattgctgaccgatccaaatctggatgatccattggtgccggagattgcgcacatgtacaagacagacaggaacaagtacgagacaactgcacggagctggaccgagacgtatgccattgtatagggaggctcaa

SEQ ID NO: 14125 - DNA, 515 bp, Gossypium hirsutum
  Clone ID: uC-gsflnu33B022h04b1
cacagagagttaaaattgcttatggagccgcaaaaggcctcgaatatttgcacgaaaaggcacatcctcatataatccaccgtgatattaagtccagcaatttgcttctttttgatgatgatgttgctaagattgctgattttgatttgtcaaatcaagcccccgacgcgaccgctcgcctccattctacaagggttcttggaactttcggttatcatgctccagaatatgcaatgacaggaacacttagttctaagagcgatgtttacagcttcggtgtcatccttctagagctcttaactggtcgcaaaccggtagatcatacgttgccacgtggacagcagagtctagtgacatgggcaaccccaaaactaagtgaagacaaggtgaagcagtgtgttgatggtagactaaatggagaatacccttccaaagcacttgcaaagctggctgctgtggctgcattgtgtgttcatttgagctgattttcgaccaattgagcatgtagtgaaagc

SEQ ID NO: 14126 - DNA, 520 bp, Gossypium hirsutum
  Clone ID: uC-gsflnu33B022h05b1
aatgcgtagaggaaaaccgctctacttgaacgaggaacgctatgctgctctaactaatatggttgcttctcatggccttgatcggagttcaaaggttcttggtcaaactaccattgataccttcttcgtggtttagtttggtttcatgtttaaggtgttagatatggctgattttgctgttctcttgtttcatattctgttgttagactcttaaatcgaagaacccctggcatgtagagtccaatgccttgacggacaagtcttcaattgaacatattcaggctttagatcaccatgttgatcgggaaccggtttcaaagaagacaacactatgagaaaacagtttggtttcttctataactttccatgttttttcttttcatctctgataagtagagccataaattctaatgtaaagcagttgaaatctttctcaagttaaagggcacatatatatataacatattgtaaatagttcaacattttcacttgacagcagctctcatattgtgcttataaa

SEQ ID NO: 14127 - DNA, 467 bp, Gossypium hirsutum
  Clone ID: uC-gsflnu33B022h06b1
caaacaggttgcttagaagtcccaagttagagaacatgggtcgtggagtcagcagtggtgggggacagagttctttgggttaccttttcgggagcggagaagctccacctccgaaaccaaccaatgtcatgagtactggcaccaccagtagtgaagttcctcagaagcagattgaggttgtgaaggaaaccgtgcaaaaaccgaccactgcttcaccatcatcgggtgatgctaaggagatccctgcaggtgttccagggagcaaaacgaacaactatttccgagctgatggccagaattgtggcaactttcttacggagcgccggacaactaaggttcacgcagcgcctggcggtgggtcttccttggattacctgtttggtggcagtgagaagtgatatgtgagatattaaatgttggaaccactgcttatggtttgtctaaaaggtttgggacagaaaatattt

SEQ ID NO: 14128 - DNA, 515 bp, Gossypium hirsutum
  unsure (1)..(515): unsure at all n locations
  Clone ID: uC-gsflnu33B022h08b1
aaagatccctctccaacaatggcttctaatcccaaggtcttcttcgacatgaccgtcggtggccaaccagctggtcggattgtgatggagctctttgccgattgcactccccggactgctgagaacttccgtgctctctgcaccggcgagaaaggggtaggccgtagcggcaaacctctccactacaaaggctcatccttccaccgggtgatccccaatttcatgtgtcaaggaggcgactttaccgccggaaacggtaccggaggtgaatccatctatggagccaagttcgcggacgagaacttcatcaagaagcacacgggacctggcatcctttccatggcgaacgctggacccggaacaaacggatctcaattcttcatctgcacgaccaagacgtagtggctggacggaaagcacgtggtgttcggacaggtagttgaaggcatggatgtggttaaagcgattgagaagtggngtctagcggtgggaggacttccaagcctggtgttatt

SEQ ID NO: 14129 - DNA, 536 bp, Gossypium hirsutum
  Clone ID: uC-gsflnu33B022h09b1
tgaattctttccctcactttctcgaaaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctgttgttgttaaaatcttataaaaata

SEQ ID NO: 14130 - DNA, 362 bp, Gossypium hirsutum
  Clone ID: uC-gsflnu33B022h10b1
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggaaaaaaaaaaaaaaaaaaaacatatacatgcggcggacagggagcaagctatctcttgttggagccgccggggaaagcccaaagtttgagccttgttggaacagacgatagctccgggtgagggcgggggctaccgaacctgtgggcctgggtgatcctgcgctttttgccactgtggactttcaagaagaatcccctggtcgtggtccataaaaagccatagtaacgccgcttactgatgggttcaccgctggactggctgtatttgt

SEQ ID NO: 14131 - DNA, 346 bp, Gossypium hirsutum
  Clone ID: uC-gsflnu33B022h11b1
cacgcgtccgcttaacacaacttaccaactcaaaaaccccaagttttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatgacatatattagggatctaaataatgaatttaaggttgaataatt

SEQ ID NO: 14132 - DNA, 502 bp, Gossypium hirsutum
  Clone ID: uC-gsflnu33B022h12b1
agctattacgtggagagccttttttgtgtagcgattctcagttagtcttttctttaagcttacagcttctctccagagttttataatgggtaaggagaaggttcacatcaaccttgttgtcattggccatgtcgactctggcaagtcgaccactaccggtcatttgatctacaagcttggtggtattgacaagcgtgtgattgagaggttcgagaaggaggctgctgaaatgaacaaaaggtcattcaagtatgcttgggtgcttgacaagcttaaggctgagcgtgaacgtggaatcaccattgatattgccctggggaagtttgagaccaccaaatactattgcaccgttattgatgcacctggacaccgtgactttatcaagaacatgattaccggtacctcacaggctgactgtgctgttctcattattgactcgaccacttgtggttttgaagctggtatccttaaagaaggttaagactcgcgagcatgctttgct

SEQ ID NO: 14133 - DNA, 370 bp, Gossypium hirsutum
  Clone ID: uC-gsflnu33B023a01b1
tctatgcgtccgcccacgcgtccggtttcattgtttatcagagcaagaaaaagaagggaaaatggaagggaaagaagaagatgttagattgggagctaacaagttctcagaaaggcaacctattgggacagcagctcagtcccaagatgataaggattacactgagccacccccagcacccttgtttgagcctagtgagttgacttcatggtcgttttaccgagctggaatcgctgagttcgttgctactttcctattcttgtacatctcggtgttgactgtgatgggagtccttaaggacaaaacccagtgctcaactgatgggattccaaaggattggcttgggccttttggagggaataaactttgc

SEQ ID NO: 14134 - DNA, 80 bp, Gossypium hirsutum
  Clone ID: uC-gsflnu33B023a02b1
tctactcgtacgtccacgcgtacgaagccaccagtgtattcacattcaaagattgagaagccttaaccaaaatcatcagt

SEQ ID NO: 14135 - DNA, 504 bp, Gossypium hirsutum
  Clone ID: uC-gsflnu33B023a03b1
gtttactacaaatacacctatccttgcacaccaggagtctcatatcatggccgtggtgccttgcctatctactggaactacaactatggggaaactggagaggctttgaaggtggacttgttgaaccacccagaatacttagaagacaacgcaaccttggctttccagacagcaatgtggaggtggatgacgccggtgaagaaacaccaaccctcagcccatgacgttttcgttggcaactggaaaccaaccaagaacgacaccttggccaagagggttccaggttttggaaccaccatgaatgttctttatggtgaccaagtttgtggtcaaggtgatagtgattccatgaacaatatgatctctcattacctttattaccttgaccttttgggagttggccgagaagaagctggtcctcatgatatgctcacctgtgaagaacaagaaccctttactgtttcttcttcatccgcaacatcattatgaataaaggaaacaaac

SEQ ID NO: 14136 - DNA, 415 bp, Gossypium hirsutum
  Clone ID: uC-gsflnu33B023a05b1
tttacgcgtccgcttccccctcttcttccataatactctttctcttcatatataatctttattttcaaacaccctaaatttacaaccacatattccagagaggatttttttttaaaaaatggtgatgaagttaccttatctgggttcttgtttgtttttggttttttttagtttggtttctattgttgcttctgggtctggaaaagggctcccaattctttcattcgatgaaggatataatcagttgtttggggatgataatctagttatccatagagatggtaaagctgttcacttgtctttgaacgaaagaacagggtcggggtttgtgtcacaagacctttacttgcatggttacttcagtgctttaataaagttacctgctgattacactgctggagttgggtttgctttc

SEQ ID NO: 14137 - DNA, 248 bp, Gossypium hirsutum
  Clone ID: uC-gsflnu33B023a06b1
ctacgcgtccgggaactttgtgcagcccacaattgttgagatttctccagatgccaatgctgttaatgaagaagggttttgtgagccatatagatggtttcaaaaagaacggttatacgatgttttagcttttcactttttattccccttatttatctatgatttttctttcttatctttgtttctttccctaactccaaacctaatcctaaaccaaaggcaaaccccactcttttttttattctatt

SEQ ID NO: 14138 - DNA, 298 bp, Gossypium hirsutum
  Clone ID: uC-gsflnu33B023a07b1
gtcataattctgagtcctagagaatttggatttatcaattcttgtgccgaatgtagttttagtgatgattcttcaaggaacaccaagcttattttttttgcataaatttttatgccatcagttggcatgattgtttccgtctttgaagcttttgtttatttcttccctgcaccttgtgtttttacctttctaacttccttgtgcagaaggcatgtcgtatactaaatgctgactttgtgctgctcatcaaatttattggttggagtttccccaatccatatttttccaagtttcggtt

SEQ ID NO: 14139 - DNA, 448 bp, Gossypium hirsutum
  Clone ID: uC-gsflnu33B023a12b1
tttacgcgtccgcccacgcgtacgctctatcctatactcaacttgttccacttaaaagcaagtgagctcgctagggttttgtgagccagagagacggggccaaaaagaacggcatcactagccctcttctttgcactcaacatcctcttcttttccctggtgagtgcttgtggttcctgcccttaccccaaccccaaacctaaacctaaaccaaaggcaaaccccactccctccccatcttcttctggcaagtgccctagagatgctcttaaactcggtgtatgtgctgacacgctcggtggctagctcaacgtcaccattggtacgcctcctgttcaaccctgctggtctcttatgcaaggtcttgctgatcttgaagctgccgcttgcctttgcacggcgatcaaagctaatttttcgggcagtaaccttaatggcccactttccc

SEQ ID NO: 14140 - DNA, 281 bp, Gossypium hirsutum
  Clone ID: uC-gsflnu33B023b04b1
atataaaataaaaaaaaaaaaaaaaaaaaaaaaaaaaaaatatataaaaaaaaaaaaaaaaaaaaaagaaaaataaaaataaaatttaaatatattgaattagttttatgagaaaactaaagttctttttctttgtgtgttgacttctacatgctttgttttcttcttctatttgctgtgggggccgtttctaggtttttccccttttcctcgccttgctttggttaggttttttttttttggttggtcctataatacccattcttgctttctttttttcc

SEQ ID NO: 14141 - DNA, 162 bp, Gossypium hirsutum
  Clone ID: uC-gsflnu33B023b05b1
cttaaatccattttttcacgtagttgcttcaactacgttccagaatcaaaacaacgtcgattcaagttcagatggaatcatcggcgaagccagcgggtggtagaaagggaggagtgaatattactgctctctttctcgttgtgatacataagagtgttctaa

SEQ ID NO: 14142 - DNA, 188 bp, Gossypium hirsutum
  Clone ID: uC-gsflnu33B023b07b1
ctttgctttcccttttttttttttttttgccaatggcttcttcaccaaaattcatctcttacttcttccttttagccctcttctccgttgaaatacatggtagggatttttctagcaaaatcccaagtgttaacacaaatgatgaaagaggtgaccaacaaataagaacaatccactttggggaagaa

SEQ ID NO: 14143 - DNA, 261 bp, Gossypium hirsutum
  Clone ID: uC-gsflnu33B023b09b1
tgttagcacatttgtgagcaagtaaaaatactgccttgttctgtcctgtatttcttcctctgctccgttcctctgctgtcaaaaatccccaacaatagctaaaagcttgaacttcaagcatttttccttcatattttatccgggtataatacgttgctgctggtgctctgtttgaaattcttactttacccggataaagtgtgtcaataacccaacagtctggatgcacaggagaaatcacatccaattgaggcgaggaac

SEQ ID NO: 14144 - DNA, 451 bp, Gossypium hirsutum
  Clone ID: uC-gsflnu33B023b11b1
aaagaattcatcaatgtcgccatggctatagaccctgaatcaaagatgattaataaggatgaaggacgcattgagaaatgggttcttagacgagcctttgatgatgaaaaccatccctatttgccaaagcatatcttatacaggcagaaagaacaattcagtgatggcgttggttatagttggatcgatggtctcaaagctcatgctgctgcaaatgtgaccgataagatgatgcttaatgcttcaaacatcttccctcacaacactccgaccacgaaagaagcatactattataggatgatcttcgaaaggttcttccctcagaactcggcacgattgaccgtcccgggaggagcaagtgtagcatgcagcacggccaaagctgtcgaatgggatgccacttggaagaacaacctctacccgtcgggcagagcagcacttggagtccatc

SEQ ID NO: 14145 - DNA, 456 bp, Gossypium hirsutum
  Clone ID: uC-gsflnu33B023c02b1
aattgtcccaaagagaagtgatcctaaggaaaaatggcagatgaattgacgttggatttggaagagcttatgcaacttcaaagcatcgcaaagagaccacgcactctatctcttatttcctctgagattcgcaacttggagaagaccttgaaagagaatgaaaatggggcttctcctgttactgttccacaaattccaacccccgtttcaacctcagttaaggctcccgttaaccctgaactgagttatgttacacttgcctccttcagctgggatcaagataacgataaagtcaagatatatgtctctctggaaggagttgaacaggaaaaaattcagacagagttcaagccaatgtcattcgatgttaaattccatgacgttcaaggcaaaaactacagatgtgctgttccaaaattgaacaaggaaattgaaccagagaagtgcaaggtgatg

SEQ ID NO: 14146 - DNA, 269 bp, Gossypium hirsutum
  Clone ID: uC-gsflnu33B023c03b1
cttgcttttgtttctcgttggagtggcggtttttatcatcactccttctctagctaaccaacatcatggcaatgagcttcccaagggtaatgtgaggaagcctttcccaggtgagaagcaaccacaacacatgccattccccgaacaccgaccaccaatacaccgtggacctggcggtaaggtggaggagccacctcatggagaataattttctcatagacacttattgactgtgtaagtttaagacacacttatacttacacaatact

SEQ ID NO: 14147 - DNA, 512 bp, Gossypium hirsutum
  Clone ID: uC-gsflnu33B023c04b1
ctcactcatccgacaattgaactctccaactgctgatgagtgtcaaagatgaaagccaccagcttgaactatgccaattaccttcagattttgggcaagtatcaagagaagcctcccctccctttcattcctggctccgattatgctggcactgttgacgccgtcggccccgccgtcaccaagttcaaggtgggcgaccacgtctgctccttcgctgccctaggctccttcgcctccttcatcgtccaagaccaatccctcctgtttgggttgcccaaagggtgtgatctggtggcagctgctgcactccctgtcgcctttgggacctcgcacgtagctcttgttcacagggctagcttgtcctcttctcaggtattgctagttctttgggccgctggaggcgtcggtttttctgctgttcaaaatggcaaggtttgcggtgcagttgtcattgctgctgccaggggagctgaaaaggtgcaatttttgaagtccttgggtgcttgacatgt

SEQ ID NO: 14148 - DNA, 479 bp, Gossypium hirsutum
  Clone ID: uC-gsflnu33B023c05b1
tttcacgcgtccgcccacgcgtccgcccacgcgtccgctgctgcaaatctctctcgtgggaaacaatacctccggttccaacttcagctcaaaaatatgtcaggggaagaagttgcggttgcccaacccgaggcggcgcctgcactcggtgagccaatggacatcaacacagccttgccccttgtggttaggaagtcacgagctcacggtgggctcgcacggggattacatgaagctgctaaggcaattgaaaagcacaatgcacatctttgcgttatagctgatgactgtgaccagccggattatgttaagctggtcaaggcactttgtgctgatcataatgttaaagtgctacgtgccccgagcgcaaaatcacttggcgagtgggctggtttgtgtaagatagactctgagggtaaagcacgaaaggtagttggttgttcctgcgtagttgtgaaggattatggtgaacaacatga

SEQ ID NO: 14149 - DNA, 53 bp, Gossypium hirsutum
  Clone ID: uC-gsflnu33B023c09b1
gtgataacaaccgctcgtaccatcaagaacacataagtttttgtcttgaagag

SEQ ID NO: 14150 - DNA, 506 bp, Gossypium hirsutum
  Clone ID: uC-gsflnu33B023d01b1
tgtacgcgtgggcggacgcgtgggcggacgcgtgggcggacgcgtgggcggacgcgtgggctcttttgcttgcgcggctgggcttagtttaagcggagagggtgtgcaggattaaagggtcaccattgtttccaacatgatgcttaataacaagtttttgttcttatcagctttgttttgcattgctgtagctggcgctttaggccaagctcctcctactcctagtaatcctccgacatccacgccggtgccgtcgaccccacccgctttcacacctccgcctactacccaaccaccttcaacacccacaactacttttccgccaccagcttccactccttctcctacattatcaccacctccagtgacagtttctccaccaccagttttcacttctccttcagcgactcccccgcccgttagctccccaacaccagcttctccttcaccggctactcctccctcagttacccatactcccgaaattttcccaccggtttttccac

SEQ ID NO: 14151 - DNA, 488 bp, Gossypium hirsutum
  Clone ID: uC-gsflnu33B023d05b1
ttcacgcgtccgcgctcaccccggtggtccagccatattggatcaggttgaggcgaagctagcccttaaacccgaaaaactccgagccacgaggcacgtgctttcagaatatgggaacatgtcaagtgcttgtgtgctgttcatattggatgagatgaggaagaaatcaaaggaagatggacttggaaccacgggtgaagggctcgagtggggtgtcctgtttggtttcggaccagggctcactgttgagaccgtggtgcttcatagtatctctgcttaaacaaggttctaatgttcatgttggctagcccaggctgcactaccatttgctttgcatttttatttattttattttcctttttattactgaaatttgtgatttgtatggttatttgaaagagagtaaagctctcacatatggtgtttaacgcctgtagaattatgtaccaccttatattttatggtaataataaattgccttttttttt

SEQ ID NO: 14152 - DNA, 431 bp, Gossypium hirsutum
  unsure (1)..(431): unsure at all n locations
  Clone ID: uC-gsflnu33B023d11b1
gtatactatccggccatcatttcagctcttttcggagtttcagagaagacacatgaaagattctgaagggaactttactgctcaacctcctccatatgaacccatagttgctgaagatggatctgtgcacaacttaaacgagtacatggagatccgtgctgctgatgtactaacagatctaccaccggaactgacaagtgcagtttttggtcagaagcacggagttgtaattggtgaagcacatcttgaggaattattttctcaaattccttgatatggtgggtacttttaactaaaatcttagaacttgcatgtttgatgcatggtcttgagcacttaaaactgctactgtacaaatattttccaatactgttatantatgtcgtgtgccacaaacctgcaaaaatgaaggaaaacaacatacttacagc

SEQ ID NO: 14153 - DNA, 513 bp, Gossypium hirsutum
  Clone ID: uC-gsflnu33B023d12b1
ctcacgcgtccggtgatgttagagaatcgcaatgtaggaaatggaatgaagagcgtcgggagaagggagaggctgcatataatgatgtgatatttgaggatttagttagaagatttgagaaaccggatagaagaaatcgttgggattcacctttgttcgagctatgggctcataatgatggagtggagagatcttctattgccattgtagatgtggtttcgtatttgacaaaaaaagcagactcgaaatctcgggatgttaagattttgcagccaaccattgccacacaaaatacccggttttcagaggcaaattcactgtatgagatggacagagccacgcaggaggtgattaatgctattgtggaagcacaatcccagtcaattggaggacctcttgccagtatctccattggtcaaggtttaccgaatatcgatatttctagatcggttgggttgccggagctacggagattgcggagaacattcatcaagttaacaggacatacaagtt

SEQ ID NO: 14154 - DNA, 58 bp, Gossypium hirsutum
  Clone ID: uC-gsflnu33B023e03b1
cctacgcgtacgaccacgcgtccgatcctctgagacagaatcaaaaactctttttctc

SEQ ID NO: 14155 - DNA, 502 bp, Gossypium hirsutum
  Clone ID: uC-gsflnu33B023e04b1
tgtgtaggagtgtatgtgtaatggtgtacttgcaggttttcctgttgttgatgtacgtgccgtgctagtagatggttcttaccatgatgccgattctagtgtcttggcattccaactggcagccaggggagccttccgagaagggattagaaaggctggccctaggatgcttgaacctataatgaaagttgaggttgtcacacccgaagaacatttaggtgacgtgatcggtgatctcaactcaaggagaggccagattaacagctttggtgataagcctggaggactcaaggtggtggatgcccttgttccgcttgcagagatgttccaatatgtcagcactctccgaggtatgacgaaaggtcgtgcatcctacaccatgcaattggccaagtttgatgtcgtcccttaacatatccagaacgagcttgctactaaacaacaagaagttggtgcttgattttgatgtttcataatttcctgggatccaaacactattttt

SEQ ID NO: 14156 - DNA, 448 bp, Gossypium hirsutum
  Clone ID: uC-gsflnu33B023e06b1
tttcaacttaccaactcaaaaaccccaagttttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgtgtctggtgtagtttgtgtggtgacttatatctgtcagttaacctttcttctcctttgctatgatggaatggctatgcttatggccttatctggttaatgaagtatccttactat

SEQ ID NO: 14157 - DNA, 321 bp, Gossypium hirsutum
  Clone ID: uC-gsflnu33B023e08b1
gtaacactgtctgtttgtgaagttaagaagtccagtgtgtagctgtgtacggaaaaaaaagcatggtttctgcatcagagattgcaacaaagttgaatctggcttcccaccctgaaggtggcttcttttctgaaacttttagggatagttctgttatgctctccacatctcaacttcctcctcaatacaaagtcgatcgtgccgttagcacatctatttacttcttgttaccggctgggagctgtgtcttaccttcaccgtattaccctgtgctgagacctggcatatttatttgtgagaaccttttaccgtctcggttct

SEQ ID NO: 14158 - DNA, 522 bp, Gossypium hirsutum
  Clone ID: uC-gsflnu33B023e09b1
ttttgagctgtcctttttctctctctatattttctcatctccttttccaccgccgttgatctcgatccgtatccccgttttcaaaaaagctccaaaaagatggccaatgctgcatcgggaatggctgtgcatgatgattgcaagttgaagttccaagaacttaaggcaaaaagaacccaccgctttattgttttcaaaatcgaggagaagcagaagcaagttatcgtggagaagcttggtgagccaactgagagctatgaagattttactaaatgtcttcccgctgatgaatgtcgttatgctgtgtacgattttgattttctaacagccgagaacgtcccaaagagcagaatctttttcatcgcatggtctcccgatacatcaaggatcaggagcaaaatgatatatgctagctccaaagacagattcaagcgagaactggatggaatccaagtggaattgcaagcaacagatccaaccgagatgggtcttgatgtcttcaaaagccgtgccaactgaata

SEQ ID NO: 14159 - DNA, 149 bp, Gossypium hirsutum
  Clone ID: uC-gsflnu33B023e10b1
cctacgcgtccgaaaaaaaaaaaaaaacaaaagggaaaattaaaaaaaaaaaaaccaaaaaaaaaaaaaaaaaggacggacagtttttatggattccaagtttacttacttatgcatgcctcgtaattggttttctatatggactccta

SEQ ID NO: 14160 - DNA, 128 bp, Gossypium hirsutum
  Clone ID: uC-gsflnu33B023e11b1
gtagttggcactggtctcggtccaactttggaattctatactcttgttagtcatgaatttcagaaatttggccttggcatgtggagaggggatcatttgtcacatattactccaactacctatcctac

SEQ ID NO: 14161 - DNA, 142 bp, Gossypium hirsutum
  Clone ID: uC-gsflnu33B023e12b1
ctactgtgaatgccagcattgttcacatcctcaagtacttaaccggctcggcaaagacctatgccaattcagttcaagcctatgttcacgtcagagatgccgcattagcacaccttctcgtgattgagaatccctttgcctt

SEQ ID NO: 14162 - DNA, 380 bp, Gossypium hirsutum
  Clone ID: uC-gsflnu33B023f01b1
atttggtgttttaccttgctgagcttggccttatgcaatattcgtcagcagtttcatactgtccgtccatgttagctgctgcagctgtgtatgctgcaagatgcacccttggggagagccctctgtggagtgaaactctgaagcaccacacgggatactcggtagagcagctaattgagtgtgcaaaactcttggttaaattccactcaacagctgcaggaagtaagctcaaagcattgtataggaaattctcaagtccagatcgcaatgccgtggcccttcttgcacctgcaaaaagccttttgcccgtagcaattcatgatggagagtgttaagctgatgattctagacaaattatataacctaatggtttttgttag

SEQ ID NO: 14163 - DNA, 379 bp, Gossypium hirsutum
  Clone ID: uC-gsflnu33B023f06b1
tcacgcgtccgctttatcttcgctctcatgtccattgcagcaacgattgcatctttgaggctcatagctgttgattccaaagaataccatgtgtttgctgatgtgtgatatctacaagggctgagaaaaatgcctaaaattagcagaaatccgattcgaatttagccttcgcttcggtttttgattagattaataatatcaatgtaatgtattcattcggttctcggttcataacttaaaaaaaaaaaaaaaaccacaaatattattaaaacagaacagaaaagagccgaaccgaaccgaattttattttaatttaattttagctagtgtttaatttctgatggtataaaaataaataaatatattttatttctaagtc

SEQ ID NO: 14164 - DNA, 424 bp, Gossypium hirsutum
  Clone ID: uC-gsflnu33B023f07b1
ttacgcgtccgcccacgcgtccgttttcttgttcttgttcgtcaacgcctccaacacattacttaatcaatattttcttcatctgattttgatcggagcatcagtctgattagaagggatctcatggccaccactggaaacaagaacatcaatgctaaattagttctacttggggatgttggagctggaaagtctagtcttgttttgcgcttcgttaaagggcaatttgttgaatttcaggaatcaaccataggtgcagcttttttctcccaaacattggctgggaatgatgcaactgtgaagtttgagatttgggatacagctggtcaagagaggtaccatagcttggcaccaatgtattacagaggagctgcggctgctatcattgcgtatgatattacaaatcaagcatcatttgagagag

SEQ ID NO: 14165 - DNA, 62 bp, Gossypium hirsutum
  Clone ID: uC-gsflnu33B023f10b1
cctactcgtccgcccacgcgtacgcccacgcgtgcgcccacgcgttcggttatagatcgaga

SEQ ID NO: 14166 - DNA, 425 bp, Gossypium hirsutum
  Clone ID: uC-gsflnu33B023f11b1
ttattaagcgttaatcaaattgaagatcatacttattttggatttacgaagagaagtagctatcttttctttgattttcttgttcttgttaagtgatggaaaacaaagcggcggtgaggtttacattagggaagcaatcgtcgatggctccggagagagacagaggcgaagcggatgggaaagagaacgaggaaggagaggagatagacgaaggagttaggttgatgtacttggccaacgaaggtgatttggacggcattcgcgagctcttggactcggggatcaatgctaattttccgcgacatcgatgatacggcggttctccatattgcagcttgtcaaggacagaccgatgccgttttcttgctcctttagcgcggcgcttacgtctatactacagatcgatggggaagcactcctttggc

SEQ ID NO: 14167 - DNA, 321 bp, Gossypium hirsutum
  Clone ID: uC-gsflnu33B023f12b1
tgctggacttctgttttcatttccagggaacggcaagcagctggagtttgggagcatgaagactaatggcaaggccattgctatccacactcttcttttctttgccatctatgctgttttgatcatggctgttcacctccatatctacactggctaaccacttccctgccggtgagagtctttgttattggtctctctattggagatctgtcttgggttttacttggtttatcaatctttgtattagcttgtttcaattttggaccaacgaaatttgtggcacagacctttgtttcccaaagtttacttttttacaattag

SEQ ID NO: 14168 - DNA, 501 bp, Gossypium hirsutum
  Clone ID: uC-gsflnu33B023g01b1
tgtgcttatctaccggaaggcgaagatcgagaccatccggcttgtaacccgttcgggccaagaggtcgaacccttgaaggtctcaagttcccgaaaagtctggtagtcgtggcgggtttggatctgattcaagactggcaattggcatacgttgaaggacttaaaaaatcgggtcaagaggtgaaactccttttcttagagaaagccactatcggcttctatttcttgcctaacaacgatcacttctactgcctcatggaggagatgaacaacttcgttcattccaactgttaataccactcaccctgcgtagttataacctctacttaaccatacgtaacaaaagttccttttccccctttaaatgtttttttatcaatggtgggtagttataagacttgttttgggttcttccttgattactacctttcgatttttgcggtgcctgtgggcgttgagcaccaaccatatacaaggaaaagggctttctctagttagctt

SEQ ID NO: 14169 - DNA, 234 bp, Gossypium hirsutum
  Clone ID: uC-gsflnu33B023g03b1
aattaggtggttcaagcaaaaacccatttctagatgatgacagctcagatgtcaatcagccaagtcatatcgagacgacggtcacttatgtctttcccctgtcgaatggagaccccatacttccaaatgtttccctggactccatggatctgagtgacggatcagtgagcagtgatacaagtcagaaatctccaccagcagtgccctctttgtttggagaggatgtccaattct

SEQ ID NO: 14170 - DNA, 403 bp, Gossypium hirsutum
  Clone ID: uC-gsflnu33B023g06b1
tttcacgcgtccgcccacgcgtccggcttcactgagctctctctctctctctctctctctctctctctctctcccatttccctccatggccgtctcttttaaaatgtgcgcgagtttcggtctatttgtgggtcttatgatgctgggtctggtaagctcagctaagttcgatgagcttttccaacctggttgggctatggatcatttcatctatgaaggagagctccttaagctcaaactcgacaactattcgggtgctggctttgcatcaaaaagcaagtatctatttggaaaagtgaccatgcagattaagcttgtagaaggcgactctgctgggactgtaactgcttattatatgtcatcggacggtccaaatcacaacgagttcgatttcgagtttcta

SEQ ID NO: 14171 - DNA, 237 bp, Gossypium hirsutum
  Clone ID: uC-gsflnu33B023g07b1
ctcacgcgtccgcccacgcgtccgattttaataaactcaattcataccaggtgtttgtggaattttcttaattgactgaataacctggcgttttattcttgcttgtatgctctgaagtgtatacaaacaaattgattgtctcaaacttctatgtgcatggcaagacataacaaattgattgaatatatcaaacaggttgttttgttaattaaaaaaattttttcatatacattttat

SEQ ID NO: 14172 - DNA, 428 bp, Gossypium hirsutum
  Clone ID: uC-gsflnu33B023g12b1
gttatagctatgggaagcgggctcattctcactctggctattctgagaatggatcaaataagaggagaaatgcaggtgatgaacttgtacagatatctggggaagctgcagttgtgaagaaggctctgcatcaaattgcatctcgccttcatgagaacccttcacgatctcagcacttgcttgcttctgctgtgtcaaatgcatatcctgctgctggtgcaatgcttggtccagctgctggtgcccagatcgtagggataacttcattggttggaccttatggacgatacaaaggtgacactggagaatggccacgctctatggactcgggttcaagggatgagatggcattaaaagaattttcttttcgtttggtttgtccaactgcttatattggaggagtgattggcaaggtggtgcttttatca

SEQ ID NO: 14173 - DNA, 350 bp, Gossypium hirsutum
  Clone ID: uC-gsflnu33B023h01b1
ccttctcgtccgccgtgattccgctctttcctctcaggtcatcttcctcagttctgttcgagggtgcaataattctttttcttctcttttctaccaagagctatcacattgaactgcagggatggctgaggagggtcaaaaagttatctcgaatgtgtatgacttgagccaaggacttgctcggcagctctcaatgaccttattagggaagcctattgagggaatatggcacactggagttgcgggttatggcaatgaatactattttggcggaggaattcaacattctcctgctgggacgaccccatatgggacaccaattagagtgattgaattaggagtcacccatg

SEQ ID NO: 14174 - DNA, 454 bp, Gossypium hirsutum
  Clone ID: uC-gsflnu33B023h02b1
tctgaggcaggtgtttagtaatcaaatgggtcttagcgaccaggacattgttgctctttctggtggccacaccctgggaaggtgccacaaggagaggtctggatttgagggaccatggactaccaaccctcttatcttcgacaactcttacttcaaggagctcttgactggagagaaggacggcctgttacagttgccaactgacaaagttctcctttccgaccctgttttccgtccattggttgagaaatatgcggctgatgaggatgctttctttgctgattacactgaagctcacctgaagctctctgagctaggatttgctgatgcataagctgatgattgcataagaggtaaaagccaacaacacaatcctacacagacgttttaagttttgatttctctttaaagctggctttaggaatgaatttgggtgtttttttttgggaagatt

SEQ ID NO: 14175 - DNA, 469 bp, Gossypium hirsutum
  Clone ID: uC-gsflnu33B023h04b1
gtatccctgaccaaggaaagtgctactagcaaatcagtgtattttgcacattgtacatcagaaatgatatttattacccatttgttggctgaagaaccagagaagctggcaggccctttgctggctgacacttatgtgacattgttaaaaggtcgtaatgcatggtatggccaaatgttagccaaaggagaactaagtcgagatatgggtgatagcatcagcggaaaaggaatgattcagggagtgtctgcagtaggagcattttatgaacttctgagtcaatcgagcttaagtgtgttgcatccagatggaaacaagcctgttgcccctgttgagttgtgccctttattgaagacgctctacaaaattcttataacaagggagaagacggctgaagcgattctgcaggcactgagggatgaaaccctgaatgatcctcgagagcgcatcgagattgcccaaacacatg

SEQ ID NO: 14176 - DNA, 310 bp, Gossypium hirsutum
  Clone ID: uC-gsflnu33B023h06b1
tctacgcgtccgatcggcgatgggaaagtggttaccggataacatctatggctgcgaccgtagatcaagctgccttcatactgagcattccaaaacgaaaaacgatggatgaaactcaggaaactcttcgcacatctgcctttccaagcacccatgtaaagggaaaatgggcaaaaaatctctacattgcatcgatttgttatgggcggacggtctgctaactctggactgtaaattacgagagtccaaaaatgttaaaaatctgaagctgttgaggtatatttggtgttgagatatgggggctgggggg

SEQ ID NO: 14177 - DNA, 417 bp, Gossypium hirsutum
  Clone ID: uC-gsflnu33B023h07b1
tttacgcgtccgcccacgcgtccgctgccttgtacgtagtaacagtagcgggaaagagagaagcctcaccaccgctgccgcagccaccatgggtcgtatgcacagtcgcggtaagggtatttcagcctcagctctgccttacaagaggaccccgccaagctggctcaagatctcttctcaagatgttgaggaaaacatttgcaagttcgcaaagaaaggcttgaccccatctcagattggtgtcattctccgtgattctcatggtattgctcaagttaggagcgttactggcagcaagatcttgcgtatcctcaaggctcacggtctggcccctgaaattcctgaggatttgtatcaccttatcaagaaggcagttgccatccgcaagcatttggagagaaacaggaaggacaagga

SEQ ID NO: 14178 - DNA, 334 bp, Gossypium hirsutum
  Clone ID: uC-gsflnu33B023h09b1
ttccgtagcagcttgactctgatacttaatgatgcaaaggctccccttgatgtgatagcatttactgcaatttcattgggtttgatatacgtgggttcctgcaatgaggaggttgcacaggctattatatttgctttaatggaccgaagtgagtcagagttgggggagcctctcactcgtcttctgccacttgctcttggtcttttataccttgggaagcaggaaagagtggaggcgactgcggaggtctcaaagacgttcaatgaaaaaaataagaaaatattgtgatatgacactactttcttgtgcttatgctggaactgggaatgttctg

SEQ ID NO: 14179 - DNA, 389 bp, Gossypium hirsutum
  Clone ID: uC-gsflnu33B023h10b1
gtctttttaagtcataggtttataatgtaattttatctacttgtttatatataaaactagtttgtaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccatttaaaaaaaaaaaaattgactcacagtaccatcaaagaaaaaaattttaaaatatggcgaaaaaaaaaaaaaaagttgggcgtattttaaaaactgggaaagggaaaaaagtccggaataccaaaaataattgtgctcaaaaaaaaaacaatttcc

SEQ ID NO: 14180 - DNA, 314 bp, Gossypium hirsutum
  Clone ID: uC-gsflnu33B023h11b1
atgaaacccatgagaggttgctggatcttgtttcactgttttgttatgtgccacgagcaaagtatctccctttggggccaataagtgcaaaactcatcgacatatatcgtacacggcataatattagtgcctcaactgggttgagtgatccagctgttgccactggaatttctgatcttgtttatgaatctaaaccggccaccactgaatctgatacactagatgatgatctagtaaatgctagtgcagtcaaccttggtgatgtgcccgctgagaacagccggaaacaatatatagcttgggcttggaacttt

SEQ ID NO: 14181 - DNA, 430 bp, Gossypium hirsutum
  Clone ID: uC-gsflnu33B023h12b1
ttcacgcgtccggaaaaagggggaaaaacgtgaggatcaatcattgatggaaaacatgggagtcctaggcaaggtggaggattaccttatatggttatcattcttcaacatcacattaacagctcagttggacatcctcgagtacatactcccccactcctacaatcccttctatcaagtttataccacgttaacccaagattatttggtgcttgagcagcactgcttttttcaaggcacttatgacgatggcacttgtttaccaactccctctcgctacgcttaacatctatgggttgttatactctaaaccctggttcaacaccagctgcctcctctttggtgcctatatcggtgcctgtacgacagatatggtgggagacaatctcaattgccagaaggcatcagccaatttgatggccatgtatta

SEQ ID NO: 14182 - DNA, 218 bp, Gossypium hirsutum
  Clone ID: uC-gsflnu33B024a01b1
tatggaagccaaatggatggtttctcttcatagtgccggtaatgctgttggcactggccaactgcccgtgaatcgttgtaagccatttgttgatgatggcaaacgggcatcgaacgctgtgcgacatagggtgggaatgtaaagggtgtccataagtattgctgcaaccataccatttctgattactttccaaaacttacctgttttgaggacctttt

SEQ ID NO: 14183 - DNA, 226 bp, Gossypium hirsutum
  Clone ID: uC-gsflnu33B024a02b1
ttaccatggttgggttggaccatgcaagcaggtttctgtgttgtatgaaggctttggagttggagatgcctccaactatgactctgttaaaagttttgctcaactttatgtggcctaatggtcacccacacttttctgacactattcatacccttagggacgcaaatggaggagttgtacaagttaatttggttaatgctaattgatagttatggattaggggatg

SEQ ID NO: 14184 - DNA, 116 bp, Gossypium hirsutum
  Clone ID: uC-gsflnu33B024a05b1
gtggaggagatccactgactctctaatcaatggctgatcctgaactagaagcaaataggcaaagaaggacgcaagagttaatggctcgacagggggtggggattcatcaccgtctc

SEQ ID NO: 14185 - DNA, 441 bp, Gossypium hirsutum
  Clone ID: uC-gsflnu33B024a10b1
tatgttgatccagaagctaagcttttgttcattgttagaatccgcggtatcaatgccatgcacccaaggaccagaaagatcttgcagctcctacgtttgagacagattttcaatggtgtttttcttaaagtgaacaaggcaacaatgaacatgcttcaccttgttgaaccttatgtgacttatggatacccgaatcttcaatgagtgttatgggaacttcgtttacaaaagaggttttggaaagttgaacaagcagcgagttgccttgaccgacaacgcaattgttgagcaggcactaggcaagttcggcatcatttgtgtttgaagatctcatccacgagataatgactgtgggacctcatttcaaggaagccaacaactttctttggccaattaagctcaaggcaccattgggtggtctgaagaagaaaggaaccattt

SEQ ID NO: 14186 - DNA, 296 bp, Gossypium hirsutum
  Clone ID: uC-gsflnu33B024a12b1
cactccacacatgaactgattacaaatgttgggtaatatattagttaccactataggttgactaggatggtagaccaggcaatgtttcctcatttattttgttccttcttttttctttttttatttttatgatgattgccgaaacagaaatcataagctatatagatttatcttctcattacagtccttcaagaatggttcaccctataaagttgtaaggtacatcataatggacaataaagttctgggtttgtaagctattcttccaaaaaaaaaaaaaacccttatatctttat

SEQ ID NO: 14187 - DNA, 492 bp, Gossypium hirsutum
  Clone ID: uC-gsflnu33B024b09b1
caaagtttctaacttcctatctcagcaatctcgttctactcttgaaccatgtcggctgctgaatcagctactgcaattcacagaaaccaagttgatctcttggatttttattgattggtctggagttgaatgccttaaccaaagctccagtcaccctttgcccaatgctctcaaacagggttatagagaagatgaaggcttgaacctagagagcgatgccgatgagcaacttctgatttatatccctttcactcaagttattaaactacattcctttgtttgtcatgggatccgaagaggatggtccaaagacagtgaaactttttgcaaacagggagcatatgggggttagtaatgtcagtgacttccctccaagtgacaactgttgtttttatcccaggataatctaaagggaaaaccctgaattcgtgaagtatgtcaagtttcagaatggccgtagcttgcaatatttatcgaagacaatcagtcagg

SEQ ID NO: 14188 - DNA, 274 bp, Gossypium hirsutum
  Clone ID: uC-gsflnu33B024b11b1
ggcattaactatggcactctaggaaacaacctcccttctccaaagaaagttgctcagctcctccaatctacgctcattgataaagttaaaatctacgacaccaaccctgatatccttgaagccttttccaacaccggagttgaccttattgttgccgttgaaaactaccacgtcgccaacattagcaaggacgcagccgcagccgacgactggtttgtcactcgtgtgcagcccttcatccccgccacttccatcgttgctgtttgtgtaggca

SEQ ID NO: 14189 - DNA, 457 bp, Gossypium hirsutum
  Clone ID: uC-gsflnu33B024b12b1
atcctcagttttactggaggatcatgaaagaagctgatataggccttgcagatgcatatatccatggagatttttcttttcttgatgaaactgaaggccttcttaatcttttccggattcttgttgccaataaagagaactcagctgcctcagggtcgaataaaagaaggacttggtggtcacctgctctgttaacagctagtatatcatctgcaaagtattttgtgaagcatctcttgagacaaaatactattacacaagctcgtaggaacatttctcgtcattatgatctgagtaatgaacttttcactctatacttgggcaaaatgatgcaatactcttctggagtctttaggacgggagaagaacatttggacgttgcacagcgtagaaaaatcagttctctaattgagaaagcaaggatagagaaacggcacgaagttctcgacattgggtg

SEQ ID NO: 14190 - DNA, 106 bp, Gossypium hirsutum
  Clone ID: uC-gsflnu33B024c03b1
ttttaactatgtcagaacatctcattttctcattcatgaattgttttgatattccctcatttattataagattgccgctttctctcacgcgcatcagaataataaa

SEQ ID NO: 14191 - DNA, 475 bp, Gossypium hirsutum
  unsure (1)..(475): unsure at all n locations
  Clone ID: uC-gsflnu33B024c04b1
cgtccgcccacgcgtccgctttgtttcaattaaattatctcccaatttttcttttttagttttctttatttttcctctccttgatcgttgttagctgcaaaaaggttacgtcagaaatggattttttcttcagaggcctaaatgaggaattttcatcttcccaaatggacattcttagatgtccatttttgaaaacattaacgagccaactaacttttccttctcgtctgccttgccttttcccatgccggtacgaggagccaaaggaccaatatttgaagatggacccaatttcgacatggcattcaggcttttccatggacgtgacggagtagttccgctatctggacaatcatccttgcgtattgagaaagctgagaccgaaacagccccaccaaagttcaatcctttggctgcanaggcagccaccattagtctcttatcctttggaccgggaggggcctttcagttttga

SEQ ID NO: 14192 - DNA, 87 bp, Gossypium hirsutum
  Clone ID: uC-gsflnu33B024c07b1
caatgggagattccagccttgcacttggcacatcagcgcataaagcgcttggtggcggctcagattctgatgtggtattgcggagaa

SEQ ID NO: 14193 - DNA, 103 bp, Gossypium hirsutum
  Clone ID: uC-gsflnu33B024c08b1
ggtagaagatttgagggaaaagtcgcaattgtgacggcttctactcaaggcatcggcttcagcatcgccgagcgttttggtttggaaggcgccgccgttgtcg

SEQ ID NO: 14194 - DNA, 432 bp, Gossypium hirsutum
  Clone ID: uC-gsflnu33B024c09b1
gccgagccgagttcggccctgcccaacctttcaagggagccaaaatcaccggttctcttcacatgaccatccagaccgccgtcctcatcgaaaccctcaccgccctcggagctgaagtccgttggtgctcttgcaatatcttctctacccaagaccatgccgccgccgccattgcccgtgactcggcagccgtgttcgcctggaaaggtgagaccctccaggaatactggtggtgtaccgagagagcccttgactggggtcccaccggtggacctgatctgatcgtggatgatggtggtgatgctactctgttgatccatgaaggagttaaagccgagcaggtttatgagaaaaccgggcagcttccagatccgtcttctaccgacaatgccgagttttagaattgttttgaccataattagagatgggttg

SEQ ID NO: 14195 - DNA, 75 bp, Gossypium hirsutum
  Clone ID: uC-gsflnu33B024c10b1
acttttgtttgcctttggtttaggtgattgaagatggtttgagttaatattgaataccatgtatgtgtatgacac

SEQ ID NO: 14196 - DNA, 216 bp, Gossypium hirsutum
  Clone ID: uC-gsflnu33B024c12b1
ttaggcaccaaggtcattgatgacgatgaggaataatttttatctgtctcttgtttacttgcattttgttctcctacaagtttcatcagagttttgactagttttacaattgtgacattaaaaatatttggtttgtgttatttagattcttaagcttgtcgctttagtttagagctttataaatagattcaaatgatgagtgtttggatttatgtt

SEQ ID NO: 14197 - DNA, 390 bp, Gossypium hirsutum
  Clone ID: uC-gsflnu33B024d01b1
cccaaaagtcatgagttgattaaactaatggccggaatcggacctttgactcaagattgggagcccgtcgttattcgtaaaaaagcccctaccgccgtcgccaataaggatgagaaagttgttaacgccgtccgtcgtgccggtgccgagatcgagtccatcaaaaaatcaaatgctgggacgaatagggcggcttcaagttgtacttttttgaacacaaggaagctcgctgaagacactgagaatcttgctcatgaccgagtgccaactgtgctaaagatagccattatgcaagctcgaatggattagaaacttacccaggctcatcttgctcagatgatcaatgagaagcccctagattatacaggagtatgaattccgaaaagccat

SEQ ID NO: 14198 - DNA, 523 bp, Gossypium hirsutum
  Clone ID: uC-gsflnu33B024d04b1
gttctcccttttgttttctatattgatctcaattctgttcttcaacaatataatcgctgaatcaaccttcggccctgaaacaatggcgacaaccactactttgggcggagaccacccttcccaaggctcccaaaacagcgtcgagctcgaaaacctagcacgctttgccgtcgacgagcacaacaagaaagaaaatgcaatggtggagtttgtgagggttgtgaaagcaagcgagcaagtttgtggcggggacacttcaccatttgacggtggaagctgtcgacgccggcaaaaagaagctttatgaagccaaagtttgggttaaaccttggatgaattttaaagaaatgcaggagtttaaacatgctggtgatgcttgatggttccgcttcttttacaggttgcgatcctggtgccaagaaaagatgtccatggaccaatgctgtaagcggtgggcacaaatgaacccgttgtcaagaagctgtggtcatgctgtgaagacctaccacagaaatccattccc

SEQ ID NO: 14199 - DNA, 277 bp, Gossypium hirsutum
  Clone ID: uC-gsflnu33B024d09b1
aggggcaaggaacttttggatacataacacaggacctcttggatgcttagctcaaaatgtcgccaaattcggaacggatgcatctagccttgaagagcaagggtgtgttagaaagcataaccaagctgccaaaatcttcaatctgcagcttcatgcccttactaaaaaattgcagggcctgtatacagatttgaactttacatacgtttgacatctacactattaagtcgaaccttatagcaatatattcaaaacttggtttttgatcagcctatat

SEQ ID NO: 14200 - DNA, 90 bp, Gossypium hirsutum
  Clone ID: uC-gsflnu33B024d11b1
aaaaaaaaaaaaaaaaaaaaaaaaaaaaaaaaaaaaaaaaaaaaaaaaaaaaaaaatgataaactctaaattgatattcatatattatag

SEQ ID NO: 14201 - DNA, 63 bp, Gossypium hirsutum
  Clone ID: uC-gsflnu33B024e03b1
atggggtgactaaacaagaatttaactctttgttctatcactacttaattttattggaaggag

SEQ ID NO: 14202 - DNA, 327 bp, Gossypium hirsutum
  Clone ID: uC-gsflnu33B024e04b1
ctcttacttcaaggagctcttgactggagagaaggctggcctgttacagttgccaactgacaaagttctcctttccgaccctgttttccgtccattggttgacaaatatgcagctgatgaggatgctttctttgctgattacactgaagctcacctgaagctctctgagctaggatttgctgatgcataagctgatgatgattgcaaaaataggaagaagccaacgacacagatgttttaggttttgtttcctctctaaagctggctcaaggaatgaatttggggaggcattccatacaagctttcttcgaataatcttaatcttaa

SEQ ID NO: 14203 - DNA, 110 bp, Gossypium hirsutum
  Clone ID: uC-gsflnu33B024e05b1
aggatagtagtataaatcatagtcaaaactcttttttatagcacagtgaaacttattgtatatatacattttacagaaaacagaaaagatattggaagtaatgtcgacgt

SEQ ID NO: 14204 - DNA, 157 bp, Gossypium hirsutum
  Clone ID: uC-gsflnu33B024e06b1
atattcagcaaagggttagtgaatccaccccaagagctgcagagtccagcttcactcacttcatcaatgaagcctaagcttccctttgaaatccttaatggttttggtccttcaaatcccaccaacgctttctaatgcggtttgtttctttgtctac

SEQ ID NO: 14205 - DNA, 329 bp, Gossypium hirsutum
  Clone ID: uC-gsflnu33B024e09b1
agcgaagaaggacgtggcttgtctgcgataagcctcggggagccgacaagtaggctttgatccggggatgtccgaatcgggaaaccgggcagaagaaattctgtcatctctcagtgaattcatagctgagtagaagcgaacctggggaagtgaaacatcttagtacccaaaatgctgcctaaactttagcataagacatccagatatgtattgctgcagtagttttttctaaagattagctggagttgtttatttatgaagttgtgaccaaaattttgagaactatttacttcttgcaatttatctttttttctgggtgatgtttccta

SEQ ID NO: 14206 - DNA, 463 bp, Gossypium hirsutum
  Clone ID: uC-gsflnu33B024e11b1
atcttccaaatgctatgaatgctgctgagattaccgacaagcttggccttcattctctccgccagcgtcactggtatatccagagtacatgcgccacatctggtgaaggactgtacgagggactggactggctctcaaacaacattgcaaacaaggcatagatggcgtaattgacttgtcagtctcagaaaatgccagccccttttggaattattgatgtttctacgtccgttaaaatgttttggtttttcatgttcttttgtttcttgcaaactttgtcatttgttcttgtagtttaagaataattgataaaattttcggtttccattgttgttcttggtagttggaaaaaaacaatgttttccccaatctcgaggccattcctttcttgatggaaattaacaggttaagtcgcgttctttaatctttaaatataaagataccagattcctttggattctct

SEQ ID NO: 14207 - DNA, 307 bp, Gossypium hirsutum
  Clone ID: uC-gsflnu33B024e12b1
agaagatggcccgtaccaagcaaaccgcccgtaagtctactggtgggaaggctccaaggaagcaacttgctaccaaggctgcccgtaaatctgccccaaccaccggtggtgtgaagaagcctcatcgataccgtcctggaactgttgctcttcgtgaaattcgtaaataccagaagagtactgagcttcttatcaggaaattgcctttccagaggcttgttcgtgaaattgcccaggacttcaagactgatttgcgtttccagagccatgctggtttagctctccaaggaagctgcataggcatacc

SEQ ID NO: 14208 - DNA, 140 bp, Gossypium hirsutum
  Clone ID: uC-gsflnu33B024f11b1
tctttccctcactttctcgaaaaaaaaaatgtcttcaggttgcaattgcggatctaactgcagctgcggtgacaactgctcatgcagcaggaaccttaaccttggatattcggagaagacaaccagttctcataccatca

SEQ ID NO: 14209 - DNA, 103 bp, Gossypium hirsutum
  Clone ID: uC-gsflnu33B024g03b1
gtaggtctcattcatgccaaccatggtgagggcattaagcaattccttcgtgaaagcttacgcggcacgaatgttgaggatatccaacatggtgcatgctaag

SEQ ID NO: 14210 - DNA, 207 bp, Gossypium hirsutum
  Clone ID: uC-gsflnu33B024g05b1
gatttccgattgaggcttggaatctctaaagagtgatcaaacctattagtggattatactaatagagatgagattcacttcttgcggggaacaatatctccagccttcagtctttgttctccaatacctcctattggtctttactatatcaaaggaaaaaaaaaaccatagccattgaaagtaggaattttgtgcaactattttaat

SEQ ID NO: 14211 - DNA, 426 bp, Gossypium hirsutum
  Clone ID: uC-gsflnu33B024g12b1
acaaggggaaaaatcaagttttttttttcttttgtagaatcaaatagataatgttcaggaaccaatacgataccgacgtcactacatggagcccggcgggccggttgttccaagtggagtacgcgatggaggccgtgaaacaaggctcggcggcgatcggactccgatctaagacccatgttgttttgggttgcgttaacaaggctaattccgagttgtcttctcaccagaagaagatcttcaaagtcgacgaccatatcggtgtcgccatagccggtctcaccgacgaccgacgcgtcctatctcggtatatgcggaacgagtgtatcaactatagcttcacgtacgattcgccgcttcccgtgggccgactcgttgttcaactcggcgtataagcccaagtctgcacccaacgtttttggaaac

SEQ ID NO: 14212 - DNA, 114 bp, Gossypium hirsutum
  Clone ID: uC-gsflnu33B024h01b1
attgaaggaaaacaggtattcaacaactcagaaagctgctcctgctaaggaaaagaaatcaagcacaaacaaagccaaagcttcagatataaaaagtggttcaaataaagaact

SEQ ID NO: 14213 - DNA, 76 bp, Gossypium hirsutum
  Clone ID: uC-gsflnu33B024h03b1
gaagagaccggcaagcgtaagctcaggatcgaggcttggtttggctccaggaagatcagtcgccgtccttcgtaca

SEQ ID NO: 14214 - DNA, 228 bp, Gossypium hirsutum
  Clone ID: uC-gsflnu33B024h08b1
tcagtcttatctaccgacaaccatcaaaagctacgcatcgcccaaaatttgataaagaaagtcccactccctctgtcatcagtctccagcaccataactttcgtactcaccctttagccaacagagcagtttgtccccggtcctagcagtactgtcaagcacaggtgtcttgtaccctttggcgtaaatcacccaatgaccccctctgtctacttcttttaatgcttt

SEQ ID NO: 14215 - DNA, 142 bp, Gossypium hirsutum
  Clone ID: uC-gsflnu33B024h09b1
tttctcgtcaatatggcagcaaatggcgttgtttctgacaagagcttgatcgtcagcttcggtgagatgctgatcgattttgtccccactgtctccggtgtttctctaagccgaagctcccggcttacttaaagcccctggc

SEQ ID NO: 14216 - DNA, 520 bp, Gossypium hirsutum
  Clone ID: uC-gsflnu33B024h10b1
cagatctcaaaaagtgtgagatggcagcaccatccacagctaccttcttgtcgttccgaagccagtgcatctaggaatgacttgaacttgaatcctgatggatctgccgtgaatcctgcagctttccaacaacagattcgacaggattctaatctaattggacaattatttcagaccgatcctgagcttgctcaagccgttgtcggaaacgatctcaacaaactgcaggagattctccgagctcgtcatcaacgaagatctgacttgcgacggcaagaggaggaggagcttgctcttcttcaagctgatccttttgatgttgaagcacaaaagaaaattgaggctgccattcggcagaaagggattgatgagaactgggctgctgccttagaatataatcctgaaggctttgcaagggtggttatgctgtacgtggacatggaggttaatggtgtcccattgaaggcatttgttgatagtggtgcccagtcaacaattatttctaaagctgtgctgagcg

SEQ ID NO: 14217 - DNA, 452 bp, Gossypium hirsutum
  unsure (1)..(452): unsure at all n locations
  Clone ID: uC-gsflnu33B024h12b1
accgcttctctcttctcttcctcctcctttcctccgtcgttgcttcggccgtcgtctccgacgttaatagcgatgacgatcctctcatccgtcaagttgtttccgatggtggtgtcgaggaggactccgatgaccatctccttaatgcggagcaccacttcacgctgttcaaatccaagtatgggaaaacctacgcatcccaggaggagcacgattaccgactgggagtcttcaaggctaacctgcgtcgggccaagcgtcatcaggtcctggaccccagtgccgtccatggcgtcacaaagttttccgatttaactctatcggagttccgccgccagtatctaggcttgaaaccgctcaagctcccagcagatgctcaaaaggctcctatccttccgactgacaacttaccggatgactntgactggcgtgaccacggtgccgtcactggc

SEQ ID NO: 14218 - DNA, 185 bp, Gossypium hirsutum
  Clone ID: uC-gsflnu33B025a02b1
ctacgcgtccgactctttgtcagcgtttcacactttctaaaactccaatatcccaaaacaatgggttcaaccggtgaaacccaaatgactcccacccaagtctcggatgaggaagccaacttattcgccatgcaactcaccagtgcctcagtccttcccatggtcctcaagtcggccatagaact

SEQ ID NO: 14219 - DNA, 270 bp, Gossypium hirsutum
  Clone ID: uC-gsflnu33B025a05b1
agaggaccgcgcccaaattggttgatccacgcgtcttttctgtactccaccatagacagactacaggtgcatagagccggtccgcatgaccgatcactgggtttactgggtgggacccctaatcggaggtggccttgctggctacatatatgagaacttgttcatcgtcagaacccatgttctccttccccagaatgaagcctttttagagattaatctcagtcatcagaataccgcaatgtgagggcggcctttaatgaacccaagcgt

SEQ ID NO: 14220 - DNA, 69 bp, Gossypium hirsutum
  Clone ID: uC-gsflnu33B025a06b1
tcgtcttggagtttggatgacagttgcctatagggactttttaagatacgatgactttgaccgaaaagc

SEQ ID NO: 14221 - DNA, 181 bp, Gossypium hirsutum
  Clone ID: uC-gsflnu33B025a09b1
tattttttttttattttttttttttattggggtttttttttttattttagagtgtaatcccctttttcccccggcttcggggggggggtctctttgggggtccccggtttccttccggttggggggcgggctgggggttctgtgtggggttccgtgttgccctggctctggccggtttttt

SEQ ID NO: 14222 - DNA, 141 bp, Gossypium hirsutum
  Clone ID: uC-gsflnu33B025a10b1
tgtgtacgcgtccgcccacgcgtccggcctcaaaaagcaaaaaccaagtagagggagttgaagtttatggtatgatggtgttgaaacgcccaaccttaatggatatgctggaacttgtagaattttgttataactagtcag

SEQ ID NO: 14223 - DNA, 239 bp, Gossypium hirsutum
  Clone ID: uC-gsflnu33B025a11b1
ttttagttggaattgtcatcaagacagactacaatgagcaccctgacgatgactttgaccgaaaagccctcccaataataagggacataagcttaccgagatacatggcacggagttcgtgtacctgtagaatacacggagcgaagatttcatcaaacggcgtagagaatatcatggataacatataagagagcttattcagggcttgtaaggccggtaatagggaccatcttccctgc

SEQ ID NO: 14224 - DNA, 245 bp, Gossypium hirsutum
  Clone ID: uC-gsflnu33B025b04b1
ttcttttcccatttccaatctccagctcccaaggtaaatatgccgatcagaaacatagcagttggccggcccgatgaggcgactcaccccgatgctctcaaggcagctttggctgagttcatctaaccttgatctttgtttcgctggatcggctcaggaatggcttaacaagttgaccgcacggcacaccccgcggctgagcgcgtctaggtatgcgtggacttttcgtcgctgtctccgttggc

SEQ ID NO: 14225 - DNA, 228 bp, Gossypium hirsutum
  Clone ID: uC-gsflnu33B025b06b1
ctatagacggaccagagactccaagggggatttcaaagaccacctttccccaaacgccgattccgctgtaatggtcccacgtgcctattacccaccgaccttagccaatggagccgcaaagatgttttggcgacccgtagccctctcctaaagaggcatattactacaggatgatttatgagagaatatactcaataatgaaaatgtggtggaaaacctctaagggag

SEQ ID NO: 14226 - DNA, 85 bp, Gossypium hirsutum
  Clone ID: uC-gsflnu33B025b08b1
tcctgtatacattagcatgggataacatcataggatttcgatcctattgcgccggcctccgggaccggagtaatgactaacaggg

SEQ ID NO: 14227 - DNA, 193 bp, Gossypium hirsutum
  Clone ID: uC-gsflnu33B025b09b1
ttaaaatctttccagtttcaattttctcacaacaaaactgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagataaatgcacctttg

SEQ ID NO: 14228 - DNA, 226 bp, Gossypium hirsutum
  Clone ID: uC-gsflnu33B025b10b1
tcttcacgcgtccggttccctggtattgcagaccgcatgagcaaggagatcactgcacttgctccaagcagcatgaagattaaggtcgttgcaccaccagagagaaagtacagtgtctggattggaggatctatcttggcatcactcagcaccttccagcagatgtggatttccaagggtgagtatgatgaatccggtccatccattgtccacaggaagtgcttct

SEQ ID NO: 14229 - DNA, 241 bp, Gossypium hirsutum
  Clone ID: uC-gsflnu33B025b11b1
ttcacgcgtccgcgaaactcctcaatttaacggttctccgtcgcatcgaccctttcgtcgaagaaattcttatcaccgctgctcatgtcgccttctatgagttcaacatcgaccttagccaatggagtcgaaaagatgtcgaaggatctctttttgctgtcaagaggaatacgcagcctaggtttcagtttattgtgatgaatagacgcaatactgataatttggtggaaaacctcttggg

SEQ ID NO: 14230 - DNA, 264 bp, Gossypium hirsutum
  Clone ID: uC-gsflnu33B025b12b1
tgtatccctatctgccaaagcatatcctctacagacaaaaagaacagttcagtgatggtgttggttatagttggatcgatggtctcaaggcccatgctgcccgacatgtgaccgataagatgatgttcaatgcttctttcatatttcctcacaacacaccaactacaaaagaggcatattactacaggatgatttttgagaggttttcctaaactggcagatgctgtctgaggagctagtgtggcatgcagcacagcctaaaag

SEQ ID NO: 14231 - DNA, 117 bp, Gossypium hirsutum
  Clone ID: uC-gsflnu33B025c02b1
cgtagtgaaagacaagacacagagagagagacagagagagagatgtcgggaggaatagcgcgtggtccactcgcctaggaacgtaaggcatggaggatgatccatccctcttggttt

SEQ ID NO: 14232 - DNA, 485 bp, Gossypium hirsutum
  unsure (1)..(485): unsure at all n locations
  Clone ID: uC-gsflnu33B025c12b1
tttagaaaaaggctaaacatcagttgcaaaagcaggtatgggaagaaaagcctggagatgaaaagaaagatatagcaacaacaaatggtgatttgatcaaagaagccaatccaattcctcactcgaacggccttctttcagaagatggttcaggataccctaaacagtgaagaactttttatcaaacggttgctaacattttctatggatccccttagggatgtgtttgtggtcttgtaaatatatatactgaattggctctgggctgggttttttctttttatcctttgagggcctttttttaagggaaanaaaattttcttttaaattttttaaattttaaggggaaaattcttttttttttttataccccaaatggtttttttatccccccccaatttttgggggggggggggataaaacccccccccaatttatttccccttttttttttcccaaaaaaaaaggggggggggggggggggg

SEQ ID NO: 14233 - DNA, 234 bp, Gossypium hirsutum
  Clone ID: uC-gsflnu33B025d10b1
tttcacgcgtccggtgagcgaagagcttggccgtggagttaggtgagcatggaattagagttaattgcatttcacctcacgcaactgtgaccccattgttccaaacaacactggggttgctcgataagaagaagggagaggagatgattgcggcttcagctgtgttgaaaggcaccgtattggaacctgaagattttgcacatgcagcactgtatttggcaagcgattgaggct

SEQ ID NO: 14234 - DNA, 250 bp, Gossypium hirsutum
  Clone ID: uC-gsflnu33B025d11b1
tttgaaaatgaattttacaagggaaaacaagattttatcatctgctgtgcctctttcaattgtcagagaacagcctagcagaatacctaatgattctgatccttctacatcttctaaagaatctttaccagaaccaactgtaaatactgaaagaaaacgacagtgttcaagtggctctgatgggcacggcgatgtgcaaataagaaagagtttgaggagcgaccaaaaaaggaggaagaaaggtgatgca

SEQ ID NO: 14235 - DNA, 242 bp, Gossypium hirsutum
  Clone ID: uC-gsflnu33B025e06b1
tcctatgatagctggagcccttagcgagttctatcgggttaagccaatgatcagaggcatcgggggcgcaacgccctcgacctattcccaaacttcaaataggcaggacctcttctcccctcacaaaaatacatcaccccctattcattctcccactcttatctttctcatccaatctaaaagctatatttctaatcactaagtctatactcagtgaacatcgaaaacaacattcttcttat

SEQ ID NO: 14236 - DNA, 82 bp, Gossypium hirsutum
  Clone ID: uC-gsflnu33B025e08b1
tccacgcgtccgaaatacacaagaaaaaaaaaacaagtgatctgataaattgaagactttatttctgttaacatccattatg

SEQ ID NO: 14237 - DNA, 147 bp, Gossypium hirsutum
  Clone ID: uC-gsflnu33B025e09b1
tcgtaaaaaaaaaaaaaaaaaaaaaaaaaaagaggaaaataaaaaaaaaaaaagaaaaaaaaaaaaaaaaaaaaaaaaaaaaaaaaaaaaaaaaaaaaaagaaacaagggatcaaaaaaaggggggccgccggagggggcccctggt

SEQ ID NO: 14238 - DNA, 213 bp, Gossypium hirsutum
  Clone ID: uC-gsflnu33B025e10b1
tccacgcgtccgcatgttacactctaacaccatttgttcaagcaaatccagtatgcagatccgagaattttagtactgttcatgtgaaacatcttaaaattgggagtcagcatcgcaatgcggtgaaggtttgtgcaacccggaggagaagggcagcatattcaaggactgaaacctatgttctattagaacccggagaagatgagaagtttg

SEQ ID NO: 14239 - DNA, 196 bp, Gossypium hirsutum
  Clone ID: uC-gsflnu33B025e12b1
ttcaaaaaactaaagaaatccttgaagtcctagcttggctcgctggcggtcgtcgcatggcctcggcaccctcacacgcgctccgactccgctacatgacggcggattgaaactcggtttaccatctaacatttttcctattgagtattgactgtgcatcatatgaaatagaagttgaaacgacagatcacccttt

SEQ ID NO: 14240 - DNA, 68 bp, Gossypium hirsutum
  Clone ID: uC-gsflnu33B025f04b1
tgtactgcgtgggcggacgcgtgggaaaaaaaaaaaatcctaaaaagcaaacaaccaaacactccaaa

SEQ ID NO: 14241 - DNA, 67 bp, Gossypium hirsutum
  Clone ID: uC-gsflnu33B025f05b1
atggagaacttagccccattttttctgcccccttggtatttttggcctcacaatcttgaacttttgt

SEQ ID NO: 14242 - DNA, 87 bp, Gossypium hirsutum
  Clone ID: uC-gsflnu33B025f06b1
tgtcttattgatggctcaaaaactcatacaaggcatataaacatgaaatgagatgctaccctaaaataaataaaactaacacactat

SEQ ID NO: 14243 - DNA, 182 bp, Gossypium hirsutum
  Clone ID: uC-gsflnu33B025f07b1
tccacgcgtccgtccactcgtccgcttgggtcctatcataaacagcaatggaagcattcgccttgatatcctcaaagaacaatggagccctgcactaaccatttccaaggttctgctctcaatctgctcgttgctgaccgatccaaaccctgatgaccctcttgttccggagattgctcaca

SEQ ID NO: 14244 - DNA, 218 bp, Gossypium hirsutum
  Clone ID: uC-gsflnu33B025f09b1
tttgaaagctaacctaattccaccctttcgattcttactagagagaactgggtcaaacatacaccacaaccactaacatcagtcttaaccacagacgcatgaaggacaatatggactatgcatggacggacaggaaggaactctaaccaccatgacacatgtaagcatatgcatcatccctatgactgccggtatgcggctaccagcctagtgccttc

SEQ ID NO: 14245 - DNA, 235 bp, Gossypium hirsutum
  Clone ID: uC-gsflnu33B025f10b1
tgtgagactggattaccggccagttcacatgaacacattagatgatgaagttgagtcattcccacctaaagctcgtgtctattaaaactcgtgctgtaatgcaaatgggttatgatgatccgacaattcagcccggcataagttatggagaacaaagatgcaataaaattacttgtaagcatattattttggcaatattcttgtgccattcatcaatcttggaactttctgtggt

SEQ ID NO: 14246 - DNA, 167 bp, Gossypium hirsutum
  Clone ID: uC-gsflnu33B025g06b1
tgccttcccttcctagatataacatttctccagggtacctaaggcatgtatccaccatcttcgccacaaaagcccatgggacaatccggcctcacccgtcacagttctgcttccgggccctttatggccaacgcctggtgattccctcatcggagcagtcaccaacc

SEQ ID NO: 14247 - DNA, 64 bp, Gossypium hirsutum
  Clone ID: uC-gsflnu33B025g09b1
tttctctccaatcactggtcgttcactgggaggccttttaaaatatgttgagccccctgaagct

SEQ ID NO: 14248 - DNA, 445 bp, Gossypium hirsutum
  unsure (1)..(445): unsure at all n locations
  Clone ID: uC-gsflnu33B025g10b1
ttttacgcgtccgtacgattgataacgtgaaagcgaagattcaggacaaagaaggaattccaccagatcagcaaaggttgatttttgctgggaaacagctggaagatggaaggactttggctgattacaatattcaaaaggagtccactcttcaccttgttcttcgtcttcgtggtgggttctaagccttaaggtcttccttaatgtgggttttctggtcttacgtgaagggattggtgccncttttgtattggnccctttttttaaaaatanaattttttcctttagcttcctttttttgggttttttaacccccggggtttttgggccaattttccctttaatttggtttaaatttgggggatttttttttccccttttcccttttttttttggggaaaaaattttgggggggggaaaaaaaattttttttttttggggcccc

SEQ ID NO: 14249 - DNA, 275 bp, Gossypium hirsutum
  Clone ID: uC-gsflnu33B025g11b1
ttgggctaagtgtcattatcagtgcagtgctgaccagcagggctattttccaaagaatgaagaactacactatctatgcagtttcaatcaccattcgtattgtgtttggacttatgttttttgccttgtcatggctttcttcttattctctttttttctattttatttctactacttttttctcctatattctctccctctttctctctattttattttattcttctcttttcttttttcctcattcttttctttaatatactttcccttttttt

SEQ ID NO: 14250 - DNA, 214 bp, Gossypium hirsutum
  Clone ID: uC-gsflnu33B025h05b1
cttatcctcatttccgtttctctcctcttaaatcccctcgcttctcctgctcagcctctgcttcaaccacaatggctaaacaagttttggtgccgatcgccaacgggacggagccgatggaagcggtgattacgatcgacgtgattaggagatcgggagctgacgttacggtgggttacctcgagaaagagctttcgcgttgacgccttgccac

SEQ ID NO: 14251 - DNA, 105 bp, Gossypium hirsutum
  Clone ID: uC-gsflnu33B025h08b1
tgcagaccggcacaaagggaatctggaaccgggaggtcaaagaaataacccgaacatcaaagacgaacacagacataacagttttggtcaaaccagagtacctag

SEQ ID NO: 14252 - DNA, 474 bp, Gossypium hirsutum
  Clone ID: uC-gsflnu33B026a02b1
gtttaagttacacatctctcaaacattccttgtacttaaaccaaaaaaataaaataaaattatagcacgaagaagaagacgaaacccaacttccctggaattcattatctttcttcagtcaaacaccacgctattgcttttgtttgcatatacaatcaggaaagggtatggcagctgaggacaatttggacttgtcgactctgcaatctcagcttagtgaaactcatgaactgtggaagcaggagattgaaaaacgtcgaggccaagttgacgtgttacaagccaaaattatggaggtaaaggcttctatacaagggtcggaagaggagtcgaagaaggagttagacgttctttggcgaagggtagaaactaccgctactttattgacttacttgaaatcaaaagcaagagtaatggctgttcccgatttagctcatatatcgtgtggcatcaaattattagacggggtagggc

SEQ ID NO: 14253 - DNA, 485 bp, Gossypium hirsutum
  unsure (1)..(485): unsure at all n locations
  Clone ID: uC-gsflnu33B026a03b1
tcccccgggtacccaccacgcgccctttttgttngccangnacatagaagtctcggggtcgattttctatttagccaaacaagatgcacatactgcggaagattctaaccggcaagacgatcactctcgaggtaaggaatcccgtgctacggggcatcgcgaaggccaacatccactaaatggagacattatgctcggaggatggcgtctgatcttcgagcggagacaactcctaatacgacttataggtggatcagccaacatgcataggagccatctactgccgcgggcctattacgttcaaggggtttacatagtcacgtacggcctatggacttacctactgacacttgcaagtggggagctgcgatccctaggtgatcctgaactcgaaggttccgacggacctctgttgccaacaaaaggttcagacgagttcaagccgtttattcgcaggctacccgagtttaattctgggactccat

SEQ ID NO: 14254 - DNA, 263 bp, Gossypium hirsutum
  Clone ID: uC-gsflnu33B026a05b1
tttctcacggacttgggctgctgatcgcaacggtggcgttaaaaggaagccaaatttacggcaagggactccgatatcgaacaggccgtcaagcctggctgagagagaacaggtcatacgtacgactgacaatgcgtctcagatccaccaccagatatggctatttacccagcatatccagctatgttggcatgccgcactcaaatgctcctgtatgggattacacatctcttgctgagacgcagttcacggtggagcatctt

SEQ ID NO: 14255 - DNA, 486 bp, Gossypium hirsutum
  unsure (1)..(486): unsure at all n locations
  Clone ID: uC-gsflnu33B026a07b1
agccttccgtaattggtcggcctttaaattctggtgggatttcgaaaatgccaggaagaggaaagggtggcaggggtcttggcaggggaggagctaagcgccaccgtaaggtcctccgcgacaacatccagggcatcacaaagccggcaattcgacgccttgcccgtaggggaggagtgaagcgtatcagcggcttaatctacgaggaaacccgtggagttctcaagatcttcttggagaacgtcattcgcgatgcggtaacatacaccgaacacgccaggagaaagacggtgactgcctggatgtggtttatgcactgaagaggcagggtaggactctgtatggatttggcggttagatgatttagggtctagattctaaaatagaggaaaaattgcaggactcagttaaagctacaagggtgggtttngntgttcgctgntataatttctaattcgcatcatcaattgcatatttttattgaaa

SEQ ID NO: 14256 - DNA, 431 bp, Gossypium hirsutum
  Clone ID: uC-gsflnu33B026a08b1
ttttgtttgctttgtatattgaagtttcctttctcgattttctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatccccccagaccagcaacgtctcatctttgccggaaaac

SEQ ID NO: 14257 - DNA, 521 bp, Gossypium hirsutum
  Clone ID: uC-gsflnu33B026b01b1
ttctcgcgtccggagctttcgtgtttgtctattgaattctttccttcactttctcgagaaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgcttgtggcgaaaataatgtataagccagctggttgggagcatattttccttttgtccaaaggattttctgctgctcattca

SEQ ID NO: 14258 - DNA, 556 bp, Gossypium hirsutum
  Clone ID: uC-gsflnu33B026b02b1
ttatacccagatgaacagatcttgaaagcaaagattgagcttttgaacaagacaaacatggtcgattacgctatggatatccataagagcctttaccgcaccgatgatgtccctcaggacatggtcgagaggagagtcgaggtagtcgctcgtctcaaagctttggaagatgccgccgctcctctcgtcactttcttgcaaaaccctaacgctgttcaggaattgcgtgctgataaacagtataatctccagatgctcaatgaccgctaccagattggtccagatcaaatagaggcattgtatcagtatgcaaaattccaatgtgagtgtggcaactactctggtgctgctgactatttgtatcagtatcgggctttgtgtactaacagcgaaaggagcttgagtgcattgcgggggaagcttgctgccgagatactgatgcaaaactgggatattgctctagaagaactctaaccgctgaaagaaataatcgattccaagagcttctcatcaccttttgaccaagctcagagtagaatatggcttatgcattggg

SEQ ID NO: 14259 - DNA, 560 bp, Gossypium hirsutum
  Clone ID: uC-gsflnu33B026b04b1
cccacgcgtccggttgtcacatggtgcactgtgcttacaacagtttatggatgggcaactttatccaccctgattgggacatgttccagtcctcccacccttgtgctgagttccacgctgcttcaagggccatctccggtggcccaatttacatcagcgacaccgttggcaaccacaactttgctctcctcaaacgcctcgttttacccgatggttcgatcctccgctgccagtactacgctcttccaaccagggattgcctatttgaggaccctctccatgatggcaaaaccatgctcaaaatctggaacttgaataagtatactggtgtgattggcgcatttaactgccaaggaggcggatggtgccgagaaactagaagaaaccaatgcttttccgagttttcgcatacggtaaaggccgagatgaatccaaaaagcattgagtggaacagtggaaagaacccaatttccattgaagatgtccaagtattcgccatgtatttttctcagtccaagatactagtcctctcaaaaccgcttgaaacatggaatctcgct

SEQ ID NO: 14260 - DNA, 93 bp, Gossypium hirsutum
  Clone ID: uC-gsflnu33B026b06b1
ttaagtggacagttcaagtgattggaagccaccaatttcgataaaaaaaaaaaaaaaaaaaaaaaaaaaaaaaaaaaaaaaaaaaccaaagac

SEQ ID NO: 14261 - DNA, 517 bp, Gossypium hirsutum
  unsure (1)..(517): unsure at all n locations
  Clone ID: uC-gsflnu33B026b08b1
gtcaagaacgtcaatggtaggagattcaagctcctggtccaccgctctcgtcaagatttcaccttacactttctccgccatcggtatcgcaatcgccatcggtgtctccgtcctcggcgctgcatggggaatatacataactgggagtagtttaatcggtgctgctattaaagctcctcgaatcacttccaagaatctaattagtgtaatcttttgtgaagctgttgctatatatggtgtaattgttgcaattattttacaaacaaagttagatgagtgttccatcatcacagatatatgcgcctgagtctcttagagcaggatatgcaatctttgcttcgggaattattgttggctttgcaaatcttgtttgcggattatgcgtaggaataattggaagcagctgtgcactgtctgatgcacagaactcgtcactttntgtgaagattcttgtgattgagattcttggcagtgcactnggattacttggagtgattgaggtataatcatgtcagct

SEQ ID NO: 14262 - DNA, 541 bp, Gossypium hirsutum
  Clone ID: uC-gsflnu33B026b12b1
gcgcttacgcgtgcgcccacgcgtgcgcccacgcgtgcgaaaattttcaaaattaaatcaaataaaaatgagtcttgctctaatactcaccgtgtccatcatcgccttcttcttaacgtacaagctttaccaatggctaaggttcaagctcccaccaggtccacgcccatggccggtggtcggcaacctttacgacataaagcctattaggttccggtgttttgcggaatgggcgcaggtgtacggccccattatatctgtttggtttggttccactctcaacgtgatcgtgtcgaattcggaactggctgggaagttttgaaagagcatgatcaacagttagctgataggcatcggagtagatcggcagccaagtttagcagagatggacaggaccttatatgggccgattatggacctcattatgttaaggtaaggaaagtatgcacgctggagcttttctctccgaagaggctggaggctctgagacctataagagaagatgaggcttccgccatggttgaatccatctttctctact

SEQ ID NO: 14263 - DNA, 479 bp, Gossypium hirsutum
  Clone ID: uC-gsflnu33B026c01b1
tcctcgcgtccgagaaaatatcacaaatcttcttctccttctcagaaatcttagtatcatcactatggcctcaaatcccaaggtcttctttgacatgacgatcggtggtcagcccgctggtcggattgtgatggagcttttcgcagattgcactcctcgcactgcggagaacttccgtgccctctgtactggcgagaaaggcgtcggccgcagcggtaagcccctccactacaaaagctcttctttccatcgtgtgatccctaactttatgtgccaaggaggtgacttcaccgccggaaacggtaccggaggtgaatccatctacggatcaaagttcgctgacgagaacttcatcaagaagcacactggtcccggtattctctcaatggctaacgctggaccgggaactaacggatctcagttcttcatttgcacggctaagactgagtggctcgacggacagcacgttgtgtttggac

SEQ ID NO: 14264 - DNA, 540 bp, Gossypium hirsutum
  Clone ID: uC-gsflnu33B026c03b1
tttcaaagcaacttttcttttccctgtcctgctgcaatggctgagcagatgcctttaaagcgcgcaagagaagaaacccagagttcagatgaagaaacaaagtgccataagtcatatgatcacatactctctttgcttgaagctgaagaggatgagccaaaccaagacctgtcttctctcctcacaactttgcaacaggaactttcttctgactctgttttagatgacccccttccttacccaacatcagccgccttagatgctggccaaaaaaaccccaggcctaacaccacagcagaagctaccaataccaacaccatcaccggcagcttagaagacgaggatattcaggatgataaagagaaagtcatacgccatttgcttgaagcttctgatgatgagcttgggattcctaatagggaacatggctttgatgttggagtttttgagtttgaacaaggttgtaacaatggtggaaatgggcttgctttatgtgataggtctgtgggaatttgaagatgacgctgctaattattatac

SEQ ID NO: 14265 - DNA, 548 bp, Gossypium hirsutum
  unsure (1)..(548): unsure at all n locations
  Clone ID: uC-gsflnu33B026c04b1
cccacgcgtccgggaaaagctaaagataagaatccacccttctctctatctatccttgcactctgagctgttaaagtacactcttcttttggggctttcttttctcttgctggggttttctctattaaaagagggtgctcttttatatttataatattgtgtttttgctctggcttttccagttgcaaaggtgtttgctttaaggtttctaagctggacagttcttacgttgttagccaaggtcttcattttcattgcgaaaggcaagttatatagatttcatgaagtcggtctttattgttttcaacttcggacgagcaactcagtttaaattgtaagtttgctggttcttggtcttccaagatagagggaaaaaaaaggtgatcattttgagttactggatatatcttccatcctgtttaggagatggagaaaggttgctcaaataatggggaaacatgtcctcacttcttgattngatccctcaagaagagagtggcatatcccagaggaagagagagaagcctgagcatagagagaagagctga

SEQ ID NO: 14266 - DNA, 531 bp, Gossypium hirsutum
  unsure (1)..(531): unsure at all n locations
  Clone ID: uC-gsflnu33B026c05b1
cctaacagagccttctcaaaaacgacattcaacaatggcgaattcaatggcgaagtctttccttcaagttgcagctactgaagaggttgtttctcctctcagagttgtccagatcgaaggcctggtgatattgaaaataatcaagcactgcaaggaattttcacctgctctggttaccggccaacttcttggattagatgttggcattgttcttgaagttactaactgtttccctttcccgatccgcgaggaagatgaggagattgaagctgatggagctaattatcagcttgagatgatgagatgtctaggggaggttaactgttgataacaacactgttggatggtaccaatcaacgattntgggttcatatcanacagttgagctcattgagacttttatgaattatcaggagaatataaggaggtgggtatgcattatctacgatccttcgaggtctaatcaggtgtcttggctctcaaggctttgaagctatctgattcttttatggaccttaccgaagctatagc

SEQ ID NO: 14267 - DNA, 515 bp, Gossypium hirsutum
  Clone ID: uC-gsflnu33B026c06b1
ttaaaactgtcggaggaggtgatgatgctttgaacacctttttcagtgaaactggtgctgggaagcacgtccctcgtgccgtcttcgtggatcttgaacccactgttattgatgaagtgagaactggtgcttaccgccagctcttccacccagaacaactcatcagcggcaaggaagacgcagctaacaactttgcccgtggtcactacaccattggcaaggagattgtcgacctctgtttggaccgcatcaggaaacttgctgataactgcactggtcttcaaggattccttgttttcaacgctgttggtggaggtaccggatcaggtcttggttctctcctttgtggagcgtttgtctgtcgattatggcaagaaatccaagttgggtttcactgtctacccatctcctcaggtctccacttctgttgttgagccctacaacagtgttctctcaactcactcccttttggagcacactgatgtggctgttctcttgacaatgaagctatctac

SEQ ID NO: 14268 - DNA, 521 bp, Gossypium hirsutum
  unsure (1)..(521): unsure at all n locations
  Clone ID: uC-gsflnu33B026c07b1
ttcacgcgtccgcgccaagatttagtgttgaaaatctcgagaacaatggccaccggtgaactcgcctgtacttacgccgcgttgattctccacgacgatggaatctcaatcaccgccgagaagattgctacattggtgaaggcagcgaacttgagcgttgaatcttactggccaagccttttcgccaagctcctcgagaaagtcaacgtcgatgatctcatcaccagcgttggctccggtggtggtgctgcccctgttgccgttgctgctgcttctggtgcagctggcgtgtggtgctgctgcggcagcccctgctgttgaggagaaaaaggaagaagagaaggaagagagtgatgatgacatgggattcagcttgtttgactagacacaattcttcccagtttggatttttcttttgatttgctgcttgaaattgcggaaaattaggactcngtataaacattagttgaattcttgcattgggttttgagaacctttgcagagattcaagaagttacatg

SEQ ID NO: 14269 - DNA, 578 bp, Gossypium hirsutum
  Clone ID: uC-gsflnu33B026c09b1
tccacgcgtccggtcagagtggacgacgccaaacgactcctagtcggagccggtgctcgtatcctcttttaccccacccttttgtataatgtcttcagaaacaaaatccaatccgaattcagatggtgggacgaagttgaccagtttcttttgctgggggcagttccatttcccaaggatgttcgacgattgaagcagttgggcgttggcggggtcatcactctcaatgagccctttgaaactctggtttccacttccttatatcatgcttatggaattgatcaccttgtaattccaacaagagattatttgtttgctcctacagtttcagatattagtagagctgtggacttcattcataacaatgcatcttgcggtagaaccacctatgtacattgtaaagctggacgaggaaggagtagcaccattgtgctttgctacttagtagagcataagcagatgacacctgctggtgccctcgaatatgttcggtctcgaagacctcgagttttgcttgccccctcacagtggaaggcagctgtggagtacagcatgcaccaacaaccgctactatacac

SEQ ID NO: 14270 - DNA, 321 bp, Gossypium hirsutum
  Clone ID: uC-gsflnu33B026c10b1
attttggaaccaagaagaagaacagaaagacaggcatgaagttcttgtttcagtgtccttgctgttcttgtttctgcttcatgaagcctaagaaagggaaaccaaagatgaaggatgacaaggctgagacaaaaaaggaagtgaaggctgaaaaagagaaggaagcgaaggctgagtgaaaatgatgatttacttacattatattcttcactgctgctcaagtaaattgtatgtaacttttgtttgaatgaaaaatgctgccttgccttggttattgtagtattatttgcttgtactgataataaacttgacatttctatt

SEQ ID NO: 14271 - DNA, 440 bp, Gossypium hirsutum
  Clone ID: uC-gsflnu33B026c12b1
ttcgagccctcaagcatgatggcgaagtgcgatcctaggcatgggaagtacatggcatgctgcctgatgtatcgaggagatgttgtgcccaaggatgttaatgctgctgttgctactattaaaacaaagaggactgtgcagtttgttgactggtgcccaactggtttcaaatgcggtattaactatcagcccccaactgttgtacctggaggagatcttgctaaggtgcagcgagctgtttgcatgataagcaataatacagcagtggctgaggtgtttgcacgcattgaccacaagcttgatctcatgtactcaaagagagcttttgtgcattggtatgctggcgagggcatggaagaaggtgaattctcagaagcccgtgaggatctggctgctcttgagaaggattatgaagaagttggtgcttgaagtggagatga

SEQ ID NO: 14272 - DNA, 466 bp, Gossypium hirsutum
  Clone ID: uC-gsflnu33B026d01b1
tttacgcgtggggttcaccaccactgctgaacgggaaattgtccgtgacatgaaggagaagcttgcttatgttgccctggactatgagcaggaactggagactgccaagagcagctcttctgttgagaagaactatgaattgcctgatggacaagtaattactatcggagctgagagattccgttgtccagaagtcctcttccagccatctctcattggaatggaagctgctggaatccatgaaactacctacaactctatcatgaagtgtgatgtggatatcaggaaggatctctacggtaacattgtgctcagtggtggttcaaccatgttccctggtattgcagaccgtatgagcaaggagatcactgctcttgccccaagcagcatgaagatcaaggttgttgcaccaccagagagaaagtacagtgtctggatcggaggatctatcttggcatcactcagc

SEQ ID NO: 14273 - DNA, 580 bp, Gossypium hirsutum
  unsure (1)..(580): unsure at all n locations
  Clone ID: uC-gsflnu33B026d04b1
tccacgcgtccgcttccctgcaaaccattacctgggtttcaatcctataaatcactggcaatgctgtccgggcatattggctcagtttcttgcttggccttatgtggggaattcatcttaagtgcatcacaaggcaaggatattattgtgtggcaacagcctgacttgaggcagttcacaaagtttggccaaggtgatggctcggtgaaggcgcttgtcaccgttagcaacaaggttttcactgcacatcaagatagtaggatcagagtttggaaggtgtcaagaagcacagagaatgtgtttaagcttgttgacacacttcctactacaaaggactatttggggaagttcatgaagcaaagcaattatatccaaactcggcggcatcataagcgtttatggattgaacatgcggatagcatttcttgtctggcagtctataatggcttgatttattctggttcatgggacaaggaccctaaggtgggaggatatctgattcgagtgtatggagtcaataaaagcacatgatgatgctatcaattgctggtagctngtagggatagtctactagcatcag

SEQ ID NO: 14274 - DNA, 548 bp, Gossypium hirsutum
  Clone ID: uC-gsflnu33B026d07b1
tttcacgcgtccggtgaagttaagaagtccagcgtgtagctgtgtacggaaaaaaagcatggtttctgcatcagagattgcaacaaagttgaatctggcttcccaccctgaaggtggcttcttttctgaaacttttagggatagttctgttatgctctccacatctcaacttcctcctcaatacatagttgatcgtcccgttagcacatctatttacttcttgttaccggctgggagcgtgtctcaccttcaccgtataccctgtgctgagacctggcatttttatttgggagaacctcttacggtcttggagttggatgagaaagatgggcaagtaaaactaacatgtcttggacctgatttgttgaataatcagaaggtgcagtacacagtgcctccaaatgtttggtctggtgcatttccaacaaaagatctcaacatttcgactgatggggcagtgacaaaaaatgatccaagggatgctgagagccattattcacttgtaggatgcacctgtgcacctgctatcagttccagactcgagctgc

SEQ ID NO: 14275 - DNA, 542 bp, Gossypium hirsutum
  Clone ID: uC-gsflnu33B026d08b1
tctttaggagctgacacagagacagggagagagagagagagagagagagagagagagagagagagagaggtgtgggggagacagtatggctaagttaatcaaaggataagatttgatccatctctcttatgttttcctttttctttgtataaagtccagaagacgcagattcaaggatattgagatgatgtttctaaagattttgttaagctagctatggcaactcttgcactccatacggagtgtgtggattctgatatataccgtgctttgggattcaaagaattgggtaaaggagttgttggaactccacggattttatcacttctttcttcgcttcttgaggaatccgtccaaagaaacgagatggagtccgagacggtgaacttcaaagataatgttgccatgtttcatgggttaagagctcccaccataagcattcagcattatatcgatcgcatcttcatgtatgctggctgcaatccgtcgtgctttctcgttgcatacatttatgtcgatagatttgttcaacaaacggatgt

SEQ ID NO: 14276 - DNA, 291 bp, Gossypium hirsutum
  Clone ID: uC-gsflnu33B026d11b1
tccacgcgtccgcccacgcgtccgggagaagtgacttccggagataagcgctgtgattcttgagaagatctgtcaatatttttattgggctcttcaatattcaaggggtaaagagactgagtttcacattgaacccgaactgactttggagctgatgatggctgctaattatctccatacatagctgattgctttttctttgattcttacgtaagatgttctgtagcaattaaccaataactttgttattttcttacaagtgtcattgacaggtaattgtcttttctcatt

SEQ ID NO: 14277 - DNA, 535 bp, Gossypium hirsutum
  Clone ID: uC-gsflnu33B026e01b1
gtaacaaggaaatcagcagttactggcttgggttgaacgagtttgctgatttgacccacgaagagttcaagaacaagtatttaggactcaaaccagaggttttcaaaaagaaccgatcaccaccagaagagttcactttcagagacgacgttgatttgcccaagtctgtcgattggagacagaaaggagctgttacgccagtcaagaatcagcgttcttgcggtagctgttgggctttctcagcagtggcggctgtggagggcataaacaagattgtaacggggaacttaacttccttgtccgaacaagagctgattgattgcgatacaagtttcaacaatggttgcaatggaggtctaatggattatgcattcgagttcattgtcgccaatggtggacttcacaaagaggaagactacccgtaccttatggagcaaggtacctgtgaagaaaagaaggaggaaatggatgtggtgacgattagtggttaccaagatgtgccggaaaatgatgagaaagtctattgaagcattgc

SEQ ID NO: 14278 - DNA, 495 bp, Gossypium hirsutum
  Clone ID: uC-gsflnu33B026e03b1
ctccctctcttcttaggtctgctgtatcttagttcttgattaattagccaatcacagcagccatgtctctcctcaatgatctcatcaacctcaacctcagcgacaccactgaaaagatcatagccgaatacatatggatcggtggatctggtatggatctgagaagcaaagcaaggactttgcctggaccagtgacggacccttcaaaactcccgaagtggaactacgatggttccagtaccaatcaagcacctggagatgacagtgaggtcattctttatcctcaagctatattcaaggatccatttagaaaaggaaacaacatcttggtgatgtgcgatgcttacacaccagccggcgaacccattcctaccaacaagagatttaatgcggccaagatctttagccaccctgatgttgttgctgaggagccttggtatggtattgagcaagagtacactcttcttcaaaaggatactaagtggcctcttggat

SEQ ID NO: 14279 - DNA, 531 bp, Gossypium hirsutum
  Clone ID: uC-gsflnu33B026e04b1
ctaacggctcagcttatttaccagacggctctaatggagagtggtttcaatctacccgatcccaaggattttgcttcacgcatctacagctcggtgaaatctagcctaaatattagtcccgatgcaacaattgaggatgatgatgatgatgtagaagaaaccgagacagaatcggacacaaaagacagtgcagtcaaagatgagttgtagattgcctgaaacctcggggacatgccttttgagttagttttaccctctgatgacaagccgaaggaactgtaacatgcattttcaagtctgaaacttggataaagggaaacattacaaacattacttagtagaatatatgtaaaccgtagtcgactgtgaaattaatctgtctgcaatttttgctcttttaatgcatcgcagtggttttaagattttcgcgtattaatatatgtttggttcgatcttattatctgtcaacatgttcaacttccattgcttaagattatatcttgcattggtatgcaatttcagtggatgaag

SEQ ID NO: 14280 - DNA, 533 bp, Gossypium hirsutum
  Clone ID: uC-gsflnu33B026e05b1
ttagagctcatctctctgcttcaaagctcctgtccgggtagaattctcttcttcctttgcgttgtgttctttgttgttcaatcgccatggcttcaaagcggattttgaaggaactcaaggatttgcagaaagatccacccacttcttgtagtgctggtccagtagctgaagacatgtttcattggcaagcaacaatcatgggaccctcagatagcccttatgctggaggtgtgtttttagttactatccatttccctccagattatcctttcaagcctcctaaggttgcgtttaggaccaaggtcttccatcccaacatcaacagcaatggaagcatttgtcttgatatcctcaaagaacaatggagccctgcactaaccatttccaaggttctgctctcaatctgctcgttgctgaccgatccaaaccctgatgaccctcttgttccggagattgctcacatgtataagaccgatcgggccaagtatgaagccactgctcgtagctggacccagaagtatgccatgggatga

SEQ ID NO: 14281 - DNA, 213 bp, Gossypium hirsutum
  Clone ID: uC-gsflnu33B026e06b1
tttcttattcgtgtgaggtttctcaaattatgcctatggtataaatttagagtcgtgtttgcttgtcatttttttgttgttagaaatgcttgtcttttacttatgatgctccataagaacatgaatagccttacaagctattgttctgtttttcatgttgtaagatttgtctaatgcccttttatgctatcaacggagtgatattttatgttt

SEQ ID NO: 14282 - DNA, 563 bp, Gossypium hirsutum
  Clone ID: uC-gsflnu33B026e07b1
tgactggatagattacccttgcaacaacgtagctttcaagctctatgagattgtgaactaccaacaatgcgtggacgacaatgtgtctgatttccacaggacaggacgactgattcaaggttgccaatttgtaaccgtgggcacttgcttcgagttcgaaggggacacgattaaattgcttatcaagctttaccagaaacctgtggttccggtaggcctgttgcctccgttattatcactggcatcaaacgaggataacaaatgggaagctataaaaagctggcttgatagcaaatgagagaaatcggctctttatattgctcttggtagtgaagtgaatctaagtgaagggtccatccaccaattggcatttgggatagagaaatccaacttgccctttatttgagtggtaaggaaccgtccagtgggtgaaggacagatgaatgacataattcctctagggttcaaaaaacgagtgtctaacaggggtttagtgttgagggattgggcacctcagttgtggatattagcccactcttcttgttggggtttcctgactcact

SEQ ID NO: 14283 - DNA, 526 bp, Gossypium hirsutum
  unsure (1)..(526): unsure at all n locations
  Clone ID: uC-gsflnu33B026e08b1
cccacgcgtccgacaaactccagtaaaaatcatccattttgagggagatttatcatggctaacaaccagcttggagttcttaatgctctggatgcagcaaagacacaatggtaccatttcactgccattgtaattgcgggaatgggtttttttcactgatgcttatgacttgtttggcatctctcttatcacaaaacttcttggtcgtatttactacacaaatgaaaaccatccaaagcctggaacattgcctcctaatgtagcagctgctgttaatgggacagcctttgttggcacgttagctggtcagcttttctttggctggcttggtgataaattaggccggaagcgggtttatggactaaccctcatgctcatggtggtctgttccattgcttctggactttcctttgngaagtctcctgctggtgttatgacaacactntgtttcttcaggttttggcttggtttcggaatcggtggtgactatcccttgtcagccaccatcatgtccgaatatgcaaac

SEQ ID NO: 14284 - DNA, 536 bp, Gossypium hirsutum
  unsure (1)..(536): unsure at all n locations
  Clone ID: uC-gsflnu33B026e09b1
gtttcaaatacccaattttcttaaccatgtgtcacatgacagcttgttcattgttaagctatatcgcgattgcatggatgaaaatggtaccaatgcaaacgattcgatctagggttcagttcttgaagatctcggctttgagtttagtcttttgtgtgtcggtggtgtttgggaatatctcattgaggtacttgccggttagtttcaaccaggctatcggtgctacgacgccgtttttcacggcggtctttgcttacttaatgactttaaaaagggaggcttggcttacttaccttacacttgtgcctgttgttactggtgttatcattgccagtgggggtgaaccgagtttccatctatttggtttcatcatgtgcgttgcagctaccgcagcatgagctctcaagtcggttttacaaggaattttactttcttccgaaggcgagaagctgaattccatgaacctccttctctacatggcaccgatagctgctgtgtttctactntgcgcaacgctcattatggaagaaaacgtg

SEQ ID NO: 14285 - DNA, 537 bp, Gossypium hirsutum
  Clone ID: uC-gsflnu33B026f02b1
ctctcgcgtccgcccacgcgtacgcccacgcgtgcgctcaaatcgaagttacatttgaggttgatgcaaatggtatcttaaacgtcaaggccgaagacaaaggcacaggtaaatcagagaagatcacaatcaccaacgacaagggtcgtttgagccaggaggagattgaaagaatggttcgtgaggccgaagaatttgcggaggaggacaagaagctgaaggaaaagattgatgctcgcaatagcctggagacttatgtttacaacatgaaaaaccagattagcgataaggacaagcttgctgacaagcttgaatccgacgagaaggagaaagttgaaacggccgtgaaagaagccctcgagtggctagatgacaaccagaatgccgaaaaggaagattttgaggagaagctcaaggaagttgaggctgtttgcaaccctatcatcacagctgtatatcaaagatccggcggaggtcctggcggtgctgcgtcaaatgaagaagaggatgattcacatgatgaactctaaaacaaaa

SEQ ID NO: 14286 - DNA, 549 bp, Gossypium hirsutum
  unsure (1)..(549): unsure at all n locations
  Clone ID: uC-gsflnu33B026f04b1
ttcgcttacagaaaatataaactggacggccgaagagatatccgaaaataatagtgagtatatgaatgaggtggtcttttgccttgacactgttttctcaacagcactgcaaattctgccattggatgctttatacacggttggttgtggggctcttgagcatatttccaactctattgtggctgcatttctcagtgatagtgtgaagaggtttaatgccaatgcagtcatggttatcaaccaggatctacagaagttagagagttgtgctgatgagaggtttcacagcacacgcctaagtgaggtatacgaggaaggtagttttcgaagtagcttgatagaagcccggcagttgataaacctattgtccagcagccagccggagaatttcgcagatcttgtaattcgggagaagtcctacaatgctntggatcgtaagaaagcggctagcattgtcgaaatactcatggactcagcagatgggatctatgggagcctttcaatccagaatacataaacaagttcacggaagaaatcaatggacatgct

SEQ ID NO: 14287 - DNA, 178 bp, Gossypium hirsutum
  Clone ID: uC-gsflnu33B026f05b1
ttgtaatagaagctttgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgctcttggtttgtatc

SEQ ID NO: 14288 - DNA, 53 bp, Gossypium hirsutum
  Clone ID: uC-gsflnu33B026f06b1
ttcacgcgtccggtcagattcctaatgaatgagaagaagctcctatttcgttt

SEQ ID NO: 14289 - DNA, 547 bp, Gossypium hirsutum
  Clone ID: uC-gsflnu33B026f12b1
cagccgtccgtttggctatggggctcatgggccattggcccgggctgctgcctctgagttgttgggcttgaaaaagttgggggctctgtacaatttcctcacgctggcaaatcctgcaggttcacttgtcttctcaggtgtaattgctagcagtatttacgaccatgaagcagagaagcaagctcatcaacatcatatccagctgcagatgtcaggcttacttttctcagggttgtatggtcaggatgaagtgctcaagtgtgaaggttctgtatgcttctttctgacttccatgatcatgtctggattttgtgtcattgcaactgttttaagcatgatacttgtgtaccgtactaagactgtttatgccaacctttatggaaagtctcgcacttgatttcaagaatgcaatctaggaatgtctctatggatgttttgtcccttttaagtggcattttttcgtgaaaactgagattggattagttttcactaagtttgtgataacagtgttgtaaagatggtactgcagaaatctggtcagtgattc

SEQ ID NO: 14290 - DNA, 529 bp, Gossypium hirsutum
  Clone ID: uC-gsflnu33B026g01b1
ctctttcattcgtttacttttgttggaaaatatgagctgaaaacactgaactgaagaaaaatgggttcggtggcaaagaagggattgcagaaatacttgttacagcttcaacatcaccctttgagaaccaaggcaattacggctgcggttttgtcagggattagtgacactgtttctcagaagctttctggaatacccaaacttcagctgagacggattcttctcaaaatgctctttggatttgcttatcttgggccatttggtcattacatgtatatgctactggataaaatcttcaaggggaagagagactccaaaactgttgccaagaaggtggtgctggaacagttgacaacttctccttgcaacaacttgcttttcatgatttactattgggtggctgttgagggaagaccctggatgcatgtgaaaactaggatcaagcaggagtatccgaaagtacagatgactgcatggacgttctggcctgttgtgggatggataaatcaccagtacatgccgttgcagt

SEQ ID NO: 14291 - DNA, 542 bp, Gossypium hirsutum
  unsure (1)..(542): unsure at all n locations
  Clone ID: uC-gsflnu33B026g02b1
gtaaatgaagggtctgcaggcacttatattggcaatggtaatggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttttcctttatttctttntatgtgttgggtttcgattggtatcttatagtcgtgtgatttctcaccaataatcatatattagtattggttccaccacgcactacgttgcttcaattatttttttaatcaaatatgttctacatntt

SEQ ID NO: 14292 - DNA, 423 bp, Gossypium hirsutum
  Clone ID: uC-gsflnu33B026g03b1
cccacgcgtccgccagattatcctttcaagcctcctaaggtcacgtttaggaccaaggtcttccatcctaacatcaacagcaatggaagcatttgtcttgatatcctcaaagaacaatggagccctgcactaaccatttccaaggttctgctctcaatctgctcgttgctgaccgatccaaaccctgatgaccctcttgttccggagattgctcacatgtataagactgatcgggccaagtatgaagccactgctcgtagctggacccagaagtatgccatgggatgacagtggttgggtgtgtaatacctatcagctttcttatgtgttttggggaaggaagggtgttttttttttcttaaagtaacttgtcattgtgctttggatatgggaaagatatggaacattctttttatttatttc

SEQ ID NO: 14293 - DNA, 508 bp, Gossypium hirsutum
  Clone ID: uC-gsflnu33B026g05b1
tctttcacgcgtccgccaccttgtccttcgtttgcgcggcgggatgcaaatcttcgttaagacgcttaccggaaagacgatcactctcgaggtcgagagctctgacacgatcgacaacgtgaaagccaaaatccaagacaaggaaggcatcccgccagaccagcaacgtctcatcttcgccggaaagcaactcgaggacgggcggactttagccgattacaatatccagaaggaatcgactcttcatctggttctacgtcttcgaggtgggatgcagatcttcgtcaagactttgaccggtaagaccattactttagaagtggagagctcggatacgattgataacgtgaaagcgaagattcaggacaaagaaggaattccaccagatcagcaaaggttgatttttgctgggaaacagctggaagatggaaggactttggctgattacaatattcaaaaggagtccactcttcaccttgttcttcgtcttcgggtgggttctaagccc

SEQ ID NO: 14294 - DNA, 196 bp, Gossypium hirsutum
  Clone ID: uC-gsflnu33B026g07b1
ttaagaggttactgatgagaactcatctccctttgtagccataaccttatataatttgaccagtttttgttagcagagttttaaaaatgtaatagttaatcggttatactcaatggtggtaatttttttttttgatttcttgagaatattgtttttaagaatattttaacaaatttatcggtagatttaatattat

SEQ ID NO: 14295 - DNA, 494 bp, Gossypium hirsutum
  Clone ID: uC-gsflnu33B026g12b1
ttttaaccctaagtacagttgagttgaaaagcttctctcttttaatactaattttagtttttgtttttatttatggctgactcatcatcatcatcttcttcttcttcttcatatattcacatggtgcaccgtcttatagaagagtgtttggtatttaagatgagcaaagaagagtgcatggaagctttgtcaaagcatgcaaatataaaaccagttattacttcaacagtaatataattaataggatgcgtatatgtattggttaaagtttggaatgagttggagaaagagaacaaggagttctttgaggcatacacaaggggaagccatgagagagccactgaaatagagaaaagacaaaggattcagaggagtctccatgcttacataagggacaacaatggcaacgatcaactccaccactaaatatcatcatattgttccaaactatttgtttttccttgcacatagttacaattattctggaataaacc

SEQ ID NO: 14296 - DNA, 158 bp, Gossypium hirsutum
  Clone ID: uC-gsflnu33B026h02b1
ttgctctacataaaaagccaggccgccaaagggggggccctaagagacgtgggcgggacgctacccccaaacgtgaacatcgggataccggcaggcacaaacaccgaacgtctcgaaatcaaaaaccaacaccaaaaggaaaccgggttcagcatcac

SEQ ID NO: 14297 - DNA, 417 bp, Gossypium hirsutum
  Clone ID: uC-gsflnu33B026h07b1
tgtacttcataaaaagctgtgccgtcaaagacagtttccaaatggtcgtgggttgcacgcgtgacgtcaacgtgatctccggtttaccggcagccacatgcaccgaacgtctcgatatcttaaacgataacgaaaaggtaaccgggtttagcatcatcggtggtgaacataggttgacaaattaccggtcggtgacgacggtacatgggtttgaacgtgatgggaagatctggaccgttgttctggaatcatatgtggttgatgtacctgaagggaatacggaagaagatacacggttgtttgctgatacggttgtgagacttaatttgcagaaattggctagcgtcgctgaaaggttggcgcgtgatggcgattgtaataaatcacaggtgatgtgaaaataaattatatatatat

SEQ ID NO: 14298 - DNA, 523 bp, Gossypium hirsutum
  Clone ID: uC-gsflnu33B026h09b1
ttttaaaatatggtatggtgggatctattgattgccgtgttaacctcgactgaagcatttgccagggtgttcttcctatatacaccctgcagttacctgctttacttcacttcattgtttctttacacgaatttcgcacgttttggtttgctgaagaaaacaataaatgcccagtgcatcgattttctccattgatgtgtggataacttgaaaaactttctctttttttgaaacctttgaagttgtagaagcaaaccggttgagctacttgtttttcatgcacaaaataggactctgggaataggatttccagggtccagctaaatcatctctttcgtttttatattcatgggtttgctataatcactctcctcttgcttcttcagtagttcgtcggtcttcacttgctaactctctgtttcctttattcctttgtactgcactggagttttatctgcgagagagatggcatacatattgagtgttttcgcagtgagaaacctgctggttttgcactggctct

SEQ ID NO: 14299 - DNA, 544 bp, Gossypium hirsutum
  Clone ID: uC-gsflnu33B026h10b1
ttgtgatggaaagtggtgatccggttcgaaccattgaaaggctgaaaacttccttaaaagctgaaagaaaggcattgagtgctttatatgcagagcttgaagaagagaggagtgcctctgcaattgctgcaaatcagacaatggccatgataacacggcttcaagaggagaaggcggcaatgcaaatggaagctttgcagtaccagaggatgatggaagaacagtctgaatatgaccaagaggcccttcaactactaaatgagcttatgatcaaacgagagaaggagaaggaagaactcgagaaagaattggaagtataccgaaagaaggttctctattatgaggccaaagaaaagacgaggataatgaggataagcaaagatggaagcttgtgaagcgggaaatcttcggctgcttgtagctatgcggaggatagcgacgagctatccatagacctgaatcgtgaagccaaggatgaagatagcagcttctctggcaaccaaaaaagcagcagtgatgcagttggtactgggaaaaatggcac

SEQ ID NO: 14300 - DNA, 541 bp, Gossypium hirsutum
  Clone ID: uC-gsflnu33B026h11b1
cctcacgcgtccggccacgcgtccgaaaaatattgctctctttctaaccttcgggagctcaccaattgctgcaaaaatggcgacgattgcgcctgacaacctaagacgtgaccagtacgtttatttagccaagttagcggaacaagccgaacgctacgaggagatgggtcaatttatgcaaaagctcgtcctcggatctactgctgcttccgagctaccgtcgaggaacggaaccttctcttggtcgcttacaaaaacgtagatcgatctctacgcgccgcgtggaggatcgtttcttctatcgagcagaaagaagaaggtcggaagaacgaggaacatgtggtgctcgtcaaggagtatagatcgaaggttgaatccgagttgtcggatgtttgcgctagtatcttgactctgttggactcgaatctgatcccatctgctgctgcgagtgaagcaaggttttctatttgaagatgaaaggggattatcatcggtattcagcagaagttaaggttgtgatgagaggaagctgctgctggga

SEQ ID NO: 14301 - DNA, 507 bp, Gossypium hirsutum
  Clone ID: uC-gsflnu33B026h12b1
ttataaatatcacaaatcttcttctccttctcagaaatcttagtatcatcactatggcctcaaatcccaaggtcttctttgacatgacgatcggtggtcagcccgctggtcggattgtgatggagcttttcgcagattgcactcctcgcactgcggagaacttccgtgccctctgtactggcgagaaaggcgtcggccgcagcggtaagcccctccactacaaaagctcttctttccatcgtgtgatccctaactttatgtgccaaggaggtgacttcaccgccggaaacggtaccggaggtgaatccatctacggatcaaagttcgctgacgagaacttcatcaagaagcacactggtcccggtattctctcaatggctaacgctggaccgggaactaacggatctcagctcttcatttgcacggctaagactgagtggctcgacggaaagcacgttgtgtttggacatgttgctgaaggcatgatgtggtgaaagccattgagaa

SEQ ID NO: 14302 - DNA, 380 bp, Gossypium hirsutum
  Clone ID: uC-gsflnu33B028a04b1
ttgttttgccgccctttttatcaacaacaacgagttcatgatccatctgcctgataatattgccaacacccatattttttatctcactttggccaacaacaaattcaatggtccacttccaagaaccattttcaaagctttctcttcgttagctgaggtccttcttttaaacgaccagcttacaggttgtataccctatgagattggtttgcttaaggaagctgtcgtttttgatgccgggaacaaccagttgactggtcatttacctttctcattagcttgtatggagaaatttggaacagctgaacttcgctggtaatcttctgtttggagcggtccctgaggtggcttgtgagcctgggaaactgatgaattttcat

SEQ ID NO: 14303 - DNA, 442 bp, Gossypium hirsutum
  Clone ID: uC-gsflnu33B028a06b1
ccgctccggaataaccgtctcgacccacccacgcgactacttttcgtgcaaagacgcgaatatgcaggcgggcgtttttccagacttgaagcctcttccctctccccttccccctcccccatccttgccatactaatctactacttgtcgtcagccagcagcggtttcacaaatacaaagtcccaaaacaaaaaagagtgaagaaagaaactgaacgaccccttttttaggcgctatctccggctctgcgataacgcgagcgaacacaccaacccctgcccatggatgtgttcccagcattaaggctagtggcccgatcgacccttttcgcaggaagggctagacccttcttcactgatctggtagcaaggcccccctggcgatgcccacgtcaccgaaggcgtggacttaagtgatccccaatatttgacccttctaaaac

SEQ ID NO: 14304 - DNA, 537 bp, Gossypium hirsutum
  Clone ID: uC-gsflnu33B028a07b1
ttgattctttgtctctatttaaaaaaagcaatttttttgaggtggtaagtgtacaaaaacaaaatgaagatctgttgcattggagctggttatgttggtgggcctacaatggctgtgatcgcgcttaaatgtccggatattgaagtggctgtcgttgatatctctgtacctaggatcgctgcctggaacagtgaccagctccctatctatgagcctggtcttgatggtgttgtgaaggagtgtcgtggcagaaaccttttcttcagcactgatgtagagaaacatgtgcgtgaggctgatatagtctttgtttctgtcaacactcccaccaagactcgggggctcggagctggcaaagctgcagaccttacatattgggaaagtgctgtccgcatgatcgcggacgtatcgaaatctgacagattgttgttgagaaattaacagtccctgtcaaaactgctgggcaattgaaatgattctcaaccacaacagcacgggaatcaaattccaatcctttcgaaccctgaatttttggtg

SEQ ID NO: 14305 - DNA, 401 bp, Gossypium hirsutum
  Clone ID: uC-gsflnu33B028a12b1
tcctacgcgtccgcccacgcgtccgcccacgcgtccgattttccaaacctgaagcctcttccctttccccttccccctcccccatccttgccatactaatctactacttgtcgtcagccagcagcggtttcacaaatacaaagtcccaaaacaaaaaagagtgaagaaagaaactgaacgaccccttttctcagtcgctatctccgactctgcgataaccgagtgatcacaccaacccctgcccagaatgttgtgccgagcatcaaggctagtggcccgtcgaccctttttggcagcaagggctagacccttctcactgatctgctagcggccccctctgcggatgccacgttcacggaggcgtggactaaagtgatccccaatatcgacccttctaaaac

SEQ ID NO: 14306 - DNA, 550 bp, Gossypium hirsutum
  unsure (1)..(550): unsure at all n locations
  Clone ID: uC-gsflnu33B028b04b1
tctacttgtccgaacagctgtaaaatcatggcatgagacttcaaaagtggatcctagagtctacttccttcttgataaggagaagagccaagccgataaatatgctccagttgtcaatattgacaaggcttttgaatcacctcatacgcacagcagttgtttttcatttcttaggcaatatgctgaagattctttctctagagcagcttgtttagttgctcctaaaagtatcatagcttatccacaggtctggaaaggtcagggttcaaggaagtggaagcatgggcaacatgatggtttctttgttcaattcgagtcaccactcttgcgaaaactatggtttatttcgagttccaatgagatggggaagacactgtgcagggatccagaggttctagatataggtgcacatgaagtatttccacgccttttcaaagaaaagctatccagntcctcatgagctttattctaggctgaaggaaattgctaggcatgccggtggactttgatgcgaggttacatatgaaaaaggtacgaacacatagcgcgc

SEQ ID NO: 14307 - DNA, 445 bp, Gossypium hirsutum
  Clone ID: uC-gsflnu33B028b05b1
ctttatgttgggaacatcgattcgtgtcttaaaatcgagatattcatgatgagtagagtgaagaattatcttgaagatcagttattggggtttgcattgataccactgtctgaagtaatactcaagaatgggaaattggagaaagagttcttcctttcttcgacggatttgattcattcgccggctggtttcgttcaattgtcgctcgagtatatcggatcatctcccgatgtaatgactattcctaatgtttgatgctgatgaaaccgataaggattcggaaacggaggagctcgaaaagatcgagttcccgtgatccgaaaatcgttaacgagaaccaaatgatggcgtccgagtactttgggatctcgtgtgcgaatttggactccaagaattctgaaatgggtgttaatgcattggattcaatccaagtccctgagcttga

SEQ ID NO: 14308 - DNA, 559 bp, Gossypium hirsutum
  Clone ID: uC-gsflnu33B028b06b1
cttttatattgctggccttgcatttacaaatggcttaatgtccaaacttcttccctcgatacagacccgcgacagaagaactgccccgtgtgcaaggcaagcatctcttcctgttcattggttcccctgtacggtcacggcacatcttcacattctcaacccaagactccacattcagatctgatcattccccaaagaccacctgcttctacatcgaacatgaccgccccttcttcacatctaaatcaacagcttcacgaaaactttttccattctcagtcccaagcatttcataaccaacaatacttcccaccttatggaggatatgcaaccttggcatcatccgaccttagtggtataccgatgacgaatttctttcatccgatgatcggaactttgggagaaatggtgtatgctagaatatctgggagctcaacacaagtatgtttgcttaccctaaccaagcttattacccattaatcaggaataacaatcttaggatgagaaggctggaaattcaagttgacaaatctcttagtagagtatccatgtttctttc

SEQ ID NO: 14309 - DNA, 190 bp, Gossypium hirsutum
  Clone ID: uC-gsflnu33B028b07b1
tcgtaaaatttactcttttcatactgtaaactagaaaattacaaaaaattaaaataaattattataatatcattttaacataaaaaaaaaaaaaaaaaaaaaaaaaaaaaaaaaaaaaaaaaaaaaaaaaaggggggcagaaaaagaggaaaaaaagaaaaaaaaagaaagaatgcgaaggggggggggg

SEQ ID NO: 14310 - DNA, 479 bp, Gossypium hirsutum
  Clone ID: uC-gsflnu33B028b08b1
tgttttcgcgttcgatccataaggaggacacactgcatattgtgcttcgtcttcgcgggggcttctaattggtggcctattttagtcgatcacgtaattttattgtgtatgaactgtttgtgttttagagtgcgtttgcggctgtttaagggaactatgctttgacgtgctgaaatggtcagggaaccacatgtttaattaccatatgcataaggttatatgttcatcgggtgatccccaatttcatgtgtcaaggaggcgactttaccgccggaaacggtaccggaggtgaatccatctatggagccaagttcgcggacgagaacttcatcaagaagcacacgggacctggcatcctttccatggcgaacgctggacccggaacaaacggatctcaattcttcatctgcacgaccaagacggagtggctggacggaaagcacgtggtgttcggacaggtagttgaaggcatggatgtg

SEQ ID NO: 14311 - DNA, 498 bp, Gossypium hirsutum
  Clone ID: uC-gsflnu33B028b09b1
ttggtaacccttgttttactcaaaaagatccctctccaacagtggcttctaatcccaaggtcttcttcgacatgaccgacggtggccaaccagctggtcggattgtgatggagctgtttgccgattgcactccccggactgctgagaacttacgcgctctctgcaccggctagaaaggggtaggccgtagcggcaaacctatccactacaaaggctcatccttccaccgggtgatccccaatttcatgtgtcaaggaggcgactttaccgccggaaacggtaccggaggtgaatccatctatggagccaagttcgcggacgagaacttcatcaagaagcacacgggacctggcatcctttccatggcgaacgctggacccggaacaaacggatctcaattcttcatctgcacgaccaagacggagtggctggacggaaagcacgtggtgttcggacaggtagttgaaggctggatgtggttaaagcgattgagaaggt

SEQ ID NO: 14312 - DNA, 334 bp, Gossypium hirsutum
  Clone ID: uC-gsflnu33B028b10b1
cgaacatcgactcgtgtgttaaaaccgagatattcacgatgagtaacgcgaagaattatcttgaagatcatatattgtggttcgccttgataccactgtctgaagtaatactcaagaatgggaaattggagggagagtccttcctttcttccacggatttgtttcatttgccggctggttttagtcaattgatggtcgagcatataggatcatctcccgacgtaatgactattcctaatgactggtgaagacgaaaccgttaaggatttagaaaccttggagctcagaaagatttggctgctggattcgtaaatcgtaggccagaaccaaatga

SEQ ID NO: 14313 - DNA, 314 bp, Gossypium hirsutum
  Clone ID: uC-gsflnu33B028b11b1
gcgtgcattgattcgtgtcttagactcgagatcttcacgtggcgcggcgtgacaaattctctacagaaggactgatcggtgtgcgcggtgagcatgccgtcctgggcaatgctcaccgttgacgggctcggagcaggtgtactttctcatgcctagactacacattcagacctggtcatcttccattgactaactgcttgtggatctatcattacacgtcgctggttgacatttcactcagcagttgaccgaagacttcttccatgtgcagctcgaagcatgatgtagccaaccatacttctcaccttatggac

SEQ ID NO: 14314 - DNA, 509 bp, Gossypium hirsutum
  Clone ID: uC-gsflnu33B028b12b1
catttttattgctggccttgcatttacaaatggcttaatgtccaaacttgttccctcgatacagacccgcgacagaagaactgccccgtgtgcaaggcaagcatctcttcctgttcattggttcccctgtacggtcacggcacatcttcacattctcaacccaagactccacattcagatctgatcattccccaaagaccacctccttctacatcgaacatgaccgccccttcttcacatctaaatcaacagcttcacgaaaactttttccattctcagtcccaagcatttcataaccaacaatacttcccaccttatggaggatatgcaaccttggcatcatccgaccttagtggtataccgatgacgaatttcttccattcgatgatcggaactttgggagaaatggtgtatgctagaatatttgggagctcaaacacaaggattgtttgcttaccctaaccaagcttcttacccattatcaggaataacaatcttaggatgagaag

SEQ ID NO: 14315 - DNA, 435 bp, Gossypium hirsutum
  Clone ID: uC-gsflnu33B028c04b1
attccctcgatcagcaagtagtggaaatcttctgatttgctagagtctgaaaaactttcaaacgaaataaaagatcgagcgatgaagattgttaagaaaagagaagacgaagctgtcaatggagaagacagtcgcctcggctatgacattcttggatgacttgtagatgcctatcatggttgggaccagaaaagcagactgtcattggatgacttgatcgctgaatgcacaacattctatatttctggacaagaaactgttaaattcttactctcatggataggcttgtatatggttattcacggagcttggcaagaaatctgggtatagtagtttgtgacaaatgcggtaaccaaaaatcgcatctataagcctctacttaacataatagaacgaccattatcatccatgaaaccctaccttcttttatgtgtt

SEQ ID NO: 14316 - DNA, 560 bp, Gossypium hirsutum
  unsure (1)..(560): unsure at all n locations
  Clone ID: uC-gsflnu33B028c05b1
catatgtgaatcttttacatgatattctcttgacctactctttttacaactttgatcttggttactgtcaggggatgagcgatctgctatctccaattttgtttgtgatggaggatgagtcagaatcattttggtgttttgtggctctgatggaacgccttgggcccaattttaatcgtgatcaaaatggcatgcattctcagctttttgcattatctaagctggtggagttgctggacagacctctgcacaaatatttcgagcagaatgactgcttgaattatttcttttgtttccgctggattctgatacagtttaaaagggaacttgaatacgagcaaacaatgcgattgtgggaagtattgtggacgcattatttgtcggagcaccttcaactgtatgtgtgcgtagctatcttgaagcgctatcgagggaagataatgggagagcaaatggactttgataccctcttgaagttcatcaatgagctgagtgggcagattgagcttgatgcgatcctcanggatgcngaagctttatgttatgtgcgggaggatatg

SEQ ID NO: 14317 - DNA, 485 bp, Gossypium hirsutum
  Clone ID: uC-gsflnu33B028c08b1
ttgctgtcttttgatctctgccccaaagcaaaaagctgtcatcttttacaatcacaactactggttatttattttcatggctcaaggagattctaacttccagcaagacatggctaaagaggaagaagaacagaggctgaaatacttggagttcgtgcaagtagccgccgttcacgccgctttgtgcttcaccaacctttacctttacgctaaggaaagatcggggccgatgaaacctagcgtcgagaccgttgagggaacggctaagagtgtggatggaccgctttatgataaataccatgatgtccctgttgaattccttaaattcgttgattccaaggtgggtgaatcagtgaccaagcttgatcgtcgagtacctccagtcatcaaacaggtctcaaccgaagccatcttgtcagtccaaaaggctcccgaggttgctcgtggcgtggcttccgaagtacaccgtgctggagtggtgaaca

SEQ ID NO: 14318 - DNA, 580 bp, Gossypium hirsutum
  Clone ID: uC-gsflnu33B028c11b1
gctggtagcgcctgctggtagccgctgcggacagtaaccgggtgcgaccgcacgcgtccggttatttcttggtggacatgatgtatggaatgacctacatttgttgtacgatggattgccatgacaaccagttatggtatgagacacctagtttctgcagtctcgtccgtgtataacgacgggggacatgaagaatcgctgtggatatctatcgtaatgcacgtggagcacaatgactgtgaacacgctgaaggcatgccatttgggcacttgtgctttagctaatctggaggagttgctggacagacctatgcacatagattctgtgcagacagactgttcgaatcatatgatgcgctagctatgagacgtgatacagataaaacggggaccagaatacgagcactcgatgcgattgcggaaagtattgtggacgcattattggtcgaagcacctgcgactgtatgagtgcgtagctatcttgaagcgctatcgatggaagataatgggagagcacacggaatttgataccctggggaatttcatcaatgagctgattgggcaaattgagcttgatgct

SEQ ID NO: 14319 - DNA, 108 bp, Gossypium hirsutum
  Clone ID: uC-gsflnu33B028c12b1
tcttttcatccgaacaggtcgttgaataggaaacaagattactgacggggatgcgcgaggatacaaccttcttatggtggtggagagccaaagcgggaaatatgctgc

SEQ ID NO: 14320 - DNA, 546 bp, Gossypium hirsutum
  Clone ID: uC-gsflnu33B028d03b1
gtgaatgtattattagattatcatgctaatccaaatgctgaaaacgaggataatatcactccattgttgtcatccgtggcagcaggttcacttgcatgcacggatttgttgattcaggcaggtgctaaagtgaatattacagctggtggaacaactccgttgcatattgcagctgatcatggaagccctgaactaataaacagcttactgaaagctggagctgatcctaatgccactgatgaagatggcctgaagcccgtccaggttgcagctgccagaggtcatcgtggagcagttgagatactatttcctttgacgtcaagaatcgataccattccagagtggactgttgatggaattctcaaatatatgcagtctgaaactgacaaacaattggagcaaatgaaaaaactgacggaagccaagtcaacaagggacactgcattgccggcaaatgatctccctgaggtgacacccgaagcgaagaagaaagctgcagaagccaaatcaagaggagacgaggctttcaaaggaaagatttcatat

SEQ ID NO: 14321 - DNA, 450 bp, Gossypium hirsutum
  Clone ID: uC-gsflnu33B028d06b1
cccacttgttcggtttgcttccgtcacaactccaaaaccgtacacaaaatgggcaaggatctaagcgacgagcaagtctcatcaatgaaggaggctttcactctcttcgacaccgacggtgacggcaagatcgctccatcggagctagggatcctaatgaggtctctcggcggtaaccccacccaatcccaactcaaagctattatcgctgaagagaagctcacggcgccctttgacttccctcgctttttagatctcatgtccaagcatatgaaacctgagcccttcgataggcagctacgcgatgctttcaaggttctggataaggacaatactggctttgtcttcgttgcagatctgagacatatactgactagcatcggagagaagctggagccctcggagttcgatgagtggatcagggaagtggatgtcgggccagatgggaag

SEQ ID NO: 14322 - DNA, 555 bp, Gossypium hirsutum
  unsure (1)..(555): unsure at all n locations
  Clone ID: uC-gsflnu33B028d07b1
ttgctcactcaacattcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgcttaagttcgctaccggcganctggctgtaccagcttttggattgtcatcaggtgtgggcgtgtctaacgcattggttttcgaaatcgtgatgaccttcggattggtgtacacagtgtacgccacagccgttgatccccaaaaggga

SEQ ID NO: 14323 - DNA, 443 bp, Gossypium hirsutum
  Clone ID: uC-gsflnu33B028d08b1
tttaaactttttagttctcaactctctcaaattcaccatggctgacaagtgtggcaactgcgattgcgctgacaagagccagtgtgtgaagaaaggaaacagcttggtcattgagactgaggagagctacatcagcaccgtagtggtcgagcctctggcagagaacgatggcaagtgcaagtgcggaactagctgcagctgcacaaactgcacatgtggcagtcactaagcagacatatagaatgatgaagtttgggacctaaaaagaataaaagttgggttgaataatttgtgtcttttgttgtagtttgaggtgtgttttcttgtctatctgtccgatgattgtctatgtctctcattttatacaatgatggaatgaccatgtcaatggcctttgtctgattaatgaactattattagtataacaaaaaaaatatggacaa

SEQ ID NO: 14324 - DNA, 513 bp, Gossypium hirsutum
  unsure (1)..(513): unsure at all n locations
  Clone ID: uC-gsflnu33B028e04b1
cttacgcgtgggcggacgcgtgggcttttttaactctaaagctaagaaagcaagccactagggttttaagagaagaccaaaatggcttcaaaaagatcagcttccatggccctctttttagcactcaacattcttttcttttccctagtcagtgctacttgtcgatcttgctcttcttccggctctaatcccatccccacccccactccatctgcacgaggtaggtgtcccagggatgctcttaaattaggtgtatgtgccaaagtgcttagcttagtcaatgtcactgttggttcacccccagtgatgccatgttgttcccttctcaatggtctcgttgaccttgaagctgccgcttgcctttgcaccgctatcagagctaacgtcttaggcctcaaccttaatgtcccagtttcccttagcttgcttctcaacgtttgctcaaggaatgttcctactggcttccaatgctaattntagtcatcactctccctacattctntttcatctttc

SEQ ID NO: 14325 - DNA, 592 bp, Gossypium hirsutum
  Clone ID: uC-gsflnu33B028e05b1
ctggtacgcctgcgggtacccgcgccccaatttcccggtggagacacacgcgcgcgctttcgcgtgcgcacacgcgtccgcaaattttggagaaaaccttgactggcaagacaatcactctcgaggtcgagagctccgacacgatcgacaacgttaaagcgaagatccaagacagggaaggcatccccccagaccagcaacgtctcatctttgccggaaaacaactcgaagacggccgtaccttggccgactacaacatccagaaggagtcaactctccaccttgtccttcgtttgcgcggcgggatgcaaatcttcgttaagacgcttaccggaaagacgatcactctcgaggtcgagagctctgacacgatcgacaacgtgaaagccaaaatccaagacaaggaaggcatcccgccagaccagcaacgtctcatcttcgccggaaagcaactcgaggacgggcggactttagccgattacaatatccagaaggaatcgactcttatctggttctacgtcttcgaggtgggatgcagatcttcgtcaagactttgaccggtaagaccattactttagaagtggagagctcg

SEQ ID NO: 14326 - DNA, 529 bp, Gossypium hirsutum
  Clone ID: uC-gsflnu33B028e08b1
aggctgcatacaccaacccggaaaccttatgggaccgtgctaatgatgccatcaacacgattatccgtcgagatgagagcactgaaacaggagagcttttgccaccttgtgttgaagcggcccttaacctggggtgctatccagtgagagcttcaaggagccaacgacacagtaatcctaggacttaccttacgccaagagcacccgaaactgttcctgcaactcctaggattttggataacggcagtgaggataggtatcctcagttatcccaggttcagtctggtagtcagcttgcaagaatagcaaccaatgtgaattcgaacacttcggtttcacaagctaaccgtcataattatccatttctacctcaaaattgcccatctggccatgaccaattgatgaggatggaaactaacactccatcgaactctggtcaagtttaccccctttattatggaattcactatcaaaatgcagagttccaaacaggttctccagtgcaggaaaatctagtgtctgatacgat

SEQ ID NO: 14327 - DNA, 538 bp, Gossypium hirsutum
  unsure (1)..(538): unsure at all n locations
  Clone ID: uC-gsflnu33B028e10b1
tttttaaacaaccacacaaacaaaaaaataaaagaaaaccttagacaggaaaaaaaaacactctcaaggacaaaagctacaacacgaatcgacaacgttaaagcgaagatccaagacaaggaaggcatccccccagaccagcaacgtctcatctttggcggggaacatcttggagacggccgtaccttggccgactacaacatccataaggagtcaactctgcaccttgtccttcgtttgcgcggcgggatgcaaatcttcgttaagacgcttaccgggaagacgatcactcttgagggcgagagctctgacaccgatcgcaacgtgaaagccaaaatccaagacaaggaaggcattccgccagaccagcaacggcttatcttaggcggaaagcaactcgaggacgggcggactttaaccgattacaatatccagaggaatcgactcttcatctggttctacgtcttcgaggtgggatgcagatcttcgtcaagactttgacccgtangaccattactttagaagtggagagctcgga

SEQ ID NO: 14328 - DNA, 467 bp, Gossypium hirsutum
  Clone ID: uC-gsflnu33B028e11b1
ttctacgcgtccgatcgctcgtatagagccccggaagtcatccttggcctcccgtatgaccagaagattgacctgtggtctctcggatgtatccttgctgagctatgttctggggacgtcttgttttcaaatgatgcggtcgtgatgatccttgcacggatggtcggaatgcttggtcccatcgatatggagatgttggagaatgggcaagagacatacaagtatttcacgaaagaatacgacttgtaccatataaacgaggaaacggaccaactggagtacctaatttccgaggagtcttcgttggagcatcatcttcaagtatccgacgtattgttcatcgatttcattagacatttgcttgagatgaatcctcgaaggcggccaaatgcgagggaggcattaaaacatccctggctatctcactaggactaaaccggaactcgccgaatggctggaggaacgac

SEQ ID NO: 14329 - DNA, 469 bp, Gossypium hirsutum
  Clone ID: uC-gsflnu33B028e12b1
ctggtgcgcctgctggctagccgccgcggacagtgtaccggggcgaccgcaccgcggccgcttattctggcggagatttggaatcctaatgtttatgctgatgggcgtgttagcatatcaaatcttcatcctccaggggatgatccaaatgggtacgagcttgcacgtgagcgctggatgccagtccatacagcggaaagtattgtattgagtatcatatcaatgctttcaagccctaatgatgaatctcctgcgaatgttgaagctgctaaggagtggagagagaggaaagatgaatttaagagaaaggtcggccgctgtgtccgacggtcgcaagaaatgttgtgatcaatgatggctgttgctgctgttccttttctagaatatatgaactcgaggaatgccttaatttttatcatgtacggagatgagttgcggctgattacaccgcacaatccttgtgaaccta

SEQ ID NO: 14330 - DNA, 360 bp, Gossypium hirsutum
  Clone ID: uC-gsflnu33B028f02b1
tgctacgcgtccgcccacgcgtccgcccacgcgggcgtccgtgttgtgaccaatgctttctcaaaatccatatggggtatctaccaacacttcttttctacggggtcacctttgtgtttcaaacccagaccccctgggtgttgggagtgcatataaacatattctcggctcgccctctatgtgaccataggtttctctctcggggggggatatcttgcggagatgagcgcctcgacatttgctggggggggaaagcgcacgaggggaggacactttatatccgcaaaagttgagagctatacacgctgtctggaggtaatctgtgtgtggggctcctaaacttttggcaggagtgtagac

SEQ ID NO: 14331 - DNA, 546 bp, Gossypium hirsutum
  unsure (1)..(546): unsure at all n locations
  Clone ID: uC-gsflnu33B028f03b1
cggacgcgtgggcagagcttgggtacccatacgaagccattcatgttaccactgccgatggatatatccttcttttagaaagaataccaagacgtgatgcacggaaggctgtctatctacagcatggtatctttgattcatccgtgggttgggtttctaatggcgttgatggttcttcagctttcgcagcatatgatcaaggctacgacgtcttccttgggaatttgcgtggtctagtctctagggggcatgtggataaaaatatctcctcacggaaatattggtggatcacagtaaatgagcttgggacaaaagatattccggccatggtagagaagattcatgaaattgaaacggacgatataaaaatgattcaacctgatgaagaaacaaacgatgagcagccatacatactgggagcgatcgctcatagtctgggtggagctgctatgctgatgtatactgtgacacgcttgattgaacaaaagccntacaggctctcaagattgacattactatcgcctggcggcttccatgatgaaacta

SEQ ID NO: 14332 - DNA, 219 bp, Gossypium hirsutum
  Clone ID: uC-gsflnu33B028f04b1
cttactcgtccgtttttctttttcttcttagaaatgctttgtacgccattgacagttttacttttacagacagcgctacatgataatgttgctgtagaattatgtaaaaactgtactgatatatatagtgtactcagtggtaaaagtttgtcttttttgatattgcttccttctgctgctgatgttttattttacataaaaaaaatcagattggaagtt

SEQ ID NO: 14333 - DNA, 550 bp, Gossypium hirsutum
  unsure (1)..(550): unsure at all n locations
  Clone ID: uC-gsflnu33B028f06b1
gatgattcgggtctaccaagtggaagttcatcggaatgggtttcacaacccgcattgccaaagaatcaacccctaatatggtacaagacaaattttgatgcccctactgggaatgaccctgttgctttagacttcatggggatggggaagggtgaagcatggatcaacggacagagcattggacgatattggcctgcctatatcgcttcaaacagtggctgtactgactcttgtgattatagaggaccttatagtgcaaacaaatgccgcaagaattgtgggaagccatctcagcaattgtaccatgtacctcgttcatggttgaaaccaagtggcaacattcttgtattgttcgaggaaatgggtgggggatccgacacagcttgcttttgcaaccagaaagaatgggaagtttgtgctcgcatgtatctgactctcacccattacccatggatatgtnggggtttggattcgaaaacaagaagggcttcaaaccctacgctatccctcagttgcccatctccgaatcaggttatttcttcaatcaaat

SEQ ID NO: 14334 - DNA, 553 bp, Gossypium hirsutum
  Clone ID: uC-gsflnu33B028f08b1
cctacgcgtccgcccacgcgtccgcccacgcgtccgcccgtgttgtgaccaatgctttctcaaaatccatatgggttatcttccaactcttcttctatgcgctccgacctttgtttctcaaaccgaaaccccctggttgctgggagttcataaacttattcgctcagctcgccctcgatgtgaccatggtttactttcacgggtggaaatctttcgcttatttgatcctttcgacattcgttggtggtggaatgcacccgatggcaggacattttatctccgaacattatgtgtttaaacccgaacaagagacttattcttattatggtcctcttaatcttttgacatggagtgttggctatcacaatgaacatcatgatttccctaggatccctgggtataagctacataaggtgaaagaaatcgcacccgagtattacgaaggcttggaatcgtataaatcatggagccaagttatttacatgtacataatggatcaaaccgtcggaccgtttagccgaatgaagaggaagatctcgaaaaaatcccgata

SEQ ID NO: 14335 - DNA, 81 bp, Gossypium hirsutum
  Clone ID: uC-gsflnu33B028f09b1
tccacgcgtccgaaaaaaaaaaaaaaaacagaggggatttattaaaaaaaagggggggggtttgccactggatggatcgct

SEQ ID NO: 14336 - DNA, 304 bp, Gossypium hirsutum
  Clone ID: uC-gsflnu33B028f12b1
tcctcacgcgtccgcgttaatctcatctggtacggcgagtttacacccatccaacgctccataatcgatgatttcatcaactctttgagttccgataaggccacactggttccttccacgtcgtcgtggaggaaaagtactgaaaagtacaaggatggttcttctaccttagctgtaggcaaacaaatccttctcgaaaattacccgctcgacaaattccttgcaagacccacattgatcggcattggccagtaagtgtcaacggcatgcgataccatcaacgtaatccttacttccaaagacg

SEQ ID NO: 14337 - DNA, 555 bp, Gossypium hirsutum
  unsure (1)..(555): unsure at all n locations
  Clone ID: uC-gsflnu33B028g03b1
cttcattttccgtgatttgaaccaaccagcgtattggatgcttggggctggattcttgtggatgtccctatggatcttggctgtagttggggccttgaatttctactacccagcattggttataattgcattactcttaagcttgtgttggacaactgaagtgatgaggaatgtagttaatttaactgttagcagagtgattgctttgtattatctaagaggaatgcagtctaacactcagttttgcttccaaagagccttgacccggaatctcggaagtgcttgtcttggttccttattcgtgccagcaatcgaagccatgagaattattgccagaggcttgaatttgcttgaaggagaagatgaattcatgttctcttgtgctcattgctgtctcaacgttatgcaatccatcttcagatatggaaatggatgggcatatgtacagatagctgcctatggaaaaggtttcgttagggcatcacaagatacttgngcactttntgagagggaagaaatggaacccattgtagattctgacatgatgagcgcgat

SEQ ID NO: 14338 - DNA, 542 bp, Gossypium hirsutum
  Clone ID: uC-gsflnu33B028g04b1
cctatcgcgtccggttattttgccttttcgctatcgtctttgcctatcaactccacggcgcagatccgaggagtctctatttttcaatccaaacaacccctctaaacactctcttcttttattgctcctactcttccagtcatggcaggcttggcaccagaaggatcccaatttgatgctcgtcaatatgaccagaaaatgactgagctgctccagactgatggagatgactttttcacaagttatgatgaagtttatgacagttttgatgcaatgggacttcaagagaaccttctgaggggtatctatgcatatggttttgagaagccttctgccattcagcaaagaggaattgtaccattttgcaagggtcttgatgtgattcaacaggcacaatccggaactgggaaaacagcgactttctgctctggaattctacagcaacttgactatgctgtagtccaatgccaggctctggttttggcacccacagggagttggcacaacagattgagaaggtcatgcgagcacttggtgattac

SEQ ID NO: 14339 - DNA, 500 bp, Gossypium hirsutum
  unsure (1)..(500): unsure at all n locations
  Clone ID: uC-gsflnu33B028g07b1
cctacgcgtccgcgctggtgggattgtttgctgtggcggtggctcatgcccttgtcgtcggcgttatgatatcggccggacacatatcaggcggccatcttaacccagccgtcacgcttgggttgctattcggtggtcacatcacggtggtccgtgcgatcctctactggatcgatcagttgttggcatcttcagctgcttgtatacttctcaagtatctcaccggaggattgaacactccggttcacacattagcaagtggaatggggttccttcaaggtgttatatgggagattattctcacattcgcattgctgttcacagtgtatgccaccatagtagaccccaagaaaggttccatcgatgggctaggtccaatgctcactggcttcgtccgntggggccaacatcttagccggtggagctttctcgggtgcttcaatgaatccggctcggtcattcggacccggtttagtgagctggaactggaccgaacactg

SEQ ID NO: 14340 - DNA, 533 bp, Gossypium hirsutum
  Clone ID: uC-gsflnu33B028g08b1
tttattattttcatcgttggggagaaagaaaatagaaatgggaagcgatagcgaagtagagaagacgcagcagaaggagaaggagaggaagaagatgttagctatagctcctatcgcaaaaccccttgctggcaaaaagctctccaagaaaacccttaagctcgtccgaaaagcatctgagcacaaatgcttgaagagaggagtaaaggaagtggttaaaagtattcggcgtggtcataaaggattatgtgttatagctggaaacatatctcctattgatgtcataactcatgttccgatcctatgtgaagaggctgaaattccatatgtctatgtttcttcaaaagaagatcttgcaacagcaggagctactaagagaccaacatgctgtgttttggtgctaaccaagcccaccaaaggtgaactcgccatcgaggaacacgacaagatgaaagccgattatagccagatagtatcggatgtatctgagcttacatcatccttttttaattaactcggaaaaaaattttgat

SEQ ID NO: 14341 - DNA, 507 bp, Gossypium hirsutum
  unsure (1)..(507): unsure at all n locations
  Clone ID: uC-gsflnu33B028g09b1
cttcattggtatacttcaaagctcatctgtcaacccagagccccttctctccgccgaatctcctttttctcccgtaaaaatgtctctggtggccaacgaagattntcagcacattttgcgtgtcctgaacaccaacgttgatggaaagcagaagattatgttgctttgacctccatcaagggtatcggaaggcgtttcgccaacattgtttgcaagaaagccgatgtagacatgaacaagagggctggtgaactgactgcacaggaattggacaatctcatgacgattgtggcgaacccgagggcagtttaaaatcccagattggtttttgaacaggcagaaggattacaaggatggaaagtattcccaaagttgtgtccaatgctctcgactgaagttgagagatgacttggagcgcttgaagaagatcaggaaccaccgtggtctgaggcactactgnngccttcgtgtacgtggtcagcacaccaagactacntgtcgccgagg

SEQ ID NO: 14342 - DNA, 357 bp, Gossypium hirsutum
  Clone ID: uC-gsflnu33B028g10b1
tttccacgcgtgcggatttgacaaaggtgtcattaactagttgattgaaaatgtatatatatatatatatcaaatatgaagaataagctacaagatatgtatagaacttatattttatgatgtatacctttgttaataaatcaaatgatgctattttactagaaataagtaatttgaatttttttttaactctgaataatataataagttattaaaatgatgtatcggtatctcaaagtttaggtttgagtttggtattaatatttgatcgggttgattgcaatgtgaatggacccaaacatttactgtcgtggtgctggaactggtgctgacacaaaggcagtaactgaaatgggc

SEQ ID NO: 14343 - DNA, 428 bp, Gossypium hirsutum
  Clone ID: uC-gsflnu33B028h02b1
catatgtctacggaataaatggcgttttcaccgatgatttcccagcaaagccggcaataccattcaattataccggcactccaccgcctggtctacaaacgatgaacggtaccaaggtatacagattggcctataattcaacagttcaacttgtgatccaagggaacactataatagcacccgagagccatccaacccatcttcacggatccaacttcttcgtagttggcagaggggctggaaacttcgatccggaaaaggatccattgaaattcaatcttgttgatccgggtgaacggaacacggataagcgtaccaactgcagggtggactgcaataagattcagagcagataacccaggggtctggttttttcattgcccattggaagttcatacaacatggggacttaagatggcattcttggt

SEQ ID NO: 14344 - DNA, 479 bp, Gossypium hirsutum
  unsure (1)..(479): unsure at all n locations
  Clone ID: uC-gsflnu33B028h03b1
ttttcgtttacgcaagtttcaaagcccctttacgatgccaaggtgcaaccaaccaccttgataccaaagcaagttggcaacatgtacacagcatctctgtacgctgcgtttgcatctcttcttcacaacaaaaacagtgaactggcaggaaagcgggtaatattattctcatacggaagtggactgactgccacaatgttttcattgcgactccatgaaggtcaacatccttttagcctatcgaacattgcgacggtaatgaatattgctggaaaattgaagtctaggcatgagtttgcccctgagaagttcgtcgagactatgcacctcatgtgagcataggtatggagataaagactttgtgactagcaaagattgtagccttttgtctcccggaacatactacctacncgaagtcgattctaagtaccggagattctacgcaaagaaggacgggaactgtactggtaatgagaatg

SEQ ID NO: 14345 - DNA, 399 bp, Gossypium hirsutum
  Clone ID: uC-gsflnu33B028h10b1
gcttcttgctatcccacccatcttgaaattggctggcagtctatcccttgctgtaaaatctgttaggtatactcgtgggagttttatattccctggtgctcagccatttcctcaccgaaacttctctgaagaggttgctgctcttgataactatttcgggaagcttggcgctggtagcaaggcttgtgtaatgggtgggctggataaacagaaatggcatgtgtactctgcatctgcagaacctgtgaccgccactggcccggtttacactctagaaatgtgcttgactggtttggacagggataagcggttcggttttctacaaagaccaatcaggctccgcagctgtgatgaccattaattctggcatacggaagatccttccagagtctgagatat

SEQ ID NO: 14346 - DNA, 236 bp, Gossypium hirsutum
  Clone ID: uC-gsflnu33B028h12b1
tgttatttgggaatggctgccttctatcgatccatatatgtcaatgatgactctcttgctcttgcattctatgagtctactatttgtcaaaatgctttttttgtttagttgtgtacatgcaacacgtgagatactaaaaagcaagaatgatgaaccggaaagctgctaggccaggaaaagttaagaagtctatctgaggctaggaaatgtccccaaagctcaatggggattgcttt

SEQ ID NO: 14347 - DNA, 506 bp, Gossypium hirsutum
  Clone ID: uC-gsflnu33B035a07b1
tttcttcgtccgggaaaagggaagagtaagatgtcgaagaatataacacatggttatcatttagtgaaggggaaagcgaatcatccaatggaagactacgttttcgcggagtttaagcaagtcaatggcagtgagctcggtttatttgccatattcgatggccatttgagccatgttattcccgattatttgaaggcgaacttgtttaacaatatcttgaatgagcccgacttttggacggaaccagagaatgcgattaggaaagcgtatcgtttaacggatacaaatatattggaacaagccattgatttgggcaaagggggttcaacggctgtgacagcaatattgatcaactgccagaagctggtaatagcaaatgttggcgattcccgggctgtgatttcttagacggcgtggcttagcagttttatatgatcatgagcccgcttctgaaagggagagcattgaatattgaggcgtttttgtttcgaactttccagggatgt

SEQ ID NO: 14348 - DNA, 332 bp, Gossypium hirsutum
  Clone ID: uC-gsflnu33B035a09b1
ttctctcgtccggtagccttttgtgctggaaaaatttgctgcaatagtatttatagtcaactgttgtgactgaagaattctatttgccctttttcttattccttcgcagtagggcttaaggaagattctttttcccccttgttcaatggaaaggcatcattgcttgcgaagcttgtgccatcattttttttttattttcccggatcataaagaaaatactgttaccatttcccaaaaaaaaataataaaaaaataattaataaactatatttattaaataataaaaaaataatattaattaaaataataaaataataataaatcacaataag

SEQ ID NO: 14349 - DNA, 308 bp, Gossypium hirsutum
  Clone ID: uC-gsflnu33B035a11b1
ttcctgcttagatccaaagaggaagcctcgattgctgttaattaatggcggtttaccatctcttacacaaagacgtctaacgagcttccactcaatgggctgacattcatagaaagcttgggaatctacccccaaagcctccatctttcaagcctgaccctttagaacccgcacctgaccctgattccgtccctaaggacaagtctaggatcgatgaacagactgaagaagagcttgaagaaatcgaagatgatgtcgacgattatcgattccttgaagaatacataatgaagaggctggctgagatg

SEQ ID NO: 14350 - DNA, 432 bp, Gossypium hirsutum
  unsure (1)..(432): unsure at all n locations
  Clone ID: uC-gsflnu33B035a12b1
gctgaggaagcactatcacaaggcttggaagctttgaatcagtctctgtctgatatcataatctctgattcacttagctgcccgcctaatatgagtaactacatgggccaaatggctatcgccatcaacaagctctccacccttgaaggtttcgttagacaggcagataatctgaggcgccaagccattcatcgactgcatcagatattgacgatccgccaagtagcaaagtgtttgttggcgatagctgagtacttccatcgcctaagagctcttagctctctgtggttggctcgacctcggcaggaacaatagaaaccctagctagctaggtcttnttttaagttgactttgattattaatgtcttctttgatattttcatcaagatttctacatatatagatagaatagatttgaaaaaggtcataatt

SEQ ID NO: 14351 - DNA, 316 bp, Gossypium hirsutum
  Clone ID: uC-gsflnu33B035b01b1
tcgtataatcaaacaggctgatagtggaaacccggacagttcataataaccagataaaccctcataagccggatcagctcttatgggtttgcactaactgatcagccagacgacgttttagagaaagccgaaggcctgtggagaaagcacgaaataggagagcccattttgccaccgagtatttgccacctttcaagcactagggggtgacctaagtgctcacaacagatagcgtctgatcgctgggggtgcccagcttcacagcccataactcatgatatcatccggacttgtgtttagctcccactgcttaagg

SEQ ID NO: 14352 - DNA, 446 bp, Gossypium hirsutum
  Clone ID: uC-gsflnu33B035b05b1
ttctctcgtgcgaccacgcgtccgtatctctatacttgagatcagcgctccggttatgggtccgggtatcttaacggctccggccccgtggtcttttggcgtccacattaccgggttgctcgaaaaagccggctgcaagactatggctagtttgcttaccagccgtggcgtgcttaagactcacgatggggcgcttgataaagggttgaccgtttctgctccgtccgatgaagcttgtcaagctgaaggtgtgcctgagttgagcaagctcaccaatgcagaacaagtctcacttgtagagaatcaggcctcgccggattacatacctaagggaacgctgaagacgacgaacgacccgatcagtacattggggactaacggggctggcaagtacgatctgacagttacaaccgacgtcgactcagatgacactacacacaggggtt

SEQ ID NO: 14353 - DNA, 260 bp, Gossypium hirsutum
  Clone ID: uC-gsflnu33B035b06b1
ttcttttatagactggctagaattgacacttggaggggtgtccatagttgctccctggtttggcaccgcatggcctacaacctatgggagggccatttactgctgtttattttgctcatagggtgaaccccacagtttatgaacattttgacaatataacccctagagtgtagcttctaacttatgaacataacatagacgacctatgaactacacaagaacatgcacgtctgtgctgcccttagatgtcaacaacaccc

SEQ ID NO: 14354 - DNA, 274 bp, Gossypium hirsutum
  Clone ID: uC-gsflnu33B035b09b1
cgcagtcctttcatgcgttgggccaccagagcggatgagggaggtaaagcttatgcctgggatccaaatatatcagaaatggcaccccgacaaagatttaatgtagattggcaccatgaacaaggcttaagggcagactgcttgttctttcacaaacatgtcacctgtgcacaacaccccctattactatgttgacctatttccatcctacgagacatgtgaaagacatgatcagggcagccacatggctggatactttaccgataatacatgg

SEQ ID NO: 14355 - DNA, 81 bp, Gossypium hirsutum
  Clone ID: uC-gsflnu33B035b10b1
tcgttcacgcgtgcgcagtcgcgattgcccgcgtgtattcaataacatgttcggaaacctggcactgaaaagtggatccta

SEQ ID NO: 14356 - DNA, 317 bp, Gossypium hirsutum
  Clone ID: uC-gsflnu33B035c01b1
tcctacgcgtccatgggtacgagtgtccaggggaaattgtaaaacgttagcgggtattcacccctcctgagacgggatatgctgaagctaccaattgcccgctgtctgaagcaaacgaacacaagcccagatggactgctgtttctgacaaaggctcaagtactcttactgatgagactgcacttgcaacaccaccacgcgatggacaatcaatgagactgcgcatacgcagacacccagctagaaactgcgcacgctgccattgccctactgcctagaagccgttgagcacctggccctccaatgacacgtttcac

SEQ ID NO: 14357 - DNA, 195 bp, Gossypium hirsutum
  Clone ID: uC-gsflnu33B035c04b1
gagcagctggtggaggacacatgccgactaactagaattggatatactttacaacgtaattatggatagtgcgacaaaaatagttgagaaagagaaagcacaaacctgagaatggagaagagactccctatggcttcgacatggatggaaaacgtgaagactgctataacagtaacaagacgagaaaagccacgt

SEQ ID NO: 14358 - DNA, 506 bp, Gossypium hirsutum
  Clone ID: uC-gsflnu33B035c07b1
ttctctctctctctctcgctcgcagaccggtcatcattgtcatcatgctgctttcgcctgacaccagaagctcgggccctattaaaaacttgatagaaagcctccctcaattatatctctggtggtctcctgtcactgatccaatcacgatgagtaccggtgaacttctcagcatcgagccttatgagctccaatttccctttgaattgcgaaagcagatctcatgttctctaaacttatccaacaagaccgacaattatgtggctcttaaggtgaaaacgacaaatgcgaagaagtactgtgtaaggcctaacactggaggtgtattacctaggtcaacgtgcaacgttattggtataatgcaagctcaaaaggaagcacctcctgatatgcaatgcaaggataaatttctacttcagagtgtggatgctagacctggagctacagcaaaggatataacttcagagatgtttaacaaagaatccgaacatcatgttgaggagtgc

SEQ ID NO: 14359 - DNA, 424 bp, Gossypium hirsutum
  Clone ID: uC-gsflnu33B035c08b1
tcctttcgtccgggaaaccttgagatgcttgaagagttggacataagtgacatccagatcagagttttacccgattctttgagattattgtcaaaaatgagagtcttccgagctgatgagactctcttggaagttccaccaagagaagtaatcaaattgggtgctcaggctgctgttgagttcatggctgatcttgttgccaagagggataccaaggctgcaccaccaaagaaggagaagggtttttggctcaggatttgctcgatttgttggccgttccggaccgcatatacagacgacaacatgttaccaatgaattactactacagttttttctctttagccccttgtaaatatctaaaaaatgtctttggcttcttgtctagaagtgtgtgtgagtgtgtttttatgccagattcattac

SEQ ID NO: 14360 - DNA, 204 bp, Gossypium hirsutum
  Clone ID: uC-gsflnu33B035c10b1
tcgtccacacgtccgatggcgtgttctttctttggaacaattgaacttaggcagaaaccagatattcactaaatacacactttcatgtcaaaaaataaatattttgctaatctaccatctaagaaactaacgtaccgtatatctcattgcaatttcaaaaaaaaaaaaaaactaaaaaccctggctggtaactctagatattcc

SEQ ID NO: 14361 - DNA, 494 bp, Gossypium hirsutum
  Clone ID: uC-gsflnu33B035c11b1
tttttggaattactgatagttaattcagcaacactgtatgagatgaaagggaaagttgtatttttttttttagattgaactcggctagttgaatgtatctggtactcttgattgttgcagaaaggagcaattagtgcatactcatgtttagaacgagctctgtaataaatttggttgctgtcttatggtgattctttgttgattaaggagtttcatcatattagtgttgaatttgttgatggcatcaattagaagaacactgtctccggtgcctcgaccggggactcctgttacaggggaggctgaacgttcagttccttctcctctgtcgaagtcgacaacgccgcagactggtggcttgttatcttctcttataggtttatcagattctcaagcattgtgttcggtgttttttcgccgataactactaggcctgttgataggccgaatccgaaacacaaggacatgtatggaggagggctctttttcatttc

SEQ ID NO: 14362 - DNA, 445 bp, Gossypium hirsutum
  Clone ID: uC-gsflnu33B035c12b1
ttaggcaataagaatattttggcgattccttcgagctgataaagatgcgaacattgtgaaccgtaagatgaggaaaggtgctcaagtggaacctacagagcctgatgagcttcaacttctagcaaccgttcaaactagtttacaaaagaaggataagaaacttagagaaatagtaaggagtgggaactgcatattaaggaaattgaagaagaatgaagaggagaattcggatcaagtgcttcacttcttctctcaagtggatttgaaattagtggcaagagttttgaacatgtctaatgtgacaagagaccaacttttatggtgccattccaaattaagcaagattaactttgttaataggaagattaatgttgaaccatcctttttgcttttcccatgttgatattttctgaattaatacagcatgtatatctattcctctcgc

SEQ ID NO: 14363 - DNA, 407 bp, Gossypium hirsutum
  Clone ID: uC-gsflnu33B035d05b1
ttcttggggccgcgtgaaagaaagggcgctcacaggctcaccattcagacacgggcgatgtggctggactcagagcatatgcttagtaccatggcagggggcgggctggagctaagataagcacactagactgtgtcgaagaacaaccttgcaggatcattgaagcgcatggctgaaacacgagccataatctgtactattgagcggtcgagctaagtgacagtccaaaagaacctagcaatatggaaatatgaataagggataaagaactgttatggatgcatacttcagcggtgaggctgtcgaccgagctaactaactgttcttcaaaggatacagcacctggggatgaatgattgatgatcgactatccaatggaatgagatacgctaaacatgctatttccc

SEQ ID NO: 14364 - DNA, 448 bp, Gossypium hirsutum
  Clone ID: uC-gsflnu33B035d07b1
tttttgcgaggttcgggttgtgacgaaaacgctctgcttaaacatgtagcactcttcgacagacacaatgatggcattttttatccatgggagacttgtcaaggttctcgagcaataggggctggttatttatcgtcattcatcagtgccttcttaatcaaccttggtctcagtcgtaaaactcgccctgtttgtgtcgtggaagtacgaagaaatcttacacaaattcgctcgcactcattcggatgccttaccatcccatgaactgaaggcaatgcttaaggctaacagggaacccaaggattacaggtgatgggtcgctagctgcacagagtgagataactctatacaatttgtgcaaagacaagggaggattatcgtagaaggaaacaatttagatgcgtttatgatggaagcctgtgtcaacaaatggactggtaaaaattag

SEQ ID NO: 14365 - DNA, 533 bp, Gossypium hirsutum
  Clone ID: uC-gsflnu33B035e01b1
tcgttcacccgtccggtctctcaggtgatctaatcttttaccgcacctttgcgggacgacggagccctgaatgtggatgtgactgacttccacactaacctggtaccataccccaggatccactttatgctttcattgttatgcccctgtcatttaagctgagaaggcttaccatgagcagctatcggtggctgacataaccaacagtgcttttgaaccctcttcactgatggccaaatgtgacccacaacacgctaagtacatggattgctgccttatgtaccgagaagacgctgcgcccaaagatgtgaatgcggctgtggccaccattaagaccaaacgcacaacccaatttgtggatcgttgccctactggattcaagcgcggtatcaactaccagccaccaactgttgttccaggaggagaccttgccaagggtcagagagctgtctgcatgatctccaactcaaccagcgtcgcggaagtgttaccccgcattgatcataaatatcgatccatgtattgcaagcacg

SEQ ID NO: 14366 - DNA, 371 bp, Gossypium hirsutum
  Clone ID: uC-gsflnu33B035e02b1
tctttgtctctggggcgaatacaccaacccgggaaccttatgggaccgtgctaatgatgccatgatcacgattatacgttgagaggagagcactgaaacaggagaagctttgacatcttgtgatgaagcggcccttaacctgaggtgctatacaaagagagctttatggaggcaacgacgcatgaatacctaggacttaccttacgccaagaggacccgaaactgcatctagaactcctaggattttggataacggccgtgaggataggtatgctacattataccaggtgcagactgtgaggcagtttgcaagaatagcacccgatgtgaatccgaacactttggaaccacaagctgaccggaataaatat

SEQ ID NO: 14367 - DNA, 325 bp, Gossypium hirsutum
  Clone ID: uC-gsflnu33B035e05b1
ttctttcgtccgcggacgcgtggggtttgaatcgtacatgcttttggattctggagcttgacgatcgaggtctcaagggcggacactctggaataacatactgctaggatgccagacaacgatagagtacgaacatacctggttcttacgtagaataactaccatactctatccactaccttaccgtagctcttctacaacgttcaaaggcatacagcctttactcttggactgattcatggagaagaagatctgtttcttcgataagacgcttaccggaaagacgatcactctctatgtcgaaagctgggccgccatcctcaac

SEQ ID NO: 14368 - DNA, 305 bp, Gossypium hirsutum
  Clone ID: uC-gsflnu33B035e07b1
ttcttttacggggaaaacggagaatgcatggagcagggttccacaagaaaggggggattccgctaattttggcttcaaacatggagcatagtatccccgtacatgtattgtccaatatggatggctcagccctcacaaaggtacacctagcatccttagaggacaccatctggagtccatgcaacattggattttggagattatgcctgtgtcggccttcagtacaaatgggtgacccagagggatcatataacacgcaccgaatgcagtaactgatcaaatcaacctgaggctataaaccatgg

SEQ ID NO: 14369 - DNA, 457 bp, Gossypium hirsutum
  Clone ID: uC-gsflnu33B035e08b1
acgcgttctttcacacgtacgggcggacgccagagagggagccttgatagacggctaccacatacaaggaagggggcgggcgctctaatatacccaatacttacacgcggaggcagtgacaataaataacattaccgggcgttatgagtctgataataggtaggagtacaatacaaatcccgtaactgggataacaccggtgggcaagccttgagccagcaggcacggtaattccagctgcaacagcggctatttaagatgtaggactcaaaaagctcgcactctggacttatgtgggggtcggacgggccaactgacggagagcaccagcgtgttcgtaactactgccggcgatgcgctcctgggcttaattggccgtaccattgctacggcgctagtaccctgaatattttatagcgctcaatgcatgcctacacttgtctacatttgcatggga

SEQ ID NO: 14370 - DNA, 307 bp, Gossypium hirsutum
  Clone ID: uC-gsflnu33B035e11b1
cccacgcgtccgtgagctggtcatgaagaaaaaaaaatgaaacccagaatttttgttctttctattgggcgtgggggggggattcttgtatggcatatggcttaattgattctgtcgggatagcgatagaaagtagagagtaaagaagaaaaactctatgggtttttttgaccagtttgtatatagaaagaacatggtgttcttgcctgcatagaattaaaagaggtcctttgtcattttagattacatgataccatttatgagactctaccacctaaagcctggtgtgctcaatctaagggatcca

SEQ ID NO: 14371 - DNA, 187 bp, Gossypium hirsutum
  Clone ID: uC-gsflnu33B035e12b1
attggtgctttggtttgtgtgtggcggtcttttctttcgggtccttttttgggtcggcctttgggggggcgcttcttttgttccctggcgccggccccggtgttggccccgtttggtgtttcctttggggggccctgggccttccttgtggcccgctttttttgggggtctggtgggtttccccctt

SEQ ID NO: 14372 - DNA, 77 bp, Gossypium hirsutum
  Clone ID: uC-gsflnu33B035f01b1
gtcgtttcacgcgtccggtaggaaacagcccttgggtagtatttcgatacgtgagacccagtctccaacatcaaaca

SEQ ID NO: 14373 - DNA, 407 bp, Gossypium hirsutum
  Clone ID: uC-gsflnu33B035f04b1
tttcattttgtccgaattcagttttcaaaacagtattggcttctacacccttgacggaccctcataaacggaacgaaatgcctggtaatagcgagtgaagaagataaccagcgctggactggaatacagaggctgataaagctccgacggagaagaagccaaatgctggttacttgctacggtgggaaggcattgcacctgccagagacaaaatggggaggtggaccaagaagagtaccgaaacctacaagatctacatcttcaaggtggttaaacatgttcatgcatatatcggtatctcaagcaaagctatgggcattatgaacagttttatcaatgacataatttgagaaacttgctcaagaagcttcgagactcgcgtggtacaacacgagacctactattac

SEQ ID NO: 14374 - DNA, 352 bp, Gossypium hirsutum
  Clone ID: uC-gsflnu33B035f07b1
ttctctcgtacgaaagcttcactgagctctctctcggtatatctatacatctctctctgtctcccatttgcctccatggccgtgtctttcaaaatgggcccgagttgcgggctatatgagggccttacagatgccgggactggtgagctcacataaggacgatgagctccttcaacctgcttgggctatggaccattgcatctatgaaggagtagccccataagatgaaactcgacaactatgctggtgctggctttgcatcaaaaagcgaggaactacctggaaaagggaccatgcagattaagccatgacaaaggcgagtgtgcagggactgctaccgataattatatga

SEQ ID NO: 14375 - DNA, 416 bp, Gossypium hirsutum
  Clone ID: uC-gsflnu33B035f12b1
ttccacgcgtccggaagcaagcagctagcagtttgctttgaattatactactataactccaccactttccaccagatttacattgcagatggcttcatcaatgctgtgggcttcaagggcggcttcttatcttaggatctctgtcttccacagaggcttttccactgttctaaaggatctgaaatatgcggattctcatgagtgggtgaaggttgagggtaactctgccactattggtattactgatcatgctcaagatcatttaggtgatgttgtgtatgttgaattacccgaagtgggagctgctgtaaagcaaggtgaaagttttggagccagtgaaagtgctaaggctactagtgatgttaattctcctgtttcagaaaagtggttggagttaatgaagagctcagtggctc

SEQ ID NO: 14376 - DNA, 356 bp, Gossypium hirsutum
  Clone ID: uC-gsflnu33B035g01b1
tcttccactcgttcggacctgcacaagagggagaacttgaatcctatcctgcttgtaattcacttccaaagtctcgtgcatactaagatcgactattgtggtaccttatcgagacatgaatctgcatcttaccatgccgatcttttacaacgatgtgactggtaaatcacaaaataggacgcaacgtaatcggctagcggctcaggatatgttggccaggcggtgtaactgagtggtggccagatacaggctcccttgcgaaaaaccttgcaggcggattggcactgcttttatgggaaaacaatgtccctccacaggggccacaccgcgggatataccatggtaaacaccatttt

SEQ ID NO: 14377 - DNA, 293 bp, Gossypium hirsutum
  Clone ID: uC-gsflnu33B035g08b1
ttctgttcctaacatgaatactgctacggaggatgtagatgatcgacgctggatccttatggatgacgaaagagttaaattcgtcgacaatgcaaatttttggataagacccgtactactgccttgaccgcattccataggaaattgatgccaacgattaagctattggggacagtataccaagggacctgcttgaacaaagacggaaaggaatgtggtaacagtatgcaagggaaccacaaatactaatactaaaagcttgaaacatattgactctccgagatgataactac

SEQ ID NO: 14378 - DNA, 435 bp, Gossypium hirsutum
  Clone ID: uC-gsflnu33B035g09b1
ttctctcgttcgtccacgcgtccgcgcctctccttacaccgccgacttctcctcttcccttgaaaggtctccaagccctcttaatctctttaatttccatctctttcacgagcattcataatgtctgccaccgaacactaccactgctcccaccgtcgagaaggtctaggccgcaccattctagaccaatactgaaggcaccagccagctgagcccgctggtgaggctcctgctgcaacagcaacccgccttgaggccccactgaccgaggaggctcccgctgctttagcttccgtcgctaagaccggctccgaaaagaagaaggaagaggcagcccaggaggatgccggaaagaagagccctactattcttatcaagctcctttttccctttaagggcaacaaggtgaagggaccccatttaccaaagtccccc

SEQ ID NO: 14379 - DNA, 242 bp, Gossypium hirsutum
  Clone ID: uC-gsflnu33B035g10b1
tcgtcacgcgtccggacggccggacggtctggattatgatggaacaggatattcgtcatcagccaaacgaacttcatgccgaaataagcaaaagatagcttaacagatgacgatttacgggcgtagggagttgattctctattgattgattcaagtccaaaagagattgatcaccacaatccattattgtgtcttctcaaggaaagatcttacgtgaactagctaccgcatgaaggctggtt

SEQ ID NO: 14380 - DNA, 486 bp, Gossypium hirsutum
  Clone ID: uC-gsflnu33B035g11b1
ttgttaatatgatgcaacaaccagcagctggaggcgtggctccgacaccttgcatggcgggcgaccagtctgagactcatcagtaccagcaacaaccgcagtcgcagccctggatgatgatgtgtgatcaacagcagggtggtcaaccgattcctccacctaccggatggacgccgtaacctgttcctccgcccactcagatgcagcagtactccgacggttctgctgctgctggctccggggagattcgatctctttggatcggtgatcttcagccgtggatggatgagaattacctcatcaatatctttgctcaaactggagaggtggattcggctaaggtgaccaggaataagcgaactgcttcaccggaaggatatgggtgcatcgaatatgagtccagtgtgacagctgagaggtgtttgcagccttataacgggctgccaatgccaaacgctgagcagaatcctaagtagaattgggcat

SEQ ID NO: 14381 - DNA, 336 bp, Gossypium hirsutum
  Clone ID: uC-gsflnu33B035h02b1
ctcggcccgcctgcacgttccggtcacttacttgctggatcgacccacgcgtttttttacacgtacggatttgcggatggagaagacgagagctcatctctatgcttcaaagctcctgtccaggttgaattcttttacttccttgcgttgtgttctttgttgctcagtgctcatggcttcaaagcggattttgaaggaactcaaggatccgcataaagatccacccacttcttgcagtgctggtccagtagctgtagacatgtttcattgtgaagcaacaatcatgggaccctcagatagcccttatgctggaggtgtgtttttagataccaccca

SEQ ID NO: 14382 - DNA, 289 bp, Gossypium hirsutum
  Clone ID: uC-gsflnu33B035h03b1
tcgttaacactaaccatatcaatgccacctttgattttgtgctcatggcatatatatcccaataccaaaacttccggctaccatgactccatgagaggactgtggtgtcgtgcaaagatcatactctcatgtttgctacaatcgatgctttccatcaacctaataaggacacagctcgagtagaatccaagcccggggctcacaattaggtactgtcggcatcggcatttaaggacctgacgggtgaaaaagcacttggagagatcggcgctgactgtaagtacaatgg

SEQ ID NO: 14383 - DNA, 392 bp, Gossypium hirsutum
  Clone ID: uC-gsflnu33B035h05b1
gctcgcccgcctgcacgcgcccgtgccttcctggctggacccacccagcgcgtcctctcgtacgcgcgagcggccatgcctttctttctattagaactttattgagcctttatctgcactgctgcatattggtttgcaatcagaggtcacatcaaaatgagcgtatcacacatgaagaacgcccaaattggcagcagattaattggctgttccaagctgctttatgttttctaccctcaaagtttgttgaacaaaaaaggttggttatacacgctgctattccatctgaacaagtagtgcttcattgcttgaatggatttcagctgacataatgggtggagctgacatggtgtagatgatgaataactagcatcgtatcacacagacaagct

SEQ ID NO: 14384 - DNA, 413 bp, Gossypium hirsutum
  Clone ID: uC-gsflnu33B035h06b1
ttttacgcgtgggcagataaagaactttgtttcatctgctccatttgtttcgaaatctctgaacaaacagggcctctgtcaatttccttgctttagcattcttgattgctttgtgatttgcaagcattgatgttggggtagcagctcgtcaccttctgcagcagcctcaaccgcatagtttaccatatttccctaatctaccaacgccatcccgacaattattcccatggcctggggcgcttactacacttcctaccacattaccaacaggactgccccctctgccaagcattacctcagtccccacaatcccaactgtgattacccctattcctctatgttttccaccattggcatctttcccttatctcccataccctgaggcgctttctgcacttgcttccacattgcca

SEQ ID NO: 14385 - DNA, 93 bp, Gossypium hirsutum
  Clone ID: uC-gsflnu33B035h07b1
tcgtttacgcgtacggaggggcggaaggctaagaggtttgaggaaagtgatactttaatgcatcctcactgactgaataggtgaactatcatc

SEQ ID NO: 14386 - DNA, 364 bp, Gossypium hirsutum
  Clone ID: uC-gsflnu33B035h08b1
tcgtttacgcgtaggcgattgtttaccaggaaaacttaggagagatccaaccatgtcgtgcacctttgaaaaaaggtggactttgttagagaagagacttgtaggtttgcccatttcatggtcccattatacctagtgatgatgcatgataccaaaccaataagagctcttcaatagatgatacaaatcctggtttaggctctgatttagcagagcaagtagcaaaacaagctgtgaagaatgttaaggagcgagataaaaggatgcgaggaagaaataacatgataagcagtcattacagcgggataagctagcatgagttcaggagcacattgatgctgtgcttcgagatgctgcaatagct

SEQ ID NO: 14387 - DNA, 326 bp, Gossypium hirsutum
  Clone ID: uC-gsflnu33B035h10b1
cttctagtcgcgagcggccatgcctttctttctatttttactttattgagtctttatcttcattactgcatctttgttttcaatcagagttcagatcaaaatgagcataaaacacatgaagaaagtccaaatttgtagcacattaattggctgttccaagctgctttatgttttttcccctcaaagtttgttgaacaaaaatggttggttatacgtctgctatttcatctgaataattagtgcttcattgcttgaatttctttcagctgacaaaatgggtgggtttgaaatgtttcagattatgaataaattgttcttcattcaaa

SEQ ID NO: 14388 - DNA, 557 bp, Gossypium hirsutum
  unsure (1)..(557): unsure at all n locations
  Clone ID: uC-gsflnu33B036a02b1
cggttttattctcagaaaaagccttatcctccccaaaagtacacagaatacaactttcctcccaaaagacttccaaaacagttcgcccttctttaatctggttccctcgtcttctccgcaacaaaatgacttcttgcaaaggactgaacactccccactagctttctcaggtacaatctttctttcatggactctggtatttctatcacgccaaattacccaaagtgcacaacaaagaagacaccgttgaggagtacagctcaccccaaaagctcgagtaagccattgatcgaacgccagatccaaattatttgagaatatgcaaaagtataaactctgaccaaacctccactgaaacaacactcattcgaaagaggtgatcaatattttcttctgcccatccacaacgaggacaacaagctgtattaatcaatttttttgtatttcatattagccagaataggtagatagttccaagagcacctctaaattgtaattntaatttccccagtacgggtaaggccccatagctttttttagaaatcactagttttcga

SEQ ID NO: 14389 - DNA, 463 bp, Gossypium hirsutum
  Clone ID: uC-gsflnu33B036a05b1
agctcgttttgggtgctgttttgttctatatcatgatggaggcccgtgattatccattaccagcctgattgtgacatgaggtgttgacatgcgtccctaaagcaacttatgctgaatcatttcaaaggcactacgcttattcattagagattcatccacatggttatctgcctgctatctattgatcgacattaacaatactttggggtcaggaccccttatatgctagaggtatagagtgcggactttgacatgagcttgtgtatcagcaactatggcatatggcgctactctttaacgattcgacactataaagtgactaaagataatgccagacgtgctagaaggaacaagcatacctacatcagcgctcttggacatagaaattaagatgatgatcactaataacctgtgatgttcgtgagcttacaacaaaaagtgtgacatgtcatgagtcacatga

SEQ ID NO: 14390 - DNA, 493 bp, Gossypium hirsutum
  Clone ID: uC-gsflnu33B036a07b1
tttatcgcgtgggcggacgcgtgggcttccttccatctcaaggaccaaactgcatcatctcctctcaccatcttttccggccaggaacttccacaaaacgtcgccctcaaaagagatcttaatgcctccgaactccagcagcgccgctatacactctcctaaaaaaacaaacagctcctccacctctctccatcttcaacctttttcatttctatggctgctccttttcatcgtctcacttcaggtaaccattctctttatggctcgcgccgcccctttctacaatcgccgaacccatttcccgaacccagtatccgacccgtgctcgtcgggtcgtatcttcgtttacaacttgccacctgttttcaacgaagagttgttggataattgccacgagctggacccatggaattcacgttgcgaagcattgtccaacggtgggttagggaggaaaggcgacgggattatccggcgtcgtaccggaagagttgat

SEQ ID NO: 14391 - DNA, 452 bp, Gossypium hirsutum
  Clone ID: uC-gsflnu33B036a08b1
tttttgttgataggcttggtaatcaggtgtctacttttgaatctataattactaaaggtgggaaagtagcagagaaagatgtgcttaatttgattgaacagttaatgaatcaattgcttaagttggatggtattatggctgatggtgatgtcaaattgcaaagaaaaatgcaggtgagcagagttcaaaaatatgttgaaacattggatatgttgaagattaaaaacgccatgcctagtaccaatggagctcaatccgaaacacagaatcgacataagcatagtgttcgaaaacaagagcagcaatccaggcaaagattagcaccaatccaggagcaacaatcgagcaactcggtttctcatttgccaatccatcaacaataccagcacaagcatcagcaccagcaggcatctggtccggtcgtagttactacgaaatgggaaacattcgat

SEQ ID NO: 14392 - DNA, 464 bp, Gossypium hirsutum
  unsure (1)..(464): unsure at all n locations
  Clone ID: uC-gsflnu33B036a10b1
ttccttgcgtccgctttttgagctttcgtgtttgtctattgaattctttccctcactttctcgaaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaagaaagcagcaaaaataacaggcctctgtaatgatatattgtcaaggatggatgcctgcaaggtctataattatgtctctgtctgtgtcttgtgtaatagaagctntgtttgtggtgaaaataatgtataag

SEQ ID NO: 14393 - DNA, 325 bp, Gossypium hirsutum
  Clone ID: uC-gsflnu33B036b01b1
cccttgcgtccgcccacgcgtccgatcacgacgaccaaaaagggagcaatccctgcactaccaaccgaggccgatgcccttgccttaatcaatggagcttagattttaagcaacttgaataatttgcacattgttttgcctcccgtgattatcctttcatttcaaagagttctcaatttattcccctttgatatgcgacctttgttcccccaacgcccaattgcttgtgttctaatgatggaaaagactttgtggttttaagcgtgtaggaaattcttttccctcttttataattttgcaatgtgattatcgaacttgttctgtc

SEQ ID NO: 14394 - DNA, 494 bp, Gossypium hirsutum
  Clone ID: uC-gsflnu33B036b02b1
aagagaagcagccgctcctccttctatctcctaaacaagaatggattcgcaaattaagtttgctgtggtggtgaaaataatgggaaggaccggatcaagaggtcaagtgacacaagtgagagtgaagttcttggatgatcagaaccggttcattatgaggaacgtgaagggaccggttcgtgagggagatatccttacattgctggagtctgagagagaagcaaggaggcttagttgaagggttatttttatactttttggggtttgtgcttggtttgaattgtctaccgtatttcttttgaattacgtttagtaggtattcgtatatcgagacttgcgatttgggagaatggttgcttcttaaacctggattttatgatgattatgctgaaatgaactgaattggttttgagttttggttatatttttgcctcccgttttgagaaaaaacgtgggattagatttgttcgtttgaatgatcacttggtattgat

SEQ ID NO: 14395 - DNA, 492 bp, Gossypium hirsutum
  Clone ID: uC-gsflnu33B036b03b1
gatttttataatagaatctaccccattcaagctggtggaggaagtaaaagatttgaaggagttagcagctaaattacgcaatgtggatgagtttgcggttgatttagagcataaccaatatcgatcttttcaaggattgacttgcttgatgcaaatttccaccagaaccgaggattttattgtagatactttgaagcttcgaattcatattggcccatatcttagagaagtattcaaggatcccatgaagaaaaaggttatgcatggatcagacaaggatatcttgtggcttcaacgggactttggcatatacttgtgcaatctccttgacactggacaggcctcaagggtcttgaaattggaaagaaatagcttagaacatcttctgcaacactactgtggagttactgccaacaaagagtaccagaatgcagattggagagtgcgtcctcttcctgatgaaatgctcagatatgctagagaagacacaca

SEQ ID NO: 14396 - DNA, 106 bp, Gossypium hirsutum
  Clone ID: uC-gsflnu33B036b05b1
ttaataaataaaacacaaaaacacccccgaaaaggcgaagctctagattctcgatgttcctcgcgatttgcgcaatcctggccatccacgtggcggttacaacttt

SEQ ID NO: 14397 - DNA, 512 bp, Gossypium hirsutum
  unsure (1)..(512): unsure at all n locations
  Clone ID: uC-gsflnu33B036b06b1
gtnatantcactttctctaaaacctcttttagtggtattgttttctaagccattttttttataatcaagaactggctaacacaaaggatagcattctggaggaaaccaacaagaaccaacaagtggttctcgtcctctatgaggccataaacactcgagacgtccaaaccgttcatcaaatccttgcccctgaccttgaatggtggttccatggtcctccagcccaccagtttatgatgcgcctcctcacgggagcttcatcggaccaaactttcattttcgacgttgaccctctttcggtcaccacttttgggtccaccgtcatcgttgaaggctgtgatcataaacgttcaatctcttgggttcatgcttggactgtaagtactgatgggataataacagaagtgagagagtatttcaatacttctctaactgttacttgtcttgtgaactttagccaaacaccaccattcaactccaacttattatcggaattggaataaccggggccg

SEQ ID NO: 14398 - DNA, 399 bp, Gossypium hirsutum
  Clone ID: uC-gsflnu33B036b08b1
gtgatgtgaagatatgtggatgagcactggaggggcgtaatctaaggcacttgtcatttttgcctcgccatcgaactctacgatggctgactgtggtcccaaaggtcgaatttcctttacttcaaacaagaagagattaatgccattatgaatgattttgttcaacgtgcgttacttgctccacctggattgtaccttggtggcacatatacatatggtgttaccaaggcaaacccgtacttgttattatagggtagaagggatccggatgtcatactattagaaagcacaatatggctatgttgactggatgctatgataagccaatgacagctgttcaaggctatagggttgtggatcggtgtggcgattatttcattgaacaggggtttcgacctt

SEQ ID NO: 14399 - DNA, 463 bp, Gossypium hirsutum
  Clone ID: uC-gsflnu33B036b12b1
ataatgatggccaacgctgcatcgggaatggctgagcatgatgattgtaagttgaagttcttggagctcaagacaaaaagaacccaccgattcattgttttcaaaatcgaggagaagcaaaagcaagttattgtggagaagcttggtgaaccaaccgaaggctacgcggattttactaaatgtctccccgctgatgaatgtcgatatgctgtgtacgattttgattttctaacggccgagaacgtcccgaagagcagaatctttttcatcgcatggtctcccgacacgtcaaggatcaggagcaagatgatttacgccagctccaaagacagattcaagcgagaactggacggaattcaggtggaattgcaagcaacagatccaactgagatgggtctcgatgtgttcaaaagccgtgctaactgaatacggttcttttaggcatctgcaaccgggaagcttc

SEQ ID NO: 14400 - DNA, 501 bp, Gossypium hirsutum
  Clone ID: uC-gsflnu33B036c01b1
cttttccctatattttctctctccggttccatctccgttctctacgaaatggcttcccacattgttggctatccccgtatgggaccaaagagagagcttaagtttgctttggaatcattttgggataagaagagcagtgctgaagatttgcagaaggttgcagctgatctcaggtcagctatttggaaacaaatggctgatgctgggatcaagtacattcctagcaacactttctcttactatgaccaggtgcttgatgccacctctatgctcggtgctgttccaccgagatatggttggaacggtggtgagatcggattcgatacttacttctccatggctaggggaaatgcctctgtgcctgctatggaaatgaccaagtggtttgacactaactaccacttcattgttcctgaattgggacctgatgttaacttctcttatgcatctcacaaggcagttgatgaatacaaggaagctaagtcgcttggagttgacact

SEQ ID NO: 14401 - DNA, 526 bp, Gossypium hirsutum
  Clone ID: uC-gsflnu33B036c02b1
gtagtaatcgctcattggtcagctgtctcgagaacacgtcgtaaaagtatagttcccaaggtcaagacggttgatgccttagccttcgcttcggttccctttcgtgtatgctgatgctttggttttgattaaatgttttaaacaacaatttccagtttcgaatttcaagtacttcaactgaaaaataaaaaaaacacgatccattagagaaattaaattataaaagcagcgccaaagcttaagaatccttcacctattctctctcgaaatatcaaccttttttatttttgttgttggaatcgaagatctgataaaaaatttgtaaacatttcttaagctctggagagatccaatttctttactgatctcaaatccatggcgtttccacgatcgaagctactttttctgctgttcgctatgtctatcgcgatcgacgccattgcagggaagagttaatacgacatattgcacgtgccgaaaggagcatccgatgagcagatcaaagagcgttatgaagctggcattg

SEQ ID NO: 14402 - DNA, 366 bp, Gossypium hirsutum
  unsure (1)..(366): unsure at all n locations
  Clone ID: uC-gsflnu33B036c04b1
gtnactagtagtgcgaatgagacgactggttattatggggtaccttcataaaagatggctaagtgcacgccgcttaggtggttattgggtcccaatcttcactttcttcttcttcccttttgtttgtgtgtatcgtctttcctttgatgttgaatatattgcataagcaaaagagcatgcaaacaaatttgctttgaaagcccctttcaatggccttttatatggggtagtgttgttatgcatgtatgtacgtatggtcctttttttcatgtatgctgtcatcaaggggtttaaccatagtttttttagtgctttgatgtgatgggaatgatgttatatcagtcatggatggatgtaattttatat

SEQ ID NO: 14403 - DNA, 382 bp, Gossypium hirsutum
  Clone ID: uC-gsflnu33B036c05b1
atgagtagtagttcgagagagtgaaacaaaatgagtggcatttgtacgatgaaggtggcgcctattgcgccgcagtgggctctttgcgcattagcgaatgccaagaaatcagctgatgtgaccgagctgcagatcggcgtcaaatataagcctacatcatgtgaattccaggctcataaaggcgatagagtaaaagtgcactatcgggggaagcttactgatggaaaggttttcgattccagttttgaaagaggtgatcccattgagtttgagcttggtagtggacaagtaatcaaaggatgggaccaaggattgctggggatgtgcgttggtgagaagcgcaaattgaaaatacctgctaagcttggatatggtgaacagg

SEQ ID NO: 14404 - DNA, 475 bp, Gossypium hirsutum
  Clone ID: uC-gsflnu33B036c06b1
gtagataatgctgctaagggaggcatgattggaactgcgattgttccgaaaggtataatcgaaaccgataaagattcggttaattatcagaaagagatgcagaacaagaagttcgaacaggaagcgatgaagctttggcttaggatgaggaatgaagttatttcagagcttcaagagaaagggtatgatgttgagtgagtgattttttcagctatggtgattctattgttaagggtcaaatttcgttattagtccttattatgaataagttgtggattgtggatttaatttttgtacttttcagttagtctttgtttttatgtgctaattatcctttagtgtaattggtaccccttcatgtatgatgcaattgaaccaagctcaaaagctcgagttagacttgaaattcgagactcaaagcttggctcaagcttcgtgttggagcttgagctaaatttgatatcatatatattat

SEQ ID NO: 14405 - DNA, 424 bp, Gossypium hirsutum
  unsure (1)..(424): unsure at all n locations
  Clone ID: uC-gsflnu33B036c08b1
cttcncaacttcccacttccaccaatcccttcgcttctcttgtttttctttctttgggtaaccatggaaatttttcttgaattcatgtttactatttctttttcttttgttatttccttccttctggctaagcttctttccttttcgtctatcattgatcaacatctagagatcgtgtcgagattatatgcggaagtcaaaactgaatcagaaaaacatgaatttgaagaagttgatgctttatgtgaatccgtggaagaaattggtacccaggaagagtcttcgaatggtggtgaagaattaattagagaaacagagggaactgttgaaggaattagtttatctgaagagaattttgctagtgaaaccactgagattgaactagctaaagaggatgaagaagggattgaggatttggtgtgtg

SEQ ID NO: 14406 - DNA, 361 bp, Gossypium hirsutum
  Clone ID: uC-gsflnu33B036c10b1
ttcttggcgcacgaactaaacggttaggatgaggggaaatctgtcgggtgctatgaaagggtttagtacccaaggttctagaagcagttgtcctatgactctgcgatgcgacatcatgctagctgaggccagaggggagtcagatccgtgctctttaacccctcctaacaactcttgaaggccaaggtaagtctcccttcctttattctttttagggcggcccacataggcgcacctagataacaaaccgaagcttgaaataatcaccttaaaaatacgggtgaccgactatgaattctctgtgatctccctttacatttttacagaagaccgaaccgttgatagcctaacactaacctat

SEQ ID NO: 14407 - DNA, 169 bp, Gossypium hirsutum
  Clone ID: uC-gsflnu33B036c11b1
ataatcaagcctcgaattaacgcaccaacggggtttgtttaaaagcacggcggtatttccaaaaaagagagaactatgatggtaggactacacggtactatagctggaggaagcaaggggtcaagagagcatacccatgttgacaaaccgacttgtagaaaacaatgat

SEQ ID NO: 14408 - DNA, 501 bp, Gossypium hirsutum
  Clone ID: uC-gsflnu33B036d05b1
cctttttgtccgaaggaaaactcagttttgcttcggtgttgtttctcccaatttcttttgccctgttttaccctcccaacccgaaagccaccttcaccctctcccttccaacatcaaacagaatcgccccttacattttccttcttctgtcccgttaatttttctgcttgtttattgtttaagctccaggaaaatcgaagaggcctcatcgttttcgagcaggaactagggctctgacaaggtttttgatctcaaaattctgacaaggttgcctataaagccaatcccaagtggaaatctgcctcctaattttgatcctgttgaaggatgcaagcttaattctctgcctctgaaagtgtgttattgcttcctattgaagcggcttgtttgattgcttcctccacccacagttgagcgtcttcttttcacacaatcactataattatgtcaggtgtttcagaatcaaatgctttttctcaagcttcttgaggaaccaaaagg

SEQ ID NO: 14409 - DNA, 525 bp, Gossypium hirsutum
  Clone ID: uC-gsflnu33B036d06b1
cttagtaccaccgccgccgcctccgcctctctcatcgaggccgcctacgatcggtctgacctatatctctcaccctctgatcgcctcaaggtttccagccttggttttggtggaaatttcaactccttttttggtgcctctgtttcaactagatcttcttcattacagaaatgcaactcaaggagcatccagcccatcaaagctacagctactgaaattcctcctacagttccaaagtcacggagcagtggcaagacaaagattggaatcaatggttttggtcggattggaaggttggttttacgaatagcaacctcaagggatgatattgatgtagtagctgtcaatgatccttttattgatgccaagtacatggcttatatgttcaaatatgattcaactcatggaccctttaagggaactatcagagttgtggatgagttcacattggaaattaacggcaagcaaatacaggttgtaagcaaaagggaccctgcagagatcccttggggtgattatggggct

SEQ ID NO: 14410 - DNA, 537 bp, Gossypium hirsutum
  Clone ID: uC-gsflnu33B036d07b1
tggtgctatgcagaggagaaccctggacatagcagactctatagacgaagcaatggcttgcgatgctagagtggcggtgcgtgccttaatcgaaggatgtcctcgagtgtttgatggcattaaaagtttggttgatgttggtggaggcaatgggactgctttatctatgatggtaaaggcattcccttggatgcatggcatcaacttcgatcttccccatgttgttgccggtgccccgaaagtcgatggcattgaatacgtaggaggagacatgttcgagagtgtaccaaaagcagacgctgctttctttatgtgggtgttgtatgactgggatgatgaggaatgcatacaaatcctaaagaaatgtagagaagccatcccacaagacaaagggaaggtcataatttgtgaatctgtgcttgaagaagatgaaaatgacaagctagaatttgtggggttgatgttagacatggtgatgatggcacattactaacaaaggcaatataaggatcctttaaggaatggaaatatgatttt

SEQ ID NO: 14411 - DNA, 537 bp, Gossypium hirsutum
  Clone ID: uC-gsflnu33B036d08b1
atcatgcgtccgggggtctgggtcttccagagagtgaggtatagagctgcgatgtttatggctcgcatgatgaactcctagaaatggttccacagcctgttcttgctgtgcttcttctttatccaataacttctcagactgaagaagagagattgcagcaagataatgagaaaagagatgttagcagtgaggtttatttcatgaaacaaactgtgggcaatgcttgtggaacgattgggcttcttcacagtgttggaaatattacttcagaaatcaagctacaagaggggtcctttttagataggttttttaaatctactgcaaccatggaaccattggagcgtgctgcatttcttgagaaagatggagagatggaagttgctcacactgtggcagctacagttggtgatacagaggcttctgacgatgtggatacttactttatctgctttacatgtgttgatgggcagctttatgaacttgattgaaggaagtcaggacccatattccctggttcaacctcacgaaattccttgt

SEQ ID NO: 14412 - DNA, 553 bp, Gossypium hirsutum
  Clone ID: uC-gsflnu33B036d10b1
ttttatctgttaacagcactcaacaatggcgaccacccttttcttcctcctatttttcacccccttcctctactccgccaccgcaccaaatcataatgcaccgcaagatctggtccgttcatcatgcatcaacgccagctacccctcactctgccttcgcacactatcatcctactctggccccaccggcaccccacgcgacttagcccaagccgacgttaaagtcagcctcgcccgcgcccgcaaagcttcgacctacttaaaaaccagcgtcacggggaaaagcaaaagggaacgagcggctctaagcgactgcgtggagcaaatggctgagtcggtggatgagctaagcaaaacgttgagtgagttgaagcatttgagaggcgaaacgttcgagttccagatgagcaatgcacggacgtgggtgagtgcggcgctgacgtatgaggacacgtgtgttgatgggttcgaaggggttgatcgggaggtgaaagatgatgtgaagaagaagatcacaaatgtggctatggttacaagtaatgctttgtatatg

SEQ ID NO: 14413 - DNA, 240 bp, Gossypium hirsutum
  Clone ID: uC-gsflnu33B036d12b1
gtgagactgccgcaattatctcacacccttcagggttgattgttaggagaatctcattcaagtcaaaaagaatggctcgggtttaacattaaaactgtcctccaaaacttcaaacaatattgcttcctcatgatcgcgtggatgtctattctaggtcatttgggagcgaaaactcttttattcccattttgtttataaataatcagctctaattatgataagaataaattgttttggtgt

SEQ ID NO: 14414 - DNA, 427 bp, Gossypium hirsutum
  Clone ID: uC-gsflnu33B036e02b1
atcatcatccatggccctctttaaggcactcaacagggacttctattccctggtcagtgcttgaggttctcgctatacacccacccctaaaccaaagccaaacccaaaaccccaacctgaccgccactctatcttcacaaggcaaatgccctacagatgcccctaatataaggtgtatgtgctaatgtgcttggcttaaccaagcccgtcattggttcacccccagagatgccatgcagcaccctttttgatggccccgccgatctctaagctgctgtatgcctgagcaccgctatcaaagctaacatcttacgcatcaaccttaacattccaatttcccttagcttgctcctcatcgcttgctcaaagaaagtttcttccaacttacaatgctaagtctttattgttcccaccattctatctagtt

SEQ ID NO: 14415 - DNA, 518 bp, Gossypium hirsutum
  Clone ID: uC-gsflnu33B036e03b1
ccccaaagtacaagcctctgttctctctgacccttctcgtttcttctccccaaacctcctctcatcccctctccctactaactctatcttccaaaacttcactctcaaaaatggcgaccagcctgaatacatccacccttatctcatcaaatcagccgactcttccctttctatttcctacccatccttctttcacaacccttctttcatttaccaaattttcgtccctgatttaaccatctttgctaccgataaaaccacctcaacttcggataaaagccacgttatctcttcttacagtgatctcagtcttactttagatatcccttcctccaacttccgtttctttcttgttcgaggtagtccctttttaacctgttctgtaaccggcaatacaccgatatcgatctccactgttcatgcaattctctcgttttcttccaatagttcactcaccaagcataccattaagctgaacaatggccaaacttggattatatatgcatcgtcatccatca

SEQ ID NO: 14416 - DNA, 487 bp, Gossypium hirsutum
  Clone ID: uC-gsflnu33B036e04b1
catgttctgctgctcggtttttcatcctctgtcccagctgcgtcctttagatcctcatctgttcccattgcaacgagagaaacagagatccgactgtcgcactatggaggtaaactcccctccttaagcctatctttttctttgttctatgtgttcgcacgctaagttccaaaaaggaaaagaaaacagtgaaaaacgaaggaaaaaaatggaatatacctcggaaatttttctgttttttttcaatctttttcgtattcaatctgtggatgccaaaaagaaaaattcttttacagtgttttttaatcggccttatatccgaatcgaattgaagagaaacaataaaatgccaaaataaaagaataaaaatcccttttttctcttattttctgctatttttgttgtcgttttctgccttttctgatttgatgcgttgttttctgatcatttctgcaggtacggatgtgcgcgggggtgcgtccggagt

SEQ ID NO: 14417 - DNA, 570 bp, Gossypium hirsutum
  Clone ID: uC-gsflnu33B036e05b1
ccttctcgtccgcccacgcgtccgccgattattgctggccacctctcacctctctcctccttttcatcgaacagctctcaaaattcccaatttttccctaagaaaaaaccctaactccatctccacatttacgcaacatgtcattcgatgaagaagagtccttcgaacacaccctcctcgtggtccgcgaagtcactgtctacaaaatcccgcctcgttccacctccggtggttacaaatgcggtgagtggctccaatccgacaagatctggtcgggtcggctccgggtcgtctcttgcaaggaccgatgcgagatccgattggaggatcccaactcggctgagctattcgccgcttgttttatctaccctggccagcgcgagagttccgtagagccagcgctcgattcttcccggtacttcgtgctcaagattgaggacgggaatgggaacacgcctttattgggctcgggttaatgagcggaacgaggcgtttgattccaacgtggccttgtctgatcacgataagtatgttagcagagagaacgagatagaggctagtgagaaaaag

SEQ ID NO: 14418 - DNA, 406 bp, Gossypium hirsutum
  Clone ID: uC-gsflnu33B036e07b1
tcctacgcggacgtcaagagggacgccaattaaggggtaaatcatggctgcatatggagggaatcatgcaggaggtgtattggagacaatctgaaacgaagaaggagggatcaggttctgggaagggaacctaaaagagaacgctgttctctaggtggagaagacaaatatagatgccctgatgtaaggaacgctctcaccatggagcaggagtaacaactcaaagaggcttgaagatcgagaccaggtgctaaaggagacactggacactctcaaagggacaccacattatgagaggttaagagatctaaacggggatacgaaacctagattacaccatgcgcatacatcgcaaaaccatagtgcctgaattactgaaaggctacccacggtagaagtatgggat

SEQ ID NO: 14419 - DNA, 485 bp, Gossypium hirsutum
  Clone ID: uC-gsflnu33B036e08b1
cttctctcataatctcaaagccggaggaggtgtgcgatcccacacctcttcggaaaaaaaatcatcttcaaaaacgaaaaatattataaaattttcgttctaaaattccaaaaaaagaaagaaaaaggaatcaatggcgtcgtccgatagcctgagcgacaagaacgcggttttcagaaagctgaaagcaaaatcagaaaacaagatgtgtttcgattgtaatgcgaaaaatccaacatgggcgtcggtcacgtatgggatctttctctgcatcgattgctcagccgttcaccggagtctcggtgtacacaatagctctgttaggtctacaaatttagactcttggtctcctgaacaattgaaaatgatgatctatggtggaaacaaccgtgcaccagttttttttaagcaacatggtttggactgatggaggcataattgaaggcacatttacttcaagagctggtgattatgtaggcaaatgc

SEQ ID NO: 14420 - DNA, 536 bp, Gossypium hirsutum
  Clone ID: uC-gsflnu33B036e11b1
gctacacacccgaatggtttttggagataagtgcagaaggtaaagaaccagtggggaagtttgatgacaaatgggtggctgattctgatgtaattgttggaattcttgaagaaaaataccctcagccttgtctcaaaacccctactcaatttgcctctgttggatcaaacatatttggaacttttgtcacatttttgaagagcaaagacgctaatgatggatctgagcaggctttgcttaatgaactcaaggcattggatgaacatcttaaggcacatggcccattcattgctggggaaaagataagtgcagttgatttagctttggcaccaaaactttaccatcttgaggttgctcttggccatttcaagaaatggactgttccggaaagcttgactaatgtccgcaattacatgaagtcgatattcagtcgtgaatcgttcgtgaaaacgcgggctgctaaggaatacgtgatcgccgggtgggcacctaaggtgaatgcatgaacaaacttgaaacagtgacccgtttgaaga

SEQ ID NO: 14421 - DNA, 517 bp, Gossypium hirsutum
  Clone ID: uC-gsflnu33B036e12b1
ctactacaccccaatggttttcggagataagtgcagaagggaaagaaccagtggggaagtttgatgacaaatgggtggctgattctgatgtaattgttggaattcttgaagaaaaataccctcagccttgtctcaaaacccctcctcaatttgcctctgttggatcaaacatatttggaacttttgtcacatttttgaagagcaaagacgctaatgatggatctgagcaggctttgcttaatgaactcaaggcattggatgaacatcttaaggcacatggcccattcattgctggggaaaagataagtgcagttgatttagctatggcaccaaaactttaccatcttgaggttgctcttggccattttaagaaatgtactgctccggaaagcttgactaatgttcacaattacatgaagtcgatattcagacgtgaatcgttcgtgaaaacgcgtgctgctaaggaatacgtgatcgccgggtgggcacctaaggtgaatgcatgaacaaactggaa

SEQ ID NO: 14422 - DNA, 359 bp, Gossypium hirsutum
  Clone ID: uC-gsflnu33B036f01b1
ccctcgtgtgcgcccacgcgtctagtcaggacaacatgccatttaatgctcatattgctgggcaagttcataagattatgcaatagggaacattcgagggagagtactacttggagaatgcattgtaccacaagagcctccgcaaattgcacgatccacttgttgcagcatttaactctgaacaacatgcgtaggctggagaccaagaaagggactatataggatgctggaaagctttggaactcgaatatggatgctgtatcgtattcggaatggaggtgatcatgcagccgtctcgggaaagtgcatcctaaggctgtagcaaacaccctatatagctagcttcagctaaaggcctt

SEQ ID NO: 14423 - DNA, 343 bp, Gossypium hirsutum
  Clone ID: uC-gsflnu33B036f04b1
gctttatggtctctctccaccacctagttattagggggtgtaacaaaagctttgcgaggtcgtatagaggtcaaattgcaactatgcaatttactggcaagagtcaagcttggaatctggtcgaacgatctagaaacggagtgatgggcattgccgggatcttaagcttggatgacttggagaagcaagatgctcaacggatgcacaataggaaggggttgaaaagataaatgaagtgagaaagtaagtactcacagaagcttcgtgcatgctatggtgggtcagacgaggataactatactgctaaattggatggcgtgacagatagcgcaatgtttaatct

SEQ ID NO: 14424 - DNA, 127 bp, Gossypium hirsutum
  Clone ID: uC-gsflnu33B036f05b1
ccctcgtgtacgccgaacaggcccgtgaaaaaaggagggggtcaaaaaaccttgggcggggagccacaacgccgaaaacgaaacatgccgcgagcggcaagaaacaaaacaagcagaaggaccacgg

SEQ ID NO: 14425 - DNA, 126 bp, Gossypium hirsutum
  Clone ID: uC-gsflnu33B036f07b1
gtaccatcaacctattggttctttgtgttaagggtgttatcaatattttgtagtggaagttaaccatgaatgagaatcttcccttttgttggtgtaatagcaaaaatgcttcagttcttccgcttt

SEQ ID NO: 14426 - DNA, 467 bp, Gossypium hirsutum
  Clone ID: uC-gsflnu33B036f08b1
tgcatccatagaagcgaaatggctggttccaggggggctcattctaccttgaaaggaccaagtgttgttaaggagatagttatcggaataacacttggcctttgtgctggtgggctttggaagatgcatcactggaatgagcagaggaaagtgagagcattctacgacatgctcgagaaaggtgaaatcagtgtcattgcagaagaataaatgttcttttagtcttgtgaaagtgtggacagcttcagctgtgtttcgttatatgcattctcttcatttggctcttagatagaagatgagcaaaacacaatttggagcttctaagaataatgtcattcattttgggatcttgatttcatatttgcatagcaaattcaagcgatttttcaatctagtgcctgtgttggtttccatttgacattgtagtttgatttggagatgtttgaaagctttttatatttttactc

SEQ ID NO: 14427 - DNA, 538 bp, Gossypium hirsutum
  Clone ID: uC-gsflnu33B036f09b1
tgctactgcgtccggttccccggttgaaggatcttggtgtctttggagttgtgaccttaaatgaaccatacgagactttggtcccaacatcgttgtatcatgcacacaatattcatcatttggtgattccaacaagggattatctttttgctccgtcatttgctgatatttgccaagctgtagattttatacatgagaatgcatctgttggaaagactacgtatgttcactgcaaggcaggtcgaggacgcagcacaaccattgttctctgctacttggtggaacataggcatatgactcctgatgcagcttatgagtatgtgagatctatcagacctagggtccttctggcacctgcacagcagcaggctgttcaagattactatcttcacaaggtgaataataatggaatctgtggagactcttgctcaatgataatgaagaaaactctagttgtagctgcataacaggatacggcggtcttcgacgatggctctgtagttgttgtaacagagtcggaccttgatgggtatgatgc

SEQ ID NO: 14428 - DNA, 331 bp, Gossypium hirsutum
  unsure (1)..(331): unsure at all n locations
  Clone ID: uC-gsflnu33B036f11b1
tggtcantccatatctagtttgactcctgttatggagccatattgtattccacatgcagtcaaaatgtttgatagcatgtcggatgaagttccagaagctagtctgctatactttttcgcacttagattattgctcaataaggacaagcgaattatgtttttatcaattaatcccaagattagagctttgtggcttaagacggaaatggaggatagttgaaaattttctgatcttttagggttcaaagatatctattatgtgactaaacaacaatgctaaactagttttatcaatagttatttatgtttgatttttggcttaaacaaaaac

SEQ ID NO: 14429 - DNA, 337 bp, Gossypium hirsutum
  Clone ID: uC-gsflnu33B036f12b1
gctaagccatctctagtttgactcctgttatggatccatattgtattccacatgcagtcaaaatgtatgatagcatgtcggaagaagttccagaagctagtctgctatactttttcgcacttagattattgctcaataaggacaagcgaattatgtttttatcaattaatcccaagattagagctttgtggcttaagacggaaatggaggatagttgaaaattttctgatcttttagggttcaaagatatctattatgtgactaaacaacaatgctaaactagttttatcaatagttatttatgtttgatttttggcttaaactcaaactttaaata

SEQ ID NO: 14430 - DNA, 274 bp, Gossypium hirsutum
  Clone ID: uC-gsflnu33B036g01b1
cctttttgtatcaacaacatgcaactgctgatgggatgccagtaaaagtacttggtgatgggtttgacgatgaggatattgaagatggtgagatcgagagcgacctaagctcttatagagccctatttcacaagaccttagcggatgtggttgacgcactgcttggagcttattacgttgaacgtcgcgagcacgcacctacccacctcaggtaatgcattgtgatccaggaggagtctgaccctgtctatatggactctatcgtgaacccatc

SEQ ID NO: 14431 - DNA, 329 bp, Gossypium hirsutum
  Clone ID: uC-gsflnu33B036g04b1
cctactcgtaccaccgacatgccggtgtggatgagaggccacctaaagacctcgaggccgggtccgaacaaacggatacggaagagggcgagagctgcagcgaccgaagccccgagagagcccacgctcgcaagacctaaccccatgtggccgacccacatgatgcacgctatgacgctgaccgttgctaggccgcacgtaaccaccacaagtaacgcatcgagagccaggcggagtccaaccctgaccagagagacactatcgtgaacccatcttatgtaccaccaagcatactcaggaaagtacattttgaggccagagaaggcgca

SEQ ID NO: 14432 - DNA, 328 bp, Gossypium hirsutum
  Clone ID: uC-gsflnu33B036g05b1
cccatgcttacgctcaacttgctattgttgatgggaggccagtaaaagaccttgaggctgggtccgaagatacggatacggatcatggcgagagctgcaggaaccgaagctactagagggtcatcgttcgcaagacctaaggcaatgtgcgcgacccactgattgaaactatgcgctgaacgtgcagccgcttgtaccacctcaatacagcatcggaggagacggagtccacctctgacatagaggctctatcgtgaacccatcttatgtaccaccaagcatactcaggagagcacattttggggccatagaaggcgcacagtacata

SEQ ID NO: 14433 - DNA, 522 bp, Gossypium hirsutum
  unsure (1)..(522): unsure at all n locations
  Clone ID: uC-gsflnu33B036g06b1
gtattattttcgccataagtcttacaatcacatactctctttgcttgaagtcgaagaggatgagcccagccaagacttgtcccccctaatcaccactttacagcaacagctctcctcggactccgttttggatgcccctttccctctttgtgaaccagcaacaccatcgccctcgaacccagacaaggaaaccgccaccaccgtcctcagcttagaagactgcacatcagcaacttgttccttgaaagaagatgatgatgatgatgataaagtgcaagtcataagacatttgcttgaagcctctgatgatgagctggggattccaaatagagaagatggcgatggagatggtagcggtggtggtagtgatgttggctttgaagtttttgagttggaagaaggtttcaacaatggcggaaatgggtttgcattgagtgatgggttatgggaacttgaagatgaggctgctaattactatactttgntacagtctgaactcttcatgtagcttcatggccggag

SEQ ID NO: 14434 - DNA, 413 bp, Gossypium hirsutum
  Clone ID: uC-gsflnu33B036g08b1
ctacgcgtccgcccacgcgtccgcggacgcggggggtcttttgcaaaaatctgtgatcccgccgcccactactactaccaccaccaccaccaccaccaccacctaccagtggtgctcttccaatcagcgatcagccaccaccacagtcaaccgcaacaacccctcaaatggcgaccactgcagcaacaacaacagttgcctccgacgcaacaaccaccactttctccgacggtccagtccttagtctcatcaacaaacgcatccgtgccttacgcaagaaatacaaccgcatcctccagatggaagaattcgggtcccagggcaaacccttaaacaaagaacaagaagaagtcctccgttcaaaacccttcgtctccgcccttatcgacgaactcgagaagctttcgcaccct

SEQ ID NO: 14435 - DNA, 256 bp, Gossypium hirsutum
  Clone ID: uC-gsflnu33B036g09b1
gtcgtccatggctgcccaatctcaacctggaccactcattgtttgaatgtatgtttttttttttatcataatttttttattatttgtatcggattggatcatgccaatcattgagatacatttgtgtttgtgaaactttttgtgtgtatgcaccaatatttgatagatttctcaaattacatgataatatatatataatgaaattttcataaaaaaaaaaaaaataaaaaaatatacaaataaaaataataaaatg

SEQ ID NO: 14436 - DNA, 550 bp, Gossypium hirsutum
  Clone ID: uC-gsflnu33B036g10b1
tgatcgtttcccggcagtggatccgatgagtttcgccctttcgttcgtcgactccccgaattcaaattctggtactcgatcacaaaggccttttgcattgctttcgtgatgacattcttcagtgtgtttgatgtgcctgtcttttggccaatactccttttctattggataatgttattcatcctgactatgaggaagcagattctgcacatgatcaagtacaaatacgtccctttctcgttcgggaaacagcgatacgacagcaagaaggcatcttcaacggaaaacacaaacctttccagggattaagttccttaggtgcatctgggaaagtttagcctagataagaaaaccaaagtttccagacaaagaacagtttgtattgatggaacatgcaacatttaccgtcgcctgtaacttctgcccggaacatgtgttttttactttctgataatactcaatcacgtagtgcaatctggttatattaaaaattttagatgtggatggtactgtttattctaaacaaatgtcccctatttattaattcata

SEQ ID NO: 14437 - DNA, 244 bp, Gossypium hirsutum
  Clone ID: uC-gsflnu33B036g11b1
tttttaaaaaaatctcagaaaaggatccagttcccataaaaaacttcgtatgtgatgtgaatcaacataaggggaaacggtttaccatttgtgcctggaaataaagattaccatgttgctcgactggctaggttagaataaattcagaggcgagttgttcttatcttggaatgatcttttgcaacttctttttgtgctatgcttctcaatgttttaatttctcaatacaacccaattttaaggg

SEQ ID NO: 14438 - DNA, 245 bp, Gossypium hirsutum
  Clone ID: uC-gsflnu33B036g12b1
tgtttataaaaaatctcagaaaaggatccagttcccataaaaaacttcgtatgtgatgtgaatcaacataaggggaaacggtttaccatttgtgcctggaaataaagattaccatgttgctcgactggctaggttagaataaattcagaggcgagttgttcttatcttggaatgatcttttgcaacttctttttgtgctatgcttctcaatgttttaatttctcaatacaacccaattttaaggg

SEQ ID NO: 14439 - DNA, 397 bp, Gossypium hirsutum
  Clone ID: uC-gsflnu33B036h01b1
ccttatttgatcaagaacatgcaactgctgatgttttaccagtaaaagtacttggtgatgggtttgaagatgaggatatggaagatggtgagattgagagtgactcaagttcttatagagtcctctctagcaagaccttagcggatgtggttgaagcactgattggagtttattatgttgaaggtggcaagcatgcagctaaccacctcatgaaatggattgggatccaggtggagtctgatcctgatgatatggactctatagtgaagccatcgaatgttccagaaagcatactcaggagtgtaaattttgaggccttagaaggtgcattgaacatcgagtttaaaaatagggccttgttgggagaagctattactcatgcttcacgcccatcatc

SEQ ID NO: 14440 - DNA, 271 bp, Gossypium hirsutum
  Clone ID: uC-gsflnu33B036h02b1
gtatcgtattatatctagtttttaatggaggactccagtatgggcatatacactaaggctaacattgctacgcgatttacttatcctcctgctggagccgcaaccagcactggtctggtgggcgtttaaagttaccaggatactctgatctcagtcacatacgatagcatgtgcagattccaggttgatatctgcaaggaaacccgttggggtgacgaaaagtgagacttaaaggtctactaaggacggagtattggcaatggtagaggct

SEQ ID NO: 14441 - DNA, 463 bp, Gossypium hirsutum
  Clone ID: uC-gsflnu33B036h03b1
tttccgggggtgccaccacgggcgcgcttttttgtgcgcgcatatttttttggtgtcttccagggcctcctaaaagtcctagctggagtagacaccaacttcaccgtaacagcaaaagcagtagacgatacagaattcggtgaactttatctcttcaaatggacaactctcttaatccctcccacaactctgataatactgaacatggtcggagtcgtggccggagtttcagacgcaatcaacaacggctatggttcatggggtccattgttcggcaaactgttcttcgcattctgggtcattcttcatctttacccattcctcaaaggtttgatggggagacaaaacaggacgcccaccattgttgtgctttggtccatacttttggcatcgattttctcactggtttgggtacggatcgatcccttcttgcccaaacaaacaggtccagttcttaaacaat

SEQ ID NO: 14442 - DNA, 442 bp, Gossypium hirsutum
  unsure (1)..(442): unsure at all n locations
  Clone ID: uC-gsflnu33B036h05b1
cccacgcgtccgctagatttgatcatctctatttctattgtaataaaagtctgagttgttattacccaaaaacaaaaaaaaaaaaaacaaaaaaaaaaaaaacaaaaaaaaaaccaaannncccccaaaaaaaaacaaaaaacaacaaaaaaaaaccaaacaaaaaaacaacaaaggccccccccccaaaaggacccaacctaccccccccggccatcccccccaaaagcccttcaaaaggccccccaaaatccaatcccccgccccccgttaccacccccggaccgggaaaacccctgccgtcccccaccaaaaacccctgccaccccacccccctttccccagctgccgaaaaacccaaaagcccccccccaacccccctccccaccagttgcccaccccaaatgccaaagggccccccccctgaacccccccataaacc

SEQ ID NO: 14443 - DNA, 203 bp, Gossypium hirsutum
  Clone ID: uC-gsflnu33B036h06b1
ggctatttaaggcggttacactttccctctctctggtgcagatagttgcatggcttgtggcagcgctggtgatagtgatcaatgggtaccttttacttgacttcttctcctccgaagtcactggcgtaatctttaccaccgttgtctgtgcatttacaggagcttatcttgcatttattgtttaccttgttaatggggggatt

SEQ ID NO: 14444 - DNA, 411 bp, Gossypium hirsutum
  unsure (1)..(411): unsure at all n locations
  Clone ID: uC-gsflnu33B036h07b1
agtttgtaatcagatttccccgatttcatttttcccaattcagaattagatttccccaatttcctaacttctttccgcgattttcttcacatctgattcaagctcctccaagtcctattcggagttaggctccgattcagttcgtcgactgttgatgcaggtctcaaaggcgacggtttgaaatttcttgttttgtttttcttctggaatgacgttagggttttgaaatttgagaactcgagtcgagcttagacggaagtcttgtcaattttagaggctaaggctgcatgtgttctgattgatctatgttgtggtgtgctagccccttggataacttatgtcattgcaaaggttggtctgaagcatgtcttcgtattataatctatggntgatttaacggtggaactcatg

SEQ ID NO: 14445 - DNA, 431 bp, Gossypium hirsutum
  Clone ID: uC-gsflnu33B036h08b1
gtttggaaccctaattccgagtgagaagggaagaaaagaaaaagaacaaagatgaggccgattttgatgaaaggtcatgaaaggccattgacgtttctcaagtacaacagagatggcgatcttttgttttcgtgtgccaaggatcacactcccaccgtttggttcgccgacaacggcgagcgtctcggcacttaccgtggccataacggcgctgtttggacttgcgatgtctcaagggattcgatgaggcttataactggaagtgctgatcaaacggtgaagttatggaatgttcagaagggaactcaattatatacgtttaattttggttcacccgcgaggtcggtagagtttgccattggggataaacttgctgtcattaccacggatcccttcatggaattgacatccgctattcatgttaaacgcat

SEQ ID NO: 14446 - DNA, 420 bp, Gossypium hirsutum
  Clone ID: uC-gsflnu33B036h09b1
tctacgcgtccgatcgtgggaaagacagagattctcggcgtcgaagcaggagccgtagtgctagtcctgtccattctaaaggccgaggaagaggtcgttatgatgatgataggcgaagtagaagtcgatcaatgagtgcttctcctgctcggcgtagccctagtcctcagaagagtccttccccacgtaagacatctccccctaggggtgaaagtcctagtagacggagccgtgatggacggtctccaagtcctcggagtgtttcaccgcagcgccgccctgctgattcacggagcccatcttcttgaaactcatagatcaatgaatgatcttgctgatgacattggaattcctggagacttgacttagcatggttcctgttgctattttgttaatgttgacgacattcaaatatcattt

SEQ ID NO: 14447 - DNA, 480 bp, Gossypium hirsutum
  Clone ID: uC-gsflnu33B036h10b1
ttctttctttccaagacaaagcttcatattatcttttttagttccgacaaaagaaaacgaaaaaaaagaagaagaaatacaatcgttttctttttgaagtcgggttttagtttttggggtgaaaaaaatgttgggagtatttagcagtgcgatagtgtctccgccggacgagctggtggcggccggttgccgaactccatcacctaagataacggcggacgctctggtgaaacggttccttgagacgaactcctccggcgtgtccatgcacatcggagaccatgtccaattcgcttattctcaccataaagagtctcctttacagcccagatcatttgctgtgaaagacgaaatcttctgcttgtttgagggagcccttgataacttggggagtttaaagcagcaatatggtctggcaaagtcagcaaatgaagtgatattggtcattgaagcttacaggcccttcgtgaccgagcacct

SEQ ID NO: 14448 - DNA, 410 bp, Gossypium hirsutum
  Clone ID: uC-gsflnu33B036h12b1
gtgttatttagtggtttaagggattttttcatttgtttcttcttacgctcgattaccttacgaaaagagaaaatgaccaagtgttacccaactgtgagcgaggaataccagaagtcagttgaaaaggctaagaggaagctcagaggtctcatcgctgagaagaactgtgctccactcatgctccgtctagcgtggcactcagctggaacttttgatgttaagaccaagacaggaggtccattcggaaccatgaagcatcctgctgagctcgcacatgctgctaacaacggtcttgatatcgccgtcagacttctcgagccgatcaaggagcagttccctaacctcacctacgctgacttttatcagctcgctggtgtcgacgccgatggagatactgggtggacctgaaa

SEQ ID NO: 14449 - DNA, 389 bp, Gossypium hirsutum
  Clone ID: uC-gsflnu33B037a02b1
cccatgcgtccgggaaaaaaaaaaaaaaaatagaagaagaaaaatacaaacataatgttcaagaacaggaagggcttgctgagggctccgaggtttcgtccgctggcttgcaaggcagtagcttttctattgtgcccgctaagtcctgtcgattggcgcggcgttgttcaacgtctggtacgtgactaccttggggtgtcccatgttcttgaagctccatctcatccgcgttaccgacgctggcctaataccgaagagggccgcccgtgacgtgcttttacacatttgtggattgtgattggcgaatggcacgcgccctgtatcgcctgttcaagcgctgatgacgttttggttaccggccacttggcccgtcccatgggcagatgcct

SEQ ID NO: 14450 - DNA, 90 bp, Gossypium hirsutum
  Clone ID: uC-gsflnu33B037a06b1
cccttgcgtccgcagagatgcatttggattggatgtcttttttgttatcctgattgctaatgataaaattgcagtagtgcttgttctatc

SEQ ID NO: 14451 - DNA, 137 bp, Gossypium hirsutum
  Clone ID: uC-gsflnu33B037a07b1
attttattgagtcctatactcgagatctacgttctcgaactgtattaccatgttatattttgttataattgtgtactacaaaatctactgtgttgagtaatgttggtgtattgaatcaataagattgcagttcatgg

SEQ ID NO: 14452 - DNA, 522 bp, Gossypium hirsutum
  Clone ID: uC-gsflnu33B037a09b1
tctactcgtacggcttttgagggcaaaaaaagaggccatgttatcgatttctcaatgaaccaaggcatgcaatggcctgctttgatgcaagctttagcgttaagagttggtggtccgccagcttttaggttaactgggttcggacctcctagccacgacaactcagatcacttgcaggaagttggctgtaagttggctcagttcgccaataagattcacgtggagttcgagtatcgtgggttcgtggctaattcgtaggccgatttggatgcttcaatgcttgacctcaggccgagtgaagttgaagccgtggccgttaactcggatttcgagttacataaactgatggctcggcctggtgccatcgacataggcttttctgaggtgaaacagatgaagcctgaacttgttaccatcgttgagcatgatgcgatccacatcggttctgttgtcttagaccggtttactgagtcattacatttatactcgacgctttttgattcgttggaggagacggtgagc

SEQ ID NO: 14453 - DNA, 368 bp, Gossypium hirsutum
  Clone ID: uC-gsflnu33B037a10b1
ccttctcttcctttcactcattcgatcacgattggggacatgcattatggatttctgaggctttatccaaaaagagctgtctttagctggtgggttttgtttgcaggaggctataaaagaggtgaatggccaaaggatatgaagccagcctcaatgagagcaagatggacgctcccctaagtacatgggtccaaatctcgaggtttctgtggggttacactgttcttcgaatgccgaacgggactaccaaccttcacttgacgtaggcaatcgatcgatccgagcctgcgcatgtgtacccattggtaggagctctcactctaagagcgcgtattgatcgtgccacaagccgacttgtgagagtttac

SEQ ID NO: 14454 - DNA, 514 bp, Gossypium hirsutum
  Clone ID: uC-gsflnu33B037b01b1
gttttaatggctcaactcatatgtggaggttgtcgaacattgctaatgtatacacgtggagcagcaagtataagatgctcttgctgtcacaccattaatgttgcaccagcatccaaccagatctctcacatcacttgcgggcactgccgtacaactttaatgtatgcatatggagctccatcagtcaaatgtgctgtctgtcaatatgttactaatgttggtatgggcaatgtaagggttccccttcccgtaaacagacctaatgggaaagctgccacagggtctatggctacgcaatctgcttcgccaagccaaactgttgttgttgagaaccccatgtctgttgacgagagtgggaaattggtgagcaatgtcgtggttggcataacaactggcaaaaaaatgaataatccagtgtgatacttgagtttgattggtgaggaattgattgtgtatatgaagtttgaactggcaaaaccattagcattgtattcgaagggataagcgtgatgta

SEQ ID NO: 14455 - DNA, 572 bp, Gossypium hirsutum
  Clone ID: uC-gsflnu33B037b02b1
ggtttcggactggccttaacaagttgactgacagcggatcatccaccccgtctggtctcgtagccgccgctctagctcatggcttcggtcttttcgtcgctgtctccgttggcgccaacatcttatgtggccacgtcaaccctgccgtcaccttcggtgcttttgttggcgggaacatcactctcttgcgcggcattctttactggatcgcccaactcctaggctcaaccgtcgcttgcctgttgcttaagttcgctaccggcgacctggctgtacccgcttttgggttgtcatcaggtgtgggcgtgtctaacgcattggttttcgaaatcgtgatgaccttcggattggtgtacacagtgtacgccacagccgttgatcccaaaaagggaagcttgggaacaatcgcaccattggccattggtttcattgtgggggccaacattttggccggaggtgccttcaatggagccctcatgaacccagctgtttcatttggaccagccttggttagctggacatgggatacccactgttctactgggcggaccccttatcagtggtgggctcgc

SEQ ID NO: 14456 - DNA, 391 bp, Gossypium hirsutum
  Clone ID: uC-gsflnu33B037b04b1
agctcgttggctcgtcgagaagaaaaggttgtaaaagacggttattcccgatttaagatatggctggcgacggagaagcttaagatattcgtagtgcaagagccagttgtagctgcttcttgcctcatcgctggttttggtctcttcctaccagctgttgtaaggcccattttagattccatggagtcatcaaagcaagtccctcaacctgctttaagagacgtggtttcaggtgtgactggtaaaaaacggggtcgctatgatttatggatcgaaaagaggcaaaaatttacgtgtagcttggaatcaccgacgaaataagtccaacttttttaatttgaggaactttctaaagtgcccttcaaccccaatgttagcatgagaatatgag

SEQ ID NO: 14457 - DNA, 520 bp, Gossypium hirsutum
  unsure (1)..(520): unsure at all n locations
  Clone ID: uC-gsflnu33B037b05b1
agttatctgttggtttcaagttttaaggaagcctgtgcccacggtttgggagttgctaatgttgcaattttggaatcgtgctctatagagggtggagatttccagaaacttgcaaacttgcattcagtccatgatcatctagttaaaaggatggaaaagagaacaaagggggagactgatctggttgtcctatgccatggaggctttcagtctctgaaagagcttgaccaaccattcccagagagtgagattttgactgaagtcatgagttctgtggagcaatctggggcaaaatatgcagccctttatgtttctgacccttttaagtccatccactatcccggttatagagagcttgaaaggtttcttgctgatgatactgcaaagaatggttcagccagtcccaaagtctgcgatgaggtttgccagctaaaatcatcactccttgagggagttttagtnggaattgtgttgcttttaatcttagaatcaggcctttgctgcatgatgggcattgata

SEQ ID NO: 14458 - DNA, 467 bp, Gossypium hirsutum
  Clone ID: uC-gsflnu33B037b06b1
ccttctcgtccgcttctttgttgctatgaagtggtgattcctaagagtaaccgcagcaggaaaaatgaaggacaagatgttagctcttttcatgattgtccttgccgtattctcgaatgcggtagccatatacagcgatgcatacgccctgtttaagaagaattcaggagcaggacccagggcatgatccatctagcagttcccttggttgcacaaaatgagattttatgtcaccatatccttgaagacacctggagttatctttcgatatccaattcgaaaatccaggtgttcggaggaggtttgataagctatataataagatgtagctttgcttccaatgtatgaaagttagattgtgaggggaagtgtatgaagttcatacatcataccccctcccccctcctctacttaggttgtgtaagacattaaaacatgttgtaaaatagcaaatatagcatatttca

SEQ ID NO: 14459 - DNA, 528 bp, Gossypium hirsutum
  Clone ID: uC-gsflnu33B037b07b1
tgtcgcgtggggtgattgcccaaaccgacggggctcgcatgtcgatagcttctttttacaaccccggcagcgacgccgttatctacccggcgccagccctggtggagaaagaagaagaagaagagaagaaaggattgtacccaaaatttgtgttcgaagaatacatgaagctttacggtgtgcttaaattccaggccaaggagccgaggtttgaagccatgaaagccagggaagcaacagcttaaagagaattcaatacctgacgtagctttgagtttgatcaagaaatgggttctgttaatggtgtattaaagaaaaaagaagtcaatgtttagtatagtctattgaataatctattttattctaaacagtgaggatcctgtcaatttctactataaaagatttgatagaataaaattacttacaaagggaatggtgggttgccacaaaggaacatgaagatatgcaataatctattttaagtgtgtgagaaaaaaatattaaagaaaaaagaagtcaatgtttacc

SEQ ID NO: 14460 - DNA, 501 bp, Gossypium hirsutum
  unsure (1)..(501): unsure at all n locations
  Clone ID: uC-gsflnu33B037b08b1
tgtttctcgttcgcccacgcgttcgaatttacataataaatcataaaaaaaaaacctgcaaaaaaaaaattagatcgatgtggcgggaccttggtcacgccaatggtattggcggcaccaaaggtgccaaaaccattggcggcatcaatggtgccaataccattggcggcaccagttaataataggggggtcggtggtggtgggagcagaaggagaaggaaagaaagaaagaaaggagaggaaagaaagaaaaagaaagaaaggagaggaaaggagaagagaaaaaaagaaagaagaagaaaaaaaggaaaagagaagaaaaaaagaaagaaagaaggaaagaaaaggaaaggaaaggagaagagaaaaaaaaaagaagaagaagagggaaggaaggaaaaaaaaaggtaattttatttataaatctaatttttttgtaatatttgtgtatttaaaatttatgttatgtacattatagntattttattattttatttagca

SEQ ID NO: 14461 - DNA, 193 bp, Gossypium hirsutum
  unsure (1)..(193): unsure at all n locations
  Clone ID: uC-gsflnu33B037b12b1
actancataaatatttgtggtttttgatgcttgggttttaattgtttgttgttttatcatggaatggtctctatttttatgggttggctaaacaataattgaactctttgttctattactacttgattttattggatggactcctttgggacagaaaatgtctctgagcgctgccacggatgttccatttcag

SEQ ID NO: 14462 - DNA, 579 bp, Gossypium hirsutum
  Clone ID: uC-gsflnu33B037c02b1
catttcaattcaatttgcagttccaatagtaatcgtagctcaaattattttgcattttagtgtgtgatgcagcagcgaggaaggatccaaaacagcagatcaaggtcgttttcaagatctcgtcttgccgttgagggattttaaatctttttcgctctcttttttctttaaaagaaaaaaaaatcgaactcttaaaagcttactagcgatctttctccggtaaccatggcgactaacggtgaacgtgaggttcaaaagaactactggatggagcactccattgatttaacagaggatggtacgatacttgattccaaggacgcagatctcgacaaagaagaccgactcgaagtgctctccctgctcccgccatatgaagggaaatctattttggagttaggagctggcattggtcgatttaccggtgaattagctcagaaggctgatagtgttatagctctagactttattgaggatgttatcaagaagaatgaaagcatcaatggacattataagaacatcaaattcctttgtgccgatgcgactgccccagatttggatatttcagaggatcaatgg

SEQ ID NO: 14463 - DNA, 370 bp, Gossypium hirsutum
  Clone ID: uC-gsflnu33B037c04b1
gtcttctgggtgaaaaaaatgttgggagtatttagcagtgcgatagtgtctccgccggacgagctggtggcggccggttgccgaactccatcacctaagataacggcggacgctctggtgaaacggttccttgagacgaactcctccggcgtgtccatgcacatcggagaccatgtacaattcggttattctcaccataaagagtctcctttacagcccaggtaaaaaaaaatcatatatggtattggctgctggatgatctcaatcgttgaaaattaattatgaatcaaacttcagttgatcaaaacgtttatctcttacagaattttgatcctggccctaacataattcgtgaaatgggggcggccgc

SEQ ID NO: 14464 - DNA, 153 bp, Gossypium hirsutum
  Clone ID: uC-gsflnu33B037c06b1
ctttctcgtgggggcaaatgagaatatatatagccatgcattattactgcttaaaacgatctctttctcccaaaaaacataaaaatctcaaaagacctccacaacgaagaactcgaagcctgtgatctcaatgctgacttgacccctctaatg

SEQ ID NO: 14465 - DNA, 570 bp, Gossypium hirsutum
  Clone ID: uC-gsflnu33B037c07b1
cctcatctctaaagccaagaaagcaagccattaaggttttgagaaaagatcaaaatggattcaaaaagatcagcttccacagccctccttttagccctcaacattcttttcttttccctagtcagtgctaattggatcttgttcttcttctggctctaacccaaggccaactcccacccctactccatctgcacgaggtaggtgccctagggatgccctcaaattaggtgtatgtgccaatgtgcttaacttagtcaatgtcaccgttggttcacccccggtgatgccatgttgttcccttctcaacggtcttgtggacctcgaagccgctgcttgcctttgcaccgctatcagagctaacatcttaggcatcaaccttaacatcccagtttcccttagcttgcttctcaacgtttgctcaaggaatgttcctactggttttcaatgctaagtcatcattgttcctacattctttcttcatcttcttatcgtgttcgtgtttgtgtttgtgttttggtttttaaaattatgattcagtatttaccggtcatcaatattatcattggatac

SEQ ID NO: 14466 - DNA, 286 bp, Gossypium hirsutum
  Clone ID: uC-gsflnu33B037c09b1
gtttatcaaacctcgtcttcgatgttccatctcgtaatctaataattccgcaatcggcagctcgggtttattaccgtttcttcctagataatttatttttctacttgtaatgagtgagtagttggcctttggtcgctgtcatgaagactgttatgttaaacaatatttgctcaattaaggtttgattcttttttgctaaaaaaaaaattcataaaaaaaaattatatttaataattaatttaaataaataataaaaaaaaataaataaaaacataaaaaaatatgg

SEQ ID NO: 14467 - DNA, 326 bp, Gossypium hirsutum
  Clone ID: uC-gsflnu33B037c12b1
ctctttatagctctcggaactgctagagggatggcgaactttcatacggatggtggcggttctatccacccatggtcacattaagtcctcgaatgtcctccccagcgatgaactcgaggcttgtgtttccgacgctggcttgacccctataatgaatgctcctttaaccacgtcttgcatagttggatacagagctccggaggtgattgaaacacgcaaaataactcaaaagtctgacgtgtacagcttgggcgcccttctcttagaaaagccgactgcaaaagctcctctccaacctttagggcaagaccactttgccgatcttc

SEQ ID NO: 14468 - DNA, 460 bp, Gossypium hirsutum
  Clone ID: uC-gsflnu33B037d01b1
tcctgcttccggggaggaacaactaataatgatttcatgggtggttttggacaataccccattggagaaataacaaggtttgatacagaacagttcactccaaggttttcaggcaatggtgtttcactcactttgggacttccccattgtgaaaacctgtctttatcaggcaccccttatcaaacttttctccctaaccaagccatgcaaatggggagaagggtcgacattggtgaacccaatgagtttgggtctataaacccttccacaccacactcttcagctgcatatgacaacatcaacattcagaacaggaaaaggtttgcagcacaattgttacccgactttgttgcctgactaaacttacaggggcttgcttcacattttccaggaaaatgaatggtagtgtaaagattaaatgaagataacgaatttcagcctagtataggtttttatactt

SEQ ID NO: 14469 - DNA, 531 bp, Gossypium hirsutum
  unsure (1)..(531): unsure at all n locations
  Clone ID: uC-gsflnu33B037d05b1
ggtttttgcatagtttaccctatctaattgtgttgtttttgaatttaggagcattgctcacttcactaggctgccctgaatgttaccaccacccatctccgccgccgaaatgtcctccgccacactatccgcctaaacatcatcatcctcccattgttaagccaccctatcaccctaaaccaccaaaacatcatcctccaaagccacctaagcctcccgtggtaaacccaccatatcaccctaaaccaccgaagccaccggtggtgaagccaccgtatcaccctaaaccacctaagcctccgatggtgaaacccccatatcaccctaaaccaccaaaacatccaccgcatcctcccaagccacctgttgtaaagcctccctatgtacctaagccacctattggaaagccttcaccgtatacacccaaaccgtcggttgtgaagcctccgccatatacacccaaacncgtcgttgtgaagccttccgcatatacacccaaaccgtccgatgtgaagccttcgtcatatacac

SEQ ID NO: 14470 - DNA, 111 bp, Gossypium hirsutum
  Clone ID: uC-gsflnu33B037d08b1
tctcttaaaattaaaaaaaaaacaaaaaaaaaaagaaaaaatcaaaaaaaaaaacacaaaaatctaacaaaacaaaaaaaaaaaaaaaaaccactccacccccctccgcgg

SEQ ID NO: 14471 - DNA, 132 bp, Gossypium hirsutum
  Clone ID: uC-gsflnu33B037d11b1
ctcggattttattaaaatcttattatatgtaaaacctcctgtgatgttagattaaactaatgcggaaatgtatttaaatctattatttatctttcgactctctttttttaaagatgagatgtcgcttcgtct

SEQ ID NO: 14472 - DNA, 403 bp, Gossypium hirsutum
  Clone ID: uC-gsflnu33B037d12b1
tcgttaaagatgaccacgacttggattcttttaccacgatattcccgttggataagatcctactacattcctgatagctcaggccaacatcacccggaaattctttgccccatccccatacggaagcttgtattcaatggatgatcccctaactctagggcctaaccgaacattcaagatggttggaaatgcccaagggctctacttagcattaagtcgagaccctaccaagttctttgcggttttttacgctgattttgcgtttaccactggcaagttcaaggggagctcctttaggtagttgtgactacatcccctgacagattttgtgcctggccctaacatacttcgagaaatggcaatagtgggagggacaggtgcgtctaggatggccaaagggttt

SEQ ID NO: 14473 - DNA, 507 bp, Gossypium hirsutum
  Clone ID: uC-gsflnu33B037e01b1
gtgtcattgtccatgggaaatctggtttcaacattgatccttaccatggtgatcaagctgctgacatactggtcgatttctttgaaaagtgtaagaaagatccatctcactgggataagatctcccaaggaggcttgaaacgtatcgaggagaagtatacatggaagatttactcggagagactattgaccctgaccggagtgtatggattctggaagcatgtttccaaccttgaacgccgtgagagtcgtcgttaccttgagatgttttatgctcttaagtaccgcaagctggctgaatcagttccattggcagaggagtaaatttaagctgttaaataacattgggccggtttttcttggagaataatattctggtttgtaatttcaattggagaagctcttttgtatttgatgttgtctatgccttttacttttttcgccggcattgtttgaacatggtgttgtgcgcccgtctattcaggtaaatatggtgacttctggtttt

SEQ ID NO: 14474 - DNA, 382 bp, Gossypium hirsutum
  Clone ID: uC-gsflnu33B037e02b1
cctatgcgtccgaaaaaagggaagcaaggacatgacgggatgatgcaaagtggcggtggggttccgggaaacgcagagatgggaatgggaggacatggtggaggatatggtgggccgggtggttacggtgggttttcaggtgggatgcaagggccgcctggtcccatgggtcatcctcatcccttgaattcatcaggagttggagtgggcgctttgagtggaaatggcggtgttgctgctgggggttattctggacttggtgggccgtatggtgggtacggtggaccaggttcaactggctatggtggaccaggatcagctggttatggcggaccaggttcaactgtttatggtgggttgagtggtgctggtgcagggggtg

SEQ ID NO: 14475 - DNA, 554 bp, Gossypium hirsutum
  Clone ID: uC-gsflnu33B037e04b1
ccttttcgtccgacacgatcgacaacgtgaaagccaaaatccaagacaaggaaggcatcccgccagaccagcaacgtctcatcttcgccggaaagcaactcgaggacgggcggactttagccgattacaatatccagaaggaatcgactcttcatctggttctacgtcttcgaggtgggatgcagatcttcgtcaagactttgaccggtaagaccattactttagaagtggagagctcggatacgattgataacgtgaaagcgaagattcaggacaaagaaggaattccaccagatcagcaaaggttgatttttgctgggaaacagctggaagatggaaggactttggctgattacaatattcaaaaggagtccactcttcaccttgttcttcgtcttcgtggtgggttctaagccttaaggtcttccttaatgtgggttttctggttttacgtgaaggattgtgccccttgatggccttttaaataatttctagtctttgtttaccggttgcatctatgtatggcttctctctggatggaatttgcatattta

SEQ ID NO: 14476 - DNA, 567 bp, Gossypium hirsutum
  unsure (1)..(567): unsure at all n locations
  Clone ID: uC-gsflnu33B037e05b1
ccttctcgtccgggaatatcgtgaaggctagtgtgaaaggatcaaggacagggtggatgagcatgagtcgaaattggggtcagaattggcagtcaaacgttgtgctgattggtcagtcgctctcatttagggtcacaggcagtgacagacgcacttccacctcttggaacattgtccctgcccattggcaatttggtcaaacattcacgggcaaaaatttcagagtttgatttctcaaataaaaagaaaaatgaaaattattagccccataagttaggaaaaaccatttccagttttacccttgatggtccaacttttgttttgttagggtgatgtctctttttgacaaattgggtacttggggtgttttctttattttacactttggttctgattttggggttaatcggtttgcatttggggtgcggtgggggaggaactgangcggctgccacaaaattgtagcccgcagcctaaatattaaacttttaaatgttattagctatacttggggaaagtgtattggttttaacttccaactcaaattatactttatatttggttatt

SEQ ID NO: 14477 - DNA, 438 bp, Gossypium hirsutum
  Clone ID: uC-gsflnu33B037e07b1
ttgtagatgccagagaaaaaattcttgatgccattgaagatctaaagcttgattctttggttatgggaagccgtgggcttggaactgttcgaagaattatattggggagtgtgagcaactatgttgtgacgcatgctacttgccctgttaccatcgtcaaggaacaatcaagctccagcaagcactgagaagtttacatgatattttctagtttgatttcccaaacaataatttgatggacgagtgtatgttgcttgatcatgttttaccaagtagcttacgcagttttacgtttgtttactgaatcttaaagatgtatggtactttgtgagttaatgcactgttatggagacgattataataatgataataatgttggtttgtcgtactaatttttccttatactaaatttatttcttttttttttctctttttttt

SEQ ID NO: 14478 - DNA, 547 bp, Gossypium hirsutum
  Clone ID: uC-gsflnu33B037e08b1
taatccttcttcttcaaacttctatttctttttttaaaaagagaactttatagagaagaagaggatcaagaaaagaattttttttttatttttattttggggtgatagtggtgactggtgagggggattgttttgtcattttcattggagtttttgggtgtattttcaaaaaaaattaaaagaaatctgagatttgggggtggcgctgtacaaaaatggagtcggatactatcgagtgcgtatcatctatagatgaaattgttgatgatcatgagatccctcaccataatctactccaccacccacacccttgtgatgcccctcatcatcaattttcatcgtcaaagccttatcacaacggcactaataatgttaatagtattagcaatattgtgggtccaacggcgattgctccggctgctcgtgtccatgatttgtttgaatgttctgtttgcaccatatttatgtttccacctattcatcattgccacattggacatacactttgttctacctgttatataccaattcactaccggtgcccaac

SEQ ID NO: 14479 - DNA, 421 bp, Gossypium hirsutum
  Clone ID: uC-gsflnu33B037e09b1
tttttctcgtccgcgtggtagtctattgaatgccttgcttcgctcacccgagaaaaaaataatgtcctcaggtggcagtggcggatccagccgcagctgctgctctggctgctattgcggtgagaactgctcagtgaaccttaaccttgcttactgggagaagacaaccagcactcacaccatcatctacggagttgcgccagtgcagatgacctctgagggaccagaggtgggcactactgcttcacggcatggatgcaggtgaggctcaagctgcaagtgtcatgcatgcacctgtgggccagctcgttgaacgcccttgattagtgaatatgaaggcggcaacctcacaggcctgtgtaatgatttattttcaaggacggatgcctgcaaggtctatagttcatggtctctctgtctt

SEQ ID NO: 14480 - DNA, 316 bp, Gossypium hirsutum
  Clone ID: uC-gsflnu33B037e10b1
gctcactctcgatctgaaggcggtgggctccgaacgccatttgatgctctgattacagtgtgtaattcaaaaagtgggacgcaacccatggcaccgatggggctatatctctgcctgaactcgttttaggaatgaggaagggatgcccattagagtagcagatgggcattgtcctaaggcctatgtattctcatttaagttaaattagatcgcgataagctgactaggactgggaaacatgtcagaacccaaaacctatgttgatgaggtagaactagttaataggatttctgctttatcatttctttgggcgggc

SEQ ID NO: 14481 - DNA, 394 bp, Gossypium hirsutum
  Clone ID: uC-gsflnu33B037e11b1
tgtagtatttgaagccgagtaatatattacttgaccagaacatggaagcccacatttctgattttggacttggacggcttgccaatattgctggagggtctccaaccacacaatctaaccgaatactttcagataaaccgctagagagactacaaaagagtgcttcctccgaagctgctccactctactcgaacttgggatctttttaccaagctcctgaagccctgaaagtggtgaaaccatcacagaagtgggatgtctactcatatggtgtaatcttgctagagatgatcacgggaaggtcacccgtggttcatgtaggtacctcagaaatggatcttgttaattggatccagctatgcattgaagagaagaaaccactttcagatgtttt

SEQ ID NO: 14482 - DNA, 542 bp, Gossypium hirsutum
  Clone ID: uC-gsflnu33B037f01b1
attgtgtgcccttggagcacttttggtctacgatgttactaatccgacgacatttgaaaatgtaagccgatggttgaaggaactcagggaccatgcagattcgaatatcgtgaatatgtgatcggtaacaaaactgatctgaagcatttacgagcggtttccacagaagatggtcaaagctatgcagagaaagaggggctttcgttcattgagacatctgcactggaagcaataaatgtcgagaaagctttccagaccattctctctgaaatatatcgcatcatgagtaagaagtcactttcttccgatgacctggcacctgcaagtattaaagaagggaagaccatcgctgttggagcaccagatgccaacactaaaaaggcttgctgctcatcatcttgaacatccatctttgatcattacaattataattcttcttttttaattacagtttgtgtttcttttatagcttgtctcgtgcttacggtgtatgcaatagctgtgcaccaattattggtatatcgactcgaatgttaatttct

SEQ ID NO: 14483 - DNA, 463 bp, Gossypium hirsutum
  Clone ID: uC-gsflnu33B037f04b1
ccctctcgtccgggtgcatcggttgtacccagaggttgaccctgccctcagccccgaccatgttccacacatgctccataaatgccctgatcaaatcccagaccccaaggccgtccagtatgtgagaaacgatcgtgggacacccatggttttggacaacaactactacaggaacatactggacaacaagggtttgttgattgtggatcaccaactggcttacgacaaaaggaccagaccttatgtgaagaaaatggccaagagccaagactatttcttcaaggagttctcaagggccattactctcctctctgagaacaatcctctcactggtagcaagggtgagatcaggaagcaatgcaatcttgcaaacaagctttactaaaatgcctcgccaaagagaaagccgagagtggccgaataaaatggttgtttacttgcttctttccaagagacatgtttg

SEQ ID NO: 14484 - DNA, 127 bp, Gossypium hirsutum
  unsure (1)..(127): unsure at all n locations
  Clone ID: uC-gsflnu33B037f08b1
ttttctcgtcctcccacgcgtccggaattttccatgcaatttcaacttggtataagttatgagatgactaaatttgcattgtaccaaataattgatgttaatgtttttgccaatntnttattatttt

SEQ ID NO: 14485 - DNA, 530 bp, Gossypium hirsutum
  unsure (1)..(530): unsure at all n locations
  Clone ID: uC-gsflnu33B037f11b1
cctacgcgtccggaattttttccccaagttgatcttctctcatttttctcgccattttgctacgctttccaaactcccaaacaacttcaccaaaattccttccaagtatcgaccccaagccattcgagatgcccaacaagctctcacggattacctccactgtacccgttacatccctttcgtctacgccgagcacattgctaaaaactccttcttttccctctcttctctcatctccggcattaatttctccaccacgagcttcaatcgaaacgtcctcagattcctcaggtaccatcccattaacgagtatgagtttttcttcgaaagtataggcattgattatgaggaagttggtggcctattgccgtccaagaagttcttcttttctgaagatgagacggttctggaggctgcttgtgcgctctctggatttgggtttccttggaacanattgngtaagctttataaagaggaaatcttgattctaaggcaagttctaaggaactaaaagctaggctttttaagat

SEQ ID NO: 14486 - DNA, 344 bp, Gossypium hirsutum
  Clone ID: uC-gsflnu33B037f12b1
ttatgcgttcggaacccaatttcaagcaaaaggtaatatatcgcgtgtaactgtttggttctccgctagactaatttacttattccctaaagcaacgagataaaatgcacaccctttaccaatccctcattcaaaagagtcttccactttaaccaggctataccactcccaagtgagatgcctatacttcgcaaagaacctgaaccggtagggccggccctttaaaagggcccagctttgataccccgggccggcgacgacttagcttttctaggggggcccctaaattcaaccaatgggccggggtttaacaacggcgggactggaaaaacccgggggaaccc

SEQ ID NO: 14487 - DNA, 323 bp, Gossypium hirsutum
  Clone ID: uC-gsflnu33B037g02b1
cccatgcttccgctagccttcttctttttcctccgcggctacatttccactctcgttcccgagatatcaaagtaaaatgaaggtggtcgccgcctacttgcttgccgtgctcggaggaaacgcttctccttccgccgatgacttgaaggttattctcggatcagttggagctgaggctgatgatgataggatagagttgctattgtctgaagttaaaggcaaagatatcaccgagctaattgcaagtggaagggagaagctggcttctgctccttctggtggtggtgctgttgcggttgccgctcctacagctggtgttggcg

SEQ ID NO: 14488 - DNA, 412 bp, Gossypium hirsutum
  Clone ID: uC-gsflnu33B037g03b1
gtttctattgattgaatctccaaaccttcttcccatttgttcattacattgttcaagataaaagacgcaaaaaaacatggccaaagttctgctgttcattgcactatgagtgcttccagctatggttagtgctacacgcattctgaataatcaattggtggtagaaggctatgtgtactgtgatacttgccgtgctggttttgaaacccctaaaactagaagcctagctgatgccatggataggttggtatgctccgacaggaagagcggccaactttgtcttcaaaaaggagggattcaccgtcagaaccggaaaataccagattcgtgtatccgaggatcacttgtatcagatctgtgatgcagttcttgtgaagagctcccagcttggttgtgccacaatggaccccgg

SEQ ID NO: 14489 - DNA, 574 bp, Gossypium hirsutum
  unsure (1)..(574): unsure at all n locations
  Clone ID: uC-gsflnu33B037g05b1
gtttaaacgttgctgttaaggatcttaaacgtggttttgttgcttcaaactccaaggatgatccggccaaggaagctgccaacttcacctctcaggttatcatcatgaaccaccctggccaaattggaaatggttatgccccagtcctcgactgccacacctctcacattgctgtcaaattttccgaactgttgaccaagattgacagacgatctggcaaggaactcgagaaggaacccaagttcttgaagaacggtgatgcaggtatggtaaagatgattcccaccaaacccatggttgttgagactttctctgaatacccaccacttggacgttttgctgtccgtgacatgcgccagactgttgccgtcggtgtcatcaagagtgttgagaagaaggacccaactggtgctaaggtcaccaaatctgctgccaagaagaaatgagagattatttgagagagatttatatcagttttcattacagctttggacaattatcctaaatttggactntagaanttactttttgtgagactttttgattgctttttaacaaatcctaggttatattt

SEQ ID NO: 14490 - DNA, 345 bp, Gossypium hirsutum
  Clone ID: uC-gsflnu33B037g07b1
gtcttcggcaaagcattccagcaatgtatgtgagacatgtggagaggaattccaatcgaagaataaattacataagcatctgggagacagtggtcatgctacgttgaaattccgatgataacaatgaggtatcctatatcactatttgatttattatcaaatgcagctaattcaaaagtagcatttccgattttggattttattttttattttttcattaaaaacatgaacattgaccaggtcttgaatggaaagatctattcgtgtaaaatgttacccttattttgagttcaatagattgaatgtggctttaaacagccataaaattcgttattaccctgcttg

SEQ ID NO: 14491 - DNA, 506 bp, Gossypium hirsutum
  unsure (1)..(506): unsure at all n locations
  Clone ID: uC-gsflnu33B037g08b1
ctttgtttggttcccgagaatatcaacaatgactcgcggcaaccagagagaaaaagatagagaaagggctcaatccaggtcaggcaacaaagggaaagctggttctaaggacgatggattgacccctgaacaacgccgtgaaagagatgcaaaggccttacaagaaaaggccgcatagaaggcagcgcaggcggcagctggaggtaacactgccggcggtgatggtggaagtaaaaacaagaaataataaaataaagacggtgagatgatttaccgtggaggttaaagatagtgttaatttgttgatcgnggaatttgatctttggtttccagtcttcgtttcgtgttttttaaagttcaacaaaccctcggcttgcttatatctttggcattgatgttgactgttaatggaattgatttcctatatggcattatggaattntgcgtttctatgattatctgtagttatcaattccagtagataaaaccccgtatcgattntgatc

SEQ ID NO: 14492 - DNA, 402 bp, Gossypium hirsutum
  Clone ID: uC-gsflnu33B037g10b1
tctactcgtccgtccacgcgtccgtggtattttcctttttactcttaaaacttaaaccgtcttccggttgtcttaataaaaatggcggtggtaattgatctttgatcatctttgatatatgatgaaataaaataaatatataaactaggaaaaaatttacctagtttataaaaaaaaaaaaaaaaaaaaaaaaaaaaaaaaaaaaaaaataaaaataaaataaaaaaaaaataataaacaacaaatacataaataacaataaaataggggcggccgttttaaaggacccaattttccttccccgggcaggcatacttttagctcttttttaggggccccaaaatctaattccttggccgtcttttaacaacgtttgacctggaaaaaccctggttttcccca

SEQ ID NO: 14493 - DNA, 541 bp, Gossypium hirsutum
  Clone ID: uC-gsflnu33B037g12b1
ccttctagaaattaaaataacacctctattctcttctgtaacagcttaataaaaaatggcggcttcttctagaaggtctagtggtccggttctccgatctcattccccatcttcccggtttacttctttctacgcttcacagtcacactctccatcttcttcttcctccgcttttgcctattccagttcaggtttctcttcacgttcaactttcttcaatcaaccaagatctacttctccaccacgtgttaacctgcacagaaactcttcatcagcgtcatctgtgcggttctcgctcgacaaccgtccgatctcaccgaaccgttcaatcaccaccgtccggagaaccactgaggcgttgaagaatttacagagcaaacagacgaagcggacttgcatgtgttcacctacaacgcatcggggatcgttccgttgcagtcttcataagagcttcaatacttcgcatgccgggacaggttacgcgccgagttatcggcttaacgcgcgtagatctgcgatgacgaactcgctcgtgagaatc

SEQ ID NO: 14494 - DNA, 271 bp, Gossypium hirsutum
  Clone ID: uC-gsflnu33B037h02b1
gagccttccagaaggccccagagtggtccgagatcgtcgccggcccccgctggaagacttttatcaggagatttaaccgtagcaaaagtgggagcggaatcgtctccagcggtaggcatgggcaattccattatgatcctttgagttacgctttgaatttcgacgaatgcccgcgacagaatggtaatttggaagacgataatgattttggtgcctttcgggcctttttaacccgttacgcttctggttcaggttcggagaaaacaacatt

SEQ ID NO: 14495 - DNA, 464 bp, Gossypium hirsutum
  Clone ID: uC-gsflnu33B037h04b1
atcttgtatgaaaaagaagggaaaatggaagggaaagaagatgatgttagattgtgagctaacaagctctcagaaaggcaacctattgggacagcagctcagtcccaagatgataaggattacactgagccacccccagcacccttgtttgagcctagtgagttgacttcatggtcgttttaccgagctggaatcgctgagttcgttgctactttcctattcttgtacatctcggtgttgactgtgatgggagtccttaaggacaaaaccaagtgtacaactgttgggattcaagggattgcttgggcttttggtggtatgatctttgctcttggttactgcactgctggtatctcaggtggtcatataaatccggcggtgacatttgggctgttcttgggaaggaaactgtctttgacaagggcaatattctacatggtgatgcagtgcttgggagctatatg

SEQ ID NO: 14496 - DNA, 390 bp, Gossypium hirsutum
  Clone ID: uC-gsflnu33B037h05b1
atttcttgcagcagacgtggatcctcatcggattttgcatcaaacggcctgctcctaccgttggtctacatgaactttatcggtttcatggacatatgccagttcagcatacaacatacctgtatctttaccagatgttctccacgagccagcaacatgcaggcaatggaaacagagaaatgtattggcaggagtgtacacatttaacaccataaaattccacccacacctttgccagagacccacaatcttctatttaaacagtgaatactctaccccgcacggactaatacagactgtgcacaatcaatatcacgaagattgcacgcttatcatggatccgacccgttaactggacgatatacgagtcttactaacaaactagacctt

SEQ ID NO: 14497 - DNA, 487 bp, Gossypium hirsutum
  Clone ID: uC-gsflnu33B037h06b1
ctcatcctttcttattccaaatctgtcattaacagtaaccgattctcctgttccttctgtaaaccaaagactggatatttgtatttccatatatatccccacctctcctgagtttatgaaccttatcagatggaagagcaacttgagtttcgtcactgggacgaactaattcctgatgcacttgggttgatcttaagctacctgtccctacaagaggtcttaacagtcattcccagcgtctgcaaatcctggaggaaggctgtcacagggccctattgttggcaagaggtagacattgaagagtggggcagtcgatgtcagccccaccatcttgatcggatgcttcgaatgctcatcacccgaagctccggatctctccgcatgttatgtgttacgggcctccacaatgattccatttgctccttcatcactgagaatgctggattccttcagactttgcgagtgcggagaagcgaaatgagtgatt

SEQ ID NO: 14498 - DNA, 497 bp, Gossypium hirsutum
  unsure (1)..(497): unsure at all n locations
  Clone ID: uC-gsflnu33B037h09b1
ctccattcgtccgaccacgcgnccgagagtggggaggtgtttaccttaaaaaccctttccaacccctagagaatgcttgcgaggaattgagaaccagtaggatgtttttgaagcttctagaggctgtgctcaagactgggaaccgcatgaatatcgggacaaaccgtggtgatgcccatgccttcaaacttgatacacttcttaagcttgctgatgtgaagggtgcggatgggaagaccacactcctgcattgtgttgtacaagaaatcatatgaactgagggtgctcgtctttccgatgctgaccaaactcaaagctccactgtaaacgaagatgctcggggtaggaagcttcggttacaagctgtttctagtctcagttcaaagctcaccaatgtgaagaaagcttgatctatggatttcgaggtacttaacagcgttgtcttgaaggcttctagaggcattgaaacattagcgacgttctaagataaatgaaaa

SEQ ID NO: 14499 - DNA, 436 bp, Gossypium hirsutum
  Clone ID: uC-gsflnu33B037h10b1
gcctctgcctgcgtctctctcttcatctctctgaacctaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgatactggatgcggtaaagcatgagtcccttaagaaaaacattgggggagcaaccaagtttttgct

SEQ ID NO: 14500 - DNA, 538 bp, Gossypium hirsutum
  unsure (1)..(538): unsure at all n locations
  Clone ID: uC-gsflnu33B046a02b1
attatttggctgtgaaagcagaggcattgcctcttaaccaaaatgtgtcagatggaaaccaggagtcagtagccatgaattctcagataactcaggcggtgtttgagaaggagaagggtgaataccagaccagagtaatgaaacagattctgtgggtgaatgggaagaggtatgagctgcaagaaatatatgggatcggaaattcagttgacaatgatgttgatccaaatgatagtggaaaagaatgcgttatttgcctttcagaacctcgggacactactgttcttccctgcaggcacatgtgcatgtgcagctcttgtgcaaaggttttgagatgccagacgaatcggtgcccaatctgtaggcaaccggttgagaggcttttggagataaaggtcaacaatggccctgatgaatgagatgagaacatgtttgttgaactatcttcctgtatagtattttggtgatatcattatgtcatgcctttctaataatcaaacaggangttataatcaattatacagtacatgatatgagc

SEQ ID NO: 14501 - DNA, 432 bp, Gossypium hirsutum
  unsure (1)..(432): unsure at all n locations
  Clone ID: uC-gsflnu33B046a06b1
cctactcgtccggcacgatgtttaatagcaagatcattgggctggtcaatggaactgcagccggatggggtaacatgggaggaggtgcgactcagttgttgatgcccttagtttatgacattattcgtcatgctggagcaactccattcactgcttggagaatcgctttcttcattcctggatgtcttcatatcatcatggggatcctggtcttaacacttggccaggacttgcccgatgggaacctaagcagtctacaaaagaagggtgatgttgctaaggataaattcggcaaggtgctatggtatgccatcacatattacaggacctggatttttgtccttctttatggctactctatggggagtgaactgtcaacagataatgtcattgctgaatantctttgacaggttcgatctcaactccacaca

SEQ ID NO: 14502 - DNA, 503 bp, Gossypium hirsutum
  unsure (1)..(503): unsure at all n locations
  Clone ID: uC-gsflnu33B046a07b1
attaaggtttcggagtagcagctctcttatcccattttctttgcagccaaccttttaacaaatatttacaacctaaaatcaacctgctagagcctgcttttgcagccgctgaacccaccattcaatttgatggtcgaaggtgcacgagcaaagatccgatcttgcccacaaagatcacccatggaaattaggtaaattaatccctctccttttcttcttaaaaaaaaactcaaatcaagcgttaatctctttaaaaacaaagcagaaattcaaaagaaacaaacattcgaccctcgcccgaatctctatattttcgagatatttgggtattcatcagtgtcgattcacatactaaaagaggaaatcgagccaacgaaaaggaaaataaatcngaagagaaggaacaaagaagcttgaaatcatctttactgtttttgatttctttntctctgtcctgtgtgcgtaaaaaaaatacaatggcagtgttcttggctgtataagcc

SEQ ID NO: 14503 - DNA, 490 bp, Gossypium hirsutum
  Clone ID: uC-gsflnu33B046a08b1
gctcctcacgcgtccgatttcccccccttaaagacaaaaacatattttgtttgttgaatttgaaggtggtagggagatgagtagagcagcgtaagcagttaaaagggcagccaagctaatacctaaacacctctaccctggttccgtccgatataactcttcttattaaattaagtagagacttgatacgcggttgaatagcgtgagaagagacctactattattcctttacgaccgccattaacatccatctatcttagccattaagatctctctaattccaattttcttcttcccagtttggagtgagaatagtacccagaaaccaatcatgagtgagatgaaagataaattgaagggcttcatgaagaaagtcaacacccagttctcttcttcgtcttcttcttcttcttcttctggtaaattcaagggccaaggtcgagtcttgggttcctcttcttcttctggacctgttaaccccatgcttacc

SEQ ID NO: 14504 - DNA, 283 bp, Gossypium hirsutum
  Clone ID: uC-gsflnu33B046a09b1
atcctcacgcgtccgtatatcaccgttttgcagcaatgagaaagctgatgaggttgaagaatttttcgaaagccgtgtgacttcttcatttgcaatgaatttgaagcaaagcattgagcaggttcggatcaaagcaaggctggttgaaagcataaagcaggagcggcaacctcttcaagacctactcaagcaattagtttgtaagggatgataacttcagctgttatctcaatgtataatatatttatatgtactaaagcataaaggcttgacattttgtctg

SEQ ID NO: 14505 - DNA, 485 bp, Gossypium hirsutum
  unsure (1)..(485): unsure at all n locations
  Clone ID: uC-gsflnu33B046a11b1
tgccgggaactttcattttgcacctgggaaaagctttcagcaatcgaatgttcatgtacatgacttgctagcttttcaaaaggacagttttaatctaagtcacaagatcaatagattagctttcggagattacttccccggggtcgtgaatcctcttgatagtgttcattggactcaagaacagccaagtgggatgtaccagtactttctcaaggttgtccctaccgtgtacacagatgtgagtgggcacactatccaatcaaatcagttttctgtaacggagcattttaagggtgcagaagtaggccggcttcaatccctacctggagttttcttcttttatgacctttctcctatcaaggtgacttttacagagcagcatgtctcgttcttgcactgtctaacaatgtttgtgctatagttgaggtgtttttactgttttnggaatattagactcttttatataccatggtcaaaaaagcatc

SEQ ID NO: 14506 - DNA, 467 bp, Gossypium hirsutum
  Clone ID: uC-gsflnu33B046b01b1
ccctctcgtccggaatatcaagttctcactcaaagcttttgcccgactgagtcactctcagccaacgcactataaaccacttgtacctaccattgcagatcagctctgtcaatcaaaccagcaaatataacatcctttcccttctcttttaatctttcttgtcttctctttcacctcgctttgttgtccatcagttgaggattcttgtcagcaaataacgcatggcagaggaagaacccaagaaggttgaaaccgtaaccccctcggagcaaccacctcccgaagcccccaaagacgttgcggaggaaaaatccgtaatcccgcctcctgcctctgaagaaaaacctgctgagtccgccgcactccaaaaggccgcggaaccgactgaggaaaagagcacggagagtactgtggaccgagatactgtgcttgctagagttgcgacagagaagcgaatatcactgatc

SEQ ID NO: 14507 - DNA, 428 bp, Gossypium hirsutum
  Clone ID: uC-gsflnu33B046b02b1
gcgctttctcgtgcggaaacgttgaccccgttttatcaaggacataagaacactagttacttaaaccctgttttcgtagggcagcaatttgttagacttggtgctgatgagacatcggagtttaatgaagacagggttaatggggtttatgatatcgatgtgaagttgtatttgaggattaggtttaagcttgggagggtcaaaactggtaggtttaagcctagaatttcatgtgatttgaaggttcctttgaacactgggaatggtagcttcggtggtacgtttaaaaccactagatgtgatttggatttctagtatgaatctgattcatgctttggtccagtctgtgattctatcttcattcagggatgtatacattttgttcttgtttttgctataggtatgtgaatatatgttgatttttggcg

SEQ ID NO: 14508 - DNA, 465 bp, Gossypium hirsutum
  Clone ID: uC-gsflnu33B046b03b1
gctctttcgtccggagatgaccgctgagatgctcgattacaagatccacgctgtctacaactctttgtacagcacacctacatgttatgggattcatatgtgcggactgctgtttgaagaccttttgctgcagggaggactggaagaggtcgacaagaagaaccacatgaaagccggtgtcttgtacaatgccatcggtgaatgcagaggattctacaggagccctgttgagaaatctgtgagggcaatgatgactgtgccattcacattgtagaagtctgagttggaggctgaggtcttaaaggaagccatgaaggagatgatggtgcatctgaagggacataggtcgctggcaggcatgcgagctgccatgtataatgctatgcctgtggcgggagttgagaagatgaatgctttcatgaaagattatccggcaaagcatgctcgatccatgtcaattgctat

SEQ ID NO: 14509 - DNA, 504 bp, Gossypium hirsutum
  unsure (1)..(504): unsure at all n locations
  Clone ID: uC-gsflnu33B046b04b1
cctactcgtgcgtaacatcccaaaaatccaacccaaagtcacttccttccatcgagctacaaccaaaagaaaaagaatgggaaataaagcctccactgccaaaatcattgaaatgcagtcggcgagtcagtggagagcccagctagaggcctccaagcaaactggtgatagatttctcggcgacctggtgcggaccctgcaaatggatggaaccggtgattgaagaatatgccaacttatatgatgatgttgagttcatcaagatcgatgttgataccttggaggatgtggctcgtcaattcaaagttgaagcaatgccgaccttcgttcttgttaagaaaggcaaagaaatatgcaggctggtgggtgctaaaaagactgaactccagaagcgtattgagaaacacaggtttgataattagcttgtttttgggggggcaaactataaatatngggtgacgaataagcttattgaagggtttcactttcttttttttgtatcca

SEQ ID NO: 14510 - DNA, 89 bp, Gossypium hirsutum
  Clone ID: uC-gsflnu33B046b06b1
tcctcatttcctacaccagtagggacggcatctgggaccgtttgggtgtgcaccaaaacagactcaccagttcggactctggaccgggc

SEQ ID NO: 14511 - DNA, 424 bp, Gossypium hirsutum
  Clone ID: uC-gsflnu33B046b08b1
tctatgcgtgcggaaacgttgaccccgttttatcaaggacatatgaacactagttacttaaaccctgttttcgtagggcagcaatttggtagacttggtgctgatgagacatcggagtttaatgaagacagggttaatggggtttatgatatcgatgtgaagttgtatttgaggattaggtttaagcttgggagggtcaaaactggtaggtttaagcctagaatttcatgtgatttgaaggttcctttgaacactgggaatggtagcttcagtggtacgtttaaaaccactagatgtgatttggatttctagcatgaatctgattcatgcttttggccagtctgtgattctatcttcattcagggatgtatacattttgttcttgtttttggttacgcatgtgaatatatgttgatttttggcg

SEQ ID NO: 14512 - DNA, 91 bp, Gossypium hirsutum
  Clone ID: uC-gsflnu33B046b11b1
tctttcacgtccgaatgcgcgatccacaatatgggggctgaatttggtccgcgtccagtgccctgtgtacctgaaaccgaataacagatgt

SEQ ID NO: 14513 - DNA, 408 bp, Gossypium hirsutum
  Clone ID: uC-gsflnu33B046b12b1
ccgaaggtggatatgttggaaggtgtttccattgttcgatccgagaaggttaaggatgagattgttttggatggtaatgacatcgaacttgtatcccgatctgcagctttgataaaccagaaatgccatgtgaagaacacggatattagaaagttccttgatggtatctatgttagtgagaagggaagggtcgccgaagaagaatgaatactatctccctgaatcatagttatagtgctgctttatttttttgtcgtagtaatattttgggactccgatttttgtcttgactttcctgtttccatggattgcaactgttacagagtacaaggatgttatctttatttgtttggagaattttggatatctgattaatctttagtactcgaattattcccccaaagaaga

SEQ ID NO: 14514 - DNA, 311 bp, Gossypium hirsutum
  Clone ID: uC-gsflnu33B046c01b1
cttaaaatgaaggttactatgggaatacagagaactccaatgagttcaactccatggaagagtttcagaacaaggaagatcagtacatggagaggcaagaagagtatgtgccctagatatttgattatcatgattcaagaatgaaaaaggaaacaggagtttgacatatatagtggttcatatatttaaagatgaggaagattgaagtttatgaagtctttcctgtgttttattattttatagcattcacttgtgtttgcacaatagttcatgctttacaaatcaaaatggatccaagactatacagtttc

SEQ ID NO: 14515 - DNA, 524 bp, Gossypium hirsutum
  unsure (1)..(524): unsure at all n locations
  Clone ID: uC-gsflnu33B046c02b1
catagcttcgtcttccactgtttatccccattaagcttctctgtttcttttaatcgtaatatttagggtaagtttcgatttttggcggggaaatatgtctggaaaaggcgccaaaggtttgataatgggcaaaaactcggcttctaacaaggacaaagacaagaaaaaacccatctctcgttcttctcgagctggtctccagtttcctgtgggtcgtatccaccgtcttctaaagttaaggaccactgcacacgggcgagtaggagccactgccgcggtttattccgctgctattctcgaatacttgactgcagaggtgttggagttggccggtaatgcaagcaaggatctcaaggtgaaacgtattactccccggcatttgcagctcgccatccgtggtgacgaggagctcgatactctgatcaagggaaccattgctggcggtggtgtgatccctcatatgcataagtcactcatcaacagatcatcccaggagtagactatataacgngtatatatatgta

SEQ ID NO: 14516 - DNA, 253 bp, Gossypium hirsutum
  Clone ID: uC-gsflnu33B046c03b1
agtgcaaggaattgcaatggaggtgcattgagggatacaaagaccgtcttaacttctttctcctgaactgttgtgttatggtagcttgaactttgtagtttgttgtattggttaccatatagtgtttacttaatttgctgaataaaagatggattgtgtagggtaaggggagtgagttgtaagaaacttttttgtctttgtcatgtggtgtgtgcttttcactcggtcccttctgaaaaaaattaactgtgtg

SEQ ID NO: 14517 - DNA, 452 bp, Gossypium hirsutum
  Clone ID: uC-gsflnu33B046c04b1
atttcacgccttattgcagttgccacagatgcgagatccaatatggacggcgcgctgaagtccttccatatgttgatcaggagcagatatctttctaatgacttaccaacgccacctacatggaacagcatcgcctgtttagacaaactatcaacgctgagatgaaaataccagtgcccataaacagctgtacaagcctacaactttaattggcgacccttacaagtacaacatctttcctactgtaccagctcagcagaatgtgactccaccacccacactataccatacacatcctgaatgcgtgacagagaatgacagtctgacaagattttcctttacaggctcccaagaaatcaaccgccacagcacatcaaaccgtgcacatattagcgtctgatattgcacattattattgtgtgctcctacattcatgatgcccatactccatt

SEQ ID NO: 14518 - DNA, 457 bp, Gossypium hirsutum
  Clone ID: uC-gsflnu33B046c05b1
ttttctggtttgccttcccttgagggtggtcctcacaatcaccagattggtgccctggctgttgccttgaaacagtccatgacacctgggttcaaggcatatgctgaacacgtgaaggccaatgcagttgcccttggaaagtacctgatgggcaagggataccagcttgctactggtggaactgagaaccaccttgttctttgggatctccgacctcttggattgactggcaacaaggttgagaagctgtgtgacctatgcaacatcactgttaacaagaatgctgtttttggtgacagcagtgccttggctccgggaggtgtactaaatggtacacctgacatgacttcaaggggtttggttgagaaggacttagaacagataggctagagccttcaccctgccgtgacaatcactttgtacatccaaaagcaatatggtaagcttttgaaggact

SEQ ID NO: 14519 - DNA, 565 bp, Gossypium hirsutum
  Clone ID: uC-gsflnu33B046c06b1
tccattcgtccggccaggttcaggttcagctgagggttgttggattattttcagataacataagatggcagctgcaatgaaactcatctctgttatgggattgaattgtgcttattagcctgggaaaggtgggtgatgcagcaggggaatgtgggaaatcatcttctgataatgaggcaatgaagctagccccatgtgctgaagctgcacaagatgagaatgcccctgtttcagccagttgctgcgcccaggtgaggaaaatcggccaaagtccgaaatgtctctgtgccgttatgctctctaacactgctaaagcatctggtatcaagcctgagattgccgtaaccattcctaaacgctgcaacatatgcaaccgtccagtcggttacaaaagtggagcatatacacttccttgaaaggaaaacttgggagacataaaaagtgctggagctcacttgttgtaccacttaatatgtagcttaagcttacctttgtttgataacagcttaaagcatgtttttattatatccaatcttgaattcaataaatcatcatgttttgcttt

SEQ ID NO: 14520 - DNA, 345 bp, Gossypium hirsutum
  Clone ID: uC-gsflnu33B046c07b1
ttctcgcgtgcgcccacgcgaacggcctgaagacgcttttgtgaggaataagacccaactcccccttagagactagacagtacagcgctgatgtaagcctacaatacccattttattggagctaacaagaagctgtctaacccacggagggagacaaaagttcaaaaacttgacctcaacatttacataagtgaaagtgctgaccgtataacccgtgccgacaaggtcaagaaacaactaaaaggacaaacccgcgcgcacttaaaaactagttacaatgctagatggttcctaagacgggctcttgagaagagtgctagctacatgactgttagtggagagaaa

SEQ ID NO: 14521 - DNA, 467 bp, Gossypium hirsutum
  Clone ID: uC-gsflnu33B046c09b1
tcgttattcggggtctcaaaaggaataaaacgtggggaaaaactataatgatcacttaaacccgattcacataacgcattgtcactcgcaatgggagagaaaaagatcggaaacaagcaaggaggaggggatgggaaaacgaaggaaaagagttcttcaacctctgagttcaaatttgagtgtttctgagatggttgtgcttccaaaatcctcaaatgcattaatcactttgaagggggggagacggtgaaaccagagatgagttcaaacaaagtgacggtgataggaactgaggatcccactggcttgaaagagaaactcgaccagaaaactaagaagagagttgagctcatttcttctcaacccaagaaagatgataacatagaggaaacagaagagaaaaaacctgaccaacagaaaaaccaggattctggtaagtaatcagacaaaaaacccaaagaggcccc

SEQ ID NO: 14522 - DNA, 520 bp, Gossypium hirsutum
  unsure (1)..(520): unsure at all n locations
  Clone ID: uC-gsflnu33B046d01b1
ctctcaccgattatcaatgaccgtgaatctggaagatcccgaggctttgggttcgtaactttccgtgacgagaaatctatgagagacgctattgaaggaatgaacggtcagaatcttgacggaaggaacattaccgtaaacgaagcccaatcacgccgaagcggtggaggcggcggtgaaggatacggaggaggaagcggaggctacaaaagaagtggaggaggcggaggatatggtcgccgtgaaggaggctatggaggtggccgtcgtgagggtgtattcgggaatggtggaggatatgacggcggaggcggtggtggcggatatggcggaggcggtggcggatatggaggcggtggcggatatggcggcggtggcggtggtggaatgggggttgacgctgagatggtgggtctcgttactcgaggaggcggagcgtctgatgtgagctggaagacttanggtcgtagggttagcatttaagtgagctttgggctttgctttttcagttggatgatga

SEQ ID NO: 14523 - DNA, 589 bp, Gossypium hirsutum
  Clone ID: uC-gsflnu33B046d03b1
attttctacaagccggcgaggaaaggaaaacctgagagggtgaaaaatgccagctggtcacggtctccgatctcggactagggatctgttttccagacccttcagaaagaagggttacatcccattgtccacttacctcaggacctacaagatcggtgactatgttgacgtcaaggtaaatggtgccgttcacaagggtatgccccacaagttctaccatggccgcactggtcgtgtctggaacgttaccaagcgcgccatcggcgttgaggtcaacaagcaggttggtaaccggattataaggaagaggattcatgtcagagtggagcatgttcaaccttcaaggtgcactgaggaattcaagctgaggaagctgaaaaatgatcagcttaaggcagaggccaaggccaggggtgaggtgattagcacaaagaggcagcctgagggcccaaaacctggtttcatggtcgagggtgcgatgttggaaactgttactcccattccatacgatgttgttaatgatctcaagggtggctactagttctactctgtttttttggcttgtgttttggttaccctttgataacta

SEQ ID NO: 14524 - DNA, 370 bp, Gossypium hirsutum
  Clone ID: uC-gsflnu33B046d05b1
tcttatctgagctagagaccgctgataaagccgctgatgaactaccgaaggatgggaaggctgtaagggtagtctcccttgacatcatgggagctctttgatgagcaatcaattgcctacaaggaaagtgttttcccatctgctgaacacctagagtgagtattgaggctggatcaacaattgcgtgggtgaagatagttggactccaaagggaaggcaatcggaattgatctgtttgtggcaagtgcaccagctgggagaatttacaatgaaattgtcttaactccatacgcaattattgctgcagtcaaagaaccttctctaagcttggttcataaatctttgaggaaacttttatgctaataattga

SEQ ID NO: 14525 - DNA, 75 bp, Gossypium hirsutum
  Clone ID: uC-gsflnu33B046d07b1
ctctatagtaaaggagggaagcccacacgggggatccctctttgtataagtatcccgtgatgatcacccttgggg

SEQ ID NO: 14526 - DNA, 52 bp, Gossypium hirsutum
  Clone ID: uC-gsflnu33B046d08b1
actctatgcagtgctaccacagacggggggactgcattgtttggataagacc

SEQ ID NO: 14527 - DNA, 452 bp, Gossypium hirsutum
  Clone ID: uC-gsflnu33B046d11b1
tcgtcatatttggggtaaatatgtcaacatacttgaggacttgaaatacgaggataactcactcaaggcagtgcagtgcttgaatgacatggtcactaatgctttaatacatgtggatgattgcctaaaatacattgtctgctttacgagatcctgcaatctttcgattttgtgctatacctcaggtcatggctatcggaacactaaccttatgctacaacaacatcgaagtcttcagaggcgtagtgaaaatgaggcgtggactcactgcgaaagtcattgtccgaaccatcacgattgttgatgtctatggtgctttctatgatttttcttgtatgatgaaagctaaggtcgacatatacgatccttgtgcacaaaaaacatcaccagcacttgatttgactctaagacttgcagggacccaggggtcccgaatgaaaggaaatctttct

SEQ ID NO: 14528 - DNA, 494 bp, Gossypium hirsutum
  Clone ID: uC-gsflnu33B046d12b1
aagctaaggctgctgaggaatcggagaaagcaaaggtggaggtaaaggatgagaccccggaggtgcagacagaaacagttacagaggaggccaaagttttagacccatagaacccgcggtggaagcagcggtggaggagaaaccagcggaggaggaaaagggagatgaaaaagctgacgagattcctgttgagaaagttgaataatagagcgaccaataccatacgtaaggtggcaaaagcttaaaggagcttctttttattataggctgtatgtcatagttggcggagtcatactactattatttatgattactatgtcggatgtgggatgatgagggctttctttttctttaatggatgttattctgctttggggtttgatatagagtattgaacttccttttgggtccaggggtcaacatgttgatggaagaaactatacgttttccattttgaatggtatggtgtatgtatgcatgtttgcatgcatgca

SEQ ID NO: 14529 - DNA, 613 bp, Gossypium hirsutum
  Clone ID: uC-gsflnu33B046e01b1
cttactcgtgcgcccacgcgtgcgcccacgcgtgcgatatactagctatggcgagtacataggttaaatttaattgtgaacataagtgaacctaattgtagaatctaaatacttttgttaattttataaattttattaaaataaaatgggtttaagatcaaataacccatatttaattattcttaaattctcaaaatatcaaaatgtaaaacagtatcgataccagaataaagatatcgacactttgataaaggtatcgatactttaagcaaagtcaagatactttaagtaaacatattcatcaaaacagtttggatagcagtagtggtccaaatttgaaaattcaccaaaaatcgtagagatagatatagaggttgaattaaatatggaattagaacttaatgagtctagtttttcataaaagaaacggtgtaagcaatagaattgtagattatgagatatatggattttagtgagacaatatcagaattattttgggttctcttgttctagctttgaaaattatagtaaattgtacaaatattttaggagatgaaatcatttgaataaagtttagcaaactatttttaggaaaacaaatggaacttaataa

SEQ ID NO: 14530 - DNA, 535 bp, Gossypium hirsutum
  Clone ID: uC-gsflnu33B046e02b1
ctttcttgcattttttaagccctagttgcattttaaatctaaccaaataaacatgggttcacctcccatggttgtggccgtccgtttgccccaagtctctgttatgacctttgctttttgatggactctgtttgctgttatctttggttggtgaagttcccttgctcttatggagttaagatgttggcacctctccggggtttcatcgtatctgaagatttagcatctggtggctgttgtagccgatgtttggctttggctccacctctatcggtggtctagcaaatgccaaggcaactttgggattgattttttggggcttcatggtgacatggcctttaccagaggcgtgcaacagcctctctttttgtttcccggtgctctctccctccagtggcttgtggggtagtgggtttggttggactttgcttgttgtacctttctgggtatcggacctttttgctgtaaatttcatcacctttctgggtaatcggcccttttgctgtaaattcatctcatttgaacccaaaagaaa

SEQ ID NO: 14531 - DNA, 517 bp, Gossypium hirsutum
  Clone ID: uC-gsflnu33B046e03b1
cccacttcgtccgcttcaattcctcatttcaagggagagagtgtatcagtgtttcttcccctctttacttaatttctctccgccatggctctctccgtcgagaaaaccgtcgccggccgtgagtacaaggtcaaagacatgtctcaggctgacttcggtcgtctcgagatcgagttagctgaggttgaaatgcctggtttaatggcttgtagaaccgagttcggccctgcccaacctttcaaaggagccaaaattactggttctgttcacatgaccatccaaaccgccgttcttattgaaacccttaccgccctcggagctgaagtccgttggtgttcttgcaacattttctgtacccaagaccacgctgccgctgccatcgctcgtgactccgagcgtgttttcgcttggaaaggggagaccctccaggaatactggtggtgtactgagagagcccttgattggtgtcctactggtggacctgatctgaacgtcgatgatggtggtgatgctactt

SEQ ID NO: 14532 - DNA, 64 bp, Gossypium hirsutum
  Clone ID: uC-gsflnu33B046e05b1
ataaaacaaagcaaagatacaagaaaaagcggaataattaaaacaacgttgggggtcctaccga

SEQ ID NO: 14533 - DNA, 91 bp, Gossypium hirsutum
  Clone ID: uC-gsflnu33B046e06b1
tcataattaagtgcaaagcaataagaagacacaagaggactattaaaaagataatgggcgtccgtgccaggggatccaagctcacatccgc

SEQ ID NO: 14534 - DNA, 199 bp, Gossypium hirsutum
  Clone ID: uC-gsflnu33B046e11b1
tttttcacctcccagcgtgcaaaggcaaccaggggagacatgctgacaacgaagggggccctacccaaaacaatgactaaaaacaaggcttccgagcgaacaatttcaacacaaggactcctataaaaacaaaaaaacccgacccaaaaattacaaggttgagaactgagaaaacctcggaccaaccgaaattaataaa

SEQ ID NO: 14535 - DNA, 108 bp, Gossypium hirsutum
  Clone ID: uC-gsflnu33B046e12b1
ctctcgcgcccgaacacgcgtccgacatagggggagaactattaggataggcccgattaccccaagactaataccctgccaaagaattgattgaacgatgaacaaaac

SEQ ID NO: 14536 - DNA, 502 bp, Gossypium hirsutum
  Clone ID: uC-gsflnu33B046f02b1
ctttcatgcattaatgtcggaaagccaaaacggccgacatatattcctttggagctctgttccctggtgtctttgcaacgttacaccaaagcgttaaccactttccagagagcttctttggttgaaaaatcaagacagaagcctcaggaaagaatgacagtcttatccagtgctttacagaggagcaactatggtgctgagccaatgctgcgttcttgtggtatttctatcagcactaatttcacccaagtcgaaggtcgtgttctgccagcgccaaggttaaaagtggggaatggtgaagatttctttcctcggaacgggagatggaattttaataacaagaaattagtggagccaactaagattgaaagatgggctgttgtcaacttctctgaccgatgtgatacgaatagccttgatccggatctgattagatgtggagacatgaaaggaattcggatagaccctccatttgatgtgttccaagagtgcaatcagaaca

SEQ ID NO: 14537 - DNA, 312 bp, Gossypium hirsutum
  Clone ID: uC-gsflnu33B046f03b1
gttgttcggaggaagggaagccagctgttgtgttgttgatttttttttagtttgggttactgtttgggtttggggctgttaattgggccgagcaatttgggcttgtgcaccatgaactgtatatatggtcaaaggacgttgaatagtgggtagacttgttgcataaatattgccatgatgttttggatactttcatagcttaattgttcttaggaattttggacttggaccttaatatgttgattcttgctcggccaaaataaaaaaaaaaaaaaaaaataaaaactgaacaaaaaaaatgagttaataaaa

SEQ ID NO: 14538 - DNA, 448 bp, Gossypium hirsutum
  Clone ID: uC-gsflnu33B046f06b1
ctttctcgtccgtccacgcgtccggccggagataagaagaagattaaagcctagaagagtgtctagacctacaagatctacatcttcaaggtcctgaagcaagtccatccagatatcgctatcttaagcaaagctatgggaattatgaacaggttcatcaatgacatctacgagaaactcgcccaagagtcttcaagactggcaaggtacaacaagaagcccaccatcacttccagggaaatccagacctgtgttagacttgatcttcctggagaacttgcgaaacacgccgtttccgaaggcaccaaagccgtgaccaaattgacctaggtcttgaatttgatggaatttgggaatttaaggatagtgttttgccctccattttagcaaggtaggtttgatgaccgttaagacttgtgtcacttatggattttataaggaagaccct

SEQ ID NO: 14539 - DNA, 335 bp, Gossypium hirsutum
  Clone ID: uC-gsflnu33B046f07b1
tcctatcgtgcggaagggaaagggaaccgagggtccattgtaatgaggtggcttgatgaccattcccctcaaatagagttccaaagtaagatatttactgctgtgaatatactctatggacgaaaaacttgtcaaattattagccttagtgtttatggattgttcagaaggctggatatgacacttctagggattcagcaaatcttgctactgggcattaccattgcatctctgaatgtaccaatctctatacttgacggagatcatatataatgtctagcactttttgaagtgaagaagctgatgaagaaacacaagatgcactaagtaatgat

SEQ ID NO: 14540 - DNA, 387 bp, Gossypium hirsutum
  Clone ID: uC-gsflnu33B046f08b1
ttctttaaccctctgaaaaaacaatcctcctgccgacagatactaaagtcttgaatttgctcgcttggggcttgtaacgaaggacaagaaaaatatcgcctatgacagaacagctacctgcatagatatcctcacagacaccattttgcctactgtcggtgtcttcctcaactttgcatgccagctacaattctggatatcccatgctctcaccctgtgtgggtacattcctggctttatttatcctatctatgccatcaccaagtacacctctaatgccgtacttgtgatatgtggagaattgctgtccgattctcggtatgattgaatttgattacgcgatagtattttatgcccactaatatttaggatgttcatttgatggcg

SEQ ID NO: 14541 - DNA, 494 bp, Gossypium hirsutum
  Clone ID: uC-gsflnu33B046f09b1
catggatgcccctaagagttgtacgcctgaagaagttgccactgtgaatgtaatatctgcaaaagatttgcttggatcaaactactgctatctggatgtgaggacacccgaggagttcagtaaaagtcatattgaccatgctttcaatgttccttacatgttcatcacacaagaaggtaaagtgaaaaatccagagttcctgaaggaggtctccttaatcttgaaaaaggatgatcacataattgtgggttgcaacagtggaggacgaggtgtcctagcttgtgttgatcttatcgaggctggctatgagaatgtgagtaacatggaaggtggttattcagcttgggtcgacgctggactcacatttgtcggtgagaaacctgctgaagagcttaaaagcaaatttcgcccttaattgaaattaaattccaccttcgtatcaatgggtgggaaaataaataaatcaaaatcatgtccaatttgccatactatat

SEQ ID NO: 14542 - DNA, 412 bp, Gossypium hirsutum
  Clone ID: uC-gsflnu33B046f10b1
gttctttcacttcgtgtggatcacactcgagttgtggacattatgagaaaggctggccatttacgtcttgagaagccatacatggttgctgtatcagagcaacaatgtattcggagttaacgatgcattgaatgagatttatgtggacgaagaagattatgatagattaagagaatctattgattagcatgataactttgatcagattggacttgcacaaaagattgagaaacatgagctgcttgaaatgaggcgtgttgctgcatacatttacaaaaaggcaggcagatggaagcagtacattgccttgtcaaagaatgacaaccattacagatatgcaatggaaacagctttacagtctggtgaacgtgaacttgcctgggagctgcttgtttaccttattgaacagggc

SEQ ID NO: 14543 - DNA, 378 bp, Gossypium hirsutum
  Clone ID: uC-gsflnu33B046f11b1
tgctgattgggggagctgaaaacctattatttcatcaacatattgaaaattaaaaaaaatcgaacggcgataatctctggcgatggatcgaccgacggcgataggcaccacgaacagatcgttattagcgatgtcctgcatgacaaccaccgtgacgatcgagaacacctggggcgcgttctcctcgtcgtcgcagcctcaagaagccctcgtcctcgaactccgccctaggaagaagaaagttacgtggaaagaaggcaccgtggacaacgaattcatgaacaagaaggagtccaagagctgttgtatataccataaagaaaagcccttctacgaagacgacagtgatgacgacggacatgaccattatcatcaccg

SEQ ID NO: 14544 - DNA, 51 bp, Gossypium hirsutum
  Clone ID: uC-gsflnu33B046g02b1
ctgactcgtgggatttgaaggaaatggaggttttaatttttcttttgcctt

SEQ ID NO: 14545 - DNA, 457 bp, Gossypium hirsutum
  Clone ID: uC-gsflnu33B046g03b1
gttggtcgcattgagaagtggattcttaggagggccttcgatgatgaagagcatccctatctgccaaagcatatcctttacagacagaaagaacagtttagtgatggtgtgggttatagttggatagatggtctcaaagcacatgctgaccaacatgtaaccaataagatgatgcgtaacgcatctaacatcttgcctcacaacacaccaatgacaaaagaagcttactactacaggatgattttcgagagattcttccctcagaattcggcaagattgaccgtacctggaggagctaccgtagcatgcagcactgctaaagcagttgagtgggatgctgcctggaagaataaccttgacccttcaggcagggctgccctgggagtccatctctctgcttacaatgccgagactccactcagcaacatgccatgccaggttatcgacaatataccac

SEQ ID NO: 14546 - DNA, 451 bp, Gossypium hirsutum
  Clone ID: uC-gsflnu33B046g04b1
gttgttccatgggggtgacgaaggaacaggtggggtgttcattgacttgaaaattgaagccttctcatctggaagtaatcgatacatctggagggtgcggtgcaggtgtggttattgagattgtatcggagcaatttgaagggacgagactactggaaaggcaccgaattgtgaatgctgctctggaggaggagattgagcaaatccatgccctgtatataaagaaagctctgaccccggagcagtggaaacaacagcctgaggctgaaaaagctaaaccagatgcttagagagacactgaagactgtaatttagacattggaataagagttcatgagaactgagctggaatactaagccatcatttcacctttagcatgcattgtagaaccatacttgagaatgactgattacttgcccacagaggcgtttgggatgcatgaacactaca

SEQ ID NO: 14547 - DNA, 515 bp, Gossypium hirsutum
  Clone ID: uC-gsflnu33B046g05b1
gctactcgtccgaaaaggtttcgattcatagagggaaaacctaaaaaaccagaaacatcaaccacaaagcgaaacgatgaaggtcatccctttaattttgatgggttgtggaggtgttggacgccaacttctgcaacacattgtttcctgcagatcacttgacgccaagcagggagttcatttacgagttgtgggagtatctgatagcaaatcactaatcattgcatcagatgttaaacaaaaagagttggatgataacattttagctgaagtttgtagggtaaaatcagatggttcttcattgtccaaacttactagcttaggtgagtctcaagtgttctccaattcagaatcaaggacaaaagtgctagacattgcatcaattcttggaaaatcaacaggtttagcccttgtagattgctcggccagttctgagacgattggagtgctaaaggaaggggtcaacttgtgatgctgtgtagttctagcaaataaagaaccttttacatgaacac

SEQ ID NO: 14548 - DNA, 370 bp, Gossypium hirsutum
  Clone ID: uC-gsflnu33B046g09b1
gttgttacgcgtccgcgcacagagtgccatgactggggagaacaagatccgttcgagaacatatggagcgaaccacccagagatgcatacttgaattgaacatcaacactggtagtagcagtccacgtaagaatatgtttaaagctgtcacaacatataaacctatctatatttcacaacatccatgaaatggatgttgatgctttctatagaataattgcttatgaatgagctgatcatgttatgaccatgtttgatacaaactccattggtgctctgtgctttatagggaagaacatcgtgatgcgcttcaaagattacagttaatgctaatttacctattttctgttattgcacgtatgaaatgtct

SEQ ID NO: 14549 - DNA, 347 bp, Gossypium hirsutum
  Clone ID: uC-gsflnu33B046g10b1
tcgtctcgcgtccgatggaactgacacgagtggggcaaattatatgtggaccttacaaaagatgatgggaagcttagccatgggatgggctctgctcaatctgatggtttaaaacataatagtgcctcacatttgatgcaatatgctctgtaatgttgcattcatttgcttatttctgccttgtttttctcgtattctatgggctgatgtctcatatgggacttttctactagagagcctacgtttctttaccattatattggaatctttgagacattattatttttttaccttttgaggacactctttttttgtatttgaaggaatttattgtttattttggttgg

SEQ ID NO: 14550 - DNA, 369 bp, Gossypium hirsutum
  Clone ID: uC-gsflnu33B046g11b1
tgttttactataccataataaaaagaatactaggggaaattatcaacaaattatgctacttcagctaacaaaatcaaagtttctttgctcgtacgcaaaccatgaaccctttcttctaacccaagctacctatacttcataaaccttggcttcaaactttgtctcttgcactctccttgctagcctctatagcaagccactgctactacactctccttcgtctcagaaccgatctatcagacaacgactttcccaccttccatagccagaaacagggcagcctgactgccaatacggacgggaaactcctcctacaacgataacattgggcgtcagctcaacaaaacccttaacccaaactcctaaaga

SEQ ID NO: 14551 - DNA, 254 bp, Gossypium hirsutum
  Clone ID: uC-gsflnu33B046g12b1
ttttttgcgcatgaaagtaaaaaaaacaataggggggcacatttaggttagacccctgtactacaagcaactctaaccctaaaacaggccgtagaagcccttaaaacaaacataacttttacatgcaatgctcccttttatttccagacagagggcatgattacaattaagcatgccatgggttcatgtttgcaatcagaaatatttagcgcccctgtctataaacccttaccactttactaaagagatgattg

SEQ ID NO: 14552 - DNA, 378 bp, Gossypium hirsutum
  Clone ID: uC-gsflnu33B046h01b1
cttacgcggccggttcttctcccctttctcccgttctttccctctcctaaactaacgtgtcaaaccacactccctttacctcaaaagctctctccttttcttgttttgtcggaaagaaaatgaatccggctgataacactgaccaccctcagcttgcaactatcaagatccaccacccatcatcccctcaccaccctacctgtgctactacccccaccccaacatccggtgcccgacgtaagatcggggtagccgtggacctctctgatgagtctgcttttgccgagcgttgggctgtccaaaactacctgagacccagtgacaccgagatccttctgcacgtgtaccccactttagtactctttggagctgactggg

SEQ ID NO: 14553 - DNA, 168 bp, Gossypium hirsutum
  Clone ID: uC-gsflnu33B046h02b1
cctctcttggtatgtagccaagcccaagaaaaaaggaacgaggggaagaatcgacaaggaatccataacaaaaaaaaaattgtgaatgaaaaaaaaagcgtgacgagaataattttctcaacccaagaaaaaaggaacgaggggaagaatcgacaaggaatccataac

SEQ ID NO: 14554 - DNA, 409 bp, Gossypium hirsutum
  Clone ID: uC-gsflnu33B046h03b1
cctactgtcgtccgcccacgcgtccggggttttagtttttggggagaaaaaaatgttgggagtatttagcagtgcgatagtgtctccgccggacgagctggtggcggccggttgccgaactccatcacctaagataacggcggatgctctggtgaaacggttccttgagacgaactcctccggcgtgtccatgcagatcggagaccatgtccaattcgcttattctcaccataaagagtctcctttacggcccagatcatttgctgtgaaagatgaaatcttctgcttgtttgagggagcccttgataacttggggagtttaaagcagcaatatggtctggcaaagtcggcaaatgaagtgattttggtcattgaagcttacaagggcccttcgtgacccggcacctta

SEQ ID NO: 14555 - DNA, 272 bp, Gossypium hirsutum
  Clone ID: uC-gsflnu33B046h04b1
ggtctttgttcaaggggagctcctttagcttgttctcacgatatcccctcacagattttgttcctggccctaacataattcgtgaaatggcaatagtgggagggacaggtgcgtttaggatggccaaagggtttgcactatttcgggccagttcatctagcgccaagactggagatgctagtcttaaggttgatgttactttgtaccactactaaacccaattgtaaaatattgaaatttataataaaatcaataaagtggctcaagtgatt

SEQ ID NO: 14556 - DNA, 427 bp, Gossypium hirsutum
  Clone ID: uC-gsflnu33B046h06b1
tccatgcttgcgcccaggcgtgcggaccatgcgggccgttttaatgagtccagcttgcttgctctcccttaaaggaccgacattgtgaagaccgttgaacccatagagccgccatcctgtgcccctgcatgggactaactcagagctgcttgcatgggatggcaaaaatactagaggggagttcttggtgctgatccctttctggggatctgctgccgggctaaaagaaaccaccgtgacccacgccacggtactaagatcaaagctaccagagtcacccacatacatgcactaatcgcaggtagccaacaatgttgatattgagcctactggtggtacccaaagaacaacagaccctcaaggggacctagaccaagtagcttgacgaaggggtgtgctaactaaaaaatttacctttccttattgc

SEQ ID NO: 14557 - DNA, 296 bp, Gossypium hirsutum
  Clone ID: uC-gsflnu33B046h07b1
ttatttggcgtctgaccaagccctggatcctgggggcgcttatctagatctacctggtgttactcatcaacaacatattcttaattttacataatgcctgacgataatgaattttttcacccctgctcaaagatgtcaacggtccagtctctacacggaatccatgccacaaaaaaggttgcgaaaaaagagagcaaaagcagaccatctgatatatggaagctctcgtactcggccccggaacttatgagattgtttaccaggcaaaatgcttgaaaacgggagagactgtttta

SEQ ID NO: 14558 - DNA, 305 bp, Gossypium hirsutum
  Clone ID: uC-gsflnu33B046h08b1
ttattgtctcattgagcatgtattaagcaacaggggaacctctataaggccggctgttgttcccacggatgattatattttgagtttactagatgaaggggcaaagagcaccctttcaggcaactataaaaggcactgggggatgtactcctttgatggccaggctaaatacacactagacctagaatagagaaacaggaggcccatctaacggatccaatgttcacgaatctcccggctagatggcgtattgccaacccgaatagggatcaatgtgaagtggcagaccacatgaaacaacgctt

SEQ ID NO: 14559 - DNA, 52 bp, Gossypium hirsutum
  Clone ID: uC-gsflnu33B046h09b1
ttctttcgcgtccgtccacgcggaccaccacgcgtgcggtattagaacgcga

SEQ ID NO: 14560 - DNA, 499 bp, Gossypium hirsutum
  Clone ID: uC-gsflnu33B046h10b1
ttttgtgcaaaaacagtgagagatgaaatagctggatgcagtgagaaggcatatgattatctttcaattaacgatgcccgacagatgttgcttttctcatctgatcaagaacttttggaatacatcaaagaggagcatcctgattgggaggtgaagaatggatccgtgtatttccagaaggccaaagactctgcaccatgtaaggagatcccatccctacaactgattaaccaaactcttagctatgctagggagttggagcggattgtgtaggcaagttgctatccagtggttgctttttctgctcttaaaagaaaatccatataacttgccatcattttgttgttgtggatttttactttttacattcagtatgcaacttaaaaaagttagttccatttcatatttctagttatatacattagtaacttccaaattgctagaatctgtgttagttggatttcgaaactaatgttggatgtgtttgaatttgccgtgc

SEQ ID NO: 14561 - DNA, 313 bp, Gossypium hirsutum
  Clone ID: uC-gsflnu33B046h11b1
ttgtatcgcgtgggaaaaaatgagactaaataggggggctttattgggacaaaccaacttcaaacggctgctactgctaccactgagtgcactattacaaatgatgcctggtcagaatctagtcttggctctggcgaactacgaaactgctgcggaaacgaacaagattacagaatcagagactttaacgctgactatgccaggcatttatctgaacggacctcttgtgtatcaagccaaccatagccttaggtggatcatcattggggcccctgctaattaggactctactgagacggtctatactaatgac

SEQ ID NO: 14562 - DNA, 334 bp, Gossypium hirsutum
  Clone ID: uC-gsflnu33B046h12b1
tttgcacccaacaaaggatcaacaacggtcgggggcctcttttagggccaacaaatttcccacaagtctcggagcacaaagaatagggcccgagaagacaacaaccgagccagactgtatcgctctagccgacaccatcgcggccagaggcagtaaacacgaatccgcctgcatggctgagcaagagaaatgcaacccaaaggacttaggcctcaaggcaattaggggacaccagatgccagtccaccagattgaggcaagtggaaaaccagcagatgccgaatacgggaggaacccgacaaactgatacaagggtttaactggtacaactcca

SEQ ID NO: 14563 - DNA, 507 bp, Gossypium hirsutum
  Clone ID: uC-gsflnu33B049a01b1
ctttttcaaggtgctgaacctggacctccatatactacaggggaccatcttataaccaatgctggcaaaatggttctcttggacaagctactgccaaagctaaaggagcgtgattctagagttctgatattttctcagatgacaaggttgctggatattcttgaagattatttgatgttccgtgggtacctgtattgtcggattgatggtaatacgggtggagaagaccgtgatgcttctattgaagcctttaataagccaggaagtgagaaatttgttttcttgttatcaactagagctggaggtcttggtattaatcttgctacagcagatgttgtcatcctttatgatagtgactggaatcacaagttgatctgcaagccagaatcgtgctcatagaattggtcaaaagaggaagttcaagtgtttcgcttttgacggagtacactattgaggaaaaggtgatagagagggcctacaaaaagcttgctctagatgctctggtta

SEQ ID NO: 14564 - DNA, 432 bp, Gossypium hirsutum
  Clone ID: uC-gsflnu33B049a04b1
ttcctttctcgattttctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggggggatgcaaatcttcgtgaaaaccttgactggcaagacaatcactctcgaggtcgagagctccgacacgatcgacaaccgtaaagcgaagatccaagacaaggaaggcattcccccaaaccagcaacgttttatctttgccggaaaacaactcgaagacggacgaaccttgggc

SEQ ID NO: 14565 - DNA, 226 bp, Gossypium hirsutum
  Clone ID: uC-gsflnu33B049a05b1
gtcggttcagagccgtgtacgatatgtcgttgggggtacgtgcgagacggattaagactcgggtgtacccgatccgaagatgggagaccgatcagtgctggtaggccaaaaaaaaaaagaagaaaattagggattattcccccctttttttgcaattgatgtttgtacacaaatgttttgtttcatcggcgggaattgagtgaatatacattttttatccccaatt

SEQ ID NO: 14566 - DNA, 440 bp, Gossypium hirsutum
  Clone ID: uC-gsflnu33B049a06b1
cactctctctcctatactcaacttcttccacttaaaagcaagctagctagctagggttttgtgagccagagagatgggtacagaaagaacggcatcactagccctcttctttgcactcaacatcctcttcttttccctggtgagtgcttgtggatcctgcccttcccccaaccccaaacctaaacctaaaccaaagccaaaccccactccctccccatcttcttctggcaagtgccctagagatgctcttaaactcggtgtatgtgctgatttgctcgggggcttgctcaacgtcaccattggtacgcctcctgttcaaccctgctgctctctcatccaaggtcttgcttaacttgaagctgccggttgcctttgcacggaaataaaagctaaaatttgggcataaccttaatgtcccactttcccttagcttgctttta

SEQ ID NO: 14567 - DNA, 437 bp, Gossypium hirsutum
  Clone ID: uC-gsflnu33B049a10b1
tcgtccacgcgtccgcccacgcgtccgttgaagaggaaatatctttgcaagaacgaagccgagttaagagaagcttggtttcccggagatattaactatgcaactagagttcctagtgacatgcttatcgtcacaatcgttctttgctactcggttatagctcctgtgatcatcccatttggagtactttactttgccttgggttggcttgttctccggaatcaggcactcaaagtttatgttccagcatatgagagctatggaagaatgtggcctcacatgcaaatccgaatcattagtgccctgttcttataccaagttaccatgttgggttactttggggtgaagagattctactatactcccatcctgggtccgctcccgatattaattctcgtcttcggctttgcctgtaggaagaaattctatggggtttt

SEQ ID NO: 14568 - DNA, 350 bp, Gossypium hirsutum
  Clone ID: uC-gsflnu33B049a12b1
gtagacattcctgaagaagaagcagtatgcaggatttgcttggttgagctgggtgaaggaggtgagactcttaagatggagtgtagctgtaaaggagagcttgcacttgctcacaaagactgtgcagtgaagtggtttagcatcaaaggaaacaagacatgtgatgtctgcaagcaagatgttcagaatctccctgtaactttattgaaagtgaatgatccaaggattgttatcagacgacctccgactgtgccacagcaggctcaagtttctggttacagggtctggcaggatataccagttctcgacatggtcagcatactggcttactttttgatttcttgaacaac

SEQ ID NO: 14569 - DNA, 279 bp, Gossypium hirsutum
  Clone ID: uC-gsflnu33B049b02b1
aatttccatagttttctgtaaaaattcctaattccggtctataaaataatagtagtagaatccaagcaaatttcatgtaatagcttgtaggcactcctaacggagaactcccctgtcaactcccctctccatacttaaaaatcttcgtgtgctgtctccgctagccgggatcttcagaattttttccgctacatccattcggaaggtattccttatgacctctgttttccagcttctattagtggcttcgattaaatttgaaactaacttagtattaag

SEQ ID NO: 14570 - DNA, 294 bp, Gossypium hirsutum
  Clone ID: uC-gsflnu33B049b03b1
agtcttgagcttagcttttaggtgcatctcttttgtttttgcgagccaaaatggttaagttagcttttggtagctttggtgattctttcagtgtcgggtccctcaaggcttatttggctgaattcattgccaccttgctttttgtctttgctggtgttggatcggctattgcttatggtaagcttactgccgatgcagttctagacccagcgggtttagtggctgaagcactggcttatgcatttgccctcttcgttgggttgtccattgaagccaacatctcatgtggtcttt

SEQ ID NO: 14571 - DNA, 248 bp, Gossypium hirsutum
  Clone ID: uC-gsflnu33B049b05b1
tttactcatgcggggagatatgctcatagtcactacttaaagatagttgattgcttgaaagacctcttacagaggagagaccatctatagtggcagatagggaattgaatcaattaagctactactcagaagtaaagtatgaattagcctgaaactaaatcagcatgtgatatatccatctaacaaagtctaattagagtgtatagaagcattgaacccatgtagtaaacagcggatgtatgcaacct

SEQ ID NO: 14572 - DNA, 305 bp, Gossypium hirsutum
  Clone ID: uC-gsflnu33B049b06b1
ggtcagaagaagaaaaacatctacaggcagattgaaattagagtaattgagaaaaacgcaatggctcaaaagatgttgatgatggcggtccttgtgatattggggacgaagatagcgacatttacggctgcggatccgacttgtttgcagagcttgatgtcttgtgctccttacttcaacaacgccactctccaactgaaaggcgattgctgtaaccctcttagacaagccggcgctactgaacttacttgcctttgcagcctcattaataactctactttgcttagttctttcaacatcaacat

SEQ ID NO: 14573 - DNA, 68 bp, Gossypium hirsutum
  Clone ID: uC-gsflnu33B049b08b1
tgacgacgacattgctaacagtaatacactcggaatggctaatggggctcactctgttagcgttgcat

SEQ ID NO: 14574 - DNA, 282 bp, Gossypium hirsutum
  Clone ID: uC-gsflnu33B049b09b1
ttacccttaaccaccaaaacggatctttggaggttcctttggataaaagagagcgaaggcggcgtgctgactgaaccccccccttaacgtaggatacccttaacccttatccctacccccttatccctaccccttatccctatctcctctttcttctcgttttgaaaaaaaaaaaaaaggaaaaaaaaatgaaagggaaaagctaaaaaatttgttttgtttgagtctagacgtcatcagttgaaacccacagtgctttgctaacctagaatactttttgac

SEQ ID NO: 14575 - DNA, 158 bp, Gossypium hirsutum
  Clone ID: uC-gsflnu33B049b11b1
gatttgcattgagctttttgcgtaagtgaggtttgagtatggggagttgtagggttattggcgctgcgttcttggttttgctccttgtagatttagcttttgctgctaggtcatttaaggctgtaggaaagggaggtggtgctggaggaggaggagga

SEQ ID NO: 14576 - DNA, 511 bp, Gossypium hirsutum
  unsure (1)..(511): unsure at all n locations
  Clone ID: uC-gsflnu33B049c01b1
cccacgcgtccggttcttcttctcctcctgatattgatcctgctcgacctttgacgcaagtcaagaaaaggagtcctttttcatccttctgcccagaatcgcctaatcaaaaatcaatcatggctgtgaccatcaagcgagcggccctcatcgttgccagtcttggcgtcttatcttttatctttggagtcattgccgaaaacaagaagcctgccgctggaactccaatttctggaaaagatgtggttatttgtaagtatccatcggatccttcggtggttctgggctacctatcggttgcatttctgatactatctactctcactggctattggtctctgttttacccctacagaggaaaatctgttccacagttctgttctcttccaaaacactagtttcttcgtcttcttcaacattgcccngtttacagggtggcttagcagccactctgctcttgtggccgacgatcacagagcaccttcacttgatcccgaatgttcatcacaat

SEQ ID NO: 14577 - DNA, 465 bp, Gossypium hirsutum
  Clone ID: uC-gsflnu33B049c03b1
gaaaaaccagagggatcctcgtgatgctgtgcaccatggtggatggatgatgaaaattatctgctggttcattttagtgattttgatgttttttgttccaaacgagattatcagcttctatgagtcagcatcaaagtttggcgcaggactgcttcttttggttcaagtcgtgcttttactcgactttgttcatggatggaatgacaaatgggttggatatgatgagcaattctggtatgttgctctactagttgtttctcttgtttgttatttggcaacatttggcttctcgggacttctcttccacttgttcactccatccggacaagattgtggactcaataccttctttatcgttatgaccttgactcttgttcttttgtttgccatagttgcactgcatcctgcggttggcggtagcattttgccagcttcaggtatatcactgtcctggatgtccctatg

SEQ ID NO: 14578 - DNA, 322 bp, Gossypium hirsutum
  Clone ID: uC-gsflnu33B049c06b1
ctactttttttttgtatcaaggcttttggtgttactcatatattattgaaggagtgatgtcggctcaacaaaatgttcaatatcaaccttccgacatcgtcatatgcagtgcaccgaaaactggaacaacatggttaaagtccctgactttcgccattgtcacaagaaccacctttgatggtttcactaaccctttacttgccaatctatcacatgattgtgtacccttttagaggatgatttagcctaatctttcaccaatcgatgaccctaaaaatcctttgttagccacacaagatccttactcttatttaccaagatc

SEQ ID NO: 14579 - DNA, 440 bp, Gossypium hirsutum
  Clone ID: uC-gsflnu33B049c10b1
tcgtctacgcgtccgaagacgatgggggaaaataaagctacaagggatgcaagcatttgtaggctataaaaaaagagcaaagtagtgaatgcatttcatcactagatttggaaatggagctccttaacgtacccaaactttccatcaatcctttgatttcatctctgattctccttttctcccttttaatttggcttaaactagcaaaaaggaaaaccctgaatttgcctgcatcacctccaaagttaccacttattggcaacatccatcaacttggcaaacttgcccaccgttctctctgggaccttgttaggaaatatggatctctcctacttctacaattggggtataacccaactgtaggggtttcatcacccgacatggttagagaaattgtgggagaccatgacattgttttcgccacagaccaaggaccacag

SEQ ID NO: 14580 - DNA, 476 bp, Gossypium hirsutum
  Clone ID: uC-gsflnu33B049c12b1
tccacgcgtccgcccacgcgtccgcaactatggggaaactggagaggctttgaaggtggacttgttgaaccacccagaatacttagaagacaacgcaaccttggctttccagacagcaatgtggaggtggatgacgccgatgaagaaacaccaaccctcagcccatgacgttttcgttggcaactggaaaccaaccaagaacgacaccttggccaagagggttccaggttttggaaccaccatgaatgttctttatggtgaccaagtttgtggtcaaggtgatagtgattccatgaacaatatgatctctcattacctttattaccttgaccttttgggagttggccgagaagaagctgggcctcatgatatgctcacctgtgaagaacaagaacccttcactggtttttcctcatctgccacatcatcatgaaaaaaagaaacaaactctagtatatgccgatttatttcaattt

SEQ ID NO: 14581 - DNA, 509 bp, Gossypium hirsutum
  Clone ID: uC-gsflnu33B049d01b1
cccacgcgtccgcccacgcgtccgccagccccgcctttctctctttcgtttcccgtctcaatgaatcccttcgcaacggcctctcccagcgccgtccttgggctgagctcgttgaccgttccgccttctccaagcccgagtcattctctgatgctctcgttcgcgtccgcaagaactactcgtatttccgagtcaattacctgtcggtgatcggtctcatccttgccttttcccttctttcccatccgttttcccttctccttctcctcggactcctctgctcctggatcttcctctacctcttccgccctgccgatcagcctctcgttctatttggcgtacattctccgatcgcgagaccctcggctttctcatcatcttcagcgtcttccgttgtctttctcactaccggtggatctcttcttatttctgctctcatggatggagtcggactcgtctgtgccacggcgcctttagggcccctggggatctttcttggacgaacaaga

SEQ ID NO: 14582 - DNA, 419 bp, Gossypium hirsutum
  Clone ID: uC-gsflnu33B049d04b1
tttccatccaaacatcaacagcaatggaagcatctgtcttgacattctcaaggagcagtggagccctgcccttaccatatccaaggtgctgctttcaatatgctcacttctcacagatccaaatcctgatgaccctctggtgcctgagattgctcacatgtataagactgatagagccaaatatgagagcactgctcgctcatggactcagaaatatgcaatgaattaagggtcggtcaggcttaggatgctatgtttgatacctattactaaataatattagtaataacttttttcgtttggatactttgataaagtggtggtgttggtgtaataagctctaaagtctttcagagggtaatttttttttcaatcaagttacttaaaaaatactattataaatatattcgatagttcgt

SEQ ID NO: 14583 - DNA, 414 bp, Gossypium hirsutum
  Clone ID: uC-gsflnu33B049d07b1
gttaaattcctttctcgagcgtttcttttttaactctccagttctcaacgaatccatagaatttcaccaagaagaagaagaagatgtcgtggcaaacatatgtagatgagcacttgatgtgcgaaatcgatggcaaccatctctcctccgccgccatcgtcggccacgatggcagcatttgggcccagagctccaatttccctcagttcaaacaagaagagattaatgccatcatgaatgactttgctgaacctgggtcacttgctccaactggattgtaccttggtggcacaaaatatatgggtgatccaaggcgaacccggatatgttattcgagggaaaaagggatctggaggtattactatttaaaagacaatatggctttgcttcatcgaattacgatgagccaatggc

SEQ ID NO: 14584 - DNA, 134 bp, Gossypium hirsutum
  Clone ID: uC-gsflnu33B049d10b1
atattagcatcccacatatgaggcacaaaatggcactacctatactatgccgagcggactaaggtccataaaccgatgagtttgagggcgcggcggtcgtcgaaaaacccggagcgcgagcccgggcggggcgg

SEQ ID NO: 14585 - DNA, 185 bp, Gossypium hirsutum
  Clone ID: uC-gsflnu33B049e01b1
cttacgcgtccgcccacgcgtccgtttgggacttatatatattcattctccatccaagggttgatgactgagaatggatgatgcaatactatatatttgcattaatttcagactctttctatgtcactgttgctaatgttgtactttgatcaccaaactataatgtgctaaattttaattttttt

SEQ ID NO: 14586 - DNA, 334 bp, Gossypium hirsutum
  Clone ID: uC-gsflnu33B049e03b1
cttatttgtacggaaacataggggttctaattaggactctgccgaccgttatctaatcgcagttatgagcatccgagagaagaaccgcagggagatgtcagagaatgtttttcacagagggttgtttgctacgccaaaaaagatcacaacttggcacaaacacctagaaatcagaagtggcatagctccaaggaatacagctggtgcacagttttaaatgcaaggaatacggaatggagactcttgcttgtatgcatcattactgggaccataccaacgacggcatagaatctttaaggacataccttagatgactccatgggattgactctgc

SEQ ID NO: 14587 - DNA, 432 bp, Gossypium hirsutum
  Clone ID: uC-gsflnu33B049e05b1
gttaatcctttccttgagagtataaaaaaaaattaagaacatgggtgtcactatcaatgctgagattgagtttccagccattgagtttcgttcatcagatttgaagcgaggaaccgatggatggcgccatttgtgcaaaaaggttcaagaggcttgtgagaaattcggttgttttgaggtggtgtatgatacgatatcgacgaaagttcgagaagagacttttgggttgatgaaagaattggtttgaggtcccggtggaacggaaacaaaagaacactagtcccatgccttaccatggctggggttggaccatgcgagcaagtttctatgttgaatgaaggcttctgaattggaaatgccttccaactttgattgtgtaaaaagttttactcaacttatgtggcctgaaggtcacccacacttttgcgacac

SEQ ID NO: 14588 - DNA, 176 bp, Gossypium hirsutum
  Clone ID: uC-gsflnu33B049e06b1
tcgcttatttttccgcccacgcgtccgaatggatcagaatttgtgcccacttatgaagataaagatggtgattggatgttggtcggagatgtaccatgggagatgttcaccaattcttgcaaaaagctgaggatcatgaaaggatcagaagcaagaggcttgggttgagttgtttg

SEQ ID NO: 14589 - DNA, 426 bp, Gossypium hirsutum
  Clone ID: uC-gsflnu33B049e08b1
ctcacgcgtccgcggacgcgtggggggtaagctgcctatgacatggtacccacaagagtatgtctcaaatttgccaatgacggacatggccatgcgttcaagcccaaacagaaactaccctggaagaacctacaagttctacaaaggtccagtagtgtatccgtacggtcacggattgagttacaccaactttgttcataccattgctagtgcacccaaagctgtcacggaccctcttgatggccaccgccattcagggaatgctaccatttcagggaaggcgatcaaagtaaatcatgtgagatgcaacaagctgtcggtagggctttaagtagacgtgaaaaatacgggttccaaggacggaactaacaccatgcttggattctcgaagccacctgctgggcattgggctccacaaaaacagct

SEQ ID NO: 14590 - DNA, 393 bp, Gossypium hirsutum
  Clone ID: uC-gsflnu33B049e09b1
tttttgttctgagcggattgcgaaatatgctttcgagtatgcttatttgaacaaccgaaagaaggttactgctgttcataaggccaacattatgaaacttgctgatggattgttcttagagtcttgccgtgaagttgcaactaagtatccaagtatcaagtataatgaaatcattgtggacaattgttgtatgcaactcgtttcgaagcccgagcaattcgatgtcatggttacccctaatctttatggaaatctggttgcaaatacagcggacggtattgcttgaggcaccggtgtcatgcttggaggcaatgagggagctgaatatgccgtgttcgagcaaggtgcttcagcgggaaatgttggaaaagaaaagatagtagagcaaaagac

SEQ ID NO: 14591 - DNA, 460 bp, Gossypium hirsutum
  Clone ID: uC-gsflnu33B049f01b1
ttccgtttacgatggttacctcaacggacaacttaatgtggctcgtgcattaggggattggcacattgaaggaatgaaagatgcaaatggaggaccactaagtgcagagcctgagcttatgactgcagatctgacggaggaagatgaattcattatcataggatgtgatgggctttgggatgttttccgtagtcaaaatgcagttgattttgctaggcggagacttcaagagcataatgatcctgccatgtgcagtaaggatctggtggatgaagctttgaaaaggaaaagccaggataacttgactgttgttgtggtttgctttcaatccaatccgcccccaaacttggttgccccccgtgcgagagtgcggaggaagctttctgcaaagggattgagagagttgcaagcttgttggatggtttgggaaactaaaatggtgacaaaatgcttactctat

SEQ ID NO: 14592 - DNA, 476 bp, Gossypium hirsutum
  Clone ID: uC-gsflnu33B049f02b1
gtttccgataaaactccaatatcccaaaacaatgggttcaaccggtgaaacccaaatgactcccacccaagtctcggatgaggaagccaacttattcgccatgcaactcaccagtgcctcagtccttccgatggtcctcaagtcggccatagaacttgatttgctggagatcatggccaaagctggcccaggtgctttcctctccccaaaagaattggcttcccagctgcccaccaacaaccccgatgcacctgtcatgctagaccgcatcttgcgcctcctggctacctactccatcctcacttgctccttacgcactcttcctgatggcaaagtggagagactctatggtcttggccctgtctgcaaattcttgaccaagaatgaagatggcgtcactctttccgcctcagtctcatgaatcaagacaaggtccttaaggagagctggtactacttgaaagatgccgtgcttga

SEQ ID NO: 14593 - DNA, 466 bp, Gossypium hirsutum
  Clone ID: uC-gsflnu33B049f05b1
gttagattgtcattcaaacctgaaaaatgggagtagagaagcaagtcatcaggcctggaaccggtcccaaacccacccccggtcagaccgtcaccgttcactgcactggctacgggaaaaatggagatttgtctgagaaattctggagcacaaaggatccagggcagcaacctttctctttccaaattggcaagggctctgttataaaaggatgggatgaaggtgtgatgggaatgcaagtggcagaagttgctcgtcttcggtgctccccagactatgctaatggtgctggtgggttttcttgcatggggaatacagccaaacttcggttctcgaattcgagatttgaagtcctaagtttgaagtgagtagcatgcagtttgctgacttgtcgagaaataaatatgtagcccgaataactcacctgtgatgaacatatatggattttatggggttgattgtttga

SEQ ID NO: 14594 - DNA, 456 bp, Gossypium hirsutum
  Clone ID: uC-gsflnu33B049f06b1
cccacgcgtccgcccacgcgtccgatgaattccaccacgaaacctgccgaaagatcaaggcccttcaccagtatgattgtttgagagctaacaaagcaacatctgcatggggattggaggctcgagtcccattcttagacaagcaattcatcaatgttgccatgtctatagaccctgaatcaaagatgataaaaagggatgaaggacgcattgagaagtggattcttaggagggccttcgatgatgaagagcatccctatctgccaaagcatatcctttacagacagaaagaacagtttagtgattggtgtgggtatagttgataagaatggtctcaaagcacatgctgaccaacatgtaaccaataagatgatgcgtaacgcatttaacattttccctcacacacaccaatgacaaaagaagcttactactacaggatgattttcgagagatttt

SEQ ID NO: 14595 - DNA, 384 bp, Gossypium hirsutum
  Clone ID: uC-gsflnu33B049f10b1
ctgttgtagagagcgccatgaacaagggtgtctgcaagtacggaaaggtcgatatcatgtacaaccatgccgtcactcttgaagccaacgaaacgcgagtgacacaggctagttccgaagacaacaagagagagttcggatcagtgagtgggcgcatatcgagggccaagactgttgacagggccatggtgccattcaagaaaggcggaagactattcactatcagactgggttcaagaataaggttcgggcgcgtcgaggcatacagagagttgaatcaagcgagtgtaacaaagacgaagagcattggcgggctgttaggagagcatggcagatcagtgaactatatttcacgtcatgcgacaatgagtgccaggttgcaaa

SEQ ID NO: 14596 - DNA, 495 bp, Gossypium hirsutum
  Clone ID: uC-gsflnu33B049f12b1
gtttaatcgaaatgcaagacccgacgggttttcaacaaatgaaggcaccggtttttccagagcaggagcagctaaaatgcccgcgctgtgactcaaccaacactaaattctgttactacaacaactacaacttagctcagccccgccatttctgcaagagctgccggcgttattggaccaaaggcggagcccttcggaacatccccgtcggcgggggtacccgcaagaactccaaacgctcctcctcttcctcggacagtagcagccaacccaaacgccagtctaaccccgctccggactcgatccgaaaccaaaatcttcccgactcgtctccgccgccgacgattccgcagcaggttcttctgagctcggcggttcagaattcggtttcgaatgccgaccagacccggatgtatgtcttgtcccttgatcatcaagcaaggaagatgacggatagtggtgggagttttagctcgctgctggcatcgagtgggc

SEQ ID NO: 14597 - DNA, 516 bp, Gossypium hirsutum
  Clone ID: uC-gsflnu33B049g06b1
attccttctcatccatagacctcaacacttcctcttctgggaaacctaaatcctctttctctcgagcccttgtgaaatcgaaccccttggatgtcgaccatggttgccggagtaagagcaaggccaccaccactcaccacaacttcaccagcatggttaagcgatttgtggacaataaatccaaaaccaaggcaatgggtcatgctcagcttctcattccatctgatgtcctagccgaggacctcaagaagacggcaagaaagggagctgctttaaccgtcttgcagaggaagctgttcgggaatggctctgccggtaaggacaggggcaaaaaggaggtgaaagccttgactgaggttaaagaaaacactaggaccttgcttatgggttgagaagtgagacggagctgttgagtgcaaataaagagctccagatggagattgccgagctcaagcttcagtttcagacaagaacacaaggttgagaagctgaaagatttgtgtttgaaacaaaaag

SEQ ID NO: 14598 - DNA, 451 bp, Gossypium hirsutum
  Clone ID: uC-gsflnu33B049g07b1
ttctttgctaaatggcgtgctgtccttaagattagtgctaatgagccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgctagaaggtactcttttgaagcctaacatggtgacccctggttccgactccccgaaaggtgccccagaggttattgctgagtacactggccgtgccttgcagcgtaccgtccctgctgcagaccctgctattgtgttcttgactggggggcaaagtagggaaggaggctacccttaaccttaatgccatgaacaagcttcagaccaagaaa

SEQ ID NO: 14599 - DNA, 437 bp, Gossypium hirsutum
  Clone ID: uC-gsflnu33B049g09b1
cacatacacagacagcggaattagattaattgagaaaaacgcaatggctcaaaagatgttgatgatggcggtccttgtgatattggggacgtcgatggcgaccgttacggttgcaagtccggcttgtttgcagagcttgatgtcttgtgctccttacttcaacaacaccgatgtcacactgccagacgattgctgtaaccctctccaacaagccgtcgctactgaacttatttgcctttgcagcctcttcaacctgccttctttgcttagttcttttgacatcccctacgttggagctattaggatcgccagtcagtgccgtgttcgttgatataatcagcgactgcatcagcgctccttctcctgctcctacaccataagctacttcttgcacatctgctccacccctcaccaggaggttgaagcggaggcgctga

SEQ ID NO: 14600 - DNA, 395 bp, Gossypium hirsutum
  Clone ID: uC-gsflnu33B049g10b1
tcgtgaattcataggtttgatgggtttagtttctcaatctttctaccactctgaccaatacttgatagccttatccataagactatagtttagtagttggcatttagcacacattacacctttttcatacatactttttggtttctctaccttacctcggttagactggtcaaagtttatagagctagcctattgatggtgtatgggccatacccacttcctaggctgtagacgggaggcacagatcttagttctatcgggataactaggtagaaggactatcatccaattatcaaggtgtgcgagccacccgactactggaagaggcggtagcccccccagaaagaaaggaaatttctgtgagaaagctcttactttgtgggacttggattagc

SEQ ID NO: 14601 - DNA, 392 bp, Gossypium hirsutum
  Clone ID: uC-gsflnu33B049g11b1
ttgttcacgcgtccgcacaacagctgcggatccattgcttccctgtttcctgtaatcaaaaaagagagaaaatgaaggttgttgctgcttatttgttggctgtacttggaggcaatgcctctccttcagctgatgatcttaagaacattcttgccagcgttggagctgacgctgaagaggaaaggctccagcttcttttatctgaagtgaagggcaaagatataaccgagcttattgcatctgggagggaaaagcttgcctctgttcccagcggtggtggtgttgctgtggtggcatctgcacccggaggagccgtcgccgccgctcctgctgcagttgagactaagaaggaagagaaagttgaggagaaagaggaatccgatgatgatatg

SEQ ID NO: 14602 - DNA, 504 bp, Gossypium hirsutum
  Clone ID: uC-gsflnu33B049g12b1
tcgattaaaacagcgcagatttctggttgtgagaggaaaggagatatggctgagagtaacgtgaaggtattgggtacatgggcaagcccgttcgtgatgagggtgaaaattgcccttcacctcaaatctgtccgctacgaggacgtggaggaagatttgttggcacccaaaagcgagcttcttcttaaatctaaccctgtttacaagaaaatcccggtcttcttccatgctcataaccctatctgcgagtccctaatcatccttcagtacatcgatgaggtttggaccacctctgcttcttccatcctcccttccgatccctatgaacgttcccaatcccgattttgggctgcctatgtcgacgataagtttttccctgccttaagaagactgttgataggtgcaacggaggaagataaaaaggcagcgtttgctgaagtggtgggaggtacgtgtttgtggaggagctttttgagaggttatcaaagggaaactttctttggt

SEQ ID NO: 14603 - DNA, 428 bp, Gossypium hirsutum
  Clone ID: uC-gsflnu33B049h03b1
atgcgtttgctagttctcccatttctacacgctaccaaagccatgtatccatcatcttcgtctcaaaagcccatgggtcacaccgtgctcacccgacacggtgctgctcccggtttccatctggccagacgccgaccatatcaccatcggagcggaccctaacctcgtcggccactacttctacgacgctgactcctcctctttaactacagagtcaacttgccaagccagttcatccaacgatccgcgagagcctaaatcagctgctgctgctgctcctgcccctcctcatccttctccgcatcatccccatggatcttaccctgcaccttcttcttcctttttggtcagacaacgcatcttccccgccggattccttagtcacctcacatcggaaaacggattttctgttacaatgggcaacagaa

SEQ ID NO: 14604 - DNA, 307 bp, Gossypium hirsutum
  Clone ID: uC-gsflnu33B049h07b1
tcgattgtaaagaatgaagtaaacttgctttggaaccaaggtttattatgatatagctatgctaatggcattgaatccaaaaagtatcaaccaatatcagtttaagattatttattttgtcgcatatagtttgtgcactatgatctttgtccaaggggaagcttttatgtttccactctatccaaaatagcttgctggtgtaagttgatatgcttaggctttcatagcctttatataataaaatttctttctgctcaataaaaaagttcttttgtacagcagtgtactttatatttgttacctattt

SEQ ID NO: 14605 - DNA, 504 bp, Gossypium hirsutum
  Clone ID: uC-gsflnu33B049h08b1
tcgtttacgcgtccggcttgatcaagcaacactggaagatctcctgatacctaatttctcctgttctatggaaacactatataatgttgactgtgtgcagcaaattcttgaacattttcttgcaatggaccagatcactggtggagcctctccatctttggttgatgatggtcagattaccgcctcgccttcattaacaccagttacactggtagccaagctaattgatgggtaccttgcagaggttgcctatgatgttaatttgaagcttcccaagtttcaggctcttgctgcttctgttcctgactactccaggcccttggatgatggtctgtattgtgcagaagacatttatcttaagtcacacccattggtgtctgaatctgagaaagaacaactatgccggctgatggactgccagaagtttttcttgaaagctgcactcatgctgcacaaatgagaaacttgcattaaaatagtggtccaattctgtcttttgacatt

SEQ ID NO: 14606 - DNA, 442 bp, Gossypium hirsutum
  Clone ID: uC-gsflnu33B049h09b1
tcgcaactttgacgcagctgctatttcttttttgtggttttcagcagcagcttgtatttggaagaatggtgagggtgagcgttttgaatgatgcactcaagagcatgtacaatgcagagaagaggggcaaacgacaggtcatgatccgaccgtcctcgaaggtgatcattaagttccttttggtcatgcagaaacatggttatattggggagtttgagtatgttgatgatcatagatctggtaaaattgtggttgaattgaatgggaggctgaacaagtgtggggtgatcagtcctcgttttgatgtcagtgttaaggagattgagggttggactgttcggttgctttcttcaagacagtttggttatattgtgctcacaacatcagctggaattatggaccatgaagaagccagaagaagaatgttgtggaaaagtacttg

SEQ ID NO: 14607 - DNA, 421 bp, Gossypium hirsutum
  unsure (1)..(421): unsure at all n locations
  Clone ID: uC-gsflnu33B049h10b1
ctcacgcgtccgcccacgcgtccggagctttcgtgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaanataacaggcctctgtaatgatatattgtcaaggatggatgcctgcaaggtctataattatgtctctggc

SEQ ID NO: 14608 - DNA, 454 bp, Gossypium hirsutum
  Clone ID: uC-gsflnu33B049h11b1
tcggttaaggtgccaatcaggttttgtgttaggtttactgacagatatcactaaagacttctgtatttgagaatgagtcggccaatggaagaagatacaccaaagaatgaggaagaggaatttaacactggaccgctgtccgttttgatgatgagtgttaaaaataacactcaggttcttatcaactgtcgcaacaacaaaaagcttctcggccgagtgagagcattcgatcgccactgcaacatggatctggaaaatgtcagggaaatgtggactgaggtaccgaagaccgggaaaggcaagaagaaggcactaccagttaacaaggacagattcatcagtaagatgttccttaggggagaatctggtataattggtttaaaaaacccaggaaatttgggggtcttatgtatgaaactttgtacggttatgtatccactagggaaatgctttt

SEQ ID NO: 14609 - DNA, 445 bp, Gossypium hirsutum
  Clone ID: uC-gsflnu33B050a01b1
ctttacaaggttgctgatattcctttcttaagtgaatacaagcttcaaatccttgatctcattgagaaggctgagaaacagccaaacatcaccattggtgtcatcgtctccatattggtgattatggtcacagttctcttcagacttcttttcggtggcaagaagcaaccaaaagtagagaagaaaccggaggttgctgagacatcaaacaatcaatcaaccagtggagaaaaggctgaagaagaagaagaagaagaagagaaagaaggaaccgctgctgctcctcgcaggaggaggcgtgacacttaaaacagaggtgaatggtgataatctgtttttagtatgggcaaatttttgggctttagaggtggtctttatagctgaaacattcacggtacctggtgatttttttttttagttttacttgatgaaacattattagatt

SEQ ID NO: 14610 - DNA, 269 bp, Gossypium hirsutum
  Clone ID: uC-gsflnu33B050a03b1
ttttacgcgtacgcccacgcgtccgtcgagattcttcacgatcgggctagtaacatcctggtactcgtccaatattggagtgttgttattaaacaagtatttactaagcaattatggcttcaaatacccaattttcttaaccatgtgtcacatgacagcttgttcattgttaagctatatcgcgattgcatggatgaaaatggtaccaatgcaaacgattcgatctagggttcagttcttgaagatctaggctttgagtttagtttttt

SEQ ID NO: 14611 - DNA, 197 bp, Gossypium hirsutum
  Clone ID: uC-gsflnu33B050a04b1
tttcccacgcgtccgcccacgcgtccgtatcttctctctctctttatccaaagtctgatgattgattccagttgggttaccgcacaaaccaactggtttaaagtccaaaattttggtttcaagattagatttttttaaaataaataaaaaagttgcagtcttgattccttttgatctaaagcctttgagtgtaggtt

SEQ ID NO: 14612 - DNA, 442 bp, Gossypium hirsutum
  Clone ID: uC-gsflnu33B050a08b1
cccacgcgtccggagaaactaggtgtgaaacaatggcgtcctcggatcttattggcaagctcgagactgatgtcgagatcgatatttctcccgaaaagttccaccatatgtggtgccacaggccgcaccatgtccaccacactagctctgaaaaagtacaaggatgcgatttacatgaaggtgaatttggaactcccggcgtcgttatctgctggagatatgtgcatgatggaaaggctaaaactgcaaagcaggtagttgaagttatggaccatgagaaaaagtcaataactttcaaaatgcttgaaggagatctgatggaggaatacaaaagcttcgtgattacaatccaaacttcccccaagagcgacggtaaaggcagtatagtgcactggactctggattatgaaaagctgcacgagggtattggacatcccgagtc

SEQ ID NO: 14613 - DNA, 378 bp, Gossypium hirsutum
  Clone ID: uC-gsflnu33B050a10b1
cttacgcatccagggaaatgcggaacttgatgagcagcgttcatatgcttcacttacatcctttgtcacacaaacaaggcctttcacaatcagccttgtggaacctggcgttaaacttgcacagcgaacaggctgaagagctcatggacgcttggatttaagccccgccatatcgctttcggagctggttatctcgcagccaagagacttaatttagagcttggttcttaccatgatacctggctagagttctaaacaactccggctgttttccaagatgtttcacagcagttgatggagctgttctaagcggataacgagggcggatctacgattcagatcagattcatcgttggcttagggttcttagctttatat

SEQ ID NO: 14614 - DNA, 279 bp, Gossypium hirsutum
  Clone ID: uC-gsflnu33B050b03b1
ctaggagccaaaaatgctgcacaagctaaggaatttgtaggtgcccttggctggagactaagcaacgaagaagtggatgagctacggtcactggcatcggagataagtcctgttaccggttttcctgtggagaagttgtaattctttttgctccgattcaagttgacttaattcttgaatgttaaacatagaatgaataactcatattctagtattggttcctttgagccttatcgattgggtgtttattcttttgcccttttttatgggatcaaataa

SEQ ID NO: 14615 - DNA, 453 bp, Gossypium hirsutum
  unsure (1)..(453): unsure at all n locations
  Clone ID: uC-gsflnu33B050b05b1
gagctttccaagatttttaatcgaatgcttcaccatggttttgctcctaatactataaccttcaatgtcatgcttgatgtttatggtaaagccaaacttttcaggaaggtcaagaaactattctggatggcaaaaactggaggtttggtagatgtaatctcttacaatactattatatctgcttatggtcaaaataaggacttcaagaatatgtcatcaaccattcgagaaatgcaattcaatggtttttcagtttcccttgaagcctataattgcatgttggatgcatatgggaaagaaggcgaaatggagaatttccgaagtgtattgcagaggatgaaggaatcaaattgtgcttccgaccactatacttacaacattatgatcaatatttatggngaacgaagatggattgatgaagttgctgctgtgctgacagactgaagaatgtgg

SEQ ID NO: 14616 - DNA, 354 bp, Gossypium hirsutum
  Clone ID: uC-gsflnu33B050b08b1
ttcgcgtccagcgcgagcttcgaaagggaatcgggttaaaattcctgaaccgggacgcggcggctgacggcaacgttagttccgttacgatacgtgcatgaagacacacaaattggagggtatcatataccatcaggaagtgagattgctgttaacatctatggttgtaacatggacaagaactattgggaaaaccccgaagaatggaacccggaaaggttcctcgacgagaaatacgacccattggatttgcaaaagacaatggcgttcggagctgggaaaagggcgtgtgccggttcacttcaagcaatgttgctagcttgtggtgcaataggtagattggtgcaggatttt

SEQ ID NO: 14617 - DNA, 450 bp, Gossypium hirsutum
  Clone ID: uC-gsflnu33B050b09b1
tttggcagcctatttacaaagcaattaatccttgtaatatagtatttgcactcattagcctgtccctcatggaatcccatcttgagaaacaaaatggagatgtgcttcaaaaatctttcaaagagatgatttctactctccctaaaaagagttgttggggttttcctgaagatcaatatcaatatcaaagtttttggttcagcccgccttttctacaaggagcattgtcggctcaacaacaattccaagctcagccaactgatatcatcctttgtagctttccaagaacaggcacagcctggttaaaatccctcactttcgccactattacaagaacttcatacaatgattccaccacccctttactttccaagatgcctcatgatgttgagccttacattggagtttgatcatgcccagatttccattaatctacatcttggaattcct

SEQ ID NO: 14618 - DNA, 446 bp, Gossypium hirsutum
  unsure (1)..(446): unsure at all n locations
  Clone ID: uC-gsflnu33B050b11b1
ttccacgcgtccggcgtttgcgtgtcttctcatctctgctttttccccctttttatctttcttcttctttttcttcttcttcttcttcttcttcttactccagccgactttttccggcaaaacggtgtcagatctttgtgatctatagccggaagtttcatttcgagttcgacgatctcatccttcgatctttccactttcttcagcctaccatgaatcccgaatatgactatcttttcaagctacttcttattggagattccggtgttggaaaatcttgccttcttttgagatttgctgatgattcatatgtagaaagttacataagcacattgnggtttgattttaaaatacgcactgtggagcaggatgggaagaccattaaacttcaaatttgggacactgctggtcaagaaagaattaggacaattactagcagctactac

SEQ ID NO: 14619 - DNA, 326 bp, Gossypium hirsutum
  Clone ID: uC-gsflnu33B050b12b1
cacacgctcttttatcaagacgggtgagaaggtgggatcttcccaggctgctaattcttgccaagctcggaacaagcccattctcatacgcgctagtcgacttgggtgttatcacaaatggttcagtctttagccatgaggtgcttgaccttaccgaggatgacctgattgagaaattcgctactggtgcctccatggttacggcattgtctctcgccatctcgtacccaaccctggctgctgcaccacacatgttcatcaatggctacaagaacatattggccgttgctgtcgcacctgagtattccttccctcaagctgataaa

SEQ ID NO: 14620 - DNA, 433 bp, Gossypium hirsutum
  unsure (1)..(433): unsure at all n locations
  Clone ID: uC-gsflnu33B050c03b1
ttattttagggtttaagccggctacagtcaccgtttcttctgagcttcctgtgggtgcgggtctgggttcatcggctgcatattgtgtttcactctcagcagctctattagctctttcagattccgtgaaattggacgtaagccaaaaaggatggtctatgtttaatgagtccgaggctgaattggtgaataagtgggctttcgaaggggagaagataattcacggaaaaccctctggagttgacaactcagttagcacatttggaaatgtgataaaattcaaatccggtgttatgacccgcgtcaattccaatatgccgctgagaatgctcattaccaacacaaaagtcgngagggatacaaaggctttggttgctaatgtttcggcaaggaaatcaaggcatcctgatgccatgtgttccgtgttaaatgc

SEQ ID NO: 14621 - DNA, 449 bp, Gossypium hirsutum
  Clone ID: uC-gsflnu33B050c05b1
tgcgattgtttcaagcgaacgattaaggatgaaggattcgcctctttgtggagaggaaacaccgcacatgttattcgttatttccccactcaggccttgaactttgctttcaaggactacttctagaggctcttcaacttcaagaaagacagagatggttactggaaatggtttgctgctaacttggcatctggaggtgctgctggtgcttcttaccttgtgtttgattactccttgaactatgcgcgaacacaacttgccaatgatgcagaggctgcaaagaagggaggagagaggcaatccaatggcctcgttgatgtctacaggaagactttagaatctgatggtattgctgggctttaccgtggtttcaatatctcatgtgtcggaatcattgtttaccgaggtctatacttcggaatgtacgactccctgagccagtggttttg

SEQ ID NO: 14622 - DNA, 230 bp, Gossypium hirsutum
  Clone ID: uC-gsflnu33B050c06b1
tcccacgcgttcgagctaacaattaatgaggaaggttttgcgggtttattgggagtaaacaccacacaagttattcctgaatctccccaccccaggcctaagaaaccttctctttcaagaactacttccctgaggcatcttcaacttcaaatattctactggagctccctcatcttatttaggctgggtgctaaacaatgggtatttatagtttatacaaatacattaaa

SEQ ID NO: 14623 - DNA, 158 bp, Gossypium hirsutum
  Clone ID: uC-gsflnu33B050c07b1
tcccacgcgtccgttctttaagttatgaagcagaatagaaaagctttattgctcgggttttgaggttcggttggggaacttgttttcattctttcccttgcccgctttgtcaaaaacagtcagttttatgcatatcgatatttaagtttgtatgctgt

SEQ ID NO: 14624 - DNA, 426 bp, Gossypium hirsutum
  Clone ID: uC-gsflnu33B050c09b1
gtaggtcccaccaataaggagttgtgtgtacacagggttttggagcttagatgaatatgatgttgggatgggaaagtgataacttgtattaggtctgcttattattattattatttttgggggggggtctacgaacaccaacgccatgggaagatttgaagagagaggattcgattcaggggtttgccctaagcctattcgaacctttagatggtctaccaactgttatcagactgagatggctgattcaaaaactggtgcagagcttcttgatataatcctccccgagggagggtatggggccgagaattccaccaaccaaatggctttattaccaccgtttttttgtggatcaccgccgagcagggcgtcaaatccggtaattccaagatgcccgtttcaacgacgagcatgccggtgctacct

SEQ ID NO: 14625 - DNA, 449 bp, Gossypium hirsutum
  Clone ID: uC-gsflnu33B050c10b1
cccacgcgtccgcttcactccacatttcacactctttttcaactttctcttcttctctttgttttaaagaggggctggagttttagccaaagaaaactccatggctaaacttgttgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattactcaaaagaagacccttttttttt

SEQ ID NO: 14626 - DNA, 401 bp, Gossypium hirsutum
  Clone ID: uC-gsflnu33B050c11b1
cccacgcgtccgaaattccccacaaatggccatcactttctcagatctccacacggaatctggccttaaatcccttaatgacttcctcaccggcaaatcttacatctctggggataagctgactaaggatgacataaaagtttatgctgctgttttgaaaaatcctggtggttcatttcccaatgtgagccaatggtataattgtgtgtcttcccatctcgcttctagcttccctgggaaagctgttggcgtttcacttggtggcaaagctgatccagctcaatctgctgaagctaagtctcctgctgcggacgatgacgatgatgacttggatctgtttggcgatgaaacggaggaggataagaaggcagcagaggaaagagaagcagtaaaaagtctgc

SEQ ID NO: 14627 - DNA, 248 bp, Gossypium hirsutum
  Clone ID: uC-gsflnu33B050c12b1
ttacttgctgctgcagcactgatgcgaagagggttctttgatgggtttattgggctaggttaaatttggttttaggctaatgtaattgggttacaatttgggcttgtaacatttgtgattgggccacgtgaattaagtttttaaatggactgggcacctttgtttatttaggcgtgggctaaaattgggtattatagttataaaatacataaattatttttataataattttttttgtgatttataat

SEQ ID NO: 14628 - DNA, 444 bp, Gossypium hirsutum
  Clone ID: uC-gsflnu33B050d01b1
ttgggattacgagtctctcgctgttcaatggggtgatcaagatgattatgaggttgttcgaaaagttggaaggggaaaatacagtgaggttttcgagggcataaatgtcaacaacaatgagcgttgtataataaagatcctcaagcctgtcaagaaaaagaagattaagagggagattaaaatccttcagaatctatgtggtggcccgaatattgttaaacttcttgatgttgtaagagatcagcactcaaaaacaccaagcttgatatttgagtatgtcaacagtacagatttcaaggttctctacccaactttgactgactatgacattcgctactatatatatgaacttctcaaggccttagattacctcggtgcattgcccttccgtctgggagagcagcttttccacagggttggaaaatccgtgccgggtcttgtcct

SEQ ID NO: 14629 - DNA, 317 bp, Gossypium hirsutum
  Clone ID: uC-gsflnu33B050d02b1
ttcagctccagctgtgggacctgctgatgagactgttatcgaaagatgggttgttcaatatgattgcccacgatttattgctactccaagtggtgctgatgcttctgtttcttataagaagatttacaagaagtcaatcatacttttgagatcactttacacacaaatgaggcttctccctgcatatagaatctttaagcagctaagttcattgagccaaacttataatttcgatcttgtttacaaggtttcatcatttagtcaccccttctctagggaagaggagagtggtatgaatgaatatttgttttgcacct

SEQ ID NO: 14630 - DNA, 448 bp, Gossypium hirsutum
  Clone ID: uC-gsflnu33B050d03b1
attgacaagcgtgtgattgaaaggtttgagaaagaagctgctgagatgaacaagaggtcattcaagtatgcttgggtgcttgacaagctcaaggctgaacgtgagcgtggtatcaccattgatattgccttgtggaaatttgagaccaccaaatactactgcactgtgattgatgcgcctggacaccgtgactttatcaagaacatgattactggtacctcgcaggctgactgtgctgttttgattattgattccaccactggtggttttgaggctggtatctccaaggatggtcagactcgtgagcatgctttgcttgcttttacccttggtgtcaagcaaatgatttgctgttgcaacaagatggatgccactacccctaaatactcgaaggctaggtatgatgaaatcgtgaaggaagtctcttcctacttgaagaaggttggat

SEQ ID NO: 14631 - DNA, 187 bp, Gossypium hirsutum
  Clone ID: uC-gsflnu33B050d05b1
tgtctgtgtcttgtgtaatagaagctttgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgctcttggtttgt

SEQ ID NO: 14632 - DNA, 414 bp, Gossypium hirsutum
  Clone ID: uC-gsflnu33B050d07b1
tcaatatcagtgacaaacctcaatggtttttggagataagtccagaagggaaagtaccagtggtgaagtttgatgacaaatgggtggctgattctgatgtaattgttggaatccttgaagaaaaataccctcagccttgtctcaaaacccctcctcaatttgcctctgttggatcaaacatatttggaacttttgtcacatttttgaagagcaaagacgctaatgatggatctgagcaggctttgcttaatgaactcaaggcattggatgaacatcttaaggcacatggcccattcattgctggggaaaagataagtgcagttgatttagctttgggaccaaaactttaccatcttgaggttgctcttggccattttaagaaatggactgttccggaaagcttgactaatgttc

SEQ ID NO: 14633 - DNA, 394 bp, Gossypium hirsutum
  Clone ID: uC-gsflnu33B050d08b1
aaaaaaaaaaaaaaaaaaaaaaaaaaaaaaaaaaaaaaaaaagaaaaaacaaatacaagaatccaaaactacacacctccaacatgctacctcttatatattgtatcctgaaacctatattctgggcgctgcccttcaaggtaccccactttccaccccctgacctctcccattttccttttttttcggctcaccccactttcaccttttggccgctggtttaatagcgtcgagcccggaaccccttcgcactttcccccatttactgcacttgaatggttcccgctttgcgccctgtcattaagcactaagggcgccggccgtactcccttcccgaaccgtgccctttccagttgcctaatgcccacccccctctctttgcgcctttaccccc

SEQ ID NO: 14634 - DNA, 423 bp, Gossypium hirsutum
  Clone ID: uC-gsflnu33B050d09b1
gcaacttgaggatggccgcacattggctgattacaacatccagaaggagtccacactccacttggtgcttcgcctacgtggaggaatgcaaatttttgttaagactttgactgggaagaccattacattggaggtagagagttcagataccattgacaatgttaaggcaaaaattcaggacaaggagggaatccccccagaccaacagaggctgatttttgctggtaagcaactggaggatggccgtaccctggctgactataacatccagaaggagtccaccctccacttggtgcttcgtcttcgtggtggtatgcagatttttgtgaagacacttaccgggaagaccatcaccttggaagttgagagctctgacacaatcgataatgttaaggccaaaattcaagataaggaaggtatccc

SEQ ID NO: 14635 - DNA, 446 bp, Gossypium hirsutum
  Clone ID: uC-gsflnu33B050d11b1
tccacgcgtccggtctaactcgaccaactatctcaattcaaagttatttggacaggatttataagtatgcaaattgtagcccttcctgttttatcgttgcatacatttaccttgatcggtttgctaaaaaaaaaacccactttgcccatcaattcattcaatgttcatcgcctgcttattacaagtgtcatggttgctgccaagttcatggatgatatatattataacaatgcttactatgcaaaagtgggaggaatcagcacaatagaaatgaattaccttgaaatggattttttatttgggttgggttttcatttaaatgtagcccccaatactttttacacttacttcacttacctacaaagagagatcatgttgcaaccaccaccaagtattgcagaatcatcattaagtcttgataggtcattaaaagtccacttatgttt

SEQ ID NO: 14636 - DNA, 472 bp, Gossypium hirsutum
  Clone ID: uC-gsflnu33B050e01b1
agggaaggctggcgcgtgtgcgggccccggcgcggaattcggggcgagacacacgcgcgtttttactcgtagacagtatgagcaaggatgagctcggggggaccagagatgagcactactgaatcaagacatgcttgcgggtgtggatcaaactgcaaatgtaatccatgcaactgctgaaaagcttgatgaaggccataaattatgaaaaaagaaagcagtaaaataacaggcctctgtaatgatttattttcaaggatggatgcatgcaaggtctataattatgtatctgactggcttgcgtaatagaagctttggttgaggtaacaataatgtataaggcatttggctgagagcaaattttcatgatgactaggagaatttgaggctcattcatggtgacttggcttatggttttatttgttggagataaactcttataaaaagatatatcggttgctgttttaggttt

SEQ ID NO: 14637 - DNA, 428 bp, Gossypium hirsutum
  Clone ID: uC-gsflnu33B050e02b1
ttgggttcgagaatcaaaatctcagctctgggtgttactatgcttctgctgttgattgccccaacttccaacgctgccatttcgtgcagtgttgtgataaaggacctgaggccttgcgtgaactatcttacgaaggggagcggaaaaccaccgaccgcttgttgtgcgggagcctccgctctggcatgcggcacctaggcgtctgccgacaataaggctggttgtgaatgcatcaaatcagcgtctaagaatattaaacccaatcaccagttagctcaggctctttcttctaattgtggaatcactttgcccgtcaccattttaccaaatgtcgattgttccaaggttggttgagagcttggaagctgaaactgggagtgcttggatgggcatgaagtaattaaaaaactccattgtagaagctcaat

SEQ ID NO: 14638 - DNA, 413 bp, Gossypium hirsutum
  Clone ID: uC-gsflnu33B050e03b1
ttcaatgcgaagaaggcacagagtgaaatgaaatactatgaagagaagacttatgtcgcaggagagtagctgatttaggtttctaatgttagcgagtttggtacagctcttcatgctgccttaacaattcatattgatgtagatgattatatcagcctgtggaagacacagacagtattattggaagatagaaagagtgcaaggcatggcatcaataccagaaacttccaagccaacgcttaatttatataatttttgttattccaattttttttaccccagttttctgagattttgaagaaccctttaataatttgtttactacgatgcttgtaaacaatgtaatcactgattactttacccctcccttgggtggggcgcatgatttttgtgtgcttttaattcaaaagcaa

SEQ ID NO: 14639 - DNA, 446 bp, Gossypium hirsutum
  Clone ID: uC-gsflnu33B050e04b1
tttccacgcgtccgcaaaatcccattgtgcattagccgctgcagagacccttcacccatgaaacaaatagcttctgacttttcaatctccaatccctattattttttgcgagttaatcggaccgatccgtcgttaccaagtccagactcatcaatatcaattatcttccatcaccgtcgcgatttctgtcgcgatttacaagttcttccactgcgcgtggtacctcttccatctagtatcgtggtccatcatacttccgtccttccaacaccaatccatgccccgttttattggcttcccttggtacatgtttgaactgcaaacttctaaacttggaggttctccccttgatttcttggatcaaacttcaatgcatgatctatcttcaactgcagcgattagttttccaataacagtcaacgtatctctctcaacacatatgtctt

SEQ ID NO: 14640 - DNA, 381 bp, Gossypium hirsutum
  Clone ID: uC-gsflnu33B050e05b1
tataactatgagtctacctctccagtcgcccctgccaggcttttcaaggctttttctcttgaagctgacaaggtttggcccaaggctgctcctcaggcagtcaagagtgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctctgggggacaagcttgagaaaatcagctatgacaacgtctgaggtagcatcaggtgtaggatgattgtgctagatgctggatttagttcaacactagtcaggactttgcgagaactggctgtgata

SEQ ID NO: 14641 - DNA, 380 bp, Gossypium hirsutum
  Clone ID: uC-gsflnu33B050e06b1
ttccacgcgtacgcccacgcgtacggttttcaaacacgtcgatgcaaggactttggctagggcttcttgtgtaagccgtctatggcgccaaaccgccaaagacgagcggctttgggagctgatctgcaccaggcactgggctaacatcggttgtggaacccaacagcttatatctgtcgttatgcctctcggcggcttccgtcagctccactcccgttacctttggacgttttccaagccacaagccgcttcggcttccgcctggactccgcccaagattatcaactccaaacccgcagcacggtgggggaaagatgaggctaatgtatgactatatcgtctctatattcagcaatatgagaagatgaataacaaaggca

SEQ ID NO: 14642 - DNA, 426 bp, Gossypium hirsutum
  Clone ID: uC-gsflnu33B050e07b1
ttccacgcgtccgacattgttcaagaaaaaagaagcaaaaaaaacatggccaaagttctgttgttcattgcactatgtgtgcttccagctttggttagtgctacacgcattctgaataatcaattggtggtagaaggctatgtgtactgtgatacttgccgtgctggttttgaaacccctaagactagaagcctagctgatgccatggttaggttggtatgctccgacaggaagagcggccaagttgtcttcaaaaaggagggatacaccgacaaaaccggaaaataccagattcgtgtatccgaggatcacttggatcagatctgtgatgcagttcttgtgaagagctcccagcttggttgtgccacaatgtcccccggtcgtgaacgtgcccgtgttatcttgaccaactttaatggcatttca

SEQ ID NO: 14643 - DNA, 447 bp, Gossypium hirsutum
  unsure (1)..(447): unsure at all n locations
  Clone ID: uC-gsflnu33B050e08b1
tgctacagtgggcttgcaagtgaaccaagagattatgaatgcaatggtctccacaagcattctaaagcaatttctactggcactgtgactgttggcctgcttaccactatcctttctgttgtctattctgctgttcgagctgggtcttctacaactctactatccccaccaagttcacctcgtgcaggtggtggaaagccattacttccattggacaaggctgatgaggagaagaagaataaggcagtgacgtactcgtacgccttcttccacatcattttttctctggcaagtatgtactcagcaatgcttttgacgggatggtctacctcagttggtgagagcgggaagttggtagatgagnggtggccatctgtgtggatacggattctaacagcctgggtaattgcagctctctatatgtggtctctccttgctcctattctc

SEQ ID NO: 14644 - DNA, 441 bp, Gossypium hirsutum
  Clone ID: uC-gsflnu33B050e09b1
gaaaaagaagggaaaatggaagggaaagaagaagatgttagattgggagctaacaagttctcagaaaggcaacctattgggacagcagctcagtcccaagatgataaggattacactgagccacccccagcacccttgtttgagcctagtgagttgacttcatggtcgttttaccgagctggaatcgctgagttcgttgctactttcctattcttgtacatctcggtgttgactgtgatgggagtccttaaggacaaaaccaagtgtacaactgttgggattcaagggattgcttgggcttttggtggtatgatctttgctcttgtttactgcactgctggtatctcaggtggtcatataaatccggcggtgacatttgggctgttcttgggaaggaaattgtctttgacaagggcaatattctacatggtgatgcagtgc

SEQ ID NO: 14645 - DNA, 447 bp, Gossypium hirsutum
  unsure (1)..(447): unsure at all n locations
  Clone ID: uC-gsflnu33B050e12b1
tgtgtcacctttacttgaaaggccaacccagaaagatagtgatgaggaatgggaatatgctgacagtactagtggcactggggagcttcgatcggataaattgaatggcgacattgcacctgatttatctgagacagcatgtgagcttggtactggtggagttggctatatttggacagcctttgaaggagcgtatgatgaagaatggaggcattcagttgcacctattcccacagataaactggttaagctaatgctagataaagatgaggatgaggaactgttaactcaagatgggaatgttatttcagcttcaagagagctgaaaactgattctgatggtaatggttctgaagatgacgataatgaagactctagagatgactatgtatcctttgagaaagaggttgaagctaccttnttaagggctgttcatgaaaatgtcaa

SEQ ID NO: 14646 - DNA, 427 bp, Gossypium hirsutum
  Clone ID: uC-gsflnu33B050f02b1
cttctcttttgttccactcgaaccccaaaactgtgtttataatggggggaggggaagggtctgcagcaagggaagcactcaggcataaatttattgatgaagttgtaatgtgtgatattgatgaggaagtggtcaatttctgccgcagatacctgactgtgaaccgtgatgcattttgcaacaaaaagcttaaccttgttatcaatgatgccaaggctgaactggagaagaggactgagaaatttgatatcatagttggagatttagcagatcctgttgaaggggggccttgctatcaactttatacaaaatcattttatgagaaaattcttaagcccaaactcaatgaaaatggcatttttgtcactcaggctggcccagctggaatattcactcacaaggaggtcttttcctctatataccacac

SEQ ID NO: 14647 - DNA, 441 bp, Gossypium hirsutum
  Clone ID: uC-gsflnu33B050f05b1
ctcagtttttgacaatggcggacaaagtattcccttcctccaaacccaccgccaccgctgcccctggcggagcagcagctcctactactactactactactacctccaccacaaccaacggcggaactaccaaatcccacctcattaaccccaccgcccgcctaccctaccgtccacagccccataacagacgtcgcaactaccgtccacggcgcaactactgttgctgctgctgtttctggatcatcctcatagtcctcgtgctcgcccttttagtagccataactggcaccgtcctttacgtcttttaccgccctcaccgcccttcattcaccctcgcttccctccgtatccaccgcttgaagctcaaaaccgccgccgactcctcctcttcccatctttcaacccttttcaacttaaccctttcttcaaaaaccccac

SEQ ID NO: 14648 - DNA, 443 bp, Gossypium hirsutum
  Clone ID: uC-gsflnu33B050f06b1
tctttggtcgcttcgatgattccttcagtttggggtctgtcaaggcctaccttgctgagtttatctcaactttggtgtttgttttcgccggcgttggctctgccattgcttacaacaagttgacaactgatgcagccctagatcccgatgggctagtcgccattgctgtttgccacggatttgctctctttgttgcagtggctatcggtgccaacatctcaggtggccatgtcaaccctgcagtaacttttgggttagctcttggtggccaaatcaccatactcactggcatcttttactggattgcccaacttcttggatccattgttgcttgcttcttgctcaaggctgtcactggtggtttgacagttcctatccacggtcttggagcctgagtttgagctattcaaggagtggtgatggagatcatcatcacatttgca

SEQ ID NO: 14649 - DNA, 363 bp, Gossypium hirsutum
  Clone ID: uC-gsflnu33B050f08b1
tataaaaataaaataaaaaaaggcagagcctccatctgtttcggccctccgagctccggcgccaaactcaaccccctctttccgatttagacccggcgatggcgctggtaagtcctcgtccttccctttttattatttatttcttatgtagaagataaaataaaaataaaaataaaatgaaacaaacaaaaacgtaaataaaaaaaatcaccttcaaaagtctgttttgttttttttttatttcaataatccgtaaaagcaaaggaagaagaagttcttccttacagtagattcggtattaaccgcacatttactttttctatgtttacatttttaacttcaaacataatttaaattggcctt

SEQ ID NO: 14650 - DNA, 301 bp, Gossypium hirsutum
  Clone ID: uC-gsflnu33B050f09b1
cgcgttgattttcggagacagtagagcaatgatgggctcggggggaacaaagttaagcacgactgaatcaagacatggatgcgggtgtggatcaaactgcaaatgtaatccatgcaactgctgaaaggcttgataaaagccatagattatgaaaaaagaaagcagtaaaataacaggcctatgtaatgatttattttcaaggatggatgcatgcaaggtctataattatgtctctgcctggcttgagtaatataagctatgtttgtggaaaaaataatgtataagccatttggctgggagc

SEQ ID NO: 14651 - DNA, 398 bp, Gossypium hirsutum
  Clone ID: uC-gsflnu33B050f10b1
ttccacgcgtccgtgcaaattctcccaaatttttcagaaaatctaacacaagggaaaaaaatgagagagatccttcatgttcaaggtggacaatgtgggaaccaaatcggttccaagttttgggaggttgtttgcgatgagcacggcatagatccaactggaaggtacattggttcctcggatctgcagttggagcgtgttaatgtttactataacgaggcttcatgtggtcgctttgttcctcgtgctgtgctcatggacttggagcctggtacgatggacagtgtccgaactggtccttacggccagattttcaggccagacaactttgtttttggacaatcctgtgctggaaacaactgagccaagggccattacactgaaggagccgagcttat

SEQ ID NO: 14652 - DNA, 447 bp, Gossypium hirsutum
  Clone ID: uC-gsflnu33B050f11b1
ttcagaactagagagagcaagctcacccagatgacccaccatcatcgttgatataacttgcaataggtactgtgataaggtgacagctaccataggccccgcaaggtaacccgccctttttatttcttcaacaaaagcagcccaacttagccaccgagtgcttttctcctcgttctctaacttgggaatcaaactctcttccatgatgttcttcttcagcgagtctaccatgatgcccttctctccttaaccttgaacagcgtcgttcacttacgaaaatgcgggagacaatagaaagatgaaagagttgagtgtgtgattgtttggatttattattgcaaacaaacaaattaggcacatagactcactgcaaacttcaaccagcgtttcgctacaactgagttggacggccctaacttgctttaaactaaactagtagtaataatc

SEQ ID NO: 14653 - DNA, 440 bp, Gossypium hirsutum
  Clone ID: uC-gsflnu33B050f12b1
cttcttagcaaacaccttcaattccagttgtttcaaaggttccaaccatcatccttggcatggatgtgtctcatggctctcctgggcagtctgatattccatcaattgctgcggtggtcagctccaggcagcggcctttgatttcccgctatagagcatctgttcgtacacaatctcctaagcttgaaatgatagattctctattcaaaaaagtgtctgacaaggaggatgaaggtatcatgagggaggttctcttggacttctatacaagttcaggaaagaggaagcctgatcaaattatcatattcagggatggagttagcgagtcacagttcaatcaagtattgaacattgaactggatcaagtaattgaggcttgcaaatttcttgatgagagttggaaccccaagtttgtggtcattgtggcacagaaaaaccat

SEQ ID NO: 14654 - DNA, 454 bp, Gossypium hirsutum
  Clone ID: uC-gsflnu33B050g01b1
gttcgaggaagtgcgcagacagttcaacacaatccctggtctcatggagggcaccactaagcccgactacgctacctgtgttaagatctctactgatgcttccatcaaagaaatgatcccaccgggtgctcttgtcatgctcacaccccttgttgtttggatctttttcggcgtggaaactctttccggtgtcctcgctggatctctcgtctcaggtgttcagatcgctatctctgcatccaacacggggggcgcttgggacaacgccaagaagtacatcgaggctggtgcttcaacacatgcaaaatctcttggccccaaaggttcagatccacacaaggcagctgttataggcgacaccatcggtgaccctttaaaggatacatccgggccatcgttgaacatcctcatcaagctaatggcagtcgaatcactcgtcttcgctcccttcttc

SEQ ID NO: 14655 - DNA, 350 bp, Gossypium hirsutum
  Clone ID: uC-gsflnu33B050g02b1
ctgtcgcgtgggtggtaatgttgtaatggcaactgctgtaaggaacatgggacgtgttgttgacaataagaacagggagaatgttcaagggtagttttgagacaatccatgattctaaatccttgttgacacgagtttgtatctcgtttaggtattgacatttattatctcgtaaaggtacaatcatcatgggtaaattgttcctaagggttttgacaggtaaatttaggttttttacaatgtttgccctactgctacccacttttttaagccatacggtcggggatgctaatgtctaattcaatgttaactttgcacttttattaaacccaattacaaaatatttgtaa

SEQ ID NO: 14656 - DNA, 445 bp, Gossypium hirsutum
  Clone ID: uC-gsflnu33B050g05b1
ttttcaggaaaagttgctgggttaatagcagaaaccattcagggagttggaggagcagttgaactagccccaggatatctgaaacaggtttatgacattgtacgcaaggctggcggtgtctgcattgccgatgaagtacaaacgggatttggtcgcacaggaagccattattggggttttgagactcaaggtgtcattcctgacatagttaccatggcaaagggtatcggcaatggattaccattaggtgcagtggtcactacaccagaaattgcacatgtgatggctcaaaaaattcagtttaacacttttggaggaaatcctgtatgttctgcaggtggacttgcagtgctcagagttatagacaaggagaagcgtcaagcacattgtgctgatgttggttctcacttgatcggacgcttgagatctttacaggacaaacatg

SEQ ID NO: 14657 - DNA, 425 bp, Gossypium hirsutum
  Clone ID: uC-gsflnu33B050g08b1
tttaacatccacgctcgtcggaaatgcccaagggctctacttagcattgagtcgagaccttaccaagttttctgcagtcttttacgctgattttacttttaccactggcaggttcaacggcagctccttcagtttattctcacgatttccccccacagatgttgttcctgcccctggcacaattcgtgaaatggcaatagtgggagggacaggtaaatttaggatggccacaggctttgccctcctgcgacccacttcttcaagcaacacggtcggggatgctaatgtcgaattcaatgttactttgtaccattattaaacccaattacaaaatattgaaatccaacgaataagatgaataaaatgttgtattcctaaagattatatttaatgtattgtcagtaatcaataaatcataattcatc

SEQ ID NO: 14658 - DNA, 455 bp, Gossypium hirsutum
  unsure (1)..(455): unsure at all n locations
  Clone ID: uC-gsflnu33B050g09b1
ttccacgcgtccgggaaataatagattcaagaaccagcaacaccctacaatgcaaggccttggaccatgcagattcattaggtcttgtactaataagtagcagaacaaggagcttgattaactggctggtgaatgcattgatgagtctccaacatccacattcagaaactggaatccctgctgtcaaaatctatggtccaaaagtaatgtttgaccgaggtccagcagtggctttcaatgtatttgattggaaaggggaaaggattcatcctgcattagtgcaaaaactggctgatagaaacaatatttcattgagcattgggtgtttacaacacatctggttcagtgataaacatgaagaaatgaaggaaaaagataagtttcagcctgngatagatgttgttacagctgcaattgggtaccttactaattttgaagacatttataggctttgg

SEQ ID NO: 14659 - DNA, 421 bp, Gossypium hirsutum
  unsure (1)..(421): unsure at all n locations
  Clone ID: uC-gsflnu33B050g12b1
acccttcctccaggcatggataacatgcaaaagtaggatgtttcagttggagcccagtatcaaaagtttaccccacttaagggctaatgagcaccaggaccaagaccctctggttggtgactcgggtagtactggtacatgttcgtgaaggaagaacttaagaaggtttaaccgggtttcaattgggccttcattaaaaaaccaggaaagcccccatgatcctgcaatcctggtaccgatttacaaatagaaagggaatggctcaaaaataaggtaggggtatatatttaccctgggttttatttcaaaaaaaaaaaaanttaaaanaaaatataaattaatttataaaaaaagaaaaaactataaaaaaaaaaaggggggcgccctctataggggcccaatttttatacccgcgcatgtg

SEQ ID NO: 14660 - DNA, 397 bp, Gossypium hirsutum
  Clone ID: uC-gsflnu33B050h01b1
ttcagaaaggcagcctattgggacagcagctcagtcccaagatgataaggattacactgagccaccaccagcacccttgtttgagcctagtgagttgacctcatggtctttttaccgagctggaatcgctgagttcgttgctactttccttttcttgtatatctcggtattgactgtgatgggagtccttaaggacaaaaccaagtgtacaactgttgggattcaagggattgcttgggcttttggtggtatgatctttgctcttgtttactgcactgctggtatctcaggtggtcatatcaatccagcggtgacatttgggctgttcttgggaaggaaattgtcgttgacaagggcaatatactacatggtgatgcagtgcttgggagccatatgt

SEQ ID NO: 14661 - DNA, 461 bp, Gossypium hirsutum
  Clone ID: uC-gsflnu33B050h03b1
cccacgcgtccgaaagaacttcgtttcatctgcttcatttgtttcgaaatctttgaacaaaaatggcctctttcaattgctttgctttagcattcttgattgctttgtcatttgcaggcattgatgttggggtagcagctcgtcaccttctgcagcagcctcgaacgcaaagtttaccatctttccctaatctcccaacgccatcccgaccatcattctcatggcctggggcgcttcctccacttcctaccacattcccaacaggactgccccctctgccaagcattccctcagtcccaacaatcccaactgcaattccccctattcctttctcttttccgccattgccatctttccctaatctcccaaaccctggggcgcttcctccacttcctaccacattgccaagaggactgccgcctctgccaagcattccctccatcccaactgcagttccctct

SEQ ID NO: 14662 - DNA, 231 bp, Gossypium hirsutum
  Clone ID: uC-gsflnu33B050h05b1
ttcagtctcttcgactaaaagcaccgcgcaccgctttccgcgcaccgccagcaacctatgaatgaaatacggatggtttttggtttctacagaggatttcttttgaatttaaggctgccctaggtttttgaagttagttatccagtgccatttagttctttctttgtggattcatatatttgttttgctgaacccttttgttgcaatggaattttcttccgacttaatttt

SEQ ID NO: 14663 - DNA, 454 bp, Gossypium hirsutum
  Clone ID: uC-gsflnu33B050h07b1
cccacgcgtccggagatgaggaaaatcatgggtgccaaagttctcttcttctttgctttgctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttggtctgtctgctagaagaggcatcgtttcgttgggaggcccttaca

SEQ ID NO: 14664 - DNA, 276 bp, Gossypium hirsutum
  Clone ID: uC-gsflnu33B050h10b1
ttttaaatgctactttttcttcctctccttcctttctttttcttaactttcgttagtataatgttataagtcgaaagaagtaagagcatttctttctttgtcttttctgccctctggtaccgtaccgtatacattatgttgttccagtcccttttagttctttctttggggatccatatattggttttgctgaccccttttgttgcaatggaattttcttccgacttaattttaaaaaaaaaaaaaccctataaaaaaacaaaaaaaaaatgggcc

SEQ ID NO: 14665 - DNA, 446 bp, Gossypium hirsutum
  Clone ID: uC-gsflnu33B050h11b1
ttaatatcatgtattaactcaagtagaatattttggcaggcccttctggcaagataatgcttttgcctgaagataacccaaatgccaaccacataatgatagccactggaactggtgtagctcccttcagaggctacctccgccgcatgttcatggaagatgttactttcaagttcaaaggccttgcatggcttttcctcggggtggccaacaaggacagtctcctttatgatgatgagtttaccaaatacctcaaggactaccctgatcaattccggtacgatctagctcttagcagagagcaaaagaacaagagtggaggcaagatgtacgttcaggacaagattgaggaatacagtgacgaaattttcaagctcttggacgatggagcccatatatttttctgtgggctcaggggaatgatgcccgggatccaagaaacattg

SEQ ID NO: 14666 - DNA, 298 bp, Gossypium hirsutum
  Clone ID: uC-gsflnu33B050h12b1
ttttcacgcgtccgaattacaggcctcagttctatctgaggacagcagatgtgactggaaaagtggaattacccgaaagtgttaagatggttctgccgggggacaacgttactgcaacttttgagctcatctcacctgtgcctcttgaagcaggacaaagatttgccttgagggaaggaggttgaaccgtcggtgctggtgtagtatcaaaagtactgagctatggattcgctattgccagatatatttcctgatatattggcatgaaagcttccaggggatacgacgtcggttttac

SEQ ID NO: 14667 - DNA, 376 bp, Gossypium hirsutum
  unsure (1)..(376): unsure at all n locations
  Clone ID: uC-gsflnu33B051a01b1
tgtcgatagcgattcgagctccgatctgttcgagctccaaaactacgatttaggtatctattcaggtggtttacctgtgtatgaaacaacacatatggacagcatcaagagaggagcaccaatttccaatggtgcactatgaaactatacattttcaacttgttgatgatgggttccatttgtttccattgccattgtaggcattagattttgctcgtcttttttttcttcttccctattgctagcttctttgaaagttcgttgaatgctttttccccttttttttattttctctgnatgtacagtttggaatgttttgttggcttcactttctgaatcttcttttctttcttttgaggctggcatggattaagcc

SEQ ID NO: 14668 - DNA, 491 bp, Gossypium hirsutum
  Clone ID: uC-gsflnu33B051a02b1
tttacgcgtccgcgacaaggagattacactaccaagattatagaatggatggagcttcaaaagagaatatggatctatgagttagggtccttgccaccgtttttgcttgtctttgcagggaatatagctcctgttgatcaccggtggaaccaacatggcctcggaggagataactatagaggattgtgtagaaatttgcatcctggtccagttagcttactgcattggagtgggaaagggaagccatgggtgagattagatgcaaacagaccttgtcctttggatgctttatgggctccgtatgatctgctgcaaacaccatttgccttggagtcctaaaattttggtattaattatttttatatatgattatgttttcatatctaggcctgagatttttagttggatgaggccatagaacatacacacaacatagatttgagtgtaaaattaagatgtttctctcttgcagatggtggcaaatgttgggg

SEQ ID NO: 14669 - DNA, 153 bp, Gossypium hirsutum
  Clone ID: uC-gsflnu33B051a05b1
tcctcgtgtccgcccacgcgtccgcacattgttgttattgtaaaatattgagctttttttcttgtgagctaaaactttgttagcgtttgtggggctttgtgttgaaattgtatcaaaagtaccttttggaattacaaattgatttcttctact

SEQ ID NO: 14670 - DNA, 158 bp, Gossypium hirsutum
  Clone ID: uC-gsflnu33B051a07b1
tgggcttcgcatgaactgctgcaaacaccatttgccttggagtcctaaaattttggtattaattatttttatatatgattatgttttcatatctaggcctgagatttttagttggatgaggccctagaacttacccacaacatagatttgagtgtaaa

SEQ ID NO: 14671 - DNA, 441 bp, Gossypium hirsutum
  Clone ID: uC-gsflnu33B051a08b1
tttttacgcgtccgcccacgcgtccgcccacgcgtccgagcatatccaaaaacttctactacttggtgctggtgaatctgggaagtcaacaatttttaagcagataaagcttctgtttcaaactggctttgacgaggacgagctaaagagctatatctctgtcatccatgcaaacatctatcagactataaaaaaactgcatgatggatcaaaggaattagctcaaaatgatgcagattcttccaaatatgttttatccagcgaaaaacagaccttggccttgggacgctttatagtcttcggctggtttgactatacaccataaatagagaactcgtacaggagatagaaacactctggaaagatattgcaattcatgaaacctatgctcgtgggaatgaacttcaagttccccattgtactcattatttcatggaaaat

SEQ ID NO: 14672 - DNA, 474 bp, Gossypium hirsutum
  Clone ID: uC-gsflnu33B051a09b1
tttgtcagcaacagccatcatgcacaggaggccctccgtcgtgcaaagttcaagttttctggtcgtcaaaagattattgttagcaggaagtggggatttaccaagtacaaccgtgctgattatctgaagtggaagtctgagaacaggatcatgccagacggggtcaatgcacagctttttggatgtcatggtcctttgactaatacgcaacctggaagagctctcctctctggatcaacctagactctcaatatccagcaaaattttaagttctctccagaagctttctgttgaactcgtttctggtttatcattatagctgtgttgcagatcttcccttagtggatttcaggtttaaaatatttggtttaatgaattgttattcacaccattattatggaattcaattttattgctattatatttccatgttgttgccttggggcaaagattgtcttatgcaaattatatttc

SEQ ID NO: 14673 - DNA, 361 bp, Gossypium hirsutum
  Clone ID: uC-gsflnu33B051a12b1
tttaggcgatcctgcccacagcgctatccgcattgacccaagaatcaactggatctgcaatccggttcacaagcacagggaactccgaggactgacctctgctggcaagaaatacaggggtcttcgtgagagggggcacttgcaccacaaggcttgacctttaaggagggcaacctggaagagaaacaacacactctgccttcgccgctaccggtgatcccctggaccgtacttggtgattttgttcctgctatcttggcttcattactattgtagggtttatatgaattttgagacagttatattgtgtgtgggacatcttgaaatatctttttcgtagcggcttttgagatatatttgt

SEQ ID NO: 14674 - DNA, 505 bp, Gossypium hirsutum
  Clone ID: uC-gsflnu33B051b04b1
gtcttatgccaccagtttatatgccaccagtgtatgaaccaccagagaaggagaaacctgaacctaagccaccagtttatgcacctccaaagaaagaaaaaccagaacccaaaccaccagtttataagcctccaaagaagccaccagtgtatgagcctaagccaccaaagccaccggtttacacaccaccaaagaaagagaagccagaacctaaaccaccggtacatgagtctcccaagaaaccaccatatggtcactatccaggacaccctccactggggaagcctcaatagagagatcccatcggctagccatcccaagaactgagctactatggctatatggataaattagtatctatacaataaaagttgcttcctactcatgttctatgttcttgtatgttcttgtatgttatgtaggaatgttttcttttactagcgagaatgcttatggcagtactcaatggaatgactattctatgtcttcttatttttcaatgagc

SEQ ID NO: 14675 - DNA, 183 bp, Gossypium hirsutum
  Clone ID: uC-gsflnu33B051b06b1
ggtacgtatcgcacatccagagaagtataccgatgaagggaagccaactcctactgagtttgaggaccctaagctttatcattatgcgattttttcggataacggacttgcagcatcagtggtggtgaattccgtcacgaataacgccaaagagccctggaaacactgttatccatgtagtga

SEQ ID NO: 14676 - DNA, 350 bp, Gossypium hirsutum
  Clone ID: uC-gsflnu33B051b08b1
gttctttgctataccctaggactatagtcttctcttccgatccatccattactttcaaattttcttcttagatcaaacaaaacaatgtccggcgtttgggttttcaagaatggtgtggttcgcttggttgagaatccagcggctgagtcattagacggaagccgacagagttcgaacactcgccgtaaagtgcttgtgcacactccttctaatgaagtgatcacttcttatgcggttctcgaacataagctatggtctcttgggtgggaacggtattacgaggacctcagtctttcttaattccataagcgatcaactgtccatttgatctctctcccctaaagatttta

SEQ ID NO: 14677 - DNA, 100 bp, Gossypium hirsutum
  Clone ID: uC-gsflnu33B051b09b1
atataccctgttcataggagtcactttccctttctttggagatcttcatgttctccagcgtgccaaatagaggaaacgcatgagagaccggggggagagt

SEQ ID NO: 14678 - DNA, 338 bp, Gossypium hirsutum
  Clone ID: uC-gsflnu33B051b10b1
gtgacaactggtcctaacatggtggttgatatgtgtaaaggagttcaataccttaatgaaatcaaggactctgtagttgcggggttccagtgggcatcaaaggaaggtgcgatagctgaagagaacatgaggggtatctgctttgaagtctgtgatgtggttctccatgctgatgctatccacagaggtggtggtcaaatcattccgactgccaggagggttttctatgcttctcaacttacggccaaaccaaggcttctggagcctgtttacttggttgagattcaagcctctgagcaggcacttgcgtggtattacagtggatttaaccagaacct

SEQ ID NO: 14679 - DNA, 475 bp, Gossypium hirsutum
  Clone ID: uC-gsflnu33B051b12b1
tttttacgcgtccgaaaatatctcaaatctcctcctcctcctcagaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaaggtcgctgacgagaacttcatcaagaagcacactggtcccggtattctcttaatggctaacgctggtcccggaactaacggatctcagttcttcatttgcacggctaagactgagtggctcgactgaaagcacgttgtgttt

SEQ ID NO: 14680 - DNA, 256 bp, Gossypium hirsutum
  Clone ID: uC-gsflnu33B051c01b1
cttatattcctctcaaaactggaagaagagacggtagaaggagcagagcagatgttgtggaggagtatcttccggaccacaatgagaccatctctggcgttctcgacaggtttgccgccatgggtattgacacccctggagtcgttgccctcctaggagctcacagtgtcggcagaactcactgtgtgaagctggtgcatcggttgtacccagaggttgaccctgccctcagccccgaccatgttccacacatgct

SEQ ID NO: 14681 - DNA, 475 bp, Gossypium hirsutum
  Clone ID: uC-gsflnu33B051c02b1
cccacgcgtccgatccgtcatcatgacaacatcaaggcgtcttgcagaaagaaaggtggagaagttccaaaagaacataacaaagagaggagctgtgcctgagacaaccacaaagaaggggaaggattatcctgttggtcctgtgcttcttgggttcttcatattcgtcgtcattggatcatgtaaggattctttctttgccatcatatttccttattcgatgtgtatggataatttgtctggtttcttcgttggaaagtgtaatatgtttagcttttcttggtgttcagttaatttcatcattgtaatcttcaaggatatttgcttaaattaaaatatctataattacaatttagagtcaagattttctgcatgtcctgtctgtcatgatttactgatcaacttcgtttacattcaccgtaacagctctctttcagattatcaggacagcgaccagcggaggtatggcataagt

SEQ ID NO: 14682 - DNA, 481 bp, Gossypium hirsutum
  unsure (1)..(481): unsure at all n locations
  Clone ID: uC-gsflnu33B051c03b1
ctggtatgacgagacagcttcaaagttccttaagaagacttataatttacctaagaaactttaataacctggagtcgggagtaaagcaaaccaaggcaggctgcatcctatataacattgtttgctagcaatgttattataatttctacgtacttcgtatttggcctgcacaagttcctaaagatgtggcactaattgtgttactcttgtatagcatatcggccatgttcaggtgaaatccagctgatgatattcaccaagatatggagtggtgagaagagggaactagagagaggcagaggaccttcaagggcttacttgtgaggaaaggtgggttggatacactcattgtaagattcaattattatatgattatgagatttcgtcatatctaatttgtgtattctctacagcatgtangaagaatttttttgctttctgaggttcttttgttcataatttgttttaactatcattgctt

SEQ ID NO: 14683 - DNA, 92 bp, Gossypium hirsutum
  Clone ID: uC-gsflnu33B051c04b1
tcttattgacgagacagcatgtaggttttttaggaggacttataacttacctaagaaactttaataaccctgaagtcgggagtaaagcaaac

SEQ ID NO: 14684 - DNA, 493 bp, Gossypium hirsutum
  Clone ID: uC-gsflnu33B051c05b1
gtcattaacagccatcatgcacaggaggccctccgtcgtgcaaagttcaagtttcctggtcgtcaaaagattattgttagcaggaagtggggatttaccaagtacaaccgtgctgattatctgaagtggaagtctgagaacaggatcatgccagacggtgtcaatgcaaagcttcttggatgtcatggtcctttgactaatcgtcaacctggaagagctttcctctctggatcaacctagactctcaatatccagcaaaattttaagttctctccagaagctttctgttgaactcgtttctggtttatcattatagttgtgttgcagatcttcccttagtggatttcaggtttaaaatatttggtttaatgaattgttattcacaccattattatggaatttaaatttattggtattattatttccatgttggttccttgggaaaaaatcaaaataaaacccttttaatttcctttttccgatctttcttttt

SEQ ID NO: 14685 - DNA, 174 bp, Gossypium hirsutum
  Clone ID: uC-gsflnu33B051c06b1
gtttaacctccttgtattgcagcagagatagggaaagcgaattgcgtttgtgctctgcacaagtgaaaaaaaatatcagtctatgattcgggaattcctctattttcatgcagcttgtcatttggttgtaatgaaatatagattatcttcctaaaacagagtaatgcaaagcat

SEQ ID NO: 14686 - DNA, 498 bp, Gossypium hirsutum
  Clone ID: uC-gsflnu33B051c10b1
gtatcgcttgccctcttctttgccctcaacgttctcttcttttctctagtcagtgcttgcggttcttgcccttcccccaacccaaaaccaaagcctactccttccccatccccctcaggcaaatgcccccaagatacccttaagttaggtgtctgtgctgaggtgcttggtttagtcaatgtaactgttggttcgcccccagtgcaaccatgctgctcccttctccaaggccttgctgatcttgaagctgttgtttgcctttgcacagcactcaaagctaacgttttgggcatcaaccttaatatcccagtttccctcagcttgcttcttaacgtctgctcaaagaaagttccatctggcttccaatgtccctaattattgtttccaattctttgtcttcttggtgttttgtgtggctttgaaggtctaagtaagttattatggtgattggtaattgcttgtttcttagtggattgagattgaataagtgtactactt

SEQ ID NO: 14687 - DNA, 212 bp, Gossypium hirsutum
  Clone ID: uC-gsflnu33B051c11b1
tgatgagcagagcgtcgagagtagacttgaagaagtttagtctctagatggtctttatacagccatagttcaaccaatgcagaccaagaaatataattatcactgccttgaagtttgacagtagtaatggctggataactagaaattgaagaaaaaaaaaaaaagaaaaagaatagaaaaaaacaatgaaaatattgagaaaaagtggaagc

SEQ ID NO: 14688 - DNA, 197 bp, Gossypium hirsutum
  Clone ID: uC-gsflnu33B051d04b1
cctttaagactttttacagagagtgagatcgtgaaatactcttcctcttctttgatttccttttcttttctctataatgtcttcaaatctcctcattttctctcctactattccttctttctcttcaggaacagaaggatacaaatatggtccgaaaataatggtgaggagtataaaaggaactaaaaaaggggagg

SEQ ID NO: 14689 - DNA, 238 bp, Gossypium hirsutum
  Clone ID: uC-gsflnu33B051d05b1
ctattgtttgttaaataaactacgcgagatcttagccggtttaaaaccctccaactctttttcatcatcatcatcatcatcatcatcttcttactttgttaactgaaaaaaaaaaactcaacttagggctaaaaaaaccagatctctctcaatcgggatcaatggaagctcaatgcaatggattgttgcaataagaaatcggattcttggacggatataggagccttttgattgattg

SEQ ID NO: 14690 - DNA, 240 bp, Gossypium hirsutum
  Clone ID: uC-gsflnu33B051d06b1
tctattcgtccgcccacgcgtccggcgaggtttaaggaagtttatagtttgattcaagacaagggtttgttttgggctttcgatcaaatggttgaaactggtgaactaccttatgaggagataaaatctagagttttggttaaaaagaatgttaaggttattgaaattggaagtgaagaaatggggatggttctggggcaggtaataggaactattgggattagctcctgtgcatttagt

SEQ ID NO: 14691 - DNA, 385 bp, Gossypium hirsutum
  Clone ID: uC-gsflnu33B051d08b1
gatatcatccagataaaggcggtgatcctgaaaagtttaaagagttggctcaagcttatgaggtgctgagtgacccagagaagcgtgagatatatgatcagtatggtgaggacgcccttaaagaaggaatgggtggaggtggtggtgcccatgatccatttgatatcttccaatccttctttggtggcaatccttttggtggtggtggtagcagccgaggccgaaggcaaagaaggggagaggatgtaattcatcccctaaaggtttctttggaagatctctataatggaacttccaaaaaagctctctctttcacgcaacataatttgctccaagtgcaagggtaaagggtctaaatcaggtgcatcaatgaaatgttctggtt

SEQ ID NO: 14692 - DNA, 443 bp, Gossypium hirsutum
  Clone ID: uC-gsflnu33B051d09b1
attccacaacatctacccacagttgggtttctttgttctttttttctttttatttcttcaaaacatgtctgcgattcctccatcagcttcacaaaactcatcatcttcaggtttccaggatttcttgcccgtgatggctgacaagctcggaggggatggcttgataggggaactgtgcaatgggttcaacctgttgatggatagagaaaaaggggtcattactttcgacagcttgaagaagaattcggccccgttggggttacaggacttgacagatgacgatttgaagtgtatgatggaagaaggtgattttgatggcgatggggctcttaatcagatggagttttgtgtgttgatgttcaggttgagccctgagttgatggaagcatctcggtttttgtttgaagaagcttttcaacctgaattcaaggattttcattgat

SEQ ID NO: 14693 - DNA, 475 bp, Gossypium hirsutum
  Clone ID: uC-gsflnu33B051d10b1
gtaaaagctttctctttcacgaaacgtaatatgctccaagtgcaagggcaaagggtctaaatcaggtgcatcaatgaaatgtaccggttgtcaaggttcaggaatgaaagtctccattcggcacctcggtccttccatgatccaacaaatgcagcatccttgcaatgagtgcaagggtactggtgaaaccatcaacgataaggatcgttgcccacaatgcaaaggtgataaggttgtgcaagagaagaaagtcttggaggttattgttgagaagggtatgcagaatggacaaaggattactttcccaggagaagctgatgaagcgcccgatacggttactggggacattgtattcgtcctgcaacagaaagatcatcctaaatttaaacgaaagggtgatgacttatttgtagagcatacattggcacttactgaggccctttgtggcttttcagtcatactgactcacttagat

SEQ ID NO: 14694 - DNA, 456 bp, Gossypium hirsutum
  Clone ID: uC-gsflnu33B051d11b1
attatttttattcttcagtctatacggtctctgacgccgctacccatcacttctaaaacccttaagctatttaccgtctcaccggtcaccgctgccggtgctactcacctgcgccttcataagtcaacggctattattgcgaagatgatggcggaagaggaaggacagttattgccgtacgtatcacagatagtattgaagagatggaaaataagagatgagttagcgattactaggaggacccagttggagttgggtaaatacggcgccacgaagagcaagaagcaatccgatgtttctgacatcaaaagacctgaacaattaatgaaagagttcagagacagggaattggacctgatcagaacgaaacatagggcaaagaggccaaaatcaatgagtccaacgataaaatcaaagttggcttgtcattatccggatacacggcaaaaatgacat

SEQ ID NO: 14695 - DNA, 471 bp, Gossypium hirsutum
  Clone ID: uC-gsflnu33B051d12b1
agatatttcaattatgtggtggtgattaatgctcccattcttgtttattttcaatatcatgccgcagtagctgcaagttatactttgagtaccatgaagtccctagaaaaagccgatattagcatctatcagtttgattccattaatagtgaaacaagtgcaactcatcttattcaaggaatttgcaatgtgcggtctctaagtttaaccactgatgcagcgattttcctaactagtggacttcctatatttcacaaccttattgaattcaaatatcttggtgttggttttaatgggagagaaacttggcttgtggagtttctacattgtgtgcctaatctaaagacacttaccctcaattttccggatgatgcgggaacccgatggaaggctttacgtatgaaagttccttcttgtttgtcatttcaccttcaggagattgaaatttcatactttgacccacgtatgatt

SEQ ID NO: 14696 - DNA, 417 bp, Gossypium hirsutum
  Clone ID: uC-gsflnu33B051e01b1
ttcacgcgtccgcgaagtttccatagccgaagctccagctgaagtcgataccaaagaagtggtagaagaagaagcgaaggctgctgaggaatcggagaaagcaaaggaggaggtaaaggatgagaccccggaggtgcagacagaaacagttacagaggaggccaaagtagagaccgaggaacccgcggtggaagcagcggtggaggagaaaccagcggaggaggaaaagggagatgaaaaagctgaagagattcctgttgagaaaagtgaagaatagagcgaccaataccatacgtaaggtggcaaaagcttaaaggagcttcttttttctataggctggatgtcataattggcggagtcatactactattatttatgattactatgtccgatgtgggatgatgagggctttctttt

SEQ ID NO: 14697 - DNA, 467 bp, Gossypium hirsutum
  Clone ID: uC-gsflnu33B051e02b1
gtccatgggagacgcggttgatggaactgtcaacacgtaccgacccttcgaagacttgcttagagtccctctcgggaaagaatgaaagatgttcggaaccgtgctcaatgaaagcgaggaagaacaatgtcaccactagggtatccgcaaagccgccgcctcatactaggcaagttactcgatcatcttcaagtccaagttctgaatttcgattcgacgaaagctcgggttcatcgtcaatatgcacttctacaacaccagtttccggaaccaccgtcttgccatcggatgcgacgggggacagtggcaatagtaggccgaactacatgaacatgacggtgtctaccaaggcgaaacaaagaagtggcaatcacggattccaaaggcagtccatggatgagttcgagttcaagaggtcagcttgtttcgataacggagattcaaaaagctcaaagagaggaaattgt

SEQ ID NO: 14698 - DNA, 294 bp, Gossypium hirsutum
  Clone ID: uC-gsflnu33B051e05b1
cgtacgcgtgggcggacgcgtgggattcgagccatcggtttagcccaattcttgaccttccaattcttgactttttcatattcgtagctaattttgagtagcgaaccggtccccagtgacaacactaatatatcctcgacccctctaacaaaagggaactcctgtttattatgcaacacgtgcgtcattgctgctgtggtcgggttgcttccattgtcgtttttcaagtcatctaataaccctaaacccaccaccccttaagatcatttttatcattttctcgagaaaatttgt

SEQ ID NO: 14699 - DNA, 475 bp, Gossypium hirsutum
  Clone ID: uC-gsflnu33B051e06b1
gttcaaggtgaagttattgaacaatcatttggagaggagcacttgtgcttcaggacgcttcaacgttttactgctgctacacttgagcatggaatgcatccccctgtctcaccaaatccagaatggcgtgcactcatggatgaaatggcagtagttgcaacaaaggaataccgttctgtagtcttccaggaacctcgctttgttgaatacttccgcctagcaacaccagaattggagtatggtcggatgaatattggaagccgtccatcaaaaaggaaaccaagtggaggcattgaatcactccgtgcaatcccatggatctttgcatggactcaaacaagatttcatttacctgtgtggcttggctttggggctgcatttaagcacgtcattcagaaggatataaagaatctccacatgctccaagagatgcacaaccaatggcctttctttagggtcacaatggacttaattg

SEQ ID NO: 14700 - DNA, 390 bp, Gossypium hirsutum
  Clone ID: uC-gsflnu33B051e07b1
gtaaactttatcacccgtctctgagttgaggaactaaggacaactctggttcgaagtttgaatctcaatggaggagcgcgactggtagcccaaatttgactgctgactgctataccagagctaatgagagaacgcaatgcagaacgggaagtctgacagtaacaagggcacgagtagggatgatgccagtaggaactccaagagaaccctatagagttgcaggtgacggaactagataagggtgctgatggagggaaagcactatatcaagagcgcgctatttgcattgagcaacagatggatgatgtattaatgacctaaatagtggcagcaggggcatacattgatagtatagatgattagaacaggcaaaatgaccacagtgatggg

SEQ ID NO: 14701 - DNA, 430 bp, Gossypium hirsutum
  Clone ID: uC-gsflnu33B051e10b1
gttccgcgcagtgttgatgctgatgattctgatgtggaagtcaacagtgacaatgaaagtgatgacgacgacgacgatgatgatgaggatgatgaagaagctctcttggctgagctcgaacggataaagaaagagaaggctgaggagaagctccgccaggaaaaactagagcaagaagaacagctaaaagccaaagaagctgagcttcttcgaggaaatccactactcaataatccaacatcttttggtgtaaaaagaaggtgggatggatgatgtggtgttcaagaaccaggctcgcggtgaaaccaagcctcaaaagcgcttcattaatgataccataaggaatgacttccacaggaaattcctgctgaaatacatgaagtaattcgcttggataccctagcagttagcgaatcaagtaaaagaattt

SEQ ID NO: 14702 - DNA, 378 bp, Gossypium hirsutum
  Clone ID: uC-gsflnu33B051e11b1
acgcgtccgtgagttccgcttctctagaggtctggtctactcaacactttctcctccctcttagcaaccaaagactcagatccgctcggatttctttgtcccagaactagaatggagacctttctattcacatcagagtctgtaaacgagggacaccccgacaagctttgcgaccaggtctctgatgctgtgctcgatgcctgccttgcccaggaccctgacagcaaggttgcctgtgaaacatgcaccaagactaacatggtcatggtctttggagagattaccaccaaagccaacgtagactatgagaagattgttcgtgatacatgcccgttcattggatttgtttctgatgatgctggtcttgatgcttgtcaa

SEQ ID NO: 14703 - DNA, 196 bp, Gossypium hirsutum
  Clone ID: uC-gsflnu33B051e12b1
tctttcaacacaccttaaatcatccataattccacaccagaaaacagagttaaagccaaagtttctcgatggagaatttgctagggttgttgagaattcatgttcaaagaggggtgaatcttgctgcgagagatgtttttaccagcgatccttatgttgttatcagaatgggaaaacagaaattgaagactcgtgt

SEQ ID NO: 14704 - DNA, 357 bp, Gossypium hirsutum
  Clone ID: uC-gsflnu33B051f03b1
ctggatctcattagatttctctgtctcttcccgccgatcatctgcaatctgattgaaagttttgtttaaagaagaaaaaaacgaacatgaagcttgacaccaccggtatggaatcggcggtgccggtttggggttctcataatgaatttgttgatgagcttgcggttgctgcgacattcgagctcccaaatactactgattttgatgggcttcaaaaagaagctattcatatggtgaaacctgttaaaggaaccaccacacttgcctttattttcaaggaaggtgtaatggttgctgctgattttagagcttgcatgggaggttatatattatcacagttagtgaagaaaattattg

SEQ ID NO: 14705 - DNA, 168 bp, Gossypium hirsutum
  Clone ID: uC-gsflnu33B051f04b1
aaaataccaacccttgttttcatttttgttttgttaatggattctgcttctgtagggggtgctgcaaccgatccgaatagcatcaacgagggtccatcatctgctgtagttacagctatagcaactccgcccacggtttcacaacaaggtggaagcttactttttttt

SEQ ID NO: 14706 - DNA, 235 bp, Gossypium hirsutum
  Clone ID: uC-gsflnu33B051f05b1
cccattcgtccgagcaatgcatggaaagtttctgttatttgagagcaggtaggttctaagccacgggacgctacccaagtgaaccaaaatttaatcaaatatgttgtctagcttcttatagtgttgtgactaagtaagaaaatggcagacaccatgctattccaaccttacttgttaatatcacattattctcctttccccttaaaattgttaatcgtagaaatgattttttgtg

SEQ ID NO: 14707 - DNA, 416 bp, Gossypium hirsutum
  Clone ID: uC-gsflnu33B051f10b1
ggggactattgaatcattacgagccatgccaatggaagccttggtcgaagaatttcgagaaaacaactcgtacgagtcatttgaaccaaagttgttaaagtcatcagttgtaccaacacgctctccccttaccgaaatcaactaaaatccagtgtgctctctcttacattcataatattctttgcaaaaattatatttgtattttgtatgattaaggtcacacctgttagtcatcattcatcatcatcattggatgattgtaaggttgcagccagtaaatggaggtgaaagggggtatactacaagttaccagaggcatcacttggtaagaaaaatggaaaaaaaaaggtaataagttttttttctttcggtttattgattttttaccttctttatcaagtaaaaaggctcgtatg

SEQ ID NO: 14708 - DNA, 397 bp, Gossypium hirsutum
  Clone ID: uC-gsflnu33B051f11b1
agcgtttgtctcagatttttgaagatggcccgtaccaagcagacagcccgtaagtcgactggtgggaaggctccaaggaagcaacttgctaccaaggctgcccgtaaatctgccccaaccaccggtggtgtgaagaagcctcatcgctaccgtcctggaactgttgctcttcgtgaaattcgaaagtaccaaaagagtactgagcttcttatcaggaaattgcctttccagaggcttgttcgtgaaattgcccaggacttcaagactgatttgcgtttccagagccatgctgttctagctctccaggaagctgcagaggcataccttgtgggtctttttgaagacaccaacctttgtgcgatccacgccaagcgtgtcacaattatgccccaggaca

SEQ ID NO: 14709 - DNA, 379 bp, Gossypium hirsutum
  Clone ID: uC-gsflnu33B051g01b1
cttacgcgtccgcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaagtggccacgttaaccccgccgtcaccttcggtgctttcgttggcgggaacatcactctcttgcgcggcattctttactggatcgcccaacttct

SEQ ID NO: 14710 - DNA, 276 bp, Gossypium hirsutum
  Clone ID: uC-gsflnu33B051g02b1
attattgttaccgctgtggaaacatggcttctatattggaagttgacgattgcaagagtcacacattcatccagtttgagccagctccaaggagaggtgaacctgatgttacccgtagaacaccggattacttcctgtgaagcagctatatgccacaacttattcaagatactcaacttttgttcctctccgctctccccttacatagttaggtagttgtggatcctttgcagcgtctgttgcatctactgcctgccattcttacatatctttttt

SEQ ID NO: 14711 - DNA, 267 bp, Gossypium hirsutum
  Clone ID: uC-gsflnu33B051g04b1
gattttgctgatacaaattttgccaaaaaatgtactatgctatatttactatactgcccgcatcataaacacgtactgcttttatttaaactgcactcatgactatcactgtaaattaacgcgacataacctacaacggccataacccacagaacgcaacatcagacattgtaggttcaccacaatgggggagcaggaccatttagacgggccaagattactttcgagacctggccatgtcatacgaccccattaccttagacaaca

SEQ ID NO: 14712 - DNA, 447 bp, Gossypium hirsutum
  Clone ID: uC-gsflnu33B051g06b1
gtatgctctcgatccacatcattaaaaaagtaatggagaaaatgaagggtctgcaggcacttatattggcaatggtaatggttatggcgatcgctacaactgatgctcaaagcatttgcaacatgccagcttcaggtttgatggcatgcaaaccagcagtgacccctcccaaccctccgccgcccacgtcaacttgctgctccgccctctcccacgctgacatgcgttgcctttgctcatataagaactccaagctgttgccttcccttggtattgacccaaaccttgccatgaaattgcctagcttgtgcaagcttcctcatcctgcaaattgttagttcctggctctccatatttgatctcaaatgtgagggaaaatcatgcttattataagcctctacttcacattaatgtactgagcttcgggttttttaattttattcttct

SEQ ID NO: 14713 - DNA, 393 bp, Gossypium hirsutum
  Clone ID: uC-gsflnu33B051g07b1
tcggactggtgctaccttctgattctccacttcgcactagtctattaacggagttccatttgtcccctgttggcggccactcaggcatcacccgtacgtttcatcgccttactacaaatgtttattgaaagaatatgcatcgagatgtccgctcttgccagatctgtcaacagatgaagtctgctacaatttctccagctggcctccttcaacctcttccaatttcgattttcatctttgaaaatatttccatcgactttatcaccgagtttccaccttcaaagggtaaaaccgtggttatggtggtcgttgatcgacttttataatatgggccttttgtgggtctgtcaactcatttttctcagcaaatagttgctttttgcttttggcaag

SEQ ID NO: 14714 - DNA, 495 bp, Gossypium hirsutum
  Clone ID: uC-gsflnu33B051g10b1
atgagatccctattagccatttttctcctcctttccttcctgtccatatcaaccgcaacatcaactcgaaaaacccgaacccgaaatccatgcacgagcatcgtgtattatttccacgacataatctacaacggccataacgcaaagaacgcaacatcagccattgtaggttcaccacaatgggggaacaagaccattttaacaggaaaaaaccatttcggagacctggtcgtgttcgacgaccccattaccttagacaacaacttgcattcgaaaccagtgggtcgagcccaagggttttatatctacgacacgaaagacatattcacagcttggttgggtgtctccttcgatttcaattctacccaaaataaaggaagtataaacttcgccggtgctgatccgttgatgaaccagacgagggatatattagtgattggtggaacaggtgatgtcttaatggctcgaggagtggctactttgatgactgatgcc

SEQ ID NO: 14715 - DNA, 499 bp, Gossypium hirsutum
  Clone ID: uC-gsflnu33B051h01b1
agagaactccgacgacgtaaccgtgaggtgatccaagtaattttcttccttcttcttttttgttttcgtttacatatctaaataaaatataaagtaatcaaataaaaaagaaaaaaaagaacaagaatttaaaacgaaagtaaaaaaacctttgaagcttttctctgttttttttctgttttcgatttctttttaaaaaaaaatctgtaatacaatattttttctttttaaaaaaaaaaacccctttacatttctgttctttggctatatagccgaatccccccttctattactggtctctctactttgtattatttctgcctctgttctcttttgttttgtttgctgctttggttttgcaagtgtcagaggagcgatgggatggtggcgtgctgcaggcatggccaagagaggggtacggcgcacatggggctagggaggcgcggcgccaggatgagctgggtttttgcctactgaaagtttgttaggtctggcctgt

SEQ ID NO: 14716 - DNA, 390 bp, Gossypium hirsutum
  Clone ID: uC-gsflnu33B051h02b1
catgattattgctgtctgtgccgatgatcctgagtatcgtcactacaatgatatcaaggaactcccacctcaccgcctggctgaaatccgtcgcttctttgaagactataagaagaatgagaacaaagaagttgctgttaatgactttctgcctgcctctactgcatacgaggcaatccaacactccttgaatctctacgcggactacatagtggagagcttgaggcggtaattgtcggttcaccgtgccccgtctatatacaaatatatatattaatatgaatatgaatatgttgctactatacaagaaattcatcggcttcttgtgcgggcagaaacaccctgcacttaatggttttgcgacaaagaaaaagtgtttttcattttata

SEQ ID NO: 14717 - DNA, 311 bp, Gossypium hirsutum
  Clone ID: uC-gsflnu33B051h03b1
gatgacaaggaagaaggaaaggaagaaggaaaggaagtaacacagcagtgggaagatgaatgggatgacgatgatgtcagtgacgacttctcactgcaactgaggaaggaactcgagaataacaccaagaactgaaccagagttgtgcttctctattgtcttgcttcctcgtttgaatttattttggtttcttgcaaaactgatgtttgagctttaactctttatgattgggatgttttatagaaacagtgtgcagaagctggtctttatggttatctgaaatatagattgtgtgggtgtttgccttgttt

SEQ ID NO: 14718 - DNA, 401 bp, Gossypium hirsutum
  Clone ID: uC-gsflnu33B051h04b1
cttattcgtccgcccacgcgtccgaaccaccattagacccatttttaaaccccaattcctcctttgttacagaagtagaacgaaaatgtcgcctttatccaaggtttttgcttcatggtgcaagaagcatgcagatggagatgatgatgacaatgattttgactatgctcccgcagcatgcatggaaggcaatggcgacgatgatgatggagactatgacgttgctccagcagcttctctcgagggtgatgatgatgacgatggcagctatgattatgctccagctgcatgataggagtgagtttatgagtgcctctaaccgtggggtttctaacccaaaacttttttgcatttatgagtgccccccccccccccccccgcttgcgcttttaaagcaccct

SEQ ID NO: 14719 - DNA, 527 bp, Gossypium hirsutum
  Clone ID: uC-gsflnu33B051h05b1
tctatgtgttcgcgatgatagacaaagaagtagctgttgggacggatcctaataacgtatttgtgtgtggattaagttaaggaggtgtttttacttatgttaggtgtaatgttgatatttattaattttatttttttttttttattattatatttattatgtttttttttattatattattttattattataattttattttattttttattatttaataatcttatttttttttttctttattttcattttttataatatcattattattatactgtttttttattttcttttattatattaaatttattatttatttattaaatctatttatttaactaaatctttatttttatattttttgtctttttttttttttattatattatattttttttgcttataaatatattttatttacatgctttatttttatatttattttatttataatgatatattttatttaattttttttttttatattttattttttatatatatttattttatataaattttatttt

SEQ ID NO: 14720 - DNA, 85 bp, Gossypium hirsutum
  Clone ID: uC-gsflnu33B051h08b1
ttcctacgcgtccgcccacgcgtccgctttttgagtcaaaaaaaaaaaaaaaaaaaaaaaaaattataaataattaaaataaaaa

SEQ ID NO: 14721 - DNA, 503 bp, Gossypium hirsutum
  Clone ID: uC-gsflnu33B051h09b1
tcaaaaatctcagctagctagcttttcccctccattaaaatccatggcttgcaccattagcatgaagatgaccttggctatccttgctctctcattattctcctcttgcttacaagccacactaggggaaattatatgtgaacaccttgaccaagacacctgtgcttacgcggtggcgtccacaggcaagcgctgtgtgctcgagaagcacgtcaagaggagcggtgaagaagaatacacttgccgtacctccgagatcgaagccgataagataaacaactggatcgaaaccgatcagtgcgttaaatcgtgcggcctcgaccggaaatcattcggtatctcctccgattccctcctcgagtctcgcttcaccgaaatgctttgctctcctcaatgttacaatggttgccccaacgtcatcgatctttacttcaacctcgccgccggagaaggtatttttcttcccaattatgtgaagcacaaaaaggaaacatacgtagagg

SEQ ID NO: 14722 - DNA, 360 bp, Gossypium hirsutum
  Clone ID: uC-gsflnu33B051h10b1
ttcacgcgtccggaaaaaaagtgcggatcaagcatagatggaaaacatgggagttttaggcaaggtggtggattaccttctattgttatcattctttagcatcacattaacagctcagttggacatccccgagtccatcctcccccacgcctacaatcccttctatcaagtttataccacgttaacccaggattatttggtgcttgagcagcctggttttttcaaggcacttatgacgttggaacttgtttaccaactccctctcgctttgcttaacatctatggattgttatactccaagccctggttcaacaccacctgcctcctctttggtgcctctatcgttgcctctacgacagc

SEQ ID NO: 14723 - DNA, 491 bp, Gossypium hirsutum
  Clone ID: uC-gsflnu33B051h12b1
tttttacgcgtgcgggccgacttctgcttgttatccactcgccaactgtaagactccaatacctactttcttcaccatccatgggttatggccaacatttgccaacgacaccgcagttcctgcttatgggcctaataatagatgccatgccaatcctgttggtcccgatgctgctgtggctagactaacacccattcaagacagactaaaccaaaggtggccaaaccttagggcaggggttgaaaactctgttttttggagacatgaatggcaaaaccatgggatgtgctctgattatcctcaagatcctttgagttattttaatgataccttaaatcttgcaacttccaccaaattcgaccctttcaaagctttgggagttcaaccatcaaacactccctatcttttaaacacattgctacaaaatgtgtacaagaacgtgggagcctatccttaaatcttatgcagtcaacgaacaggaggcgcacttt

SEQ ID NO: 14724 - DNA, 267 bp, Gossypium hirsutum
  Clone ID: uC-gsflnu33B055a01b1
aagttatgattacaatcatcctcttcttggttgcatcgaggacactgggcatcagcaactatacgtttaatcttcagattagcaaaagtaggaatgtaattccaagagattccccatattgtaattttgactttcgaggggatttgtaaattccatagctttttgtaaaaggctttagtttcggtttgtaaattaataggattttgagtaccctcctgtaatagtttgtaggtgcttctaaccgaaaatttgccaaatgattctcct

SEQ ID NO: 14725 - DNA, 187 bp, Gossypium hirsutum
  Clone ID: uC-gsflnu33B055a05b1
cctccgctcacgctagcgtgttcagttctgctggcaacgttacaatggaaagaaccggcgagtcatttcgccgcgcgtcaacagaaaatcgaggatacgctcacggccaaacaaatccctattattactttggtgccccccaaatcgaaccccacttacccagagtttccaacccgcctcacttcga

SEQ ID NO: 14726 - DNA, 421 bp, Gossypium hirsutum
  Clone ID: uC-gsflnu33B055a06b1
ctttcgttttcgaagggatggagcaccggaggaaccagcatacgtctcggtgacgacaacttggaaggcttatgcagggctctgcaccccggtccggttagcttgttgcattggagcggtaaaggaaagccatggctgagaatcgactctaagagaccctgtccgttggattccttgtgggctccttacgatctgttccgccatccgtctttgttctccaatagctaaaatacggcggagagagttcatcggattacgcaggagaataaggacacgcgtaaaaaaaggaaagcaccttgcaacttgcttcgccagtgaaaatatggagttaccgcgggtataagctgcctgacaaccgcgctggttgccatgttgacattctggtttgagtgctcatataggaaagtgggaaagggaagtt

SEQ ID NO: 14727 - DNA, 419 bp, Gossypium hirsutum
  Clone ID: uC-gsflnu33B055a08b1
tgttgatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgggtaatagaagctttgtttgtggtgaaaataatgtataagccatttggttgggagcaaattgtccttttctccaaaggattttt

SEQ ID NO: 14728 - DNA, 472 bp, Gossypium hirsutum
  Clone ID: uC-gsflnu33B055a09b1
ttttatgttaagaaactgcaacaggagcaattcaaaccttttgaacaagtgacgctcgaaccgtttgagcgcgaccatgcttgtgttgttggtggttaccggatgccgaataaacagaaagctgcacataagggttttggaggcttagttttaagccctaagtttcgtggctttggattagaagtgatgaacatgttctgggatcaaacatctttcttttttgtactaaaaatcaaatttatttctactaaggagaaagggctcctaattagacaaacaaagcacaagaatcgtgtcttttatttttagagagggttcaatccttatttgagtttggatttgacaataattactattggggtgaggaaatttctgttgattagattggtacttgatatgttttcattaagaattgagtctttgaacttggttaatgtttttgatggagttttaaagaaatatgttttgggag

SEQ ID NO: 14729 - DNA, 474 bp, Gossypium hirsutum
  unsure (1)..(474): unsure at all n locations
  Clone ID: uC-gsflnu33B055a12b1
tcgttttaatcaaagctgcttctgtgaaagggatgagctacgtcgtcttcactgcctactgttatattttaggaacccttgttttcctcctcctagtctccctctttaaaagcaaatcagtgctccctcaattgaagtaccctcttttttccagaattttccttattggactttttgggttttcaggtcaattatgcatgtacaaaggcttacaacttagttccccaactctggcttcagccattagcaatctcacaccagcttttaccttcatacttgctgtcttcttcaggattgaaaaagtagcatttagaagttcaagcagtcgagctaaaatcatgggcacctttacatcaatatgtggtgcattagtgattattttttacaagggccccaaagntttttcattatcatcatctgctatacaccaaaggcctctagggttaatgtcatctgaatcaaattggatcattg

SEQ ID NO: 14730 - DNA, 531 bp, Gossypium hirsutum
  Clone ID: uC-gsflnu33B055b02b1
gcgccttcttgtccgatgaaactctaaaccccaactctccagattacatattgcaaacagtggggtcattggattcaaaagaatcaccagccaataacccaggccttcattctccccctgatgaagccaccaaaggctacatcatgcagcaaaccatgtttcgaatcaaggacccaaaacctacccttgaattttatagtcgcgttttgggcatgtcgttgctaaacaaagtggatgttccatatatgaaaatgacattgtatatgatgggctatgaggatgtttcatcagctccgagtgacccagttgagaaaactatttggacatttggaagaccagctactatggaattaacacatttctggggtactgaaaacgaccctgagttcaaaggataccacgatgggaattcagaacctactggcttcgggcacattggcatcaccgtggatgacatgtataaggcatgtgagagatttgagagtcttggagtagaagttgtcaaaaacccagcgatggttatgcattcat

SEQ ID NO: 14731 - DNA, 376 bp, Gossypium hirsutum
  Clone ID: uC-gsflnu33B055b05b1
gcaagactacttatttctccgctggcgatcttctaattcaaccggagtgccctaatagccacggtaggcaagaactgttcggccattgacagagaacggagactcggagtacaactccaaactatcgtcacctatttccagaggattgataaagcccacgatcgactgttacttggcttttccggcctcggcaccggtgctcaaaccttgtatcaaaggcttggctctaggtacaaactgactgagctcagagatgaaagagacacgaaacctgacactattgctaaccttgactatgcgattctttacgagaaaaggttggggccatacttgagccaacctgcaattgctggattaggagatgaagacatggcct

SEQ ID NO: 14732 - DNA, 389 bp, Gossypium hirsutum
  Clone ID: uC-gsflnu33B055b06b1
cctactctctcgctctctctctatctctcgcttgaatatttttttctatattcaacaatctgttcaacacctgtatgtcaactgatgtggaaacattcgcatttggatccacttgaagagctagatgcgaagcaaagctatatctatggatagagtcatccgtttgcatttccggctgcatgaagtgctggaagaagtggtgcgaggaaggacatcatccgtcaacgacttgagaaaagttaccgaacagagtactcggatattcctcgagttcccctcagaacaaaaaagggaattgttcgtaaatggatcccaagatttgaaatctgtgccctacttggaaacctacacagaggatgtttgctcatgaaatctccaaagaatttgca

SEQ ID NO: 14733 - DNA, 522 bp, Gossypium hirsutum
  Clone ID: uC-gsflnu33B055b07b1
ctttaatttctcctgtttcttcagttccaggcgacatcaggttcgtgacattcaacataatctcaggaacatcaatgtcttgtcctcatgtttctggtgcagctgcctacgttaaatcatttcatcccacatggtctcctgctgctattcaatctgcccttatgaccacagccgcccccatgagctctggcatgaacatggaagctgaatttgcattcggttcaggccatttgaatcctttaaaagctgcaaatccaggtctagtatacgatgctaatgaaccgattacataaacttcttatgcggacaaggatacgccactcggctaatacaattattatccaaagacaactccacttgtcctaaagacactaatgggacagtttcggaactaaactacccttccttaggtctttccacttcgccattgaaaccattcagccgtaccttcaaaaggaccgtcacacacgtgggatctccgacggcggtttacagagctcacctgagtttccgacaggtacg

SEQ ID NO: 14734 - DNA, 503 bp, Gossypium hirsutum
  unsure (1)..(503): unsure at all n locations
  Clone ID: uC-gsflnu33B055b10b1
tcgattggcaaagaacaagaaaccggaaggtcaagaatgtctaaatgactcggacaatcagagtgtcgacaatctagtatctccgtccggcatttcaccaagtcaaaatctgattccaacttcaccagcaggtgtatggcctggttcaagaacaatggatatgcgtaacactcatgttgacatcgatctaatgcgcggttgactcgtttcctctaatagtttcacaagcaatgtacaaagtttgctgctacaggcagcctgattttcagcttgacggaatctcacttgattttactcgtcgacaagagcggtggtttggtccgatatttgtagctttgatagaccgaactcacgatttctactgatcccatcggtaccatttcatttctccaatttgaaccagttntaaattagacatgcttcagtcctctttataggcagccatggntnttagttatctttattttacttttcgacattattgacatttatgtaccccgatc

SEQ ID NO: 14735 - DNA, 518 bp, Gossypium hirsutum
  Clone ID: uC-gsflnu33B055b11b1
tgcttacgcgtccggtgattctcactccccacggatacttcgctcaagacaatgttttggggtatcccgacaccggtggccaggttgtttacatcttggatcaagtccgagctttggagaatgagatgctcctccgtataaagcaacaaggactcaacatcacccctcgaatcctcattattactagacttcttcctgatgctgtcggaacaacatgcggtcaacgacttgagaaagtatacggaacagagtactcggatattcttcgagtacccttcagaacagaaaagggaattgttcgtaaatggatctcaagatttgaagtctggccatacttggaaacctacacagaggatgttgctcatgaaatctccaaagagttgcaaggcaagccagatctgatcatcggaaactacagtgatggcaatatcgtcgcctccttgctcgcacataaattgggtgtcacacagtgcaccatcgcccatgctttggagaagacaaaatatcctgattcagat

SEQ ID NO: 14736 - DNA, 512 bp, Gossypium hirsutum
  Clone ID: uC-gsflnu33B055c01b1
atttctttctcccttctctacactctcatcgtctcagcttcaaaaatttcttcgcagactttctttagaaagatatattttctatttccactttcatttctactcattttttagacgcataattctctgtggcttgtaattttttagactgttgtaaaggaggaaaaggagagaccgtttctggaaatttttggaatgggggagttggaaagattttgaattttctctgtattttaataatgaaaaatctttccaattcctcccattccactgatttctaacacttcctctccattttcttactttcttcaatcctttttgtttcatcatttcttgcagtttgtaagtgaaatcggtaaaccttacctaattttcttactcttctgttgtatttttatatagatctattcttaaccgtcttccatggatcttttgagatttgcttcttgctatatagttccagatccttggttttattttttagttaaaaattaggtacaagggaacttatt

SEQ ID NO: 14737 - DNA, 527 bp, Gossypium hirsutum
  Clone ID: uC-gsflnu33B055c02b1
cccacgtgtccgtgggattgtgtaccagttgggtattgctaatcacagtaccagtattgctgtatacttgctttcttggatctacatttttgtggcatttggaatttatctggtaatctcatatgctcgggacaaatatgcagctaaggagcatatatatttccggatggttcagttcctggtcatcattcttggaatactagttattattgcactgcttgagtttacagcctttaattttgttgacattttcaccagtttattggcttttattcctactggctggggacttatatcaatcgctcaagtacttagaccattcctgcattctacctggctttgggaatctgtggtttctgtagctcggctgtatgatataatgtttggagttcttgttatggtccctctggcatttttgtcgtggatgcctggatttcagtcaatgcagacaaggatcttatttaatgaagcatttagcaggggcctgcgaattttccagattgttactgggaaaaaatcaagtgact

SEQ ID NO: 14738 - DNA, 534 bp, Gossypium hirsutum
  Clone ID: uC-gsflnu33B055c03b1
gttgactactcaactatggtacaaaaggctccagaaggaacacctgcaggtggaggtttacttgtagttattgtgcatgaagctgaagatatcgaagggaagtaccacacaaacccacacgtgcgactgtcattcagaggggaggagagaaaaaccaagcgtgtaaagaaaagcagagatccgagatgggaagaagaatttcagtttatggtggatgaaccacccacgaatgataaaattcacatcgaagcgttcagtacatcctccaggatagggctactgcatcccaaggaatctttgggttatgttactataagcctagctgatgttgtgaataacagaagaatcaatgaaaggtatcatctgatcgactctaagaacggtcggattcaaatcgagatgcagtggagaacttcttagatatgccagcaatttgtttatgaggaaaggaaggtagtcgtgttacttgagactgtactgtcactatgtttctttcttcccttcccttttcctgttgatcaagcttcttgactc

SEQ ID NO: 14739 - DNA, 55 bp, Gossypium hirsutum
  Clone ID: uC-gsflnu33B055c05b1
cgttatcttttccgtccacgcgtccgtccacgcgtgcgttagttctagatcgcga

SEQ ID NO: 14740 - DNA, 163 bp, Gossypium hirsutum
  Clone ID: uC-gsflnu33B055c08b1
tgtttgtcctggagttgtttcttgtgctgatatccttgttctgtctgctagggaaggcatcgcttccttgggaggacctaatattcctctcaaaacgggaagaagcgaccgatgacgtatccctgcaacaaatatgcaggtaaagaacatatacatttcccga

SEQ ID NO: 14741 - DNA, 432 bp, Gossypium hirsutum
  Clone ID: uC-gsflnu33B055c10b1
cttacgcgtccgcccacgcgtccgattcgattaggcgcggttgtcattaccgggatcatcttagccaccatgttttggaagctagacaattcaccgaaaggcatccaagaacgtttaggtttcttcgcttttgccatgtcaacaacgttctacacttgcgccgaagcaatcccggttttcctccaagaacgatatattttcatgagagaaacagcttacaatgcttatcgtcgatcatcgtatgtattagctcactcgctaatctctatcccatctctagttatcctctcgatggccttcgccgcaataaccttttgggcggtcggactcgctggtggcctttccgggtttttcttcttcttcctaaccatcttcgcctccttttgggccggaagctcgttcgtaacattcctttccggcatcgtctcccat

SEQ ID NO: 14742 - DNA, 506 bp, Gossypium hirsutum
  Clone ID: uC-gsflnu33B055c11b1
attctgtaagacattttcaggaaaatgaagcttcccctccccctccccctcccccttcctcttggtttgcaaatcagtgccattgacaatagtttggtcaaggagcttttccggttcctcctccatccaggatttggcatttgatctgtccatttctgcttttttgcgagataacatctacaactttggagaactccttgctcatccaattgcttctttagcgtttacaagtctggtcattgcagctgttggataattggatgggcaaagtacataacgcttggttatcaactgaggctaaaaacacctgatctcgttgcatcatgaatttttttctccagttcctttctgccattgtaacaatttcgttatttgaaaagggaagaagaagggaaagtgaaatgattagcaatgaggatagagataagtgttagtcatttgcgggaatagccatatttgtatgattcctttagtaggtattgcttgatccttaaatctttgttctg

SEQ ID NO: 14743 - DNA, 121 bp, Gossypium hirsutum
  Clone ID: uC-gsflnu33B055c12b1
ttggttgatttgatgtttgtgggtgtttttcatgaatgaaaaaaaaaaaaaaaagaaacaagaatttgtacttgttgttaataaggaaatgtaaataaaccttgattacgaatgtttcctt

SEQ ID NO: 14744 - DNA, 532 bp, Gossypium hirsutum
  Clone ID: uC-gsflnu33B055d01b1
atttattttagttctactgagacattgaacgctgaggacaaatttttctgtgacaagtgctgcagtttgcaagaagcccagaagagaatgaagataaagaagcctcctcacatcctggtcatccatttaaaacgattcaagtacattgagcagcttggccggtacaagaagctctcataccgtgttgtgtttccacttgagctgaagctgagcaatactgtggaagatgcagattcggagtattctctgtttgctgtagtcgttcatgtgggaagcgggcctaaccatgggcactatgttagcctggtgaaaagccataaccactggttattttttgacgatgaaaacgtggagatgatcgacgagtccgcagttcagacattttttgggtcagcccaggagtattcaagttatacagatcatgggtatatcttattttatgaaagacttggtgcaaacaagaatagcttgagaagagggtttggcttttaccatgagttgctgttctagaatcaggaaaaaacgggaaaaa

SEQ ID NO: 14745 - DNA, 322 bp, Gossypium hirsutum
  Clone ID: uC-gsflnu33B055d02b1
ttttgctcgcgaatttggtgatctgcagaatcagagggtaaaattggaaggaaaaaaaggctaaaagaatgtttttgcgaatgatatcgcggtcgttgttggctaaggtgaaggagacaacggggatcgctggattagacgttgcacctaacgcaagggaagtccttatcggtctctacaacaagactctgaaggagatccaggccgaacctgaagacgagggataccgtatggccgttgagagcttcacgcgccaccgactgtagggttgccaagaggaggaacactgggataagattgttaagccccttaaatgttcata

SEQ ID NO: 14746 - DNA, 520 bp, Gossypium hirsutum
  Clone ID: uC-gsflnu33B055d03b1
gttttctgatggtcacagcagtcgcgatcaccaatcaggccagctaagtctggatgagaaagcatttcacagcacctcttctaaagtaatttctgctgtcaatgcacagaagccacagcggaaatcacttcccaaactgccttctcagaagactagactgtctggttcaacaaatgacgaaaagacatctaatacgtccagccagaaaaaggtcaatgcacctaaagcatctaccgagggaaagatagccttgcctaaagcaataaatgaagaattatctccaacccaactgcagccagcagtttctgctgctggttcatatgaaagtcagcgagacattgatcaagtggacttggttcaagagccgattgcactggagcattaagcatggcaatggtgtcaagtggatgttcatatacaaagttcttgacctgaatttgcctaaataaggacgtctaacactgaattatctgatgatcaacgcataaaaaagattatacattaccggatatgatgttgt

SEQ ID NO: 14747 - DNA, 487 bp, Gossypium hirsutum
  unsure (1)..(487): unsure at all n locations
  Clone ID: uC-gsflnu33B055d04b1
ctttcattttagtccttcgccaaaaccttacaacaacgacaatgttgcaagaaagacacggtggtggtccaccccacggcgtaatactagcagtggtcgtatttgtcgtggtattaactccgttcttatccggtgaccaaggtgaagctatcactgaagccatttgcgagctattgactccactcggtctccttctcttgcccatcttcctccttctcgcaatccagttcctttcctccgatcgtggcttctttgtctccgccgtcttctccaccggtgaacccgacaccatttacggtctaagtggctcccctgtcggcgttgccctctttcttctcctcgncttgttcttactttacaatcgtgtttccatcttcggcgggggcgatgattccgatgattgacgatttaacgtcgcagccctgtctttggtatgtcttcattcggttcggcgtcgttgaggaatggattccgatgatcataagtg

SEQ ID NO: 14748 - DNA, 337 bp, Gossypium hirsutum
  Clone ID: uC-gsflnu33B055d05b1
gctatcctttatatgctgaagcctatgtcactgtgcaccactatgatattgctcttgatataacagttatcaataggaccaaggaaacccttcagaatttgtgcttggagttggcaactatgggtgatctgaaactcgttgagcgtccacaaaactataccctagcccctgaatctagcaagcaaataaaagccaacatcaaggtgtcatcaactgagaccggagtcatatttggcaacattgtttatgagacttcgaatgtgcttgaaagaactgttgttgttcttaatgacatttatattgatatgatggactatattcctcctgctgtttgtac

SEQ ID NO: 14749 - DNA, 429 bp, Gossypium hirsutum
  Clone ID: uC-gsflnu33B055d06b1
agtgcattaccactttgatcaatccttaatttcccaatttcttctgaaaccctaatcctaaattgataccccaacttcggtgttccaatggccactgaggaaccaactgtcgccgtggaatctgcgcctgagccggcggaagagaaccccgctgaggctacagccaatcccaaatctggcaaagcaaagaaagctaaagagcccaaagccaagaaggctgcagctcctaggaagccacgagcttctcctgctcatcctccttacgaagagatggtcaaagatgcaatcgttactttgaaggagaagactggatcaagtcagtatgctatcactaaattcattgaagagaaacagaagaatcttcctggaaattttaagaagcttctgcttttccatttgaagaagcttgtggctgctgggaagttggtc

SEQ ID NO: 14750 - DNA, 269 bp, Gossypium hirsutum
  Clone ID: uC-gsflnu33B055d07b1
ttgcctacgcgtccggattcgccaaatagttatagtaatttttgaaggaagttgtaaaccccataattttttgtaaaaatttgtagtttcggtttgtaataagtaattactaggatccagattagccccttgtaatagtttgtaggtatttcgaactgagaattccccgaatggttcttctttccaaacttgaatatgttcatgatccgtctctgcaagtgggatctgtaaaattttcttcgcagttttccggtgaaaaggtatcatat

SEQ ID NO: 14751 - DNA, 514 bp, Gossypium hirsutum
  unsure (1)..(514): unsure at all n locations
  Clone ID: uC-gsflnu33B055d11b1
tcgttgtaaaacacgctagaaagtttcagccagttttcctgccagacaaacaagtccaccagtcctctcactaggtttcaatatagaaaattttttctcctttttctatcgatctgtacatccgctgattccttagtgctctttacgatgccttctcgccgtagaaccctcttgaaggtcatcatcctcggcgacagcggggtagggaagacgtctttgatgaatcaatatgtaaataagaaatttagcaatcagtataaggcgacgattggagctgattttttgacaaaggaagtgcagtttgaggataggctttttaccttacagatctgggacacagctggccaggaaagattccagagcctaggtgttgctttctatcgcggtgctgattggtgtgttcttgtatatgatgtcaactcaatgaaatcgtttgacaaccttaacaactggagagaagaatccttattcaggcaagcccttcngatcctgagaatttccgtttggtgtttgg

SEQ ID NO: 14752 - DNA, 493 bp, Gossypium hirsutum
  Clone ID: uC-gsflnu33B055d12b1
ttgttttaaaacacgctagaaagtttcagccagtttgcctgccagacaaacaagtgcaccagtcctctcactaggtttcaatatagaaaattttttctcctttttctatcgatctgtacatccgctgattccttagtgctctttacgatgccttctcgccgtagaaccctcttgaaggtcatcatcctcggcgacagcggggtagggaagacgtctttgatgaatcaatatgtaaataagaaatttagcaatcagtataaggcgacgattggagctgattttttgacaaaggaagtgcactttgaggataggctttttaccttacagatctgggacacagctggccaggaaagattacagagcctaggtgttgctttctatcgcggagctgattgatgtgttcttgtatatgatgtcaactcaatgaaatcgtttgacaaccttaacaactggagagaagaattgcttattcaggcaagcccttcggatcctg

SEQ ID NO: 14753 - DNA, 340 bp, Gossypium hirsutum
  Clone ID: uC-gsflnu33B055e02b1
agctgatgattttgagccaccacttatccctgctaagacgattcctgatccagacgataagaaacctgaggactgggatgagagagccaaaattccagacccaaatgctgtaaagccggatgattgggatgaggatgctcccatggaaattgaagatgaggaggctgtgaaaccagaaggatggttagatgatgagcctgaggagatagatgatcctgaggccaccaagccagaagattgggatgatgaaaaggattgcaagctggagcacctacctccagaacggctggcccatatgcatattaattcactgatcccaactcagctcaaatgtttacac

SEQ ID NO: 14754 - DNA, 258 bp, Gossypium hirsutum
  Clone ID: uC-gsflnu33B055e03b1
gcttcctgcgtctctctcttcatctctctgaacctaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccgatccttcagccgaagatactgctgaggatgaaggtgttgatgaccaat

SEQ ID NO: 14755 - DNA, 227 bp, Gossypium hirsutum
  Clone ID: uC-gsflnu33B055e05b1
gcgcctcgctacccggctatctcgagtggtgaaggaaacgagatggttcaggatctattgctttcgcatgccactcctttgacccttggactcgaaactgctggaggtgatatgactgatctgattccgagaaacactaccattcccaccaagaaggagcacgcgacttcaacttactctgataaccaaccctgtggctagatccaagattatcaaggagagcgagc

SEQ ID NO: 14756 - DNA, 512 bp, Gossypium hirsutum
  unsure (1)..(512): unsure at all n locations
  Clone ID: uC-gsflnu33B055e07b1
tattaaattagggggaaaaatgggagggggagagcatgggcatggagttcaggatttcagggcgaaggtgtggagcatgtcggggggtccgtactgccggcccaagcactggcgtcgcaacactgccattgccatgttcggcgttttcctcatttgcatccccattgccatgaaatcagccgagctcgagcaacgacctcatcagcctgtccgtccgattccttcacagctttggtgcaagaacttcggaaacaaagattattgaagtctgcctggggctgttgatggagtaccgatggcatatcagagcagcctatgatctgtatttgagaccctttcaccgatttagctttcttcgtgatcaataagttgtgcttgtttttgccttcactgtgttattgacaaattttgaagttgatttttttgtcaaactgaatcaacttaatatctgtttattccatccgntaaagtggattaaaacattttttttaaaaaaaaaaaaaaagggcggg

SEQ ID NO: 14757 - DNA, 493 bp, Gossypium hirsutum
  Clone ID: uC-gsflnu33B055e08b1
ccttcgcgtccgcccacgcgtccgcttgtgcaagaagttttctttggcaatgtactcagcgcgaatttgggacaggctccagctagacaggctgcgctaggtgcaggaattcctaactcggtcatatgcaccactgttaacaaagtttgtgcatctgggatgaaagcaacaatgcttgccgcacagagcattcaactggttcaagtgcaaaacagccagcatcaacaacaatatgcgggttattctcagattcatcatgcatcacaatctgttgcacctacctccagcacggctgccccatatgcatatgaattcactgatccaactcatgctcaaatgtattacactcagcctatggcacccaacatgcctcctcagtaccaaaccatgactgcagtagtcttgccagatgcacccacgcaacttccgactgacaacatcaagccacagatcagaacttcacagccaatatagatcagtcaagaaggaagcg

SEQ ID NO: 14758 - DNA, 475 bp, Gossypium hirsutum
  unsure (1)..(475): unsure at all n locations
  Clone ID: uC-gsflnu33B055e11b1
cttgtcgcgtgggttccaactgcctggatctcccttatctttcctcttaccttcacttctcttacaattcttccaacaccactctctccatcgccttcatcgccacaccttccaaatcgggtggttggatcgcatgggccataaatccaaaggccaccggcatggcgggttcacaatccctcgttggctacaagaactccaccaccggcaccgtccaggttcatacctatgacatcagctcctacagttcaattgttgccaaggatctgtccttcgaggtctgggataagacggctgagagtagaaggacgnggagtttggcgattttcgctaaaattaaggttccggcggatttagcggcgagtgggaagattaatcaggtttggcaagtgggtcccagcgtcggaactgatggcagggtggacaaacatgccttcgcccgctctaatttgcaatctaaaggaaccttggattt

SEQ ID NO: 14759 - DNA, 510 bp, Gossypium hirsutum
  Clone ID: uC-gsflnu33B055e12b1
tgcctaaacaatcggatggctgcacaccttgaatccaaggaggaaaaggcatctgaagcttttcttagaaagtatcgtcttcatgggaacttgggggaatcagaggacattgatattgtggcactaaagaactacatggatgctcagtactttggtgagattggtattggcactcctacacagaacttcactgtgatatttgacactgggagttctaatttgtgggttccttcatctaaatgttatttctcgatagcatgctatttccatcgaaaatataaatcaagccgttcacgtacctacaaggctaatggtaaaccagcggatatccaatatggcactggagctatttctggattctttagtgaggaccatgtaacagttggtgatcttgtagttaaacatcaggaatttattgaggcaacaaaggagtccagcttaacatttttgattgccaagtttgatggtatacttggacttggatttaaagagatttcagtttgaaatgct

SEQ ID NO: 14760 - DNA, 364 bp, Gossypium hirsutum
  Clone ID: uC-gsflnu33B055f01b1
cctacgtgtccgggctggggagcccatggtggcggtgctttctctggaaaggacccaaccaaggtggacaggagtggagcttacatcgttaggcaagctgccaagagcattgtagctaatgggcttgcacgcaggtgcctcgtgcaggtctactatgctattggtgtgcccgagcccttgtctgtcttcgaaaacagctacggaacaagaaagattcctgacaaggaaattcttcaaactgtgaaggagaactttgatttcaggcctggaatgatcaccatcgacctggacctcaagaggggtggcaatggccggttcttgaagacaggtgcctatggacattttggaagggacgaccccgact

SEQ ID NO: 14761 - DNA, 424 bp, Gossypium hirsutum
  Clone ID: uC-gsflnu33B055f04b1
tctacgttagcgtccacgcgtccggagcaaagcagcctgatttcatttctccaatatggctagagggttgaagaaacatttgaagaggctcaatgcccccaggcattggatgcttgacaagcttggtggtgcttttgcacccaagccatctgttgagccccacaagtccagcgaatgcttgacattgatccttattctgctaaacaccaagtacaatgttactcccactgagggaatcctttgttgctctttaacaacaggcacaggctggttaaaatacctcactttcgccactattacaagaacttcatacaaagatttcaccacccctttactttacacgctgccttatgatgttgtgcctctcatggagttcggacattcccagttttccactaatctacatcttgggaattcctctttt

SEQ ID NO: 14762 - DNA, 439 bp, Gossypium hirsutum
  Clone ID: uC-gsflnu33B055f05b1
cccactcttccgcccacgcgtccgcccacgcgtccgctctgaatcactacaaaaatgaatatggaaatgacataaacaaggacttgaaggctgaccctaaggatgagttccttgcactactaaggtccacagtgaagtgcttggtctatccggaaaagtattttgagaaggttcttcgcctagcaatcaatagacgaggaacggatgaaggagctcttacaagagttgtttgcactagggctgaggtggatctaaagatcatagcagatgagtatcagcgaaggaacagtgtcccactgactcgtgccattgtcaaggacactcatggagactatgaaaaattgctgctggtacttgcaggacatgtggagaattgaatctgatatcatgagacaatttcctggtgaataaatgtttatgaccaaactataatggtcta

SEQ ID NO: 14763 - DNA, 317 bp, Gossypium hirsutum
  Clone ID: uC-gsflnu33B055f07b1
ctacgcgtccgaatacactcaaatctacctccaacttccttctttgatttcttttttctttctctcatggctaaacaaaaaatcccagatcgaacaaccgaagacaaatctaaagacgagttaccagcatgttgtcctccggtgaccaaagctaagagcggaggcaggaagagaagctgccttgaaggatgtctctttgctttgtgctgctgctggttatgggaggcatgctgcgacctgtaggaataatggagcaccctgatggcaatgattacgacaaagaaatttctaaccctaattatgaaaatcacatattg

SEQ ID NO: 14764 - DNA, 233 bp, Gossypium hirsutum
  Clone ID: uC-gsflnu33B055f08b1
cctacgcgtccggaaaatcatgggtgccaaagttcttttcttctttgctttgctttccttttcagctgtctcggcatttgcacaggatgaggaagaccaaggtcttgatatgaacatctacaaggattcttgggctcaggctgaagacattatcaaggagcaagtcaagctactgtacaagcgacacaaaaacactgcttttaattggctgagaaacattttccatgactgtg

SEQ ID NO: 14765 - DNA, 361 bp, Gossypium hirsutum
  Clone ID: uC-gsflnu33B055f09b1
ctttcagatcaccaaaaccttcaacaatgggctttgttaaggctcaaaaaaccaaagcttactttaagcgttttcaggttccattcaagagaaggagagagggaaagactgattacagggctaggattcgcttaaccaatcaagacaagaacaaatacaacacgcctaaataccgatacgttgttcgatttagcaacaaagatatcaccgcacaaataatttctgccaatattactggtgatatggttcttgcttcggcttactcacatgagcttcctcgttatggacttgaagtcggacttacaaactatgccgctgcttattgcactggattacttttgggacgccgtgtacttaagtt

SEQ ID NO: 14766 - DNA, 325 bp, Gossypium hirsutum
  Clone ID: uC-gsflnu33B055f10b1
ccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggtttttggggggcccattattaataccccgtttttcccccggagatctttctttatttgttttctttaaaagaaaattaagggcgaatgtttataacattttaatataaaaaaaccttgggaaaccccctgtttttccccctttaaaaactcccttt

SEQ ID NO: 14767 - DNA, 395 bp, Gossypium hirsutum
  Clone ID: uC-gsflnu33B055f11b1
ggtcaacaagggtttgttgattgtggatcaccaactggcgtacgacaaaaggaccagaccttatgtgaagaaaatggccaagagccaagactatttcttcaaggagttctcaagggccattactctcctctctgagaacaatcctctcactggtagcaagggtgagatcaggaagcaatgcaatcttgcaaacaagcttcactaaaatgcctcgccaaagagaaagccgagtgtggccgaataaaatgtttgtttactcagtttcttttccaagagacgagtttgttaatgtgcaggtgagtaatggtgcaatggtactggtttgtaacgatcgatccattgcatttttcttttagcataagccaggttgccttcttttgatgttggtcatgggc

SEQ ID NO: 14768 - DNA, 388 bp, Gossypium hirsutum
  Clone ID: uC-gsflnu33B055f12b1
ttgcctacgcgtccgcaagaaaatcccatgtcgaatcgtctgctattactattactatcagtactgatctaagaataaaactggcagctttgtactgtgttttcatttgaatatttgtatgctaggtttgattatgctgttatgagtgggggagcgcagcgttctgtttttatgtaatgaattaaatctactatgtgcttttatttgagtgaaaaaaaaaaaaaaaaaaaaaaaaaaaaaaaaaaaaaaaaaaaaaaagggaaaaaaaaaaaaaaaaaaaaaaaaaaaaaaaaaaaaaaaaaaaaaaaaataaaaaattaaaaaaaaagggggggccgttttaaaggaccaaagtttacttccccgggcttgcaagttaaaagttttt

SEQ ID NO: 14769 - DNA, 287 bp, Gossypium hirsutum
  Clone ID: uC-gsflnu33B055g04b1
gttgcttctaccacaactacagagaagagagtcaaggggaaaaaaagcgtcgttgttcttgcttcttcttctacttcgctctctctctttctccgaagttcctccttcgatcttttatttattcagtattgtaaaagatggccgacggtgaggatattcagcccctcgtctgtgataatggaactcgaatggtgaaggccggttttgctggtgatgatgctccaagggcagcttttcccagtattgttggtcgtccccggcacactgacgttacggctgggctgggt

SEQ ID NO: 14770 - DNA, 508 bp, Gossypium hirsutum
  Clone ID: uC-gsflnu33B055g05b1
gcctgcattccccctcctctgccactccagtctcctcagccaccgattacaaccacgattcggatgtggcgcagaagggcatcgacggcgctgccaccggtaagaactcctccccttttcgtctattttctaaagaaaaacaaccaataaaagaaaaaaaacagtaaaggaaagaaaaatcgaaacacgagattcaccttcaaattttgtttttttttctgatctcttttcccttgtattttatttttaattttcaatacagaaatttgctcaccccctaaatcggtttacaattggccttttataccgaaaactaataataatcaataaaactcctatctcttgcttgttgtgctgtgattcgtggtttgtttgcaggtggagcgagcgttgtgcgcgtcgacgtgcgcgacatgcggtgcgacatgcaggaactgctgcggcgcgagtttgctgcaatgcctagggtttctgctaaactttttggtttttgggctagcaggctagg

SEQ ID NO: 14771 - DNA, 506 bp, Gossypium hirsutum
  Clone ID: uC-gsflnu33B055g06b1
ccttcgcttccgcccacgcgtccgatcccttggtacaaaaaatcaccgacttatatgaccaaatctcaaccctcgacagtctcaaaccctccaaagatgtcaacatgctcttcacccaactcgtcctcacatgcatgccacccacccatatcgatgtcaccaagctttgcaaaaaggttcaacagatgaggtccaaattgattcggctatgtggtgaagccgagggactattagaaacccatttctccaccatcttagcatcctatgataacccacttcaccatctcaatattttcccttactacacaaactaccttaaactcagccaactcgaattcaatatcctcaccaaacactgctcaaatgtgcctaacaaagttgccttccttggctctggtccccttcccctcacttcgatcgtgttagcttctttctaccttaaaaccacctcgttccacaactacgatatcgacccttcgctaattcgaaagctcttcgttagtctc

SEQ ID NO: 14772 - DNA, 328 bp, Gossypium hirsutum
  Clone ID: uC-gsflnu33B055g07b1
tcgttgttgtacggctcatgggacgtgcagcttcacacattactttggagtgtgctttgcagactcatcctaacattactattattggagaagaggttgctgccaagaagctgacccttaaaaacgtaacagactacatggttgatgtcatttgcaaacgtgctgaacttggttataactatggagttattctcattcctgaaggtcttattgacttcattcctgaggtccagcagcttattgctgaacttaatgaaattctggcacatgatgttgttgatgaaaaagggctatggaaaaagaaaccttaccaacaatcttctgaagc

SEQ ID NO: 14773 - DNA, 512 bp, Gossypium hirsutum
  Clone ID: uC-gsflnu33B055g10b1
tgtctcgcgtccgtgatactagattcaacaaggttttcaacaggggaatgtctgatcactctaccatcaccatgaagaagattctcgatacatatgatggtttccaaggactaaaaacattggtcgatgttggcggtggtaccggtgccacgcttagcatgatcgtctctaagtaccccaccataaaaggcattaacttcgatttgcctcatgtcattgaggatgctcctagctgtcctggtgtggagcatgttggtggagacatgtttgtaagtgtaccaaaaggagatgccattttcatgaagtggatatgtcatgattggagcgacgaacactgcgccaagtttttgaagaactgctatgaagctttgccagacaacgagaaagtgattgttgccgaatgcattctttctgattaccccgatcctagcccttgcacgaaggtggttgtccatattgattgcttcatgttggctcacaaccctggtgggaaagagaggaccgaaaggaat

SEQ ID NO: 14774 - DNA, 497 bp, Gossypium hirsutum
  unsure (1)..(497): unsure at all n locations
  Clone ID: uC-gsflnu33B055g11b1
tctcctttgcgtccgcccacgcgtccgaaattattgcaggtaagaaagtgaacattttcttaaacctcaaaagaaacccatgcaatacgaagaacacataatgtcgatcatctctgtgcacgactggtttggttcagttcggttcaggtcatagtcaagcttgaaacatttgttttacaagatcctggatgtaggttggttttggtgtgagttggacggggctgtggggcaactccataaacctgcccttgttttcactcttgcttacatttcccaatacaatgatctttggagtaataaatagggaacacattttatatctatctatctatctatttatctatatatattataatatttgtagagaaaagcgtgaatagaagttttttcatgcttgtaatttatgtacagtacccaatgattatggctgctcatctggagatgaaactgattgtttatggatgtttattatttttattagaagattggaatactnt

SEQ ID NO: 14775 - DNA, 510 bp, Gossypium hirsutum
  Clone ID: uC-gsflnu33B055g12b1
tatttagtatttgcactcattagcctgtccctcatggaatcccatcttgagaaacaaaatggagatgtgcttcaacaatctttcaaagagatgatatctactctccctaaagagaatcgttggggttttcttgaagattattatcaatatcaaggtttttggttcgccccgtcttttttacaaggagcattgtcggctcaacaacaattccaggctcaacccactgatgtcatcctttgtagctctctaagaacaggcacaggctggttaaaatccctcactttcgccactattacaagaacttcatacaatgattccaccacccctttactttacacgctgcctcatgatgttgtgcctttcatggagttcgatcattcccagttttccactaatctacatcttggaattcctcttttagccactcatcttccttattccttcttacccagatctataattgattttggttggaaaattatttacatttgcagggaccccaaagataca

SEQ ID NO: 14776 - DNA, 285 bp, Gossypium hirsutum
  Clone ID: uC-gsflnu33B055h05b1
agttcattctgctatattgagtggtgaaggtaatgagaaagtgcaagatctcttgctcttggatgtcactccattggcttccggtttggaaaccgctggtggtgttatgaccgttttgattccaaggaacaccaccattgcaaccaaaaaagaacaagaattctcaacctactccgacaaccaacctggtgtgttgttccaagtttacgaaggtgaacgaacaaggaccccagacaaccacttgtttttgaaatttgagcaatttggcatcccttctgctggtag

SEQ ID NO: 14777 - DNA, 519 bp, Gossypium hirsutum
  Clone ID: uC-gsflnu33B055h06b1
tcttcgtttccgcatcaagaagccatgggagataactggaccctgcgccgacccagagtacaaaaacgcagtgcccaaagccacggagtatcgtgttcgctgccccgccaccactttgcaaaagcccatcgtccctacctccgaccctgaaaccgtcttcgacatcaaatactacagccgcgatcaacgccggaaccgccctccgatccgccgtaccatcttgaagaaagatgacgtggtgaagatgatgagagagaaaacatttgatgtcaacgattttccaaaggtctacttgactgctaaagttgaagaggatgagaatgccgttggcggaggctaccagaaataggcgagcactgagcactgagcacttatggctgaatttaatggtgcaccagtcccatctgattcactctcttagtagcttgttattgaacaaatgcaggtattgtagcatagcaatttcttgagacactttgagttaaaaggggttgcagtttcggggtttccgacataata

SEQ ID NO: 14778 - DNA, 295 bp, Gossypium hirsutum
  Clone ID: uC-gsflnu33B055h07b1
tttattctaccaccaattcatcttgagggcaggagctgctaatgctcttggttcattcataagccaaacccatgtttgattcattttcctttcctcgatgcttttctagaagaaccctccaaaaaaacacatatataaattgtgaaaataatgtgggaatttgcttgttatgatttgtgtatgtttaaccgtcccttcagagccctcccttttttcttcaaagtttcccttcgaggaagttggaaaattttatagaaattggtttcatgaaaaaaaaaaaaggactaaaagcaag

SEQ ID NO: 14779 - DNA, 417 bp, Gossypium hirsutum
  Clone ID: uC-gsflnu33B055h10b1
ttaactacgaccaccacattttgcttcgtatctttgataatggaagccaaatggctggttcttttttcagtggcggcaatgctggtggcactggccaactgccaggaatcgttgaagccattggtgaagatggtaaagggcaagaagctgtgtgacaaagggtgggaatgtaaagggtggtcaaagtattgttgcaaccataccatttctgattacttccaaacttaccagtttgaggacctttttgcgaagcgtaacacgccggtagcacatgcggttgggttctgggattaccattccttcattactgctgctgctcagtatcagcctcatggatttggtaccaccggggaaaagctccagaatatgaaggaagtcgctgcttttcttggacatgttggcagcaaaactttatgt

SEQ ID NO: 14780 - DNA, 510 bp, Gossypium hirsutum
  Clone ID: uC-gsflnu33B055h12b1
tttcttacgcgtacgctcgcccctcccttcctctctgcttttactttgctaagtccaagccttcgacaatggccgaaccctctaccatttcaccagctcccctcttgaaagatgagctcgacatagtcattccaaccattcggaacttggactttttggagatgtggaggccctttttccagccttaccatctcatcattgttcaagatggtgatccttccaagaccatcaaggttccggagggcttcgactatgagctttacaataggaacgatatcaacaggattttgggtcctaagtcttcttgtatctctttcaaggattctgcttgtcgctgctttggttacatggtttccaagaagaagtacatttataccattgatgatgattgctttgttgcgaaagatccgtccggcaaagacattaacgcactggagcagcacataaagaaccttctttgtccatctactacagttgtcttcaacactctctatgacccgtaccgagctg

SEQ ID NO: 14781 - DNA, 442 bp, Gossypium hirsutum
  Clone ID: uC-gsflnu33B056a03b1
tctcgactctgtctcccctatcgctctttttcatcgatcagatctcttcaaacccatcaattcaaacaaccctccactcattccatccatgacgcttggctcaggaggatccagtgttgtggtgcctcggaacttcagattgctggaggagcttgagcgtggagaaaaaggtattggagatggtactgtcagctatggaatggatgacggagatgacatttacatgcgctcttggactggcaccattattggtcctcataatactgtacatgaaggtcgaatctatcagctgaagctgatctgtgataaagattatccagagaagccaccaagcgtccgttttcattcaagaatcaacatgacttgtgttaaccacgaaactggagtggtggaaccaaagaagtttggacttcttgcaaattggcagagggagtataccatg

SEQ ID NO: 14782 - DNA, 536 bp, Gossypium hirsutum
  Clone ID: uC-gsflnu33B056a04b1
tcggacgcgtgggcttatagcaccaaacgaaaaacaaattattggattagagaatcgaaatcaagaagaaaaagaacccataggtgaagggggtcttgtatcagatgcacaaaaacaaggaaattttaaatccgttctctcaaaccaagaaaaagatgttgaagaagattatgataaatcagacaaaaaaaaaaaacgtagaaagaaaaagcaatacaagagcaacacggaagcagagcttgatttcttcctaaaaaggtatttgcgttttcaattgagatgggatgattctttaaatcaaagaataatcaataatatcaaagtatattgcctcctgcttagactgataaaatccaagaacctcaattcctcttttgaaagtgtattgggttaaacgtataaccagattttaatttttggtgatttgggtttaacttgaagagagaaaagaaatcttttcatgggggagttaggagctctttctactgggctctctatcatggtttccacagtgcaataaaaatatgttatagtct

SEQ ID NO: 14783 - DNA, 258 bp, Gossypium hirsutum
  Clone ID: uC-gsflnu33B056a06b1
tgtcttcgcgtccgggaaaagatggctatggcaaagtcctccaatgctccaatactattgacaaagaagtataactgtcagaatcgtagaccaacatgggcccagtctcctgctaccaccgcgaaagtccttgcttttatatgcccggatgtggaaggtcgaaacagatctatgtcagcaacagcaaatagagaagcccgtactgacatcatcgcacacacctactcctgaaagccgtggagttcgtgcacagaaatt

SEQ ID NO: 14784 - DNA, 502 bp, Gossypium hirsutum
  unsure (1)..(502): unsure at all n locations
  Clone ID: uC-gsflnu33B056a08b1
tgaaaaaagaagcaaaaaaacatggccaaagttctgttgttcattgcactatgtgtgcttccagctttggttagtgctacacgcattctgaataatcaattggtggtagaaggctatgtgtactgtgatacttgccgtgctggttttgaaacccctaagactagaagcctagctgatgccatggttaggttggtatgctccgacaggaagagcggccaagttgtcttcaaaaaggagggatacaccgacaaaaccggaaaataccagattcgtgtatccgaggatcacttggatcagatctgtgatgcagttcttgtgaagagctcccagcttggttgtgccacaatgtcccccggtcgtgaacgtgcccgtgttatcttgaccaacttcaatggcatttcatccaccacccgttatgccaatgccatgggcttcatggttgacgagcctgaagcaggctgtgctgagatgatgaagatgtatcangaggatgaggaggatg

SEQ ID NO: 14785 - DNA, 497 bp, Gossypium hirsutum
  Clone ID: uC-gsflnu33B056a09b1
ctacaatatccccttggattgtgacacttgatgctcttgaaccttttgcatgtcatgctcctaagcaggatccccatccattgccatatttggcagagaaaatatccaaaaactatgatattgaattggaggttcaaattaaaccttctggacaaactgattcatgcgtggttacaagaagtaatttcaagaacctatattggacagtgactcaacaagtagcacaccacacaatcaatggttgcaacctgaggccaggcgatctccttggaactgggacccttagtgggcctgaatttgaatcatttggatgtttgctggaactaacatggaatggacaaaaatcattgccattaaatgggacaactcgaaaattcttagaagatggagatgaagtaaccttctctggttgctgcaagggagatggttacaatgttgggttttggaacctgtgctggtaagattgtcccaccacgcgattgaggaaacttttttac

SEQ ID NO: 14786 - DNA, 376 bp, Gossypium hirsutum
  unsure (1)..(376): unsure at all n locations
  Clone ID: uC-gsflnu33B056a10b1
tcttccacgcgtccgcccacgcgtccgcccacgcgtccgagcccacaaatgcacagtgtctctagtatcatcgccaatggctaaatgcagcaaaccatctaatctccatggtggattgaagggagctaccttgaggcccgagaagccatttactgcgaataagcttccgtttattctatacaccgttgggccatttgctttcgaacccaaatgctactagaaacttagattccactcttttcctttgttgttgctcttaatgtgttaccagtacttacgagttccctagcttattgtaatcgcattttgttcagtgtattgctttgtgtgaaaatagattacagacgaataatcaatcgatttctactttgactna

SEQ ID NO: 14787 - DNA, 345 bp, Gossypium hirsutum
  Clone ID: uC-gsflnu33B056b01b1
ttttgatgcaggagggattggcatacttaccagccggaatctgcatgtcaacaatgggacgccatgtctcatatgaacaagcagttgcttggaaagtccttgaagctgatgaaagcactgtccattgcttggctttctcttttgtaaactggtcttttgtgtaaaaacatttgactgtaatttatatgttctacacctcaggctttccccagtagagaaggaaaaaaaagaagttttgtaatggcttaatacacgatttggcctgaagtatacctattttcttactttgtacctaattttttttttttggtctcaatctggtatctgaagtatcaatcacctctc

SEQ ID NO: 14788 - DNA, 440 bp, Gossypium hirsutum
  Clone ID: uC-gsflnu33B056b04b1
tgtctacgcgtccggcttgactcctgctaatcaaagccaaaactcttgacctggtgtttccagctcacattctggcgatggatctccgagaatcgatcactagccaaaccgacgtcgctttgaccctgaccaaacacgttctccaaactgaagccaaggactcgaacctagtgttctcgcccctgtcgatccatgttgtgctcagcttgatcgccgctggtgctaagggtccaaccctcgaccagctcctctctttcctcaagtccaaatccaacgaccagctcagctccttatactacgaggtggtttccgttgtcttcgcggatggaaatccagccggtggtccccgattgtcatttgcaaacggggcttggtttgaccggtctgttcctctcaagccttctttaaacaggttctggacaacgtctacaaggctgctt

SEQ ID NO: 14789 - DNA, 507 bp, Gossypium hirsutum
  Clone ID: uC-gsflnu33B056b07b1
tgcggaaaaaccaaaaaaatggcgaagccccaacttttatttctattttccttttcccttctctgtctcatatctttttccgccgccgattcctccatcatagacgacttacgtctagccggttccagtttcccgtcggttcatgcaaagaagctgattagggagttgaatttgtttcctaaaggggaagtcaatgtcgttgacgaacatcgggtttcgttgccggagggtcccaaactggtggagaagcggttcaagttcccaactttggaagtgcccggtggagtttccgttgaggatttgggtcactatgctgggtattacaagcttcctaactctcatgatgccagaatgttctacttcttcttcgaatcacgcaatagcaaaaaggaccctgttgtaatctggttgactggagggccaggttgtagcagtgaattggctttgttttatgaaaatggccctttcacaattgctgataacatgtctcttggttggaatgagtat

SEQ ID NO: 14790 - DNA, 350 bp, Gossypium hirsutum
  Clone ID: uC-gsflnu33B056b09b1
ttgccataaagcttctccaattccttgttcccctgctaatcttgggattggccttcggtgtccgctcctataccaaaacaccagcttcatcttaagcattgagactccccaagagataatttgaacaatcttcacaataagattatgctagtttaaatttgtttggaattttcacatactgcagggtggtaaatggttggatatttttattcaaacatttgctccaatgcagttgaacaaactcagattcgcctccgattgtgataatttgataattgtctttcccagttttcaccatgtgtttgttcaatgctccctttctttgataaaaaaaacttgttcatttactc

SEQ ID NO: 14791 - DNA, 504 bp, Gossypium hirsutum
  Clone ID: uC-gsflnu33B056b11b1
tcgggaaaacatcgaggaatatgggagattgtgtcgagaaaggacaaataagtccatgatcaagaacaggcaaatacaggttatagataatgacagcggagttcacatgaggccaatgcctggaatggttggcttgatttcgtccaaccccaaggataagaagaaaacaatgccagttaaacaatcagatgtgaaaagaaccctaagggatcgtggggaactggaagatataatgttcaagctgtttgaaagacaaccaaattggactttgaagcaacttgtccaagagactgatcagcctgctcaattccttaaagagatactgaacgagctctgcgtgtacaataagagaggcgccaatcaaggaacctacgagcttaagccagagtataaaaaatctgcagaggacactgcagctgaataagtcagatatagctgtattttacgtttcctttttcttcagttaatcggaatatgtctgaaaacaaccctcatgaagacgac

SEQ ID NO: 14792 - DNA, 533 bp, Gossypium hirsutum
  unsure (1)..(533): unsure at all n locations
  Clone ID: uC-gsflnu33B056c01b1
tggctgttggaaaagtgcttcctgccttgaatggaaaattaactggaatggctttccgtgttcccaccgttgatgtttcagtggttgacctcacagtaagactagagaaagcagcctcttatgatgaaatcaaagctgctattaaggcggcgtccgagggagaattaaagggaatcttgggttacactgatgaagatttggtttccactgacttcgtcggtgacagcaggtcgagtatctttgatgcaaaagccggaatagctctgaatgaaaattttgccaagcttgtctcttggtacgacaatgaatggggctacagcacccgtgttgttgaccttatcattcacgtggatgctgttttgaaagctaagtaagttggtcggctggattgtctcggcagctgtatgtaatttcacggatcgatccttaccttgttccgtatctatggtggaggccatgagtttaaagaaataagccttgtttagagtcttatgtcaatagtttttacctctntatcctgttaaatgaaacga

SEQ ID NO: 14793 - DNA, 230 bp, Gossypium hirsutum
  Clone ID: uC-gsflnu33B056c02b1
cttttttttaacctgtaaaaaaccaaatacagtttctctcacttaggatcgcaggtatacgctagcaaatcataaaaaaaaaaaaaccccactactttcttcatgccgcagatctgagctatgcataattgtacatccaaaaaaaaaaaaaccagagttatgtgatccagcactattatgtaatcgaatgttagtttttttttctcaatacaactcttgaagttttttat

SEQ ID NO: 14794 - DNA, 494 bp, Gossypium hirsutum
  Clone ID: uC-gsflnu33B056c03b1
tttctatcaaagagtaagcccaacaatgccgcccaagtttgacccaacacaagttgtcgatgtgttcgtccgcgtcaccggcggcgaagtcggagctgctagttccctcgctccgaagatcggtccactcggtttatctcccaaaaagatcggtgaagatattgccaaggaaaccgcaaaggaatggaagggtctccgcgtgaccgtcaagctcactgtccagaaccgtcaggcgaaagtcatggttgtcccgtcggcggcggcgctggtgattaaggctttgaaggagcctgaaagggataggaagaagaccaaaaacatcaagcataatgggaacatcggccttgatgacgtcatcgagattgctaaagtaatgaggccaaagtcgatggcgaaggacttaagaggtacggtgaaggagattctgggcacctgcgtctccgtgggatgtaccgttgatggcaaagaccccaagggtttgcagcaggaaatcg

SEQ ID NO: 14795 - DNA, 421 bp, Gossypium hirsutum
  Clone ID: uC-gsflnu33B056c06b1
ttctatcgcgtccgcaaaaattgtcttgtgttgtacatgattttcagctctaagaaaattcgaacacgacagaaccggggaacatgtggaaaaattcctacttacctcattttttcattacttttcatggatgtttgtgtaaattaatccattgttgttcaataatttaaatatttatccactgctgagactttaaaaaaaaaaaaaaaaaaaaaaaaaaagggcgttcgttcattaagggtcatggcttgcttgcccacattggctaaagaataaaggttctattgggcccctttactaaggatgcctgggtttcccacaataacaactacaatgggatatatttcattgttctctccaccaccttctcttaggccttaaaatttctctttcggttggtgaaagaacgctattccaatcc

SEQ ID NO: 14796 - DNA, 520 bp, Gossypium hirsutum
  Clone ID: uC-gsflnu33B056c07b1
tgttttccttgttctcttctacattcagcaaaggggggctctgagatcacataccaaaatggtgaaagccgttgccgtccttagcagcaatgaaggtgttagcggaactgttttcttctcccaagaaggagatggtccaactaccgtgactgggaacctttctggtcttaaggccggactccatggcttccatgttcatgcccttggggacataactaacgggtgcatgtcaactggaccccattttaatcctgctggcaaagagcatggtgctcccgaagatgagaaccgccatgctggtgatctaggaaatgtcactgttggtgatgatggctgtgctagcttctccatcaccgacaaacagattccactcacaggcccaaactccattatcggaagagctgtagttgtccatgcagatcccgatgaccttggcaagggcggccatgagctcagcaaaagcacaggaaatgctggcggcagagtagcttgcggtattattggtctgcagggctaaaat

SEQ ID NO: 14797 - DNA, 441 bp, Gossypium hirsutum
  Clone ID: uC-gsflnu33B056c11b1
gcgaaggagagaaatggcgagcggagggaaagtgtcttttaaagtcactcttacctctgatcctaagctccctttcaaagtgtttagcgtgcctgaagcagccccttttacagccgtcttgaaattcgcagccgaggaattcaaagtccctcctcaaaccagtgctatcatcaccaatgatggcgtgggaatcaatcctcagcaaagtgcaggaaatgtgttcctcaaacatggatcggaacttcgcttgattccccgtgacagggtgggagccttttgaaataacaaaaacttcatttgttatctctgagtgagaagactgggtatgactttgtttggttatggatcctttgttttggtatgtatgtttaaacttttacttgatgtagaacatgacggatagcaactttcttttttcctaaaagaaatatataagagcaa

SEQ ID NO: 14798 - DNA, 536 bp, Gossypium hirsutum
  Clone ID: uC-gsflnu33B056c12b1
tattagtttcaaaatctctggacaaaatgggttatttcaattgctttgctttgggattcttcgtggctctgtcgcttgcaagcattgatgttggggttgcagctcgtcaccttcagcaactgcctccaattccaacattgcctacaaccacactcccaccattcccatctatccctaatctcccacagccatccataccatctttcccaaggcctggggcgcttcctccacttcctgccatgcctgctttgcccacattgcctagtgtaccaagggccacattgccccctctaccaagcatgccttcgattcccacaatcccaactacaattccctctattccattcttctctccaccaccttctcctagtccttaaaaatccctttcgctaggtgatgggtggctattccaatccagagtcttatttttttggccaccacttatattgcattgtataaatgggagtttccccaattcccatgattttctgtactttgatacttattttgcttattattggattatatacttatta

SEQ ID NO: 14799 - DNA, 485 bp, Gossypium hirsutum
  Clone ID: uC-gsflnu33B056d01b1
tatttcgttgtaaatttgtttccgtagtaatcatcaaatctttcgaagatgtcaggcagaggcaagggtggcaaggggctcggcaaaggaggtgccaagaggcataggaaggttttaagagacaacatccagggcattactaagcctgccattcgccgtttggctcgtcgaggaggtgtcaagaggatcagtggcttgatctatgaagaaactaggggagtattgaagattttcttggagaatgtgattcgtgatgctgtgacttataccgagcacgccaggaggaagaccgttaccgccatggatgttgtttatgccttgaaaaggcagggcaggactctctatggttttggtggttaagtttaggatcattcttaagttcttaactgtaatgcctctagaacttgactctagatctatatcgatatgtacttgcatgtgtactcgagtgatgatataatgaattgtaaccttaagaatgatcg

SEQ ID NO: 14800 - DNA, 460 bp, Gossypium hirsutum
  Clone ID: uC-gsflnu33B056d02b1
gattgtggatcaccaactggcggacgactttttggaccagaccttatgtgaagaaaatggccataagccaatattattttttctaggagttcttaagggccattactttcctttctgtgaacaatcctctcactggtagcaagggtgatattaggaagcaatgcattttttgaaacaagcttcactaaaatgcctcgtcaaagagaaagcccagtgtggccgaataaaatgtttgtttactcagtttcttttccaagagacgagttttgtaatgtgcaggtgagtaatggtgcaaatggtactggtttgtaacgatcgatccattgcatttttcttttagcataagccaggttgccttcttttgatgttggtcatgggcttggtggatgtagggatggatgtaatatatgtatgtaaggttgttgttgacttggttttatgcctgaattttattgtttaa

SEQ ID NO: 14801 - DNA, 405 bp, Gossypium hirsutum
  Clone ID: uC-gsflnu33B056d04b1
taatgaatccccttctactgtcagatttcaaaagcccaactcctcagccaccgtcactgcttggagcctcagccaccgtcactgcttggaggcatgttttcacttccatcgtggtagtgtctgtgttaaaggggttgtggtaagtacacagtgccaaaataagtccttcactatctctgaacatgattcccataactaatttaagcaaataattgttgtaagctgcgtcaaaattgcatttgatcgtgtttgctcttggtggtgaccacattctgttatataaccctgcagatgttgctatttcttttactgtactggtactctctgccttgtatgctttgataaatgttattaccctgtctgtattcatcttttcgccctgatggtggattttatttcttttct

SEQ ID NO: 14802 - DNA, 473 bp, Gossypium hirsutum
  Clone ID: uC-gsflnu33B056d06b1
tcctacgcgtccgggcgtttggttgcgagagttgctctccaaagcgatgatattgagctcgttgctgttaacgatcctttcatcaccactgaatacatgacgtacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcgaagaaggttatcatttctgctcccagtaaggatgctcccatgtttgttgtgggtgtcaatgagaaggaatataagcctgaccttaacattgctccaatgctagctgcaccaccaactgtcttgctccattggctaaggtgatcaacgat

SEQ ID NO: 14803 - DNA, 483 bp, Gossypium hirsutum
  Clone ID: uC-gsflnu33B056d08b1
ttgttgattgtggatcaccaactggcgtacgacaaaaggaccagaccttatgtgaagaaaatggccaagagccaagactatttcttcaaggagttctcaagggccattactctcctctctgagaacaatcctctcactggtagcaagggtgagatcaggaagcaatgcaatcttgcaaacaagcttcactaaaatgcctcgccaaagagaaagccgagtgtggccgaataaaatgtttgtttactcagtttcttttccaagagacgagtttgttaatgtgcaggtgagtaatggtgcaatggtactggtttgtaacgatcgatccattgcatttttcttttagcataagccaggttgccttctcttgatgttggtcatgggcttggtggatgtagggatggatgtaatatatgtatgtaaggatgtggttgactgtgtatgatgcatgaatttcaatgatttaaaagttatgatgaattatgc

SEQ ID NO: 14804 - DNA, 422 bp, Gossypium hirsutum
  Clone ID: uC-gsflnu33B056d10b1
tcccacgcgtccgcccacgcgtccgcccacgcgtccgtttccattgaaaagaaaaatcttaagaaacagtgatggaaggtatttcagcgaccatgtacaagaacttgaaagggtactggcaaaggagaggctacatcaagctaaatggtacgaaaggaggaggacggcggagcaaggtggagcttgggtcgtcgcgacggaggcgattctggaagataagggtgaaagcgaagctgagattaccttcgcctaagaagttctttgtttggctacgtgatgcgtacgtgaaaatgatgcatggggttggctaactcccggatggttagtaccggctacggtggagcttttggggaccatcatgggattgcagtcttgcggaagcggccggttaaagtgttctttgagaaaatgatcctctagat

SEQ ID NO: 14805 - DNA, 369 bp, Gossypium hirsutum
  Clone ID: uC-gsflnu33B056e02b1
ttttaatccttcgcttaactttctggagagagaaacatgtcttcaggctgcaaaagtagatctagatacggatggggctacagctcgtgatgcataccgaaccttaacctcgagtactaggccaagacaagcaggactgagaccatgatgtccggaaatccgccacgcaagaccacctttgagggaccagagatgagcactactgagtcaagacatggatgcaagtgtggatcaaactggtcttgtaagccatgcgactgatgagaacctcgcttaaagccctagatgatgaacctagaaaacaggagaagaacaggcctctgtgatgacagattttgaaggataaatgcctgcaaggaatatgactat

SEQ ID NO: 14806 - DNA, 443 bp, Gossypium hirsutum
  Clone ID: uC-gsflnu33B056e04b1
tccttgctctctccccctttccttctctttgattttctgctagggtttcaaagaaacccatgattgccgcccttcaaccaccgtaccaccaccggactcgatggctggcgatacaccaaaatgggctcctttagctctccccttttttacttgttggaggctagttccaaaaacgaaaagacaagggttcaaccccctttttagactcaaccacgccgaacggaggggaaggctccgataacgcggctatgggccggatctgatgttggagaggtggaagtggtagacagcatgggagagtgggagcggcgcttgtggcagacaacatgggagaatgggagtggtgctggtggcaaacagcatgggagaatgggaagaggcaagtgggagtctagggttttgggaatgggcttggatggtgggctaggttgattttggttttg

SEQ ID NO: 14807 - DNA, 234 bp, Gossypium hirsutum
  Clone ID: uC-gsflnu33B056e05b1
tcctacgcgtccgcccacgcgtccgcccacgcgtccggaaatattggaaataataatttgaaattaaatttgattggttttaaatttagatttctgaaaaacaaaaaatggaaaaaaaaaagtgctgtttaattttaatctggtgtagacgaagatattttgatcctctaatatatatgcactctcttttatatgtatatccgttgttttattattttatattttgttcttttc

SEQ ID NO: 14808 - DNA, 301 bp, Gossypium hirsutum
  Clone ID: uC-gsflnu33B056e06b1
tttacgcgtccgcccacgcgtccgaccacgcgtccgcctacgcgtccgcttgcttggaaaaaaaaaaaaaaaaaaaaaaaaaaaaaaaaagaaagattaaaaagaaaaaaaaaaaaaaaaaaaaaaaaaaaaaaaaaaaaaaaaaaaaaaaaaaaaaaaaaaaaaaaaaaaaaaaaaggggggggcaggttaaaaaaaccaaaattaagagcccggtctataaaaagtaaaaattttttaaatgggatccaaaaataaattataagggccgccgataaaaaaaatgttgaggggaaaaacc

SEQ ID NO: 14809 - DNA, 535 bp, Gossypium hirsutum
  Clone ID: uC-gsflnu33B056e07b1
ttggacttcgattacggtgcattagcacagttgctatatttctcaatcaacaatcttggagatccattcattgaaagcaattatggagttcattcaaggcagtttgaagttggtgtgctagattggtttgcccgtttgtgggaaatagaaaaggatgaatactggggttacattacaaattgtggtacagaaggcaatcttcatggaattttagttgggagggaagtgtttcccgatggaattttgtatgcttcacgagagtctcattactctgtctttaaagctgcacgaatgtatcgtatggagtgtgtgaaggttgacactttggtctcgggtgagattgattgcagtaatttgagaccgaagttgcttgctaataaagacaaaccggctatactcaacgttaacataggaacaactgtaaaaggagcagtagatgatcttgatgttgtgataaaaacccttgaagaatgtggattttcacatgatcgattctacattcattgtgatggagctttatttggactcatgatgc

SEQ ID NO: 14810 - DNA, 477 bp, Gossypium hirsutum
  Clone ID: uC-gsflnu33B056e08b1
tttccacgcgtccgatttttttgttcatcaatgggattccctgtggtttacacagacgttttcgtacccaaattcttcgttcacacgctatcgtttttgggtttcatcagaaacctaatcctctcactttttaattacctcggactctccgatttcctcgaaaccgacaccgtttggccggaaaacccgacccgaaccacaccttttaaaccgccggtatccgctctcttgatccgtgaaatcctacccgtcgtaaagttcgaggaactcgcgttggtcggtggtggtgatccgccggagagttgcgccgtttgcttgtgcgagttcgaaggaaaggaagagatcaggtggttgaagaattgtaagcatgttattcatagaacgtgtttagaccgctggatggatcacgatcaggtgacgtgtccgctttggaggacattcgttgtacctgatgagatgcaagctgagtttaataac

SEQ ID NO: 14811 - DNA, 522 bp, Gossypium hirsutum
  Clone ID: uC-gsflnu33B056e09b1
tgcaaagtagatggttcccgtattttctttctccatcgatcaattgtgcatcttactcaaggtgatgctactgtttcctcttatttcacgcaattaaagttgctttggaatgaatacactgctcttgtctctttttccgattgtgcatgcgaggttgcccatcaaaattcgagtcacattcatcaacagtgattattccaatttttgatgggtctaaatgagacctatgctgcagttcgaagccagattctcttgatgcagcctttaccctcgataaatcaggcatactctatgattgttcaagaagaagcttagaggagtttttcttctgttttgtcgcatgtttccgatcctgtggctttatcttccactgcatttggcagccgtaagaaattcactgagtgtcactaccttcactcctcaatagtattcacagatcctggacttgctgaataagagtcaagctactgttgcacctgctgtgaattggcagaattcaaatcagtagtcggaacgaggaca

SEQ ID NO: 14812 - DNA, 234 bp, Gossypium hirsutum
  Clone ID: uC-gsflnu33B056e10b1
ttggacgcgtgggttttatgccaaatggagatcttaaaagataccctttggggttatgttttttagttcggatttggattctcttgaaaagctctatgataataaactcacggattcaacatgatgtttaatgattattattgcataatgtggattggtattttcagttgctaaaagacaaggaatcaaccccctttttagactcaaccacgccaaacggaggggaaggctccg

SEQ ID NO: 14813 - DNA, 286 bp, Gossypium hirsutum
  Clone ID: uC-gsflnu33B056e11b1
ttttgaaacttcgcgaaagcctcacaagggtttatgtacaaagaacgggcaagcccctatgggttgtatccgaagacatggaaagagatgtttttatgtcagcaacagaagcccaagcttatggaattgtggatcttgtagcggttaaataagttaaataacaaatagcaatagcaacgatttaacaccaatccacaatttaattaagattgatttaatccctcttcttcctttccttcttaacttaagcctaaagcctaaggggttaatattttattaatctatt

SEQ ID NO: 14814 - DNA, 517 bp, Gossypium hirsutum
  Clone ID: uC-gsflnu33B056e12b1
ttctttcccttcaaacaaaacacccccccctacatatattcatatcccaaagttgttctcttaatcggaattatcatgggacgatcaccctgttgtgaaaaggcacataccaataaaggtgcctggaccaaagaggaagaccaacgcctcattgactacatccgtctccacggtgaaggttgctggcgttccctccccaaagctgctggactgcttaggtgtggtaagagttgcaggttaagatggataaactacttgaggcctgatcttaagagaggaaatttcagtgaagctgaggatgaacttatcatcaaactccacagtttacttggaaacaaatggtctttaatagctgcgagattaccgggaagaactgacaacgagatcaagaactactggaacacgcacatcaaaaggaagcttataagcagaggaatcgatccacaaactcatggtccactcaatcaacccaccaacaccaataaatccactgaattggatttcaggaacgtaccca

SEQ ID NO: 14815 - DNA, 416 bp, Gossypium hirsutum
  Clone ID: uC-gsflnu33B056f04b1
tccacgcgtccgcggacgcgtggggcgtggacgaccggtggttggcgagccttgggcggtggcggcgtgcgaggaggtggaacggcgcgcattgttggagcctggcatgcggcgctggggcttagggtttgctccattctgtcgaaattgttaaagtcatttgggccaggttttttattttgggcccgttgggtgtatttaattttggctttgggctactactgtaatagactgtcttattttggattttgggtttctatttagggcccgggtaaaaatgggctcttacaaatatgtctcctcaaaggtcttaagaatgccatttttgccaaacatatgcctaacatgaaccatccaggaatgtttgcaaaggtccttaatggcacgccccacaactgaataagtttgctaatctt

SEQ ID NO: 14816 - DNA, 508 bp, Gossypium hirsutum
  unsure (1)..(508): unsure at all n locations
  Clone ID: uC-gsflnu33B056f05b1
ttgttttccttgttctcttctacattcagcaaaggggggctctgagatcacataccaaaatggtgaaagccgttgccgtccttagcagcaatgaaggtgttagcggaactgttttcttctcccaagaaggagatggtccaactaccgtgactgggaacctttctggtcttaaggccggactccatggcttccatgttcatgcccttggggacataactaacgggtgcatgtcaactggaccccattttaatcctgctggcaaagagcatggtgctcccgaagatgagaaccgccatgctggtgatctaggaaatgtcactgttggtgatgatggctgtgctagcttctgcatcaccgacaaacagattccactcacaggcccaaactccattatcggaagagctgtagttgtccatgcagatcccgatgaccttggcaagggcggccatgagctcagcanaagcacaggaaatgctggcggcagagtagcttgccgtattattggtct

SEQ ID NO: 14817 - DNA, 533 bp, Gossypium hirsutum
  Clone ID: uC-gsflnu33B056f06b1
ttcttaacaaagcttgtagcactgaaacctgggaaacccgtccaggaaatgataaaaaatgtaatgctagggaaagatgaaggtgcagactactctgacactgatgaagaagctaatgccagtagtacgagaccctggggaattgcaggaaggggcactgttacagggagaaaaccacttcctgttcgccccggcatgtttcttgagactgtgacaaaggttttgggtggtatatataatggaaatgtctctggcataacggcacagcatttagaatgggttcatcagaaaacacttcaagttcttctggaaattgcattctaattcttcaagctacttgtaccaaaaattggattacatcataatccgcagtttacatcaaaggagagagatgattccataagtagaggttagagaatcctgctcccaactatgaaatatttatgaaattatgtcatttagaaattgagcaatgttacatgtacatttgttagaatgaactgcagtttactattttgtattttgggtagtct

SEQ ID NO: 14818 - DNA, 399 bp, Gossypium hirsutum
  Clone ID: uC-gsflnu33B056f07b1
ttccacgcgtccgcccacgcgtccgtctagttctacttctacctgcagctcagcaaagactgctacaaaaaataagaaaagtagtgatctcaaatacgacttattcggatgggtaatccttgctttggcattgttgcatgggttggatttgcaaaatctcagatgccaccttcacagctgccaccaccaccatgataagcacaggatgcaagcaacgccctgacatctaaatgctgtttgcattgattcaaaaagccttaatttatgttagtttagtttttttgaccttattcgtgctcctcagctaatgcttgaaaactagtcatttacagtacaattgctttattcggagaataggtgagtgattgttaacatgaaaaatccatctgttgattattt

SEQ ID NO: 14819 - DNA, 418 bp, Gossypium hirsutum
  Clone ID: uC-gsflnu33B056f08b1
ttgaaaatgaagggtctgcaggcacttatattggcaatggtaacggttatggcgatcgctacaactgatgctcaaagcatttgcagcatgccagcttcaggtttgatggcatgcaaaccagcagtgacccctcccaaccctccgccgcccacgtcaacttgctgctccgccctctcccacgctgacatgcgttgcctttgctcatataagaactccaagctgttgccttcccttggtattgacccaaaccttgccatgaaattgcctagcttgtgcaagcttcctcatcctgcaaattgttagttcctggctctccatatttgatctcaaatgtgaaggaaaactatgctttattatagcccttacttcacattattgtactgagcttcgggttttctttttcctttatttcttttta

SEQ ID NO: 14820 - DNA, 525 bp, Gossypium hirsutum
  Clone ID: uC-gsflnu33B056f09b1
tctctgtcttcgttgctgtttatcaacctgttcagtctcttgttgtcgctattatgtcttcccttgctttaggcgaagagttctatttgggaggtatcataggggcagtgctgatcataacgggattatatttagtgctatggggtaaaagcgaagaaagaaaattcgcagctcaagaaaaagccgcaattcaatcgtcaacggcggagcacggcaacagcagagcatcgagccatatcaaaacatcccttactcagccacttttgccaccttcaacggaaaatgtttgacccctaaagaaaattcctaaactttcaaccattctgctttgctgcaaaaaatgaaagaaacaaatggggaaaaaaccaagcactaccctatatcagaaagtttgtgtgtgtatgatacttttttaatttcttttctttttctttttcctttttaatttagtcgtcaatggctgttctctgagtagcagagagggtttttgaagatgatgatgatcactgtcacagctgtgtatga

SEQ ID NO: 14821 - DNA, 514 bp, Gossypium hirsutum
  Clone ID: uC-gsflnu33B056f12b1
tttcactcttaaactctaaaccccaactctgcatatttcatattgcaaacgatggcgtcattggattcaaaagaatacacctgccaataacccaggccttgattttccccctgacgaagccacctaaggctacattatgcatcataccatgtttcgtgttaaggatccaaaacgcactattgaattctatcgtcgtgttttgagcatgacgctgcttaacaaagtggatgttccatatatgaaaatgacattgtatatcatgggatatgaagatgtttcatcagctccaactgacccagttgagaaaactatttggacattcggcagaccagctactatggaactgacacacttttggggtaccgaaaacgatcccgagttcaaaggatatcacgatgggaattcggaacttattggatttgggcacatcggccttaccgtggatgacttggacaggcatgcgagagatttgaagtcttggagtggaatttgtaaaaaaccaagtgacggtttt

SEQ ID NO: 14822 - DNA, 530 bp, Gossypium hirsutum
  Clone ID: uC-gsflnu33B056g01b1
gcttatttcaacaaattcagtgcctacctgaaaatgagttcatcacttctagtctttctccgtccttgacattgaatggtagtttgcattcagaaattcctggacttaaagttgagtcatctacaggaatgaatactgatgctcatcaggatggtgatgtggttagtttaaagtccaactcctctctttctgaggaagtttccttctgtgaaaacaattcatgtttacagattgattcagaagttatccgaataaatggtgatgatatggataaggttaattctatagctgtgagaggaaatccagagaatatggataggattagtactctgccatgttcaactgatatgaaggggatttgcaggtctgacaaagatctatttgatgcaaccaactccgaagatatataaaagccaaaagtgcgatgacaattgatgcacagcaattttcatttgttccaagagaaataaatagctgtgagctagattcgcaagtatcaactagttatgtgatgaaagttcacaagacgt

SEQ ID NO: 14823 - DNA, 353 bp, Gossypium hirsutum
  Clone ID: uC-gsflnu33B056g03b1
gcgtttttctcttcacggaaccagctggagcactaatcgcagacatggaaacagaaggggagcaactgtgcgaagctgcacgaaacggctacggcgcccaagcgaaagctctggtagagtcaggagccgacgtctccttcttcgacagcgatggactcacgccggtcatgcacgccgacaagctcggccataccgatttagtcaaagctctgcttgaggctggcgcaccgtggaacgctctttcttcttctaaccaatccgctggtgactttgccatggactccggtcaccaggaagcctatgaagcccttctcaatgctggaattcaggctgaattgattttgggaaccatt

SEQ ID NO: 14824 - DNA, 511 bp, Gossypium hirsutum
  Clone ID: uC-gsflnu33B056g04b1
tcttggttttcgggttcaatgcaacaaatgggcaatcattgttcgattactgctgggagaaatccccgagaggactgtttttatgcagaaaggcatggagaaagcattgaggccatactttgaactgacaaatgctgtccgcattggtgatttggagcttttcagatctgttgctgagaagttctcaactactttcagttcagaccggacccataacttgattgtcaggctgcggcataatgtcattcggactgggctacgcaacataagtatctcatattctcgcatcgcactggccgatgttgcgaagaagcttagattggactctgttgctgatgctgagagcatagtagccaaggcaatcagagatggagctatcgatgcgacattggatcattcaaatggatgtatgctgtccaaggagacgggtgacatctactctacaactgagccttaaacggcattcaactctaggattgctttctgcctaatatgcataacgatgctgtgc

SEQ ID NO: 14825 - DNA, 286 bp, Gossypium hirsutum
  Clone ID: uC-gsflnu33B056g05b1
ttttttttagaggaaaaaaagaatcttattgaaaatgtcacaagcccaaaaaattaaaacaattaaaacaaacacaatcaatagtcgtacaggtggaatatggttgtcatctcaggtttctttttgaattttacttaatcagttgtgtatatatatatatatatgaacacgtagatttcacagtagtctgcataatggaaactgtatatgattagctagcacttttggagaacttgatgtaggcaacttttaatgattcagagtgttattgttttcttttcttttc

SEQ ID NO: 14826 - DNA, 445 bp, Gossypium hirsutum
  Clone ID: uC-gsflnu33B056g06b1
tttttagatcgcgagcggacttccttttacaggaattgttttattgaaatttgcctttaccacaaacaaaacagcataggtttatattctcacttggaaaaacaaaactggttaacattaagactattatgcgcgcttgtcaatacagtaaatatggcggaggagtctgctatcttaagcaagttgatgttccggttccaattccaaaatatgacgaagccttgatcaaagaagaaacatatattattaacccaattccactggaaacttcatgacggtgttccttcgaacatttttaacctcggaaatttccctacattaaatgtgactttacttgtattctgagatggttaacttctatgggttaatacggaagtaataaaactttattttctgtgaatggttcgttatcaatatttgcttaacaacatttgttctatcaagt

SEQ ID NO: 14827 - DNA, 503 bp, Gossypium hirsutum
  unsure (1)..(503): unsure at all n locations
  Clone ID: uC-gsflnu33B056g08b1
tctttggagagccttttttgtgtagcgattctcagttagtcttttctttaagcttacagcttctctccagagttttataatgggtaaggagaaggttcacatcaaccttgttgtcattggccatgtcgactctggcaagtcgaccactaccggtcatttgatctacaagcttggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccagatactattgcaccgatcttgatgcacctggacaccgtgactttatcaagaacatgattaccggtacctcacaggctgactgtgctgttctcattattgactcgaccactggtggttctgaagctggtatctctaaagatggtcagactcgngagcatgctttgcttgctttta

SEQ ID NO: 14828 - DNA, 482 bp, Gossypium hirsutum
  Clone ID: uC-gsflnu33B056g11b1
ggacaaggtaatgatatttgttttaacaaagatgattcatcccatccactctcctccctaaacttccagcaattaacgacactttttgggaacattttcttacaggaagtccactcactggggacacagatgagatatactcgagttccctcgaaaatggtgcatacggtggataggaagcagttttaagggaggagagtggatgggatgaatcatctttgctgacaaataggccttctttacatcacattagcaggaaggggtgatgtcgtacaagctgtatacgcaaatacttgattggttttcttgctttaatgaggtaaaacttggtaccgcctgtgttcctgcttagtatgtgatcggtttatctatggttttagaaggcttaatattatattcaaaatttggattggtctcatgttgcgatgagtttattctagaattatgggatgacaaggcattgatatttggttaaacaaaaa

SEQ ID NO: 14829 - DNA, 526 bp, Gossypium hirsutum
  unsure (1)..(526): unsure at all n locations
  Clone ID: uC-gsflnu33B056g12b1
ttccacgcgtccgctcctccttatctttctcagagtttttcttgatttttgcctttaccacaaacttaaaagcttcggtttttattttcactttgaaaaacaaaaatggataagattaagactatgatgcgcgctgttcaatacagtaaatatggcggaggagtcgccgatctcaagcaagttgaagttccggttcccagtccaaaaaaggatgaagttttgatcaaagtagagacagctagtattaacccaatcgactggaaactacaggacggggtagctcggccatttttacctcggaaattcccccacattcctggtactttacttttctctggatggttcagctctatgggttaattcgaagcatcaaaacttttctttctgtgattgcttgtttttcaatcatttgcttaacaacatttggtcgagcaggtcccgatgtagctggagaagtcgtacaagttggatcagaagttcaagagttcaaagttggngagaacgttgttgccgtacttggtaatgg

SEQ ID NO: 14830 - DNA, 479 bp, Gossypium hirsutum
  Clone ID: uC-gsflnu33B056h01b1
ttgcttccggaagaaaccgaagaatttcttgggaatcctacaagatccattcgttcttttttctctgatagatggtcagaacttcatctgggttcgaaccctactaagaggtccactagagatcaaaaattgttgaagaaagaacaagatgtttcttttgtcccttccaggcgattggaaaataaagaaatagttaatatattcaagaaaattacgtatttacaaaataccgcctcaattcatcctatttcatcagatccgggatgtgatatggttccgaaagatgaactgggcagttccaataagatttcattcttgaacaaaaattaattttttgatttatttcatctattccatgaccagaacatgaggggatacacgttacaccatgattttgaatcagaagagagatttcagaaatggcagatctattcactctatcaataccgagccggatctggtgtatataagggattttc

SEQ ID NO: 14831 - DNA, 398 bp, Gossypium hirsutum
  Clone ID: uC-gsflnu33B056h02b1
ttcctctcgtccgtcaataatgtctaccacacacttgttatatattgctacttggagtggtggctctcgccactccctcttttggtacctatgagtctcccaactatgggaagccccctactcctgttcataaacctcctaaggtgaaacccccaccttatgaacatcctgtttataaacctcctaaggtgaaacccccaccttatgaacataagccccctgtctatgaaccaccaaagaaggaaaagcctgagcctaagccaccagtttatacacctccaaagaaagagaagcctgaacccaaaccaccagtatatgaacctccaaagaaggaaaagcctgagcctaagccaccagtttatacaccaccaaagaaagagaagcctgtgcccaaacca

SEQ ID NO: 14832 - DNA, 189 bp, Gossypium hirsutum
  Clone ID: uC-gsflnu33B056h03b1
gcgtcctctcgtgcgatcttaggggcttaacaggcaacgtctttacctggcgaactggtgaagtgataaccttgaacattcaactattgtgacttttcacccaacagatgtgggagctctcgaagggaacatgttaggcttttactgagataaatgacgggtgttcgttatagcataagcgcttttggg

SEQ ID NO: 14833 - DNA, 375 bp, Gossypium hirsutum
  unsure (1)..(375): unsure at all n locations
  Clone ID: uC-gsflnu33B056h05b1
tgttttgcattcatcaaggatcctgatggttattggatcgaaatctttgatttgaacggaattagacaaatagttaatactttagcttgagttagtacttcaccaagttcaggtagctttttattgcttatcatctttgtacatcattgcaaatcaatctaatacatatcaatgtcaatgtcaatgcaggaaacaatgatatggcatatgttgcagattccagagtctacttccgtacactaaatcatgttttttaaaacttatcgagggacaaatttaagtgaaatcttaattgaagcacatttantttcagttgtgtctatgttttctccatgtttaatatgtataataaacaaagtgaaaataaagtatttt

SEQ ID NO: 14834 - DNA, 526 bp, Gossypium hirsutum
  Clone ID: uC-gsflnu33B056h06b1
tgattaagctttctttctaaatccctctttagcaaggactttggaccgaataccaaatttctgggaaaaatgcagttttccaggaattttatgataatttgttctgcattgctcctgtgctcttccttgacatatgggcaaacggctactccaccggctccggtggcaatgaccccaactccgacacctgcaccggctccggcacctgaatacgtaaacctaacttatttactctctgtggctggtccatttcacactttccttaactaccttgaatcaactaaagtgattgacaccttccaaaaccaagccaacaacactgaacaaggcattacaattttcgttccgaaagacgattcgttcaagggtcttaagaagccgtcattgtccaaactcagtgatgatcagcttaaatcgctcatccttttccatgccttgcccaaatactatgccctagccgacttcaatgacctcagtacaaaaggccctatcactacacttgctggtgggcaatacactttgaatt

SEQ ID NO: 14835 - DNA, 356 bp, Gossypium hirsutum
  Clone ID: uC-gsflnu33B056h09b1
ttccacgcgtccgcccacgcgtccgattcctcttccgtcccgtagattccgccagatccatccaagggttcaatctctgagactgagtcttttttaaactgttatggtgcctctcaggggacatgttaggcttttactgtgataaatgacaatgttttgttatagcattagtgcttttgatcaaaaaaaaataaaaaaaaaaaaaaataaaaaaccagaacaaaaaataaaataacttaaaaaaagtaaaaaaagggcgggctttgtcgaggttccattttaacgctcgcgtgcgggaaacaccaaagttttcctttagttatagcttaatcaaattaaccggctttggccggtcg

SEQ ID NO: 14836 - DNA, 528 bp, Gossypium hirsutum
  Clone ID: uC-gsflnu33B056h10b1
tggagatctgaatccacaaggggagaaatcaaatgcttcatatgatatgagattctttgggtttgatgcaagcgaaaacgaagacttatttggagatgggcctttgcccgagtgggtggggtggggagaatcatcagatttgaaactaggtggttcaagcaaaaacccatttctagatgatgacagctcagatgtcaatcagccaagtcatatcgagacgacggtcacttatgtctttcccctgtcgaatggagaccccatacttgcaaatgtttccctggactccatggatctgagtgacggatcagtgagcagtgatacaagtcagaaatctccaccagcagtgccctctttgttcggagaggatgtcgaattcgtaggggtggaattagaaggtacagagaaggcaatggaacaagctttaaaagaaggaatagttggtgaagcttggaccgtaaagaggaacattatttcaaaggtaccacagaaggagaattcggacgacgatggggctgaatgaatgagttc

SEQ ID NO: 14837 - DNA, 84 bp, Gossypium hirsutum
  Clone ID: uC-gsflnu33B057a01b1
tcccacgcgtccggaataacaagattgttggtgtcgttgaatctgagctgactaaaaatcccaaaactgttttggttttcctgt

SEQ ID NO: 14838 - DNA, 486 bp, Gossypium hirsutum
  Clone ID: uC-gsflnu33B057a02b1
ggttcacatccaatggtccggcatcgagtgaccgtccaagctcgactggctcggcctctactcgccccccgactccccccatcacaacttcatcggttacaagttcctttcatcttcttcctcaacttgggaatctggagcgggctccatttctctccccctcaccttcctccgctctaactacaccttccggatcttccgctggaccgaatccgaggtcaacccggaaatccacgaccaggatcataatcccctcccgggcacgaagcacttgttggcggaatccgagacggtgggtttcgaattgggtcgtgggccggagcagatccacttggcgttgaccggtcgggaaggggagatgcgggtgatgttcgttgcggaggacccagaggagaggcaggtgaggtacggagagaaggaaggagagtgggaaggtgacgtggccgtggcacgtgtggggaggtacgagaggggagacatgtgtca

SEQ ID NO: 14839 - DNA, 395 bp, Gossypium hirsutum
  Clone ID: uC-gsflnu33B057a05b1
gctctcacgcgagcggcgagatggctcatctaccgggacagctaacattaatgggcttaagcatggcctacaagggttccatgcacatgccctaggggacacaacaaagggatgcatgtgaacaggacctcactgtaatcctgctggaaaagagcatggcgctcctgaagatgtgaatcggcatgctggtgatctaggaaaagtcactgttggtgctgatggctctgcgagttattctattgtcgacaaacagattgctgtctccgggccacactccattattggaagagcggtcgaatggcatgctgatccggatgaccttggcaagggggggcacgagcttagcaaaagcactggaaatgctggcggtagagtagcttgcggaactattggtc

SEQ ID NO: 14840 - DNA, 350 bp, Gossypium hirsutum
  Clone ID: uC-gsflnu33B057a06b1
tctccacttggaatccattgcttcctctgcggtacgagcagcaattaaggtgaaggcatcagttattatatgtttcacatcctcaggaagagctgctagattgattgcaaagtacaggccaacgatgccagttctctcagttgtcatccctcgccttaagacgaatcaattaaagtggagcttcagtggggccttcgaggcaaggcaatcccttattggcagaggtcttttccctatgctcgctgatccacgacatcctgcagagtctacaagcgcatcaaatgagtcggttttgaagggtgcacttgaccaccggaaggctgccggagttattaagtcacatgaccgag

SEQ ID NO: 14841 - DNA, 377 bp, Gossypium hirsutum
  Clone ID: uC-gsflnu33B057a10b1
ttgccgccgctgatgtcgagttccggtgcttggtcggagggctcgaatggtccaccgacgaccgggccctcgaagaagccttcagtgctctggtgaacacgtcgaatggaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgtgcataagtggaggcggtggcggaggatttggaggaggaaacggtggttacagccgcggaggaggcggcggtggatatcgggtttgccaaggaggatatggtggttgacgccgagaaagtg

SEQ ID NO: 14842 - DNA, 494 bp, Gossypium hirsutum
  Clone ID: uC-gsflnu33B057b02b1
tgtgatggtgtcggttatagttggatcgatggtctcaaggcccatgctgcccgacatgtgaccgataagatgatgttcaatgcttctttcatatttcctcacaacacaccaactacaaaagaagcatattactacaggatgatttttgagaggtttttccctcagaactcggctagattgactgtccccggaggagctagtgtggcatgcagcacagctaaagctgttgagtgggacgctgcctggaaaaacaaccttgacccttcgggccgggctgccttgggggttcatctctctgcttatgacgcagagacttccctcagcaacaagccatccaaggttattgatagtataccacggatggactttcctggagttgccatacagagttaatgcctgcctaactggaagacaacagaatggatgaaatatttaataaaatgagtaggagcctgggcatgtccaaatgtatgaagtatttaataaaatgagta

SEQ ID NO: 14843 - DNA, 322 bp, Gossypium hirsutum
  Clone ID: uC-gsflnu33B057b04b1
cccacgcgtccgggagatatgtcagggcagttgctttggccacaaagcaggtgtagccctgagtgttctcctttacctagtcccagaatgacgagccctggtcccagctctaggatacacagtggtgctgtcacccctttgcatccgcgagcagcaggggctgctgctgagtcacctacaagtcgacctgatgatgggaaacagcaaagccacaggttgcctttttcccccaataccaatatctaaatattggccctttttcttcctgggtattctggaggaaccattttcatcaattaacccgaaagttcctggtaggggc

SEQ ID NO: 14844 - DNA, 491 bp, Gossypium hirsutum
  Clone ID: uC-gsflnu33B057b07b1
taccctctttacgcttcagcttctcttcgactgtgtagtggaatcgggatccatggcggccttgcagtacctggaatctcttcgaaatgagcatccagagctagccgactggtatagttctctagcagatctgtatcagaagaagctttggcatcagctcactctcaagctggaacagttcgttgctctcaccgtctttcaggctggagatgcactgatacagttgtatcataattttatcactgactttgagaccaagattaatcttctcaagcttgcacattttgctgttatagtttctcggcagtattctgacaaagaagcttctactagttatcttgaaggtgtgatcgaaaagcttcaggctactaaagagcagcgcatagaagagccaattatttatattaagatgcaaattgccaaatttaagcttgagcagggtgaccaaaaggagtgcaagaaacttcttgatgatggaaagagtactcttg

SEQ ID NO: 14845 - DNA, 293 bp, Gossypium hirsutum
  Clone ID: uC-gsflnu33B057b09b1
tgtcgtcgctgatgtcgagttccggtgcttcgccagagggctcgcaggggccaccaacgaccgggccctcgaagaagccttcagtgctctggtgaaatcgtcgaatcgaagatcattaatgatcgtgagactggaagatcccgaggctttggattcgttactttccgtgacgagaaagctatgagggactcgatcgaaggaatgaacgggcaaaatcttgatggaaggaacattaccgtaaacgaagcccaatcgcgcataactggaggcggtgtcgcaggatttggaggtgg

SEQ ID NO: 14846 - DNA, 411 bp, Gossypium hirsutum
  Clone ID: uC-gsflnu33B057b10b1
atggcttcaaatcccaaggttttcttggacatgacgatcggaggtcaaccggccggccggatcgtgatggagcttttcgcagacgtcactccttgtaccgccgagaacttccgggcactctgtaccggcgagaaaggcgtaggtcgttccggtaaaccactccactacaaaggctctaagttccaccgcgtgatccctgatttcatgtgccaaggaggtgatttcacagccggaaacggaaccggaggtgaatcgatatacgggtctaagttcgccgacgagaacttcatcaagaagcacaccggacccggcatactatccatggcgaacgccggtcccggaacgaatggatctcagttctttatttgtaccgctaagaccgagtggctcgatgggatgcatgtggtgttt

SEQ ID NO: 14847 - DNA, 496 bp, Gossypium hirsutum
  Clone ID: uC-gsflnu33B057b11b1
cctatttacaacaacaaaaaaaatctttccagtttctattttctaaaaacaaaactgaaaatgtcttgctgcggaggaaactgtggctgcagctctggttgcaagtgtggcaatggctgtggaggatgcaagatgttccctgacataatagagaagactacaactgagactattgttcttggtgtgacaactcagaaaatgcactttgagggatctgagatgggagttgcggttgagaatggatgcaagtgtggagacaactgcacttgcaacccttgcaattgtaaataagagggggggaaaatgaacaacaaagagaagcagagaggcctttgtctttttaactaaataaattctattactttagtatgtatcagcaaatctttatgaggattctggtcttaattatgtgtaatgtgggctttctgctatgtcagaatgaattatgatatttaagaaagtttgttttcaattgaaagaatggccgttccttttt

SEQ ID NO: 14848 - DNA, 270 bp, Gossypium hirsutum
  Clone ID: uC-gsflnu33B057b12b1
tgttaattattttcttaatcagctttggttgaatcctaagacttttttttctcatattgcttcccttttttgtatgtgttcatgatcaacaaatgactgagatatctcaagctgcctaaattgttggttttcagagtttggaataaaattttctgaaacaagaagcttgtacttgctgagaaaaacaataattaaaacggtagaaaaaaaactcaaaaaaaaacagatggagaaaaagaaaaaaaggaccgaaaaaaacaccatgtcaac

SEQ ID NO: 14849 - DNA, 457 bp, Gossypium hirsutum
  Clone ID: uC-gsflnu33B057c02b1
gttgatcgtctcacgaagtacgaccacttgtttgctttgctgagacactttgattgcaaatccattgccaaaataatggtgcaaggtatggtgaaacttcatgggataccccgttccatcgttaacgaccgagatccaatttttgtcagtgaattatggactgagctggctcaactccagggcactgatttgtgtatgagttctgcataccatctacagacggacggccaaacggaggccctaaattgatgtttggagatgtatcttagttgcatggcaggagatgatctggaaaagttaccttgtgtaagccatgtattggtataacactgcttatcaagattcagcaggcatgacaccgttcaaggcgttgtatggttgcgaacccccaacaatagtaagttatacggatggtggttcctcaaatacccagctcgaccatgacttgaatgaacgt

SEQ ID NO: 14850 - DNA, 463 bp, Gossypium hirsutum
  Clone ID: uC-gsflnu33B057c04b1
cggcgatcctccatgcccatgccacgaatcggggaccggtactacacgaggtgggctccctttggtcctcctccgaacggaggtcgaagacggagccttcgcggcccaccacgacggaagagacgaggaaaggccccgggaggttcgtcggagcacctcaagcagtgtatcggaggtttcagaggccgacggttggctggtgagaaggcgaggcagcgcgtgtggaggaggccgaacggcgcctagggtttccctcttctcctttggctgaaaaatgtttaggatagttgggctagttgggcttcagggttttcttttaattgggtattgggtaactatggtattttggcgtatgtgttaaatggactcttggacttttattttgctcattgtgtttggacgcttatgttggattggtggcatgggccacaacttgctagtacacttctttgttctgttgcac

SEQ ID NO: 14851 - DNA, 504 bp, Gossypium hirsutum
  unsure (1)..(504): unsure at all n locations
  Clone ID: uC-gsflnu33B057c06b1
tatcccgaaacccttattttcccctaaatcaaaatttcccctaaaccccaaattgtccccaaatcaaacccatttgccgtctccctttctcttttggttcgacagcaagcagaaagattaagggatttcatttcgaaatcaaacccgactgaaggctagcttttgcgagtccaacaaatcaagttggtcaagaattttagatttacgtttgctgcatcgccttcggtagtctttcgcatcgtcatcggcagccttctgctacatttccgtcggcatccctcttctacatctccgtcggcatccctctgctgcttctccagttttctgtcatccaatttgcttagcttcaatccacattgacttaggtaaggctttgggtcctccattgtggtaattgcgatgaccatgactttcttctttcttcttagatagtgcagcagcatgcctgcacttcctccaatgcttgcctcttctaccaatgcatgtnttaatacttgaacacca

SEQ ID NO: 14852 - DNA, 487 bp, Gossypium hirsutum
  Clone ID: uC-gsflnu33B057c08b1
taacaaacggatttaattaatactgtttaggttaggactaaaatttcaaatttcaaaaattaaaaagaatggaaactaaaattgatcaaattaaaataaagatattaaattcacaactttcataaagtacaagaactaataacagaatttaactgattatcatgggataacgaaaattgtttttttttttagttggaattaccatcgaattaatcatcctgttcttaatttttcgatttataatttaggaattgtgcctgattcttctgttggctcctccttggaagcagcaaattctgaagtggagaatgatggtaatcctcctcctcataccctgtttcagggtcactttggaaatgatctccacaagactccataactcaagttaaacattaattagccatttatgtcgtgtcccagccttctatttatttcttgtcattgtgagaatgtttctgttttcccattggttgccattggttgctgc

SEQ ID NO: 14853 - DNA, 350 bp, Gossypium hirsutum
  Clone ID: uC-gsflnu33B057c09b1
ctcttctttcctcctagcccaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcaagcccttctttgatgttttga

SEQ ID NO: 14854 - DNA, 476 bp, Gossypium hirsutum
  Clone ID: uC-gsflnu33B057c10b1
cttgtgccatatcctcggatccatttcatgctctcttcttatgcgcctgttatctcagctgagaaagcataccatgaacagatatcagttcctgagatcacaaacgctgtgtttgagccctcaagcatgatggccaagtgcgatccaaggcatggcaagtacatggcttgctgcctgatgtatcgaggagatgtggtgcccaaggatgtgaacgctgctgttgctaccatcaaaacgaagaggaccgtgcagtttgttgactggtgcccaactggtttcaaatgcggtattaactatcagcccccagctgttgtccctggaggagatcttgctaaggtgcagcgagctgtttgtatgataagcaataacacagcagtggcagaggtgtttgcacgcattgaccacaagtttgatctgatgtactcgaaagagcatttgtgcattggtatgttggagagggcaggaagaaggtgaat

SEQ ID NO: 14855 - DNA, 496 bp, Gossypium hirsutum
  Clone ID: uC-gsflnu33B057c11b1
ttaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaattaaaaaaaaattgggggggcctttttagggatccaatttttctttcccggggttggcgagctaattttttttttttggggacaaaaaaataaaaatatgggcccggttttaaaaaccgtgggagggggaaaaacttggggtttcccaatttaatttgtttggtaaaaatccccttttttcacgggggggataataaaaaaagggccctacctgtcccttttttcaaaattttgtacacttaaatgggaaaggggaccccccctttttggggcctataagggggggggggtggggggtgttcccccaaggggtccttttattttggcaggccctttaggcccggttttttcggtttttccccttttttt

SEQ ID NO: 14856 - DNA, 260 bp, Gossypium hirsutum
  Clone ID: uC-gsflnu33B057c12b1
tttaccactcattaataaattccatagcgggggcttttttaaaaaatcaggggttatcctaagtgttcttctttacccttttccataaaaacgagccccctgtcctagctctaggatacacagtggtgctgtcacctactaggaatactcgagcagcaggggctgctgctgagtcacctacaagtcgaccctgatgatgggaaacagcaaagtcacaggttgtttttttccccaataaacaatattaaataattgccctt

SEQ ID NO: 14857 - DNA, 467 bp, Gossypium hirsutum
  Clone ID: uC-gsflnu33B057d02b1
gaattcctattttccctttatccgcactggggaaaagaatagagaaaaattgcaatagctttttttgatcgtcataaagaaaaagcgccggggcgtgacctgagatcatcaaaacctaaacacgatcctttgatttccgaaatatgtggagaaggctacttacttcacagttcaaatatctggcaacacttccatgccgatccgcctctaaaacggcgccgcttccattcaaatctcacatttctccttccccttctgcttccctcctcgttcgccatttctccgccgagtcagcggatactgctgtgaagaagagagttgaggatgtaatgcctatcgctacaggtcatgaacgagaggagcttgagtctgagcttcagggaaagaaaatccttgaagatgtaaacaaccctgttggtccttttggcacacaggaagctcctgctgttgtcaagtcctactatgac

SEQ ID NO: 14858 - DNA, 335 bp, Gossypium hirsutum
  Clone ID: uC-gsflnu33B057d04b1
ggccggttcttgaagacagctgcctatggacattttggaagggacgaccccgacttcacctgggaagttgtgaagcccctcaaatgggaaaagcctcaatcttgaagtccccccgtccgtactgccccgtgcttttctcatccgcggtgctgaataatcccgatgtttcgtagctcctaccggaaatatctaatctcatacttataatgccctttttcattttcattttctatttcttcttttatcgatgcttgttttgatttatgtgtctttttatcagcgtcggtgttgcaaaactgagtgagaattttgcttatattgatggcattggaatt

SEQ ID NO: 14859 - DNA, 451 bp, Gossypium hirsutum
  Clone ID: uC-gsflnu33B057d05b1
taattgccattgtttctggagtagggcagagaaaggaagaagaagaagagagatggggcagttgtgcatagagctcaacgtggatatgatgggacttgtgcttgcgctagttatcgccatcgctctcttgctttcctgcgtcaaccaacctccccggccccgccgaccaatggttgttactcatcgtttaggttggtaaacccttcgttttgcgtctttactccccaagttactcgagtaacttaagtctcataaggtcattgaaaattgaatccatgtataaactcctttatttttttgtgaattaagtaattgtataaaaacaaaaacaaacaccatctcctctatccctcatcccttcccttataattctttttctcttttctctcctactatttaaaataaatctggggggggccgttttaggggttccaagttttttctcccgggc

SEQ ID NO: 14860 - DNA, 489 bp, Gossypium hirsutum
  Clone ID: uC-gsflnu33B057d06b1
tcctcacgcgtccgcccacgcgtccggatttcctgatgtttgggggtgaaccaagctgcagttcatctgatggtagctatggcaaagagatgaaacaagaagatcatatgggttttcggggttttggtgcttcattagactatggtaccaacaatggagttaaccaatggattgagaaacaaagtgggcatagtggagaatgcccattagattataaccctgaagatgttaagagactgattagctctaataataactgcttcttcatagatgaaaatgacacacaagataaagctatgtactgctattactactagtgatggaactgcttgcaggaaagatttgatgggtaaggcccaaagctgagggattgaaaagaaaaaaagaaaaaagactttcagtttctggggtaatgtgtactgaatctgatgaaatgaaacatattttaaaatttgccttttttatatggatttgatgcatttctttttg

SEQ ID NO: 14861 - DNA, 106 bp, Gossypium hirsutum
  Clone ID: uC-gsflnu33B057d09b1
ttaaaaaaaaaaaaaaaaaaaaaaaaaaaaagaaaaaataaaaaaaaaaaaagaaaaaaaaaaaaaaaaaaaaaaaaaaaaacaaaaaagggggggccgttttggg

SEQ ID NO: 14862 - DNA, 476 bp, Gossypium hirsutum
  Clone ID: uC-gsflnu33B057d10b1
gacccacgcgtccggggaagttcttggcatcacaagatttggaatccaaaaaatggacaaaagtatattgatgctggcttcatttgagaagacaggtgatcacctttttaatgcttctgttaatgggagggatgacaagattgagggggttaccgagtgcatcatcatgggcatcccgatgcaattaggcactggaatactcaaagttatgcagagagttgatccccttcctctgcttcaatacggagcggatcctgttttatcttgaagaggtcatcatcagcacacctcgttgtggtactttccgtatgctgttcaggattgatttttttattttcttttctccgagcttatgtatttagtaattcactggagttttatagatatttcctttacaaatttgaatttgcacaatgttaaataggaacacttttataaagattgattcatttaaccttattaatctgaccttttct

SEQ ID NO: 14863 - DNA, 314 bp, Gossypium hirsutum
  Clone ID: uC-gsflnu33B057d12b1
tcccacgcgtccgcttgtgttcagtgattgatgaaatgaaagtttggaaagctctaattaggagtaccttggattgaatttaatcttcgttgaaatccgtatcattttgttatctgatctggttttcgatttctatcatctctcttctgttgtttgtttgaatgttcaaagtacttggatgcttccagtcactcaattgaagtacagcacatagtctcgtccaatgctgaagtactcttattcccaggttttttcttctttttaattaatccttttcttttaaaaatcgattatgtttctgtttggttcaatat

SEQ ID NO: 14864 - DNA, 495 bp, Gossypium hirsutum
  Clone ID: uC-gsflnu33B057e01b1
tattgcttttagttgcctcgatttcaagtgaatcagaatgggtaaggaaaagactcacattaacattgtggtcatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccaccaaatactactgcactgtgattgatgcacctggacaccgtgactttatcaagaatatgattactggtacgtcacaggctgactgtgctgttttgattattgattccacactggtggttttgaggctggtatctaaaggatggtcagactcgtgagcacgcattgcttgcttttacccttggtgtcaagcaaatgatttgctgttgcaaca

SEQ ID NO: 14865 - DNA, 495 bp, Gossypium hirsutum
  Clone ID: uC-gsflnu33B057e02b1
tcctttccattatcgtgaccgctgttctcgagctccgatggagtggtgtcagcatcgaggacttatggcgtaacgagcagttttgggtcatcggtggcgtttcagcgcatctctttgccgtcttccaaggtttccttaagatgcttgcaggcattgacaccaactttactgtcactgccaaagcagctgatgatgcagattttggtgagctctacattgtgaaatggactacacttttaatccctccaacaacactcctcatcgtcaacatggttggtgtcgttgccggattctctgatgccctcaacaaagggtacgaagcttggggaccactctttggcaaagtgttcttttccttctgggtcatcctccatctttatccattcctcaaaggtcttatgggacggcaaaacaggacaccaaccattgttgtcctttggtcagtgttgatggcttctgtcttttctcttgtttgggttcggatcaacccgtttg

SEQ ID NO: 14866 - DNA, 496 bp, Gossypium hirsutum
  Clone ID: uC-gsflnu33B057e03b1
tcccacgcgtccggaatgagcctagcaaggatagtttggatacatttagggaaaagaatgccagtgaaacagtattggaagctactaggttgaaagagctggcaagtgagcagctaaaattggcgatggccgagaatacctatgccgaaaaggctagactagaagcgaagaagcagatagagatggctgagcttgagtttgcaagtgctaaaaggataaggcaacaggcccaaggtgaactggagaaggctcaagtgttgaaagatcaagcaactaagaagataagtgctactatcattcaaatcacttgtcaagcttgtaagcaccaattccatacatcaactgctgcggttccagctgatgagacctcacttgctatgagttacatgtcttcagccacaactgaaggagaaggagagtgacggtaagttgagattatacaacgataatgatccattcttagtctccaaagtctctttggtttgatgtacatgtt

SEQ ID NO: 14867 - DNA, 496 bp, Gossypium hirsutum
  Clone ID: uC-gsflnu33B057e06b1
tcccacgcgtccgcttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatccccccagaccagcaacgtctcatctttgccggaaaacaactcgaagacggccgtaccttggccgactacaacatccagaaggagtcaactctccaccttgtccttcgtttgcgcggcgggatgcaaatcttcgttaagacgcttaccggaaagacgatcactctcgaggtcgagagctctgacacgatcgacaacgtgaaagccaaaatccatgacaaggaaggcatcccgccagaccagcaacgtctcatcttcgccggaaagcaactcgaggacgggcggactttagccgattacaatatccagaagga

SEQ ID NO: 14868 - DNA, 453 bp, Gossypium hirsutum
  Clone ID: uC-gsflnu33B057e08b1
tgctcccggtaattgtgatggattagcttttgtgcttattcctaatggtttccacacaagatttcagggccaagggtcttttggtctttctggtgaaaatatattccttggtattgaatttgatacaaagaaagatgatgataaagctggaaactttaatgcaaatcatgtaagcattgatattcatggtgttgaatctgttaaacttagcaatttgtcatctctgaatttagtgttgaacagtgcgaatgtcttgaaatcttgggttgattatgattcgagttccaaacttttacaagttagattaagcaaattagatgaaaataggcctttgaatccaattctagcataccatattgatttggtagaaagtggggatatatggatggcttttcttggtataatatcaacacctagtgatgaattttaacatatagcagcaatggtttatgt

SEQ ID NO: 14869 - DNA, 493 bp, Gossypium hirsutum
  Clone ID: uC-gsflnu33B057e09b1
ttcttgctctctgtagccgccgcctgcgtgggtgtcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagacaaacattgagggagcaaccaagtttttgctttcaaaattgaaggaccttcaatttttcgtaggagagagcat

SEQ ID NO: 14870 - DNA, 478 bp, Gossypium hirsutum
  Clone ID: uC-gsflnu33B057e10b1
tctcccaggaaatgtgagctttgtgaggctggcggacatgaatgaggaggaatggaatcttttcctagagaagttccaggagttgctctacccgggatttgaaaaacgaaaatcggttactttaggtcagaagcagatacagaggctcggtacttcgtgccagttttgatatcgagatatctgtatatcgataccagatagtcgaaatgagttttaggattgtttgcacttggttctgaaggactgttaggagagatttgagtaatatgggtttggccccgggaattgttgtagtttgggagcagcattacgaggaatagatgtaaatattctttggcttcatttcagctaagtagaattggttttatttcttcttttaaggtctttgattttgttttttgctttttggttcctttttctttcacttgaatcaccttcttatggaccttgtttgatcaataatatataaaaagggaga

SEQ ID NO: 14871 - DNA, 488 bp, Gossypium hirsutum
  Clone ID: uC-gsflnu33B057e12b1
gcctgccatataatcatataaccaggctccgtcgtggtactcttcggccaccacaatgccgaaaatcgccttgggaacaagccaagaggctgctcagcctgactgcatcaaagcccttgtggtcgagtttatcaccactttcctcttcgtattcgttggagtaggagctgccatggccgccgatgagtcgggggcaaatgcgctggtgggattgtttgctgtggcggtggctcatgcccttgtcgtcggcgttatgatatcggccggacacatatcaggcggccatcttaacccagccgtcacgcttgggttgctattcggtggtcacatcacggtggtccgtgcgatcctctactggatcgatcagttgttggcatcttcagctgcttgtatacttctcaagtatctcaccggaggattgaacactccggttcacacattagcaagtggaatggggttccttaaggtgttatatgggagattattct

SEQ ID NO: 14872 - DNA, 464 bp, Gossypium hirsutum
  Clone ID: uC-gsflnu33B057f01b1
tcccacgcgtccgctgttgtggtttcgattgtgatttttagaaatccagtttccgttactgggatgctcggttataccctcacggtcttcggggttatactctacagtgaagccaagaaacgaagcaaatgagacatcatcctgggattacggtattggttgtgattgtgatatattttagtgcaaggatatcaacaatgttcaaagaggcaaagtttcggtagcatacaatgctgcggatttgtatgctgcggattttgcgccatagattcctataattttcccatggaaacctgggaagctgctttttcttttgtatcggcaacagctgcgggattttagtcaaaaattagaggaaataccattttatgttcattctttcaggagaaaaaaaggttgtagacatggtctttatacattggttagatttcccatatttcattaattaatggaaaagaaaactc

SEQ ID NO: 14873 - DNA, 499 bp, Gossypium hirsutum
  Clone ID: uC-gsflnu33B057f03b1
tcccacgcgtccgcccacgcgtccgaattgaaagaaaagaaaaatggttctgctagagaaactttgggatgatgtagtggccggtcctcaaccggaacgtggccttggccggctgaggaagatcaccaccaccccacccttgtccaccaaagatgaggcttcatcaatggcgatgccgacgagtccgacgacacctgggacaccatcgacgccggtgtcggctcgtagggacaacgtgtggaggagcgtgttcaatccaggtagcaaccttgcaaccaaaggtattggcgctgaagttttcgacaagcctcaacctaactctcctactgtttatgactggctttacagcggggagacccggagcaggcatcaccgttgataaggcggtggctgacggcggtggatggtagcaaaaccactagcagaaggttgcagctacctgaggagcaggatttgcatgtaaatatatatatcgtccttttaaaagttttcaatgggt

SEQ ID NO: 14874 - DNA, 491 bp, Gossypium hirsutum
  Clone ID: uC-gsflnu33B057f05b1
cttctcctcagccataacctgtgttttctccctccaagagaccagcccgcctcaaggtatggtgaccgacgctcgcaggcttcgaaacagggtttctttcagccaccgaattccctttgaaccccgatttcgacgaagtaaaagggaatccgcagcctaaactcaaggtaagatctctttttcttttctttttttgaatgtaaaatgacaaaaaaagaagaaggaagaaatagcaaatagaaccgaagaacaaagatcaccttctcaagaagtagctttctgattttcaagcaatgtgtattgcgtatgtattgcgtgtattcgcttatattgccttcgtgaccattacaaagattaaatcgttggctttatagccgaaaagaaatcataagataaaaaatacaaacaaattcctattggctgccgttctcgctgctgttatttgtttcctttcgcggtacaggtgcgtggcgtgtgtaccaggctgtact

SEQ ID NO: 14875 - DNA, 391 bp, Gossypium hirsutum
  Clone ID: uC-gsflnu33B057f06b1
tttcttctcgtccgtgaccaaatggctttggaaggagacttgttagggatgtgcggacatttatactgtatttggcatcattgcacgccttgccatcattgatcctgcttccggtgaccaacctctctttaatgaacacaagtctattgttgtcactgccaatggttagatttacaaccatgaagaactaaggaagaagatggcccaccacatgtttaggactggcagagactgttatgttgttgcccatttgtctgaggagtatggggaaaactctggggacactcagcatggaatctcttcattagagctgcttgatacccgtggcagcagattcgtagaggcacgcgatgctattggtgtcacctacctgtatattggctggggacat

SEQ ID NO: 14876 - DNA, 481 bp, Gossypium hirsutum
  Clone ID: uC-gsflnu33B057f07b1
tgttcaatgttattcctgattctatcccagactgggtatttgactttatgccaacacgaggtggctactttattggcaatgttagtcctgcaaggatggatttccgatggttttgtttaggtaactgtatagcaatactatcttctcttgcaactccagagcaatcaatggctattatggaccttattgaagcccggtgggatgaacttgttggagaaatgcctctaaaaatagcttatcctgcaatagaaagtcatgaatggcgaattgtcactggctgtgaccctaagaatacaagatggagttatcacaacggaggatcatggccagtgctgttgtggctgctaacggctgcttgcatcaaaacgggaaggccgctgattgcaagacgtgcgattgatcttgccgagacacgtttgttcaaagatagctggccggagtattatgacgggaagctcgggagatatattggtaaacaggc

SEQ ID NO: 14877 - DNA, 495 bp, Gossypium hirsutum
  Clone ID: uC-gsflnu33B057f09b1
tctgagaacttttatgtgttcgctgcaggacttttctacgttttacttgtattgttttgttctcaggttgattaatagaactcctcgtttttcttccctatttcatctgggttatacttggttgtaactctgttttcgtgttatcttgtttaggttagagcattatgcgacaaggcataaaatatgtatctcaaagactaaatacatttgcatgtgttaggtatagaaaaaggtgtttccattttggtgttaagattttatgcagtgtagttgcttactgtcttacactatgttgtccttttaggcaaaatggttgaacacgcaattgagcaaattatggccttttgttgcagaggtgcatactttggctttctgttccggtgtttaggattctctggcggttgaatcgaaagcatcaaaggacttcttttaagtatatgcaggcattgcaatactttggcttcacataagcttgaaccaccctttgtttatatt

SEQ ID NO: 14878 - DNA, 490 bp, Gossypium hirsutum
  Clone ID: uC-gsflnu33B057f10b1
atcgttcaaattgaagctactggcaatctagagatcaactccaccgaggcgagtcgcgagccccattcctgcttcgaacatttgagaccatttatggtgttttagggtgtgatcacagtgagaaagaccgatggtaggtggccatggagggagcacaactcacaaaggtgtaaattggcaccacccagagagatggaacgtagacaccggcaagggcttgagcgctgtcatggggtttgggtcctgtacagggctaagcaggatggtcccgtagtgttgggttggcgacacccttgggagggccatgatgaccattctcatggccatggagacaagcattagctgcagcctgaagaagcttatctgcttatgggtgcgtggcacagatgctgttctggaatgtcttctgtttattttcttcggtgtcaataaagtgatggtgaaatgggattgtaagcataatgaaatgaaaacttgaactttatttatg

SEQ ID NO: 14879 - DNA, 263 bp, Gossypium hirsutum
  Clone ID: uC-gsflnu33B057f11b1
tgattattcccctgagaggtggagcgactcccaagttctcgcagaggacaaatttgagtacagagaattaccaagttgtgtgaatgttaatatcaatattccaagtgtactaataataggttgagacactttttggtgaactttgagagcaagttcaagtattcaaacaacggctattgtttttctgaaagttcatagatcattgatgttgtacttcaattttaggttcggtttgatttatgaatatatttttattgtcattt

SEQ ID NO: 14880 - DNA, 493 bp, Gossypium hirsutum
  Clone ID: uC-gsflnu33B057f12b1
tggaaaaaacagagacaaaaagggtcaaaggcatgccgacccttacaaagctttataccatgcaagaagcctctcagcacaataccaaagatgattgttggatcgttatagacggcaaggtatatgatgttacttcttatttggatgagcatccaggaggtgatgatgtagtcctcgagtcgacagggaaagatgcaaccgatgattttgaagatgctggacacagcaaaagtgcaaaggagctcctgcaaagcttttgcattggtgaacttgacacatcctcccctatcatcccagaacttgaaatttcctctaagagggaagccgttaagtactctgagaagctcatggacttgacaaagcaatattggaccatccccgtggcaattgttggcatctctgtgttggttggtttcttatacctgcataagaagtaaaccagtataatgttttcccctattggctgctgaatggaaattgttaccccaatttt

SEQ ID NO: 14881 - DNA, 488 bp, Gossypium hirsutum
  Clone ID: uC-gsflnu33B057g04b1
taaaagctttgcggtgagagaaagggaggaagagggcggaagagcagcggtggccggctgtggcaaaattaaatggccacccctctttcctcccatttccctctttctttcttcccttctcaatcaccttccttgggaaagccttttctcttttcttcctctatttctttccccgctcttcgttttctctcttacaccaacctcacgaagctccctagaacctctctcctcgctttctcttctaacaattccggttcttctcctttcaacgatgcttccggttcgaattcttctccttctaagaaatcggttctcaccaatctgatacaggagatcgaaccattggatattagccttatccaaaaagatgtccccccttcaactgtggatgcaatgaaaaccactatttcggacatgttgggtttacttccatctgataggtttcaagtctctatcgaggcattgcgtgaaccttttccaaagttatt

SEQ ID NO: 14882 - DNA, 478 bp, Gossypium hirsutum
  Clone ID: uC-gsflnu33B057g05b1
taccggtacaagatgaggttcgtctacgctcactttccgatcaacgcctcaatcactggcggcaacaagtccatcgagatccgtaacttccttggcgagaagaaggtgcgtaaggtggatatgttggaaggggtttccattactcgatccgagaaggttaaggatgagatcgttttggatggtaatgatattgaactcgtgtctcgctcagcagctttgataaaccagaaatgtcatgtgaagaacaaggatattagaaagtttcttgacggtatctatgttagcgaaaagggcaggatcgccgaagaggaatgattgttatctcaagtcatagttatgggtgccatgttatttttctgtcatagtaatttctttggtaccatggttttttgttgttttacctctttatttggattacagctgctgagtagaaggatgcttatctttatttggttgtactagaaaattttgacttgct

SEQ ID NO: 14883 - DNA, 501 bp, Gossypium hirsutum
  Clone ID: uC-gsflnu33B057g09b1
tcccacgcgtccgggaacctgcatccacaggtactggtaatttatcattgtccgatctactccaacaatctacagaaaagaaagtggaggtggctgaacgtgtgattgaagagagggaacttacagtaagcaaggaagcagcaccggtggaagctgcaggaactattcaagccaaagatttaaaaactgatgaagtacctgaaggagaggaacagaataagaccgactctggctcggatgctccagtgatggtggaagcaccgagagaagctgaaactaaaccacccaagaaatctcaaaacatactatcaggtgttgggtccaaagtcaagaactcaatttccaaggtgaagaaagcaattactggtaaatcttctcatccaaaagaaccaaaagcaatatcaccaaagtgaagcgagaaatgaaaatcatcctcaattcttagtacataatcacatattttatgatttgttttatagggtttgttttctgtcaaatatt

SEQ ID NO: 14884 - DNA, 490 bp, Gossypium hirsutum
  Clone ID: uC-gsflnu33B057g11b1
ggcaatcttatatggccattgttgttagacaatgttcggcctgatatgaggattgcatgggaggaacctttcggcccggttttgccagttataagaatcaactccattgaggaaggaatccaccattgcaatgctagcaacttcggtctccagggatgtgtgttctctaaggatgtcaacaaagcaatattgattagtgatgcaatggagaccgggacagttcagattaattccgcaccagctcgaggaccggatcatttcccatttcagggtttgaaagatagtggaattggatcacagggagttaccaacagcattaacatgatgacaaagatcaagagcactgtcatcaatttaccaaccccatcttacactatgggttagtattgccaatcagggaatacaaacatacatacatacataaatataaattagttaaaatcttagctaagatggtaaatatgtatgtttgagaatagttgcatatgat

SEQ ID NO: 14885 - DNA, 489 bp, Gossypium hirsutum
  Clone ID: uC-gsflnu33B057g12b1
tgggaactcataactcctcaaaagtcttcttcaatggcagctcgagttcttgttttggcttcaattcttattttctcttgttttgcagagacatgctatggggtgatctctttctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatcgtcaagaaaccctacaccaacgtcaacgaaacccttgaatggaccatcgaacgagacgtgccgacggcgacgttctttatccgagcctacgctttggactccgacgaccacgaggtggcgtacggtcaaaacaccgac

SEQ ID NO: 14886 - DNA, 422 bp, Gossypium hirsutum
  Clone ID: uC-gsflnu33B057h02b1
ttgctcaagtcatcctgaacatgaaattgccaagcagcaaatgactggctttggtggtgtggtcagttttgaggtggatggagatttgatgaccaccatcaagtttgttgatgcattaaagataccatacattgctacatcatttggtggctgtgagagcatggtggatcagcctgctataatgtcctattgggatcttagccaagctgagaggcgcaagtatgggattgaggataacttggttcgtttcagcttcggagtggaagacttcgaagatttgaaggctgatgtactgcaggcactggagaccatataatggcgctaatccccgtcgtttggttttaggtttaaatgaccaacctagttattttggtgtttcaattggtatttgagctgttttaagtctgtgtcgtgttttgttt

SEQ ID NO: 14887 - DNA, 491 bp, Gossypium hirsutum
  Clone ID: uC-gsflnu33B057h04b1
tgatgaatcttcctgggaatttcaagaaggggcgtcttgtccatttgaagaagcttgtggctgctgggaagttggtcaaagttaaggcttcgtataaacttccatcggctagatcttcgaagacggctactgctgcttctgctcctgcaaaaaagaaaacggctactactaagtcgaagtctaagcctgcctcaaagcctaaggaagggaagagtacaaaagctactcctaaagcgaaggccaagacaaaaactacttcgaaggccaagagtaagccggcggctaagccaaaggctacttctaaggcgaaggctgctccagccaagactaaggcagtggcttctgtgaagccgaagactactgcagctacaaagccaaaagctgcagccaagcctaaggacaagccggttaaggcttcgaggacttcaactaggacgtcctccggaaagagggctgctgctcccaagcctgctgcgaagaaggctcctgcg

SEQ ID NO: 14888 - DNA, 423 bp, Gossypium hirsutum
  Clone ID: uC-gsflnu33B057h05b1
ttccacgcgtccgcccacgcgtccggtgagcgtgatgatttgctgagcaagccctcacttaatggcatccctcttctggtactaggcaacaagattgacaagcctgaatctctttcaaaacaggcattgactgaagaaatggggctgaagtcgattactgacagagaagtttgctgctacatgatatcatgcaggaactcaaccaacattgattctgttattgattggcttgtaaagcattctaaatctaagagcggaaaaaaacaactctttcttttttattcaaataaaaaaaaaaatcatctttgctgaatctgtgttttataattcgagtttcccatctgtaatcttgtggatgtttgggtttttatcatttatgtcaacgctttctgttttgatgatttaatggtaagatgtatacag

SEQ ID NO: 14889 - DNA, 495 bp, Gossypium hirsutum
  Clone ID: uC-gsflnu33B057h06b1
tgttttttgcaagtcatgcaaatacgctggagctgacaccctgttgggagcgacgcctattttgggtgccactgtaaagctgacatgcaagaacaccaaatacaagcaagaggccactgcgaaaactgacaagaatggctatttcttcctgcaagcaccaaagaccgtcaccagctttggagcccacaaatgcacagtgtctctagtatcatcgccaatggctaaatgcagcaaaccatctaatctccatggtggattgaagggggctaccttgaggcccgagaagccatttactgcgaacaagcttccgtttattctctacaccgttgggccatttgctttcgaacccaaatgctactagaaacttagattccactcttttcctttgttgctcttaatgtgttaccagtgcttacaagttccccagcttattgtaatcgcattttgttcagtgtattgctttgtgtgaaaatagattacagacgaataatcaat

SEQ ID NO: 14890 - DNA, 183 bp, Gossypium hirsutum
  Clone ID: uC-gsflnu33B057h08b1
gtcaccagattagggttacagatgatggcggtacaaatcaaaacatttaacatctaaacagaaactaatatgtaatttaaaatttaacaataaaaaacttaatttaatcatagcataatactcttataagccttaaaccgagtttaagaggccctaaaagtaacttgggaacactgagggacc

SEQ ID NO: 14891 - DNA, 487 bp, Gossypium hirsutum
  Clone ID: uC-gsflnu33B057h09b1
ttcacacttgaagccgatgttgttctggggggtgctggtagatctccattcactgccggacttggcttggacaagataggagtggaaactgataagataggacggattttagtcaatgacagattcgctacaaatgtggccggtgtttatgccattggagatgtaattccagggcctatgctagcccacaaagcagaagaagatggtgttgcttgtgtcgagtttatagctggtaagcatggtcatgttgattatgacaaggtccctggagttgtctacactcatcctgaggttgcatctgtcgggaagaccgaggagcaggttaaggcacttggtgttgattaccgtgttgggaagttccctttcttggcaaatagccgagccaaggctattgatgatgctgaaggaataggtaagatattggctgacaaggagacagacaaaatctttgaggtcatattatggcccaaaatgctggagaggttat

SEQ ID NO: 14892 - DNA, 462 bp, Gossypium hirsutum
  Clone ID: uC-gsflnu33B057h10b1
tcccacgcgtccgaaagaaatgaaagggggaagtgggagcgaagggacgatggtcatggcacttcggtcatggccgattacggcgttcatcggcgctcaacgcctccgccgttgcaccaatccgaagccactcgaactactggtacggggcgtgtgctggcactgggcatgagggtggcgtacggggttgtcgacgtggctgttggaggcgtgggggctgagttcggctgcggcgtgagagaaagaaccctagggttccgaagttgtaatgttctgggcttggtttctgtgccgtttgagtcttagagctttgggttgttttgtaactgggcttgggtattagttatagggtcatgtaattgggcttaggctatgatttggcttgtaaaaggacattaaaatgggctgtttgtgttttaaattttttgtttattgatttattttatattttgtttcgggggt

SEQ ID NO: 14893 - DNA, 424 bp, Gossypium hirsutum
  Clone ID: uC-gsflnu33B057h12b1
tcccacgcgtccgaaatttacaaataaattgtatcttatcccttaataaaataattggaaaattttcatataattcttttaaaatttacctatttattatttataataaaaaataaataaataaataaataactacaaacatgtatatcattggagaacctagctagaacttaagaatattgcattgataaggttaaaagggaaggaaatgatttaagatatgatcattataattataataattattgattgttattattagctatttctaaaaagctgtgattgccttgtgttttgtgaatgtctggttgaataatcttggtcttaaaagacactgcaaccatttgtcttgttgtctgtatattatttgcctgtaatttggtaatagttataataatattaatctcaatttttatttcaaaaa

SEQ ID NO: 14894 - DNA, 260 bp, Gossypium hirsutum
  Clone ID: uC-gsflnu33B058a06b1
gctagatgtagcttggggaaaacggtctcgcgtagtattggatgttggatgtggggttgccagctttggaggttttctttttgacagaagtgactgttgccatgtgctttgcaccaaaagatgaacatgaagctcatgttcaatttgcacttgaaaggggaattcctgctgtgtctgctgtgaagggtgctcagagacttacataccctgggagagagtatggtattgtacattgtgcacgatgtagagtaacatgggac

SEQ ID NO: 14895 - DNA, 489 bp, Gossypium hirsutum
  Clone ID: uC-gsflnu33B058a08b1
ttgcccacgcgtccgcccacgcgtccgcccacgcgtgcgaattttcatcccacatacatcactcttctcccacccacccaaccactttcctttctatcccaccattttctctttcttttgctttctaaaacatggccaaaacactacttaacaaacctctcattaccttcttcttctttttcttcttcagcttctttattcaaaccaagcaagataacccatgtccgtatccatgtttcccaccaccaacaggcaccggcggcggaggcggcggcggcacagtgacacaaacacctccagctagttactcaccaccctcccaaacaggagcataccctccacctacagggaacttaccatattactatccaccaccaccttatggtggaggtaattctttatatggtcagcccccttctgaccctatcttgccttatttcccatactactatagaaaaccttcacaccaaacagatgatcagtcagcag

SEQ ID NO: 14896 - DNA, 354 bp, Gossypium hirsutum
  Clone ID: uC-gsflnu33B058a09b1
ttggttctcatagctggcattgctgcttatgtaaagagggtttccccagaggtgaaggttattggagtggagccttctgatgcaaatgcaatggcattgacgatgcatcatggtgaaagagtgatgttggacaaggttggaggatttgctgatggagtagatgctaaggaagttggtgaagaaaccatctgtctatgtagagaattggtcgatggcgtaggtcttgtaagacgtgatgctatacgagcctgtataaaggacatgtttgaagagaagagcgagcatactagaaccagcaggtgccttacttctagcatgagctgcagcatattgcacatattatggagtgaacgg

SEQ ID NO: 14897 - DNA, 191 bp, Gossypium hirsutum
  Clone ID: uC-gsflnu33B058a10b1
tcggttgctcagtgcttgggtgcaatctgtgggtgggggttgttgaaagatgtgaaagatacttactacaatagttatggaggaggtgccaaggagctgccagatggtggtaacaagggacgcaccttggacaaggaagacacatgtgcctatggatgttgtttacaaagaattctgagacaaagctctcc

SEQ ID NO: 14898 - DNA, 531 bp, Gossypium hirsutum
  Clone ID: uC-gsflnu33B058a12b1
tcgctttatgagctggcgagcttgcctatggaatggtttaacttactttgtcgaaaaaaaaaatgtctacaggttgcaattgcggatctaactgcagctgcggcgacaactgctcatgcagcaggaaccttaaccttggatattcggagaagacaaccagcactcagaccatcatctccggagttgcgccagagaagatgacctttgagggaccagagatgagcactactgaatcaggacatggatgcaagagtggatcaaactgctcttgtgatccatgcgactgctgaaagcttgatgaaagccatagattatgaaaaaaagatagcagcaaaaataacaggcctatgtaatgatatattgtcaaggatggatgcctgcaaggtctataattatgaatctgactggcgcttgagtaatagaaagctttgtttgtggtgaaaaaaatgaataaacatttggtgggagcaaaatggccttttctccaaagaattttggtggtaattaaggggacctgggttaagggttatc

SEQ ID NO: 14899 - DNA, 526 bp, Gossypium hirsutum
  unsure (1)..(526): unsure at all n locations
  Clone ID: uC-gsflnu33B058b01b1
ctttgacaaaggcaaaaaggtacttggaggatgttattgcccataagcaagcaattccattccgccgcttctgtggaggagttgggcgaaccgcacaggctaagaatcgacattctaatggacaaggccgctggcccgtgaaatctgcaaaattcattctcgatttgctcaagaatgccgagagcaatgctgaggtaaaaggtttggatgtagactcacttatcatatctcacatccaagtgaaccaagcacagaagcaaaggcgccgaacatatcgtgcacacggaaggattaacccctacatgtcttcaccgtgccacattgaactgatcctgtctgagaaagaggaacctgtcaaaaaagagcccgagactcaattggctccaaggaaatcaaagggtgcttcgtcttaaattgctgagtaatggattgtaactcttgaaaattttacattttactttagttgcctctgtaatgagaacattnttgggttccttatgaaatgcttaagactcaaagttagtct

SEQ ID NO: 14900 - DNA, 489 bp, Gossypium hirsutum
  Clone ID: uC-gsflnu33B058b05b1
cctacgcgtccgctgacatgctctgtcaaacacgtacattttctctagaaacagagagatcgtctgttaaaatacttcgcagggaattagcgagatcctgaaattttcctgcgttttctctcttcaatcttctccggctacctgatttatccgtcatcatgacaacatcaaggcgacttgcagaaagaaaggtggagaagttccaaaagaacataacaaagagaggagctgtgcctgagacaaccacaaagaaggggaaggattatcctgtcggtcctgtgcttcttgggttcttcatattcgtcgacattggatcatctttcttccagattatcaggacagcgaccagcgtgggtatggcataagtctgcacttctgatgttaaggaattgcgaggagactggtcatgcattgggctttgcttttctgttcgatttgtagggaaaaacttgagatatatttactagagagatatgcttacgatgtgaa

SEQ ID NO: 14901 - DNA, 247 bp, Gossypium hirsutum
  Clone ID: uC-gsflnu33B058b06b1
atgtaagatgaagaagaaagcaaggaaggaagaagatgggtcttccatgcactatggctctttggtttcagcttctacttttgatgtgtggcagtgggatacatggtgtgaagaatttgagggaaaaacacggggatgctcaacttgttagaaaggtggaggataaatattctcttgcttctaatatagcacattctgcagctgaggagtcatcttctcaagttgctaagcaactgggggatatata

SEQ ID NO: 14902 - DNA, 194 bp, Gossypium hirsutum
  Clone ID: uC-gsflnu33B058b07b1
ttctcacgcgtccgcccacgcgtccgtttcttttcttttctttcttttttactgtttggcttatacataaataatacctgaaactaagtgataaacatcgacttattttgtgatgttacttaatataagtttgagattttgttgtattagaacttgttttcaagctatgaatctaaaactacaattattggtct

SEQ ID NO: 14903 - DNA, 198 bp, Gossypium hirsutum
  Clone ID: uC-gsflnu33B058b09b1
gtatactttttattatttttttcatgttatgcaatttactgatttcaatatattttcaagcatgtaagtcagtttaaagaccacggttgtatagttttcttttttcgcttaaaatcaatgtgatgttcataatgtaggtatcatgatttgagaatcattttataggaatgaattggcactgatgcagttcaacattgt

SEQ ID NO: 14904 - DNA, 317 bp, Gossypium hirsutum
  Clone ID: uC-gsflnu33B058b10b1
tcgcataaacatcggaatgaaggcgttggaatgacagagcagcctcccgaatttggtaaggtctgactctattgtgcctcacggcgttttaattccctaaaattttggtggtacctgtcaagagaggtattgatagatccaagaatgaatagactgaatgagctatggatgaatataagttgtgtagcttcaaagataaattatagatataggatgctatcgttgttaatattttacctacttacttggccacgttttcaatgatgatatggtgcatttctcaaaaaaaaaaaaaaaaaacaaaaaaataccatcat

SEQ ID NO: 14905 - DNA, 369 bp, Gossypium hirsutum
  Clone ID: uC-gsflnu33B058b11b1
tcgattaatctaaggaagttttgtgaggctaaggataatagcttgaatgctaaagatgaagaaataaagatgctgatgaaaaaggttgaagcattctcaagagccatggaaatggagtctaaacgagtgaagaaggaaacacaacttgttaaagaaaagaagaatggatcacccaaaatggaggataccaaaaaggtgaaaaacaataactgtagaaggtcttgaagattggcaatggaattcatttgattggttggatatgattgagagtgtaaatagtgacttataatgttgttttttggatgataattagcttacttaaaataaagttggttgcgaatgatgaaaattgcgtttgtgatgctaatt

SEQ ID NO: 14906 - DNA, 275 bp, Gossypium hirsutum
  Clone ID: uC-gsflnu33B058b12b1
ttgattaagcatgatgggaatcaatgacaagtgtggggatggttaaataattaaccatggatccaccatacaatagtgatgtatgattaacaactacatgggttgacttgattgaatatgttattacggactataacaacacagacacgcttatactagctcacggaaatgaaatggacatatcctgacactaattactacaagtggtatttgttaaagtaaacatattaacatcacataacattcataggcatgtccatcataacaccaacatt

SEQ ID NO: 14907 - DNA, 472 bp, Gossypium hirsutum
  Clone ID: uC-gsflnu33B058c01b1
cctacgcgtccgcccacgcgtccgcggacgcgtgggcttttgtcacatttttgaagagcaaagatgctaatgatggatctgagcaggctttgcttaatgaactcaaggcattggatgaacatcttaaggcacatggcccattcattgctggggaaaagataagtgcagttgatttagctttgggacccaaactttaccatcttgaggttgctctgggccatttcaagaaatggactgttccggaaagcttgactaatgtccgcaattacatgaagtcgatattcactcgtgaatcgttcgtgaaaacgcgggctgctaaggaatacgtgatcgccgggtgggcacctaaggtgaatgcatgaacaaactggaaacaatgaggtgtttgaagcgtatgagttatgtaataaaatgtgagggatggtgatgtaataaaatgtttgaatgtatgagtgtcaatgctactaagttg

SEQ ID NO: 14908 - DNA, 452 bp, Gossypium hirsutum
  Clone ID: uC-gsflnu33B058c05b1
cccacgcgtccgcttctttctagctatatccttatcagctttcaaagatggcaggaatcgcctttggtcgctttgatgattccttcagtttggggactgtcaaggcctaccttgctgagtttatctcaactttggtgtttgttttcgccggcgttggctctgccattgcttacaacaagttgacaactgatgcagccctagatcccgatgggctagtcgccattgctgtttgccatggatttgctctctttgttgcagtggctatcggtgccaacatctcaggtggccatgtcaaccctgcagtcacttttgggttagctcttggtggccaaattaccatactaactggcattttttactggattgcccaactttttggatccattgttgcttgctttttgctcaaggctgtcactggtggcttgacagtttctaatcacggtcttggagct

SEQ ID NO: 14909 - DNA, 269 bp, Gossypium hirsutum
  Clone ID: uC-gsflnu33B058c07b1
taaaaagcacaagaaagttatattgtgaagataaaactcaaagagttgaaaaactttattcaatgaatgtgtttaatgaataatgaagatacctttatataggctagctaattaatcaaaataaagctcttaactataatgaaactttaattaatctaaacaagaagtagttctaatgaactaaactttcttattgactaagaaacataaaactcctaaacaacttcaaatacttgaaaatttcctaaaatttggaataaataagttat

SEQ ID NO: 14910 - DNA, 196 bp, Gossypium hirsutum
  Clone ID: uC-gsflnu33B058c08b1
tttgttattgttggcaaatttagtgcttgctcggcaaaatagaagggtacttggaaacatttggattctatgcgtttttttttggctgtttgtactgttcttaaaaaacacttgaaattcatcatcgtttatatcactccgctattgtttgtactgtagaaagaaaacttttttaagttcatggaaattttgggtc

SEQ ID NO: 14911 - DNA, 489 bp, Gossypium hirsutum
  unsure (1)..(489): unsure at all n locations
  Clone ID: uC-gsflnu33B058c10b1
tcggtatcaattgacataagcacatcttactttgttgcttggaccatccggatagtggctgctatcatgatgcttcagagttctatggatcccatccttgcagtagaggcatttttatctggaataatgctctcatcagttttgtgtaaagtcactcgattgagattcctgcgccgtgtgtacaagaagctgttcaagttagccaaagtcattggaagaaacactcaaattcctgatttatcactagatctatattctcatgacgaatatacgtacaggaagcctgaagactctaatttccttaatcgacggtctaagcatttaccccttgcttcttgcaatacttctcttctaggaactaccaagacatctncgagtcagctgtcagatacagactctttcccatccacctttcacaacacaccagagaggagaaatttttctaaaggtgagtgggagaagttcaccagagactccacaaaaagggct

SEQ ID NO: 14912 - DNA, 446 bp, Gossypium hirsutum
  Clone ID: uC-gsflnu33B058c12b1
tcgatttgaagccttcttcgaatttcctcattcaagatgcaaattttcgtcaagaccctcaccggaaagaccatcacattggaggtggagagttctgatactattgacaatgtaaaggccaagattcaggacaaggaaggcatccccccagaccagcaaaggttgatcttcgctggtaagcaacttgaggatggccgcacgttggctgattacaacatccagaaggagtccacactccacttagtgcttcgcctccgtggaggaatgcaaatttttgttaagactttgactgggaagaccattacattggaggtagagagttcagataccattgataatgttaaggcaaaaattcaggacaaggagggaattcccccagaccaacagaggctgatttttgctggtaagcaactggaggatggccgtaccctggctgactataacat

SEQ ID NO: 14913 - DNA, 476 bp, Gossypium hirsutum
  Clone ID: uC-gsflnu33B058d01b1
attgggtcagaaaagattgggcgcttgcagttggaggtgcagaaaattcaatttctcttattgaagcttgacgatgaaaaagaaagtagaggtcgaaccaaaatcaccgaacacaaaacaactgttttattgcgagactatctttacggtggtgtaagaaacatcaagaagaggaagaactcactcttttgtgcatgcgtgcgaccccaaactaaatgagatcgaggcaattaatcatgggcacataatcagtgtagtttaccgataatgagactagttgcattgtcaataaagttcaccttcctagttttgcatttcacatatttaatgtcttagagaagctttcatcttctttagtttcgagatcctgctgtatatttcaggcacatcaaagtgaaaagaagctgcacttttatagcctaaaaacttccttttatttataaatttaccttggtataaattcttggattcattag

SEQ ID NO: 14914 - DNA, 120 bp, Gossypium hirsutum
  Clone ID: uC-gsflnu33B058d02b1
ctgtactcgtgggctttttttgaagcaatgtaggagtgggatagcaatgtagggtgttggatttattctctcttaatcaatatatatatatatgattttgatagagtgatagagtgatag

SEQ ID NO: 14915 - DNA, 424 bp, Gossypium hirsutum
  Clone ID: uC-gsflnu33B058d03b1
gtttgatatggcagaagaattgactgaggctttggatgagcttacgcgacttgactgcatcggaaacagaccacgcactctatgtcttatttcctatgagattcggaacttggagaggaccttgaaagagaatgaaaatggggcttgtactgttactgatgcacaaataacaacctccgtttgaacctaagataagggtaccgttaaccctggactgagttatgttacacttgcctccttcagctgggatcaagataacgatgaagtcaagatatatgtctctctggaaggaggtgaacaggaaaaaattcagacagcgttcaagccactgtcattcgatggtagattccatgacgttcaaggcacaaactacagattgtgctgtttcaaaattgaacacggaaattgtaccagagaagtgcaa

SEQ ID NO: 14916 - DNA, 323 bp, Gossypium hirsutum
  Clone ID: uC-gsflnu33B058d06b1
ttatatttttctttttagattttgtggtgttaaaatcgtatttgttcatagttttttgcagcaggcaacatgtcgctcacaattcctagccttctcggtggcccaagaaccgacgtcttcgatccattttcagtatgggatctttcagatgaattcttcaactctgcattggcaaacactatgtcatcatcatcttcagtacgcgaagcttcggccattgccaacgcaagggtagattggaaggaaacaccggaagctcacgtgttcaaagcagaccttccagggctgaagaaagaggaggttaaagtggaggtatgaagaag

SEQ ID NO: 14917 - DNA, 219 bp, Gossypium hirsutum
  Clone ID: uC-gsflnu33B058d08b1
tcgcctcacgcgtccgcccacgcgtccggggagattaacgttgagccaaacagtgatgtttggaaacataagttaaggccaagactttccgatatcatatacgaaacggaagcggtgcatgtttcagaataactttagttcaaagccgagaaccgccggtcggaaaagattgatctcggtggctgtaatatatatttacttaataatggtttttgtctt

SEQ ID NO: 14918 - DNA, 477 bp, Gossypium hirsutum
  unsure (1)..(477): unsure at all n locations
  Clone ID: uC-gsflnu33B058d10b1
tcgtccacgcgtccgcccacgcgtccgcccacgcgtccgctcaattccattaggggactcctcattccagaatcctctgtatggttgcatgcaagactcttcagagctgcagaacagagggcaagttgacccaccgaccccaactccaacatttgtcaaggtttataaatcagggtcagtgggacgctcgttagacatctccaggttcagcagttaccatgaactgcgagaggagctggctcagatgtttggaattgaggggaagtnggaagaccctttaagatcaggctggcagcttgtatttgtcgacagggagaatgatattcttctacttggagacgacccatgggaggcatttgtgaataatgtttggtacataaagatactttcacctgaggatgtgccgaaaatgggcgagcaacgggcagagccttttagccccacaacctcaggttaaaggattgatagcaccggcac

SEQ ID NO: 14919 - DNA, 459 bp, Gossypium hirsutum
  Clone ID: uC-gsflnu33B058d11b1
tcgaaatccccaaaacgggaaaaaaagaataaagaagacatgaggacacagaagaggccgatgcatgcggtgtcgatgtgggtaagacgacagccgccgaaggtgaaggcttttttggcggtggtatcggggatggcggcattggttcttctccgagtcattgtacatgaccacgataacctcttcgttgccgccgaggctgtccattctatcggaatctctgtcctcatctataagctcaccaaggagaagacttgtgctggactatcactcaaatcccaagaactaacagctatctttttagctgttaggctgtactgtagctttgttatggaatatgacatacacaccttacttgatttagccacattggctacaacattgtgggttatttatatgatccgtttcaaactaaagtccagctacatggaagacgaagacaactttgtgatatattat

SEQ ID NO: 14920 - DNA, 490 bp, Gossypium hirsutum
  unsure (1)..(490): unsure at all n locations
  Clone ID: uC-gsflnu33B058d12b1
tcgttcaaagctctctctctctattctctttggcttatctatcgctttgatttcgcatccttgctgtgcactcgatggcaaatcgatggttgaggcctgaggtgtatccgctgtttgcggccgtaggtgttgctgtcggaatctgcgggtttcagttggtgcgcaatatctgcatcaaccctgaagtcagggtaaccaaggagaacagggctgctggggttttggacaactttgctgagggagaaaaatattctgaacatttcttgagaaaatatgtccgcaacaagacgccagaaatcatgcccagtatcaacagcttcttcactgacccaaagtgaggcttcactcttgctttatgctgaaactaaaaaataaaaaaaatagaagaactaagtcttattcaatcaataccaagntatgccctttctttctgctgactgtgatgcaaatttgtgttggttttgcacttggatgaggtgtgttctttaag

SEQ ID NO: 14921 - DNA, 427 bp, Gossypium hirsutum
  Clone ID: uC-gsflnu33B058e01b1
cttactcgtccgcccacgcgttcgcgatatcttcactggcaagaagttggaagatattgttccctcctcccataactgtgatgttccgcatgtcaatcgtactgactaccaattgattgacatttctgaggatggatttgtgagcttgctgactgatagtggtgatactaaggacgatctcaggctcccaactgatgagaacttgttgaaacagatcaaggatgggtttggtgagggaaaagacctggtggtgtctgttatgtcggccatgggggaggagcagatctgtgctcttaaggacattggtccgaaatagttcgaggtttggtgattttaagtatgttattacaaatcttaaatggaattatttttataagtggcttttaatatcttgcctttcaagacttgtggtagggtataaatgttg

SEQ ID NO: 14922 - DNA, 331 bp, Gossypium hirsutum
  Clone ID: uC-gsflnu33B058e02b1
attgattgtttggttagggaggagagactccatgaaggcaagctttgatggtgcaaaccagttcatccctgccccaaattcctttctggagactcttatttccaacttcaacgaacaaggtctcgatatagaagatttggttgctttgtcaggtggccatacacttgggatggcaagatgtgtgagcttcagacaaagggtttatgacatcgaagaaaagcgtgtcaagttcaaaagataccggacatttcgatgaatcctacggtccatatgcccggattcaggaagggatgaagcgattgcaccgctcgatttttcaactcctgcaaag

SEQ ID NO: 14923 - DNA, 488 bp, Gossypium hirsutum
  Clone ID: uC-gsflnu33B058e03b1
ttttatttcaaatattggatcatccacaattgttccagcagatgtcaggctaaagaacaaggctgaatgtataccttgtgagcaagtggaaccatccattagtgatcaagaaaccaacaaaccctccgataagatacagagacgtttggctcaaaatcgtgaagctgctcgtaaaagccgaatgcggaaaaaggcctatgttcaacaactagaatcaagtcgtttgaaactagctcaattggagcaagagcttgaaagagctaggcagcatggtatacacatagccggtgcatcagaggctggttattttggactgtctggaactgtaaactcagggattacttcatttgagatggaatacagacactgggttgaagagcaaaatagactgatttgtgaacttagaactgcagtccaggcacacattactgatatagagctccatatactcgtagaaagtggcttgaaccactattacaatctggtcc

SEQ ID NO: 14924 - DNA, 398 bp, Gossypium hirsutum
  Clone ID: uC-gsflnu33B058e05b1
gttgtttggttgagaaggactttgaacagataggcgagtttcttcaccgagccgtgacaatcacttagaacatgcaaaagcaatatggtaagcttttgaaggactctaacaaagggtgggacaacaacaaggagatccaagagctgaaggttgatgttgagaagttcgcatcctcattcgatatgcctggcttcaagatgtccgaaatgaagtacaaggattagatctaaatcaccatacgatctaattgatgttattatcagcatctgccactttttgggttggcctcatttgacgtcttatgagtgaaaggaaaaagaaagggaaacgagaaggatggcaaaagccttccacgtaccgatttaaagtgcctcatttactggtcaatttgataagat

SEQ ID NO: 14925 - DNA, 554 bp, Gossypium hirsutum
  Clone ID: uC-gsflnu33B058e07b1
ttgcttacgcgtccgcatggttcaagtgaacgacctcaagaattcacctggacctggtaaaaaggaactcagacaagctaccaaccaagcccttaacttgcttcaagataactatcccgaatttgtggccaaacaagtgttcatcaacgttccatggtggtacttggctttcaataggatgatcagtcctttcctgactcagagaaccaagagcaagttcgtatttgcaagtccagccaaatctgctgagaccctcttcaaatatattgctccggagcaagtaccagttcaatatggtggactgagcagagagggtgaacaggaatttagcgtggccgatgccgtcacagaggttacaatcaagccagcagcgaagcatagtgttgaattccctataactgagaattgtaatctggtttgggaactccgagtagtgggatgggaagtcaattatggagccgaattcgtgcccgaccgccaagatgggtatactgtgatcgtattgaaaacaaggaaaggttctttgtgtgatgaaaccgtgatcctcgatgctt

SEQ ID NO: 14926 - DNA, 545 bp, Gossypium hirsutum
  Clone ID: uC-gsflnu33B058e12b1
tcggtttcatgctcgatttgcctcgaaacgggtactgataatggggatcggtcttgggctaagcttcaatgtgggcatcaatttcatttggactgcattggttcagcattcaacgtaaagggtgcgatgcaatgccctaattgcaggaaaattgagaaaggtcaatggctttatgccaatggttgccgttcatatccagaatttaacgtggatgatttgacacatgatgaggacctttatgatctaagttactctgaaatgtcatttggagttcactggtgtccatttggaagcttagcacgacttccttcattcgaggtaggagagttttcatcaacctcatatcatgagttactgggacagcaagccatctttgctgaacattcagcatctgctggtcatccatgtccgtatgtagcttactttggaccaacggttcatccctcatcctcaaattccggtggaagtgtttcagatagttctagtttcaacggtcactggaatgtccatcagtgccttgtgagatgcctacatcttatgctttt

SEQ ID NO: 14927 - DNA, 478 bp, Gossypium hirsutum
  Clone ID: uC-gsflnu33B058f01b1
cttactcgtacgattattgagaaattggttatgtgtattggcttaagataaaagcccttcattttgtattaagcctagataatcgctattatttattttggtaaatgcatatgatgatccttctatgaatgaattgatgtcttttgggatagaattagtatattgaaatgatcttgtgcaggttgtgcaaaatgagtgacaaaatgggctggaagataccctagtttgtccacatgggcaagacacatgggcgtgtgtctaggccgtgtgtgacacacggctcacccccatgggtgtgtgttatggccgagcgtaccctgcacttaaacttttaagtcagtattgtccaccggtaggccacacaggtgtgtgtcatgggtgagccctaaagacagggttgcacataggctaagagcatgggcatgcctcaagtcacaccggcgtgtggaaccctaaagcatgaattttttccagtttt

SEQ ID NO: 14928 - DNA, 454 bp, Gossypium hirsutum
  Clone ID: uC-gsflnu33B058f03b1
atccggctgaacatatatattcattgacagcaagtgggaatatttttctgtttgcttccaattctcaaaaggcagttattgctgttaatttggttagtaaggcagttaaaaagatccctccatgtccattaggtccacgtggtacctcttcctggaggagatccgagatgaagctagtacccgaatcatcggattccggccatttccggtttttgttcgtggaactagtggggaacagtccggttgtgttcgaatacaatttatagaccgaaaaatggcagtgcagagaagcaagagaggggaaggggaacttcgtagggaatgattgtatgattatcaatgcacataatgcacctcaggagagtttggtggttgcgattggatctgaatacatcccaccaaagatcctaccaccaaaattcggaaacagagagcagcaggcaagctgggtgaa

SEQ ID NO: 14929 - DNA, 393 bp, Gossypium hirsutum
  Clone ID: uC-gsflnu33B058f04b1
ccgccactgctaaagatttgtcggctaaggagtgcttgccatgcaacacgaatgatctacgggccatgactgaagaaactgcaagtaaactaattccaaaggtggatggatggaatatggcaaatgaagggggtacattgaagctaaaaaggtcttggaaagttaagagtttcaccaaaggactggagatgtttcagcttatatctgatatctgttgagcagaaggccattatacagatctgcatctggtcggatggaacaatgtaacagttgaaatatggacgcatgctgttggtggacttacggaaaatgacttcatacttgctgccaagatcaacaccacttgaacttggaccattttcttaggaagaaagctagtgcttgacggggatt

SEQ ID NO: 14930 - DNA, 420 bp, Gossypium hirsutum
  Clone ID: uC-gsflnu33B058f05b1
gtggagacggtggaaaccatggagttggtggtagcggaggtggtggcagaggaggaggtggcgggtccaattccagcgatgatccatggaagcgttttggcattctgggtcttttcctaagtggatggagagacagggttgcagcatatccgcagtttccattcaaagttttaatggaagagttggtgggagtcactgcttgtgttcttggagacatggcttcacgtcctaattttgggcttaacgagctcgacttcgctttttcaactcttgttgtcggtttcattatgaatctcactgttatgcatctttttgcaccaacagcttactgagcttcttcaagtctcccttttatatttgcaaactgttcctcaagttattatgtttgaaccgggagcttttacccttaataaccgtttt

SEQ ID NO: 14931 - DNA, 402 bp, Gossypium hirsutum
  Clone ID: uC-gsflnu33B058f07b1
tcgaataaaagtaaaggagaaaatgaagggtgtgtaggtacttatattggcaacggtaactgttatggaaaccgctacaactgatgctcaaagcatttgcagcatgccagcttcaggctggctggcatgcaaaccactagtgacggcttcaaaccctccgccgcacacgtcaactagatgatccgccctgtcccacgctgacatgcgttgcctttgctcatataagaactccaagctgatgccttgcctagggattgacccaaaccttgccatgaaattgcctagcttgagcaagcttactaatgctgcacatagctagatcctggctgtgcataattgatctcagatgtgagggaaaatcatgcttattataagcctctacttgacattattgtactgagc

SEQ ID NO: 14932 - DNA, 495 bp, Gossypium hirsutum
  Clone ID: uC-gsflnu33B058f09b1
tcgctttacacgcgacatcgtttagcgcgtatcagcaagatcaacaccggatttatgttgtactatacatcacgttgaaaggaccttttcgtaattttaactcaacctccattctcagggtaactaaaaaccatttttttccctctcgttctgaaaaccagagagagaagagaaagagaaaaaaggcaaaaaggcgcaaatccaacaccgttactctttgctttgctaacttacgcttctgctattctacgcacctttctgttcacctttttcccttctttctctctctctctctctaggatttttttttcctttttttctttttttgtcgttctctcactaagacctccgcaatgaggaggagactcgcggctctcttcttcatttgcgatctctttgtgttgttcggtttcgccgtcgccttcgacgcccagaccttgtcggctgtggagttcaatgccaccgctgccttgaccaatgtgtaagacccgagat

SEQ ID NO: 14933 - DNA, 547 bp, Gossypium hirsutum
  Clone ID: uC-gsflnu33B058f12b1
tcgtttcacgcgtccgcccacgcgtccgcccacgcgtgcgagatattcctgagacaacggtccatcctgtgccgccagtgcctagcaagacggtaagattttcgactgtaaatatcgaagagatgggtgcaacgaatgagaaatatcagtcgcctaggattcctgaaatagagatctcaactccacctccaaataatggaatggacaaggaaccaatgcatagcaggaagaaatggaacaacgaggagagccctcctaaagcagccaaagggtttagaaagcttcttttctttggaagaaaaagcaaaaactatgctactgcttagtgtatgcttgtctttccatattgcttatgtttcgggttttcagttttttcgggtggaacgtaccaataaggcctttgatgttgctgccattcaaggattcatgaacttattaagaaaaatggggaaaataagagagagattcataatgtaaattaatctttgtttgatatatcatgctggaaggggttaaacacattcttttttggttgactgataccttt

SEQ ID NO: 14934 - DNA, 464 bp, Gossypium hirsutum
  Clone ID: uC-gsflnu33B058g01b1
tgttcaattgcccctctgaattcgtaaatcatggtaagttcctggttcttaagttacttcggttggattaacatctgcacgttacagctcgatacagggtaaaattttggaacggtttaccttcctatctggatagtctgctcggagaccccttttagcttgcatgagatgacgattcttcttggtttccggccttcttctctggaatcgaactaggcagcagtggattggaaacaagaagtctaaaaatcggcctcaaaaggttcgggaacccaaactgagttggaatgcgacttacgaaagtttactcggaaacaacaaaccattccctcaacctattcctctccctgaaatgatcgattttctggtcgacatctgggaacaggaaggattatatgacttgacaaacagtacagcgaagcacattcggaaaaaaaaaaagaaaacgttagatattaataccc

SEQ ID NO: 14935 - DNA, 445 bp, Gossypium hirsutum
  Clone ID: uC-gsflnu33B058g03b1
cctacgtttccgaagaactttgggtttcttttgtttcttagataaacaaaaaatatggaggagaatatgtgaaaaagtgtatggagaagaagaaagagaatttaatttccatggcgaatttaaggttttccgatgagaatccgtcggcggtggcagcagcagcagcagcagcagcagcgaccagtttcggtggaagcatctttgacatggcaactggagcaggggcatgtgatggagatactaagtgggggtcttctttaggtcatggacttgcttggcatccatcaagatttcattgccccttctttattcgatttctttcagccaccaccgattttttcaccaccacctcccttaacatcatctgaaccactttttcaccaacaactggacaccaagcagcttaaagcccttccatcgccggcctccatcgtgccggaatctt

SEQ ID NO: 14936 - DNA, 388 bp, Gossypium hirsutum
  Clone ID: uC-gsflnu33B058g07b1
tcggttacatgtcaagtgcttgtgttttattcattttggatgagatgaggaagaaatcaagggaagatggacttcagacaacaggagaaggactggagtggggagtgctctttgggttcggacctggcctcactgttgagactgatgtgctccatagtgttgctgcttaaagttaaacaaacatgccttttaagtaattggtcgtgctccacttggcttgcagttttatcttcttcttttttccttttttagattatttaaatcctatgaatttgtgtgtttattgttaaagactagaacactttgatggtgtgggcgggaagcttaacgcctattcaattcatgtaccaacttatattaaatttatggcaataataagttcctttgc

SEQ ID NO: 14937 - DNA, 530 bp, Gossypium hirsutum
  Clone ID: uC-gsflnu33B058g08b1
ttgcttacgcgtccgctgctcactctctttaacttgcgttcatctccattattgtttcagatcgtaaaatcaaaaccaaattttcgtttaatttatacatataaacacccaaaaacaaaaagggcataaaaaaaggagattcaatggggatcttctccttcaatgccatagctttggccttcttattagccattatctctggcgccgtcaatgcttgcccttcttccgaccgagaagcattgctagctttaagttcatcgttaaaggagccttatttaggcatcttcgattcatggaaaggcaccgattgttgttccaactggtacggtattagctgtgaccccaccacttaccgagtcaccgacgtttccctacgcggtgagtccgaagaccccattctttaaaaaaccggtcactcatcttgcggttacatgaccggtaccattaaccccttctttttgacagttcgaccgggtaactactttaataatgctgattggaaggaatcgccggtgagatcccatcatgct

SEQ ID NO: 14938 - DNA, 540 bp, Gossypium hirsutum
  Clone ID: uC-gsflnu33B058g09b1
tcgcctcacgcgtccggagaaggtcaataacagaggcctttgtgccattgctcaggctgagtcccttcgctataagctcctcggaggtctcgccgtccgtagggcctgctatggtgtgcttagatttgtcatggagagtggagccaagggttgcgaggttattgttagtggaaagctaagggcacaacgtgccaaatccatgaagttcaaagacggatacatgatttcttctggtcacccagtgaacgagtacattgactctgctgttcgacatgttcttctgagacagggagtactgggcatcaaggtgaagatcatgcttgactgggatccaaagggtaagcaaggcccaacaactccacttccggatcttgtcaccattcaccctcccaaggatgatgaagttatcaaggtggaagcacccgtgccgaccgagattgaacttccgccagtggcttaaagccgatgatgactgtaatgatagtcatctatttgatatttggagcatgtcaagtgcttaaaatttggagtttttaagtt

SEQ ID NO: 14939 - DNA, 481 bp, Gossypium hirsutum
  Clone ID: uC-gsflnu33B058g12b1
attgcgtatgatcccacggcgaacgtcgtttacacgggttgtcacgatgggtggatcaagcgagtcaggttgagtgactcggtcgtggaaaattttgttaacacccatggtagacctctaggtctcgctcttggtcacaacaaggaaataatcgttgctgatgcatataagggactactgaatataagcaaggatggtgaagtggagctgctaacagatgaagctgatggccataaattcaagcttacagatggtgtagatattgcagataatggaatgatatatttcacagacgcttcttacaaatataacttaaatgaagatatatgggatatcttggaaggcaaacctcatggtcgatttatgagcttcgatccggttacgagaaaaaccgatgtgctagtcagtcatctatactttgctaatggagtcgcagtgtcacctaatcaagatcatgcattcttctgtgaaaccgttatga

SEQ ID NO: 14940 - DNA, 373 bp, Gossypium hirsutum
  Clone ID: uC-gsflnu33B058h02b1
atcttttatcgcgtccggattaaaatggtgggggtggcattttttggaccctacgctgcggcccctcacgaaaatacagggcaaggtgcctgggatcctgaagaagaggaaccctatttggatcccacgtgggcacatttacagatagtatacgagcttctcttgagatatgttgtgtcctcggatacagatactaaagttgcaaagaaatatattgatcattccttcattttgaagttgcttgatttgtttgattcggaggatcccagggaaagggagtttttgaaaacgatttttcataggatttatggtaaattcatggtgcatcgaccatttattagggagggcgataattaaatcttttatagggtta

SEQ ID NO: 14941 - DNA, 446 bp, Gossypium hirsutum
  Clone ID: uC-gsflnu33B058h03b1
tcgtttaagcaaagaaaaagaagatgcaagagaagagcaaatcaaagaaaggaaagggtctgaatcattgaagtcaggctatgatcccgacgtataacaagttccagcttttcaaaaggaactccagcaggtaccaaacaggaaatagtgtttcattaaatccattgaaatgaaaatagggaaatagataattggagctgtgctccattcccttctatcacaggaaaattccattgtgggggcataaaacaggtggaaagaaatgtgatttggttgggaattggggggatgctacaatctttggattactgatttatatattttacttgtgactaacttttggctacatacaggtacctatttttggcactgatattgttagtagccatcgaaaaatctaatacgaatgacttgttattcactaagagtcttggccataataggta

SEQ ID NO: 14942 - DNA, 277 bp, Gossypium hirsutum
  Clone ID: uC-gsflnu33B058h08b1
gttgatgtaaggaccaaggtgaaaacctgcaggagggcactttgagtaaaaaaaaaagatgaaaaaaaattaaaaacaaggaaaggaaccacgaatcctgaagaagaagaaccctattaggaagccccggcggcccatttgcaccaagcctacgagcccttcccgggaaatggagggctctcctatacgggcacctaaattaaaaacaaagatcttggtcattccttcattttgaaggaaaatgcatcgcttgaccccgccgaacccacggaaaggg

SEQ ID NO: 14943 - DNA, 421 bp, Gossypium hirsutum
  Clone ID: uC-gsflnu33B058h09b1
gtttctttatctggatataaaatttgtcatatgctttgcttcccaaggtcggggcctatcaaggaaattgcatagagttgttaacgacataattgctaaagccatggctgcatttgctgccacagggatggatccatatggagtgctgcctgacgatgagtggttcaacgaaatttgtcaagatgcaatcgaaagattaagtggaaaatcgaaagccgaccgggatctgaacagccccactgcctccgtatcagcacaatcaatttcatctgtaagatcacatgggagatactagctgctgtttctttcatttttgggtattttgataggcaacataatttagtaatgaatatggatctttctgactataatttatagggaatcatattttttggatctgctgctgaataagattacatga

SEQ ID NO: 14944 - DNA, 295 bp, Gossypium hirsutum
  Clone ID: uC-gsflnu33B058h10b1
tgttttcgcgtcctgccacacgtacgtacgggttgggttgtgtaaaggcctcgcttgttcaactaataacaactttggaggtgagaggaggcgcacttggactggccatagctatacaacaagttgacaagtgatgcaaccctatatcccgatgggctagtcgacattgctgtttgccacggatatggtatatttgttgcaggggttatcggagccaacatctgaggagggcatgtcacccctggagtaacgtattgggttagcatattgcaagggcagattcactcattacgtc

SEQ ID NO: 14945 - DNA, 457 bp, Gossypium hirsutum
  Clone ID: uC-gsflnu33B058h11b1
ttgggttaagcaattcgccaagatgcagaacgaagagggtcaaaacatggatctttacatccccagaaaatgttcggccactaataggctgatcacctcgaaggatcatgcttctgttcagattaatgttgggcatttggatgagcttggcagatacactggaactttctccacttttgctctttgtggttttgtccgtgcccagggtgatgctgacagtgcacttgacaggctttggcagaagaagaaagctgaagtccgacagcagtagtgggagttggattgctttttactacttgcttggtctctgaattttggagggaaaatgtgttttttttttaaatcagtgacctttaagttctatcttggttttttttaaaatggattatgttgaatttgatctgatgatgtttcgtacctaatttgcttgcattgaacctaatataatatctttttg

SEQ ID NO: 14946 - DNA, 292 bp, Gossypium hirsutum
  Clone ID: uC-gsflnu33B058h12b1
cttggagcaacagacggaggcgcacacgtgtgggggtgcagcacgcgcgaggagagctgtgattttccttctgcagcgactgaagggttctagaaaccctaaggtttctggaacactcttccgaagtgggctaattgggctgagttgggttttgggctttgaatcgggtttaggtattgtattgggtttgggtatttaatttaggcttaatgtaatctgggttttgggttaataacttgtattggactgtattatttggacagtttttattggatttttaattttatttttc

SEQ ID NO: 14947 - DNA, 500 bp, Gossypium hirsutum
  unsure (1)..(500): unsure at all n locations
  Clone ID: uC-gsflnu33B059a02b1
cccactcgtccgcccacgcgtccgcaattgatagttatggcatttattttggattgttttctaacaccctcttggctttaacatataaacccatgcaactatgcataggtctttgctcgatggtatagagctcctgaattactttttggtagcaagcaatatggttctggtgtggatgtttgggcagctgcctgtatatttgcagaacttctcctacgacgaccatttctacaggtgaacctagctgtcttcagtgtttttgatacttgcattttttttggtgagttaattcttggtacagagcactgtatcaatatgtcatctgtttaaagtatccttcttagtatattttctcattttcattggttcaacatttaacattntgtagggcacaagtgacattgatcaattaggaaagatctttgcagcttttgggaccccaacatcttctcaatggccagatatgttataccttccctgatatgagaataccaatatgt

SEQ ID NO: 14948 - DNA, 528 bp, Gossypium hirsutum
  Clone ID: uC-gsflnu33B059a03b1
gagcctcgctattctctcaatctgggccgttgatgctgctcaccaccatgcgacagcgccatccccttcttcttcttcatcctcctcttcctccaccgtggactgctcgactctgatactgaacatggcggattgtttgtcgttcgtgtcaagtgggagcgaggtgtcgaaaccggaaggaagttgctgttctggattgaaaaccgtgttgaaaacgggccctgagtgtttatgtgaggcttttaagagcagtgcttcaatgggtgtttcattgaatgtcactaaggcctctacattgcctgctgcttgtaaagtttctgctccttcttctacaaactgcgctgcatctgtcactcctgctggtgccccagatgtggaaccatcagcaacagcaggtgcacccacaacattctctgcagcaaatgaggtagcaccaacaccagctccgggaatctcaggctctgcggtgctttcggtttcggccggatctattgcgtaggcattataagtatgttgtgtcgggctacg

SEQ ID NO: 14949 - DNA, 332 bp, Gossypium hirsutum
  Clone ID: uC-gsflnu33B059a04b1
ccctcttgtccgccaggctctgatcttcgtgactagatcgcgtagctggtcgtacgctgagcgtcccggactactattggtcactgccttcatcattgcacagcttgttgcaactttgattgctgtatatgcaaactggggatttgcaaggatcaaaggaattggttggggatgggctggtggcatatggctctacagtatagttttctaccgtaccattggatataatgaaggtcgccatccggtacattctaagcggaaaagcttggcttaacctactcgaaaacaagactgcatttcccacaaagaaagattattggcaaagaaaaagg

SEQ ID NO: 14950 - DNA, 371 bp, Gossypium hirsutum
  Clone ID: uC-gsflnu33B059a06b1
cccactttttccgcccacgcgtccgatctactagtgttgaaaatactcatgcgaatgacactacttccgcaactgccgcaaatggcatggaaactgttaactctacaccttgccctacttctgcacaggattcgtagccaaaccgtccgatgactcctttgatgtcgaagaagtcatcacaaccttatgagaggaagcatactgatgaagatgatacttggtctgtcgcttcctctactgctatatatgctcgacgatcaagattgagggtaactgatggatcttcaccaacttttaaaagtgctgaacgtgctgaaaagcggagggagttttaccagaagttagaggaaaaataccgagctttggaggct

SEQ ID NO: 14951 - DNA, 68 bp, Gossypium hirsutum
  Clone ID: uC-gsflnu33B059a07b1
ccttcgcgtccgggaaaattgcgcaagggctttgagttccttcgttgcgaaaccaaaatgggactttg

SEQ ID NO: 14952 - DNA, 495 bp, Gossypium hirsutum
  Clone ID: uC-gsflnu33B059a08b1
gctttcttaaaaacaccttgaaccggaaacagtcgacgacgcagctaaacatgtcggaaagagaagaagattacgattctgatgcacccgaagagttttcaaatcagcagggaataaagcaagatgagaacataagaaaaatccagaaagaaaacaaggccagggttcgtcgtgagggaaaagaacgtcgaaggctttgggctcagaggaaaacaccccgtcaatctacaaaggttgaaaaggtccaagaagatgtagaaactgatgaggaatctcaggctaagaaggggatgcttcctaccaacatcgttgaaatgcttgcatctcgtgaaaaacaagttttcttatccgactccgaggatgagaaggctgaggtaaatccaattccgagaaagaaaaagaagaaaaactcaggggttgaacccgttattttgaacgacatgccacctcctcaatgcttacaaagctccttggagttcttgagaaaaggaaaat

SEQ ID NO: 14953 - DNA, 524 bp, Gossypium hirsutum
  unsure (1)..(524): unsure at all n locations
  Clone ID: uC-gsflnu33B059a09b1
atcctcactccacatttcactctctttttcaactttcccttcttctctttgttttaaagaggggcttgagttttagccaaagaaaactccatggctaaacttgttgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattactcaaaagaagacccttttttttctttnttacattattatccctataaatttcctatttgaaattcaagtcattgaagcataaggttgcactgtaatactaactatata

SEQ ID NO: 14954 - DNA, 299 bp, Gossypium hirsutum
  unsure (1)..(299): unsure at all n locations
  Clone ID: uC-gsflnu33B059a10b1
ggggnnnggggggaaaaaaaatcaagaaatctaaaacatatttcaattatagtactcagtttgactggttcgatggaaaattttcatttgtgcgcctgccccataacttcgatagatatatgcttcggttgtttttatggctaagaacaggggaaaatgtaggcccttggttcaactttcaggtaatttataattacgttgggtttgaagttaaaaagcattacacttaacagtaatacagaaaaaaagattacaccataaaagaagatgccatatttcaacaccactggaaaacgaac

SEQ ID NO: 14955 - DNA, 467 bp, Gossypium hirsutum
  Clone ID: uC-gsflnu33B059a12b1
cccttgcgtccgcccacgcgtccgatttggccagctttttatcttctcctttatttctcattttccaaatccaccaaaccttccaaattagtcaacagatcaaatctggaacccaatttgcctttctcccttatattcattttaatcagattattattccgagaattgctctatgctttccttttgaccaccatccatggcccgtaaacaacgccttctcctcctttccccacctccgtcggagtaacattcatttggtccttctccggtgcgagctccgattgcagcgaagcacataactccttagtatgaccgtgcttccagcatgtgaagcaaatagtcggcaacgcttcatattcaactctctggttcatgccattcacaaggacttgagcaatcaaaggcttgtcgaagttgatgtaaacaaccatcctagcaaagcggcctctaatcttactatcggagag

SEQ ID NO: 14956 - DNA, 306 bp, Gossypium hirsutum
  Clone ID: uC-gsflnu33B059b04b1
ccttcttgtccgcttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgcgctgtccagtcatgtgatgcttcactgctgctggactccacaagaaggagc

SEQ ID NO: 14957 - DNA, 314 bp, Gossypium hirsutum
  Clone ID: uC-gsflnu33B059b06b1
ccttctcgtccgcccacgcgtccgctcagtgcaccagggacctttccagcactgagtgtaagaagtgtcttgacggcataatcgaggagcttccgacctgctgtgatggaaaagaaggtggaagagtcgttggtggcagttgtaactttagatatgaaatttacccttttgttaatgcataattaaacctttgtgatcgttcaaaaaaaaaaaactatatatgccctgcaataaataaagttaatctaatcatatatattagtatgggaatgtatttatagtaaataaaagaaagtatgatttttgcatttagg

SEQ ID NO: 14958 - DNA, 512 bp, Gossypium hirsutum
  Clone ID: uC-gsflnu33B059b07b1
gtttttgacaatggcggacaaagtattcccttcctccaaacccaccgccaccgctgcccctggtggatcagcagctcctactactactaccaccaccaccaccaccacaaccaacggcggaactacaaaatcccacctcattaaccccaccgcccgcctaccctaccgtccacagccccataacagacgtcgcaactaccgtccacggcgcaactactgttgctgctgctgtttctggatcatcctcataatcctcgtgctcgcccttttagtagccataactggcacagtcctttacgtcctttaccgccctcaccgcccttctttcaccctcgcttccctccgtatccaccgcttgaagctcaaaaccgccgtcgactcctccacttcccatctttcaacccttttcaacttaaccctttcttccaaaaaccccaactctcatttctccttctcgtacgacccattcgtcatttcatgtgtgacccagcatggcgatgttctgataggga

SEQ ID NO: 14959 - DNA, 505 bp, Gossypium hirsutum
  Clone ID: uC-gsflnu33B059b08b1
gggtggtgaaagattgaagaattttgatcatgtcgatcgcgttggaacggatagaatcggcggggttcgggcgggtaatgaattgcgcttgcgatagttctaaattcgaatcgccgccgccggttaaggaaacgaagcagttgttattggcggagacggcggcggttgaagaggaggaggatgattggagggtttcgtcgtctactacgacgtcgtcttcgatcgggaagaacagtgatgaggtatccggaatatcatcggacggtggtgattgcgaggaaaatgaagttcaaagctcttataatggtcctttagatatgatgaattcccttgagcaggtcttgcctatgaggtaagaaaaaccaaaaaccaaaaataaaaatctttccttttggtataatttattgattaatatgcttaaaaaaatctgggttttcttgcaggagaagcatctcgagtttctacaatgggaaatcaaagtcttacacgagtttggtcgatgcat

SEQ ID NO: 14960 - DNA, 443 bp, Gossypium hirsutum
  Clone ID: uC-gsflnu33B059b09b1
ccctcgcgtccgagaaaaaggaataaatatagtgataatttgattcttcgtcgacggagtaaataggagagattatttctttcttcgtctttacaaaaacaaaaaaatatattttaaaagaattaaaagaaaaaaaaaaaaaaaaaaaaaaaaaaaaaaaaaaaaaaaaaaaaaaaaaaaaaaaaaaaaaaaaaaaaaggggggggccctttatagaggaaccatgtttactcgcgggtgtatgcgatgaaatattttttttatggggccacaaaaaaaaaatacggggcccggttttaaacagcggggagagggaaaaacccggggtgtcccacaattaaatcgtttggcaaaacacccctttttccccaggtggaaaaataaaaaagagccccacacaaatcccttttcaaaaattttgcaccccctaaggggaaaggggc

SEQ ID NO: 14961 - DNA, 477 bp, Gossypium hirsutum
  Clone ID: uC-gsflnu33B059b10b1
tccacgcgtccggaagtttcctttctcgattttctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaagcatccccccagaccagcaacgtctcatctttgccggaaaacaactcgaagacggccgtaccttggccgactacaacatccagaaggagtcaactc

SEQ ID NO: 14962 - DNA, 421 bp, Gossypium hirsutum
  Clone ID: uC-gsflnu33B059b11b1
tttatcgcgtccggaaaaaaaaataaagcctaaaaggtaaaaggttaacagattgtagggaaaaagaaaaaaaaatggtgagattatccaaatggcttctaaaagaagcaggaaccggagttaacaagacactttcagagatccttgattgtccgatctgcaaacaagctttaagggtgtgcgaggaaccaccttctctgatcagcgattctattggtgtctcttttgctataaaggatgggatcccatgtttggtgcctacagatgggaagatacttgatactgatgatacaatgaaacatgataatgctgctgatgattcagctaacaacaagtcacgaatggctaggaggggatccgtggatctagctattaacatggtgctatggatggcaaaggacgacctcacctatttatcttt

SEQ ID NO: 14963 - DNA, 455 bp, Gossypium hirsutum
  Clone ID: uC-gsflnu33B059b12b1
ttttcgcgtccgcccacgcgtccgttctgagcttgatatcacggaccaagatgtcactaaaatagcagatatgattgatggggaaatcgcatctttggtaccagagtggaagaggggcttgggcatagatgaaaactcgatatgcacgggttctagtttttgtcaaaattgtgctttgaatggccacctttcggatttcttatcatcgagtagtgcaggtgccaagaacctgcaagttctcgagtgttggaaacacggttgcaccactgtccatggccggtttgaagagatcacgtaccaagttggagagcctgaacaatgtgtttctgaaggtgtagaggcttccttgagccaaccagacggtatccattatgccgacatttggggtcaacgggaagggtcagaactaattccgccaggaccaaaggacatttgctgcacaaagtgaacgaaat

SEQ ID NO: 14964 - DNA, 568 bp, Gossypium hirsutum
  unsure (1)..(568): unsure at all n locations
  Clone ID: uC-gsflnu33B059c01b1
ggatgtgtatcccacttctttcatcgagctatcaaagcttacaatactgggactcggaaacgtcgaaagatccatggtgatgattttggtgatgtccgctggcacaagactggtaggaccaaaccagtctttttggatggtgttcaggaaggatgcaagaagattatggttctctatatgaccactgtcaaaggtggaaaatctgagaaaacaaattgggtgatgcaccaatatcatctaggaactgaggaggatgaaaaagatggggagtatgttatttctaaaatatttcatcagcagcaacaacccaaacagggtgataaaactgagcaagatttacctgaaacaactgatacaatgattgttaaagtagatcctgtgactccaaagtctgtgacacctgacccaccacgaacagggaggcaatgcgatgaatatgaccaaggacaggagtataccattccttgcatcaatccctctgctcaggtattttcagcanagcaccctacaacgcagtatgttgaagatgaagctcaagctgaatgcgaaaattcagtcttaatgatct

SEQ ID NO: 14965 - DNA, 499 bp, Gossypium hirsutum
  Clone ID: uC-gsflnu33B059c02b1
catcttaattcaatttgcagttccaatagtaaacgtgggtcaaattattttgcattttagtgtgtgacgcagcagcgaggaatgatccaaaacagcagatcaaggtcgttttcaagatctcgtcttgccgttgagggattttaaatctttttcgctctcttttttctttaaaagaaaaaattatcttactcttaaaagcttactagcgatctttcttcggttaccatggcgactaacggtgaacgtgaggtttaaaagaactactggatggagcactccattgatttaacagaggatggttcgatacttgattccaaggacgcagatctccacaaagaagaccgactcgaagtgctctccctgcttccgccatatgaagggaaatctattttggagttatgagcttggcattggtcgatttaccggtgaattaatttataaggttgatagcccaatagctatacactccattgaggaagtctttattaaaatgaaagct

SEQ ID NO: 14966 - DNA, 459 bp, Gossypium hirsutum
  unsure (1)..(459): unsure at all n locations
  Clone ID: uC-gsflnu33B059c05b1
cccacgcgtccggcctgcttctttggctgtttcttgttcaagcatgcaatgtaaaagcagcaatctcatgctagggaacgttacagtgcagcaaagtagtgctggatgcaatgtcacttcttgtgcttatagtggttatgcaaatggcaccattatcacttcgttgtcatcatctctccaacctcgatgtccaggaccacagcaatttcctccccttgtagccccacctacatatgtaactcgggattcagtttttgccccagcacctgcaccccagtcagatggtgccaccaccgcaacagtgcccaagacttctacagtgcccaagacttctacagtgccatctacagggtctcttcctggatttcccccaggaggtgccccttttggaagcttatctaatgcttcgacattgatgaattcagctgccgnccttcctgccgcacttgtgatatactt

SEQ ID NO: 14967 - DNA, 450 bp, Gossypium hirsutum
  Clone ID: uC-gsflnu33B059c06b1
ccctcgcgtccgttcacatttcatttgatggtcagaggcgaattgaaagctaagcagtggtaattctaaagattccccgggggaaaaatagagatgtctcctacgttacccataatatgtggaagtatcgacgtaatttcatagagtcattcggtctgaatgctacatgaagaacataagccagatgacggaacgggaagacctaggatgtagaagatcataacatgagtggttcgacagatttggattcctatatatccactcatgtggtacttcattgtacaatatatataagaattatacgataagaattatacgaatccatctgtatagatatcatcatctacatccagaaagccgtatgctttggaagaagcttgtacggtttgggaaggggttttgattgatcgatcaaaagaaaatctactcaaccgatatgccttaggcacg

SEQ ID NO: 14968 - DNA, 573 bp, Gossypium hirsutum
  unsure (1)..(573): unsure at all n locations
  Clone ID: uC-gsflnu33B059c07b1
ctttcatgtccctaaatgagaaagagccttgcgagtttccgtcacaaacgcccgcccaaccccagcccaacccaccccgtgtcgccaagaaacgcacccgccaagacaaccactccccgtttcgcggggtacgtaagaggaggtgggggcgttacgtctccgagatacggttaccgggtcaaaagacacggatatggctggggtcgtttgggtcaccggagatggcagctcgggcatatgactcggcagctttcttcttgaaaggcgactctgctatcctcaacttcccggagttagtggggtcacttccccggccagagtcttgctcgaggagggatatacaatccgcggcggccaaagcggctttgcaggaatcggtgggcagggtaaaagatgaggagggtccggaaagcttncggtggtgggatgctgtggggatggcggcgtttgaggaagtgaaaagcagtcccgtgaggtttgattcaatggagggagagcttgtgtctttcatggaggatgatcatcatttcttcacttcctggcttgagttgtaaatatatataataatgattt

SEQ ID NO: 14969 - DNA, 334 bp, Gossypium hirsutum
  Clone ID: uC-gsflnu33B059c10b1
tgttgatgctgcgttggttgcctgtatggtcgacttgcacaatgttggaacctttaatgttgatacgggattcaaagtcgattatttaaatgagttggaaaaaatgttagaaaaagttctacctaatgccatgttgaaggctaaacctaatcttgaatcgaggattaggacattgaaaagggattggtcaatcgtttatgacatgcttagtggaaaaaacaatagcagttttggttgggatgatcataggcagcttgttgttgctgaagatgcggtgtggaactcatatataaatgtaagaattatttcaagtatttattatcttattttgacc

SEQ ID NO: 14970 - DNA, 388 bp, Gossypium hirsutum
  Clone ID: uC-gsflnu33B059c11b1
ttttaaaaaaaaaaaaaaaaaaaaaaaaaaaaaaaaaaaaaaaaaaaaaaaaaaaaaaaaaaaaaaaaaaaaaaaaaaaaaaaaaaaaaactataaaaaaaaaaacaaaaaaaatggggggggccttttgaaggaaccaaatttaaatcccccgtggttacaagaactatttttttttatggggcacctaaattaaagtaaatgggcggtggtttaaaaccatgagggctgggaaaaccctgggtgttcccaagttaaatcgctttgtgaaaaaaccccttttcgcaacctgctgaaaataaaaagagcccctacacatctgcttttcaaaaagtttgcacttcctaaatgtacatgggaccccccctttatggggccattaaacccg

SEQ ID NO: 14971 - DNA, 441 bp, Gossypium hirsutum
  Clone ID: uC-gsflnu33B059d04b1
cttctatagtggctggattacctttagcaggaaacccactgtggtggagaacaatgtttggtattgctattgtccctgctattttattggctgtaggaatggctttttccccagaaagtcctcggtggctgtttcagcaagggaaaattcctgaagctgaaaaagctataagaacattatatgggaaggaaagagttgctgaaattatgtatgagttaagaactgcaggtcagggctctacagaacaagaagcaggatggtttgatctatttagtagccgttactggaaagttgtgagtgttggagctgcacttttcttattccagcagttagctgggatcaatgctgtagtatactattctacagctgtgtttcgtagtgctggaattgcatctgatgttgcagcaagtgctctcgttggggcatcaaatgtcattggct

SEQ ID NO: 14972 - DNA, 529 bp, Gossypium hirsutum
  unsure (1)..(529): unsure at all n locations
  Clone ID: uC-gsflnu33B059d05b1
ccttctcgtccggtgatcccattgtgcaaagctgtgttagaagcctatagggatcttggataccggggcaataggcaaaagactagaatgatgtggctgattgatgaactggggattgaagtgttcagatcagaggtagccaaaagaatgcctcagaaagagttggagagagcatctgatgaaggtttggttcaaaagcaatgggaaaggagagactacctcggtgtccatccgcaaaagcaagaaggtttcagctacattggcattcacatcccagtcggtcgcgtccaagctgacgacatggacgaactagcccggttagccgacatgtatggctcgggcgaactcagactcactgtggagcaaaacatcataatccccaacgttgagaactcgaaactagaagcattacccaacgagcctctattgaagatcggttttcaccccaaccaagtattctcatgaaagggctagtagcttgtactggntaccagttttgcggacaagccattattgaaacaaaagctag

SEQ ID NO: 14973 - DNA, 571 bp, Gossypium hirsutum
  unsure (1)..(571): unsure at all n locations
  Clone ID: uC-gsflnu33B059d07b1
ttctccatctcgctttccttcattcaaacccttagtttcaactaagagattcactccaatggcttctgttgctacttctcaaactcttggcatttctgaaaccttctctaaactgaaaaatcaaggcaaagttgcattcatcccctacatcacagctggtgatcccgacctttcaacaacagcagaggctcttaaggtgcttgattcatgtggctcggacataattgaactcggtgtaccatattctgatcctctggctgacggtcccgtaatccaggctgcggctacgcgttctttggcaagaggaaccaacttgaatgcaattctttcgatgttgaaggaggtggctccacagttatcttgcccgattgctttatttgcatattacaacccaattctaaagcgtggggttgagaaatttatgtccgctataagggacgtaggcatacaaggactggtggttccagatgtccctctagaagagacccgactttngagaagagaagctctcaaaaataagatngaactgggtatgcttacaacaccaactacgccgacagaccgaatgaaa

SEQ ID NO: 14974 - DNA, 370 bp, Gossypium hirsutum
  Clone ID: uC-gsflnu33B059d08b1
tctatgcgtacggccacgcgtccgctcagtgcaccagggacctttccagctctgagtgttagaagtgtcttgacggcctaatcgtggagcttccgacctgctgtgatggaaaagaaggtggaagagtcgactggtggcagttgtaactttagatatgaaatccacccttttgttaatgcataataaaacctttgggatcgttcaaaagctaaagactatttctgccctgcaattaattacgttaatctaatcatatatattagtctgggaatgtatttatagtaaataaaagaaagtatgattctgcaatccagcacaaagtgagtttcctggaacagaattgcatggcaaacagagttaatttgaattg

SEQ ID NO: 14975 - DNA, 467 bp, Gossypium hirsutum
  Clone ID: uC-gsflnu33B059d09b1
gttatttgcagctgatgaacacatcagaaacatatgaaagaaacaaatcattttctctatatccaacccgtcactccgtattcttgtctttcaagtaaattaagatcgcaaccatttattttggcttttactgggtgaagttgtacaattatacaacacgccccttggcaaaaagcttattagattgtgaagtgattgcagaataagctctatgtatatacacaaatacgtattcctgcatgatatatagaaaaccgaaaaagcaatggaaatccgtagaagctgcgcattgagacaaagtaccgagtccatgcgcaaagtgttctgttgtttaggataagcagggaagcctctggtttctggtagtaaatgagtggattgtcttgtagtcttatatatttgaacaatctgggaagcaatcttatcattgctttgttctggaagataataaaatcatgtctttcatg

SEQ ID NO: 14976 - DNA, 529 bp, Gossypium hirsutum
  Clone ID: uC-gsflnu33B059e04b1
ccttttcgtccgattaaattgaagatggatgatactgctgaattgtatggatttgatgatgacaaggacgagaacaagtttgacatcaagaaaattgcaagtgaaaactggattgagcccccaaaaagagagcagaagcgaaaggaagagtctgcctggcatttgctaatgaggtactgtgctggctttacggaacagtcaaagagaatgaggactacatactacaattcgcaccaccattcaaccgattggagcttctacaagcacaatcttgccctgatgcgattactaatcacgttgaacaatcgtcagttctcattaggaaaattcctagagatttgacagaggcatcgatatcgggtgcatggttgtccattgcaactgcattggctatgatatttttatttggaatggaggatgggttgcttcacactgcttgcgggactccaaattatgttgctcctgaggtgctcaaagataaggttatgatggtacatcatctgatatttggtcttgcggagttattctc

SEQ ID NO: 14977 - DNA, 392 bp, Gossypium hirsutum
  Clone ID: uC-gsflnu33B059e06b1
atcaccgcgacccagtgtagatccactgttcatccatgcatggccttatgattgatcgcttagcccaaagtctgaaccgagaatgtgacatgcaagaccatggctcatgcctgattgaggcacatggttacagatcatgctcaccgatggatccctgaaaaccactgtgatggtaagacgatgtactcgaaacgctcttctaagaccaagccagagtgcactgagcgttcccccatgggggtaccaaatgtgaggtgcatatatctggatgctgtacaatcgcgcattgatcgccttgcacagagaaggccagatatggtgcctgatctctgaccatgctttatgacatggatacacacagtgatgctgatcgtgtgcatggcactgagcgc

SEQ ID NO: 14978 - DNA, 380 bp, Gossypium hirsutum
  Clone ID: uC-gsflnu33B059e07b1
ccctgatagtgatgccagagaaaaaactctcgacgccggggaagttttaaagcttgtttctttgtttaccggaagccgagggcttggaactgttcgaagaattatattggggagtgcgagcaactatgttgtgacgcatgctacttgccctgataccatcgtcaaggaacaatcaagctccagcatgcactgaaaagtttacatgatattttctagttagatttcccaaacaataatttgatggacgagtgtatgctgtttgatcatgttttaccaagtagcttacgcagttttacgttcgtctactgaatcttaaagatgtatggtactctgtgagttaatgcactgttatggagacgactattataatgacaataatg

SEQ ID NO: 14979 - DNA, 316 bp, Gossypium hirsutum
  Clone ID: uC-gsflnu33B059e08b1
cttgtcttcgaggaatgagaaagatagtggcaagccgaaccccgtaagaatgaccgtggcactagtaatcttgggtgtggtgtgtcttgtcggacttttgctgacttattttcttacacgggaaaccacgggaaggtcccttgaggacaatgagatctatgaagatgaacttatatataatacatagaatttctaataaagtttttaaaccccacaagtaaattttaggaataaaatattaaaaaaaagacacacatcataatgtttaaaagttatcaatgtatcaaatactaatcaatgtatgtgttaatataat

SEQ ID NO: 14980 - DNA, 518 bp, Gossypium hirsutum
  Clone ID: uC-gsflnu33B059e11b1
cgtagacaagaagaagaagagagttaagaagagcgtcgagacctacaagatctacatcttcaaggtcctgaagcaagttcaccctgacatcgggatctctagcaaagctatggggatcatgaacagtttcatcaatgatatcttcgagaagcttgctcaagaagcctctaggctcgcgaggtacaacaagaaacccaccatcacttccagggaaattcagaccgctgttaggcttgtacttcctggtgagcttgccaagcacgccgtttctgaaggtaccaaggccgtgaccaagtttacttcatcttgaaaaggctatttgttgatctgtagttggggttagggttaggaggctgctttttaaattagatcggtgtggtttttatgtttatttttctgaaatttccgcatatttattttgatatatggtttgtattagcgagatggatctactcgatcctgatatggctattgtagaaattaatgctattaacgacaacttaatttcttggagcttg

SEQ ID NO: 14981 - DNA, 389 bp, Gossypium hirsutum
  Clone ID: uC-gsflnu33B059e12b1
ttttcgcgtgcgtccacgcaatcgctgctgcgctatgtatttgtctatcccatagtgttcacccatctttgaatgcatcgctcacaaaactatggatgggaaggaggaatgctaggagcatgccctgaaagttgacaccctaccggacgacccttcgagtgacgacatgctcattctctatggactgtacaagcaagctactgttggaccagggaataccaggaaatgaaagggaggaagcattgggggattatatcacgcaaagtcaaacaactgtgtgcggctggtggaagatcttgaagcgtgagtgtatgactcaatgaaactggtgacattacaagccctagacggatacttgaagatgacattactatagaataagggatgga

SEQ ID NO: 14982 - DNA, 480 bp, Gossypium hirsutum
  Clone ID: uC-gsflnu33B059f01b1
aatgtttagaatgttaaggtgcctttggctttgtttggtggatctggaaactatgcatctgcactgtaccttgcagccgtaaaaggaaatgctctggacaaggttgagtctgaacttcttgaccttgttcaggcatcaaaaaacagtcaattgttttctcaattcactaaggacttgtcagtacctgcagagacacgggtcaaagccattaatgagatatgtgggcaagctaaattttcagatcttacaaagaactttttagttatactagctgagaatggaaggctaagacatatagaaagcattgcaaagagatttgtggagttgaccatggctcataagggagaagtgaaagctattgtcacaagtgttattccccttccttctcaggaggagaaggaactaaaggagacgttgcaggaaataattggacaggggaagcaggttaagctggaacagaagatcgatcctagtattctt

SEQ ID NO: 14983 - DNA, 569 bp, Gossypium hirsutum
  unsure (1)..(569): unsure at all n locations
  Clone ID: uC-gsflnu33B059f02b1
cccatttgtccgcccacgcgtccgcttgttgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattactcaaaagaagacccttttttttcttttttacattattatccctataaatttcctatttgaaattcaagtcattgaagcataaggttgcactgtaatactaactatatattttatgttgttagttggtactagnggtttatgtgttttggttttttttgaccaaattgcactccattaaatgagagtgctaatttttgtctatttattaatgaaatgtgtcgttattcc

SEQ ID NO: 14984 - DNA, 494 bp, Gossypium hirsutum
  Clone ID: uC-gsflnu33B059f03b1
cccattcgtccgcccacgcgtccgaagatcgtaataatgaggacagtcgcaacagagatgagagcaaagagaagatccctgatcgggatagagacagggaacatggacaggataaggtgaaaacaacagataaccagaagcttttggatgccaaacaactaattgatatgattccaaagaccaaggaggaactattttcatacgagataaactggaatgtgtatgatcagcatgcattgcatgagagaatgagaccctggatctcaaagaaaattacggagtttttgggagaagaagagaaaactctggttgattacattgtgtcgggtactcaggaacatgttaaggcttcccaaatgctggagctgctgcagtctatattagatgaagaagcggagatgtttgtgcttaagatgtggaggatgctgatatttgagattaaaaaagtagaaactggcctggctttgcggtcgagatcctgaactaacattctt

SEQ ID NO: 14985 - DNA, 497 bp, Gossypium hirsutum
  Clone ID: uC-gsflnu33B059f04b1
attgttatataccctggtgttatatattccctggctcagtaccgatacatgcctggatacccacgagtcgatgcacaaaacacgtatctgataacgagatacgacgggactgtcatcaatgcccaaccttggggttacggaggtgaaacacgtgaattatgggatggctcgaaaatgctagatgcaaagctcaacacggatgcaacagagaaaggctcggatcggttttggaaaatgcttagcaagcctttggagagctcgcgagtggggaatggtgaagttttggaacgtaggaaccctttagccttggcacattttgccaatcaccctgctaaagatacggtgccaaacgtgatgatctgtccttacgacttcccgctgactgagaaagacatgagagcttacattccaaatttatcatttggaaacgctgaagaagtaaacatgaggagattcggcagtttttggttcagatggggttcgagaaacagcgagtc

SEQ ID NO: 14986 - DNA, 290 bp, Gossypium hirsutum
  Clone ID: uC-gsflnu33B059f05b1
ccctctcgtccgcccacgcgtccggaaaatccctaatttgtttacttgctagcttattcttcttcttgctgccgacaaatcgagtttgggatttgggaatttgcgattgggaatttcaagttaccaaatttccggccaaagcttgggaaaaaatgactgattacgaagaaccgcggtatcaaggaaacggagataatctcgaaaacagttatggcggaggttcttctcctaagtctcgttccgacgatcaaaacgattctaaatatcaggattatgagagagagtcttct

SEQ ID NO: 14987 - DNA, 437 bp, Gossypium hirsutum
  Clone ID: uC-gsflnu33B059f06b1
cgtttgagcaaaggagaatcaatcttgaagcaagtaatcagcaaggtcagatgggatggttgtcatggggaacttcattggtgagtaacgccatctctggggtttcccaaagtgttggggaatacctgagtgggccaaaggctagggatccgtatctggatcaacaactgtgatctcttggtgctcgatgtgtagctgtttcaagagattccagtagccaaataagagtagcttagcaactacaagatttgtgtatatatgctctgtaataatgaggataccccggatatacatgcgtgggagctgaatagacgcaatgtgatttgtgtatagtggcttcaaagccgtcgttgggtttggctcctttaagctgctaactccaaaataaataggttgttttcttaaacttgacaatgtagttgagtgtttttattttc

SEQ ID NO: 14988 - DNA, 509 bp, Gossypium hirsutum
  Clone ID: uC-gsflnu33B059f07b1
ctttcgcgtccgggagcacaagaagaaggttgaagccaagaacgcattggagaattatgcctacaacatgaggaacactgtcaaggatgagaagattggttcaaagcttgacccggccgacaagaagaagattgaagatgccattgatggagcaatccaatggttggatggcaaccagctagccgaggccgatgaattcgaggataagatgaaggagctcgagagcatctgcaatcctatcattgccaagatgtaccaaggtgcaggggctgacatgggtggtggcatggatgaggatgccccacctaccggtggcagcagtgccggacctaagatcgaggaagtcgactaaattaacagcttctgctggtgctatattttattttttctgcaacctatgttttgatgtctcgaaaaatctggtttatttttgggaacattaccattttaggtaatgaatgctccccgtcttaagaatatatcaacttctttatattaatgttagtttt

SEQ ID NO: 14989 - DNA, 345 bp, Gossypium hirsutum
  Clone ID: uC-gsflnu33B059f09b1
ttttgaatctgtgctggaaccaggatggggatcgtgctggttgagtacatcttaggcactttgttacactctttcgactggatgcttcctcccggtactggggaattaaacatggatgaggcctttgggcttgctttgcaaaaggccgtgcctctttctgccatggttcgcccacgcctcgcaccaactgcttatgtttcctaagcacatcccttgccttatcactgctcatttttcctacttctgctgcttttgttatctgatattcaagcttgatgtgatgtgtatcaattgatgcatcttttagtttcaattctactctaaaaacaatcttgcatgcctttc

SEQ ID NO: 14990 - DNA, 416 bp, Gossypium hirsutum
  Clone ID: uC-gsflnu33B059f10b1
tttgatttcaggcctggaatgatcaccatcgacctggacctcaagaggggtggcaatggccggttcttgaagacagctgcctatggacattttggaagggacgaccccgacttcacctgggaagttgtgaagcccctcaaatgggaaaagcctcaatcttgaagtccccccgtccgtactgccccgtgcttttctcatccgcggtgctgaataatcccgatgtttcgtagctcctaccggaaatatctaatctcatacttataatgccctttttcattttcattttctatttcttcttttatcgatgcttgttttgatttatgtgtctttttatcagcgtcggtgttgcaaaactgagtgagaattttgcttatattgatggcattggaattaacaagctgcaacattattaagtt

SEQ ID NO: 14991 - DNA, 471 bp, Gossypium hirsutum
  Clone ID: uC-gsflnu33B059f12b1
tgttacgcgtccggaacccaatttcaagcaaaattgaatatatcgtgtgtaactgtttggtactttgctagactaatttacttattttctaaataaatgagataaaatgcataaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaaaaatggggcggccgttttaaaggaacaaattttactaaccctggcttgcaactttatagtttttttataggggcacctaaattaaatcaactggccggcgttttacaaacgtgtaattggaaaaaccttggcgttaccaaattaaatcgccttgaagaaaatcccctttttccaatttggattaaaatcaaaaaggcccgcaccaattgcctttccaaaaatttgcccaacctaaatggaaatatggaacccccttttatcggg

SEQ ID NO: 14992 - DNA, 452 bp, Gossypium hirsutum
  Clone ID: uC-gsflnu33B059g01b1
cccattcgtccgttcactttcagatcatcaaaaccttcaacaatggcctttgttaaggctcaaaaaaccaaagcttactttaagcgttttcaggttccattcaagagaaggagagagggaaagactgattacagggctaggattcgcttaaccaatcaagacaagaacaaatacaacacgcctaaataccgattcgttgttcgatttagcaacaaagatatcactgcacaaataatttctgctaatattactggtgatatgattcttgcctcggcttactcgcatgagcttcctcgttatggacttgaagtcggtcttacaaactatgccgctgcttattgcactggattacttttggggcgccgtgtccttaagttgcttgaaatggacgatgaatatcaaggaaatgtggaggctacccgagaggatttctcagttgagccaactgacac

SEQ ID NO: 14993 - DNA, 572 bp, Gossypium hirsutum
  Clone ID: uC-gsflnu33B059g03b1
atggttacagcaacagagctgcatgctacacaaaatggggtgcattgcccgaggtgctgaaagatgctgaaaagtgcattgagcttgacccaaccttttccaaaggttacacaagaaaaggtgctgatcagttcttcatgaaagagtatgacaaagctttataaacataccaggaagggttgaaacacgatgccaataaccaggagctgctcgatggtgttcgaaggtatacacagtattcttttttatttttggttttctcttcctaattcagcagtaccttattttaagtatttggttatctcaattattttgcagatgcgtagaacagatcaatcaagccaatcgaggtgatttgagccccgaagaactgtatgaaagacaggctaaggcaatgcaagatccagaaattcagaacattctcttaaaatcctggtatgagacaggcaagagcttataaattggttaaaaatatgactttagtccttgtacattttggaaattaggaacgtctttttattttcaatattgaaattcaggtggataattacacggtttttttttaattgttg

SEQ ID NO: 14994 - DNA, 530 bp, Gossypium hirsutum
  unsure (1)..(530): unsure at all n locations
  Clone ID: uC-gsflnu33B059g04b1
ccctcgcgtccgcttatcttcttcttcttcagttccttacccctcagttgctgattggtgggacactgtgaggctctacactgaccaaacaggatcaaacattacagctaccatttccatttcgggtgagttttatgattctgggtactcccatggtgtttacttaagtcgtttatcgatgcaatcgatcatcaaagctgcggttacatctcatttgaggctattgcctctcaatcctcacaatggactttatttggtgctaacttcacaagatgttcaggttgaggatttctgtagagcagtgtgtgggtttcattacttcactttccctatccttgttggtgtaacggttccttatgcttgggttggttatagtggaactcaatgtccaggtatgtgtgcttatccatttgcttggcctaagtactcggngaagccacccccgaatggaggtaatgacataacacatgcgccgaatggngatgcaggggtcgatgggatgatcagtgttatcgctcatgagttagcgg

SEQ ID NO: 14995 - DNA, 318 bp, Gossypium hirsutum
  Clone ID: uC-gsflnu33B059g06b1
ctttctcgtggggttgggttgaattacatatgccgttacgagcagcagcaaaacgcattgttggattgtgcaagcagtttcgatttcgaggactgcatggaatggcagatgaaatatggaaatttgtacattgattaattacgaagttcgaatattacaaatacatgtagagatttgtagactatttttcttgaccctcgtagttcaacaagatgttaatatctcagttacgcatggaaaggctttccctgtaatcaaagcttgaaatagattaatgtatccacttttgaaggtatgggaaatctttacttctttagt

SEQ ID NO: 14996 - DNA, 510 bp, Gossypium hirsutum
  unsure (1)..(510): unsure at all n locations
  Clone ID: uC-gsflnu33B059g07b1
gaagttgcaaagtagaaaaatgggaattccatcagaaataagggatgtttggatacagagaaaaagaaattccttcataattccttcccctgctgaagacgagaagaatttgagagccaagcaattctctcaagaaggaattcgtgccggtgtcaaggcggctgcggtcgccgccgttgtcagcgccgtacctaccttgattgcagtacgtaagattccttgggcaaaggcaaacctcaaccatactgctcaagctcttatcatcagtggagcatcaattgcggcctacttcattaccgtagataaaactgttttggaaagtgctaggagaaattctcgagcacagttcgacaaaactgtttgaatgctagaattgaaggtattcagtggcgaaggttctcaggacaagtatgatacatgtcaatangtttaaagctgttgtatgccatgcatncactttttttttctttnttttttctgtggaattttatcatcaattaagcagtttaa

SEQ ID NO: 14997 - DNA, 533 bp, Gossypium hirsutum
  Clone ID: uC-gsflnu33B059g09b1
cctatcgcgtccgaaccactctcacattaaatattgttagtgaaacaatggcgtcttcagctctgataagtaagcttgaggcagatgtagagattaaggcttctcctaagcagttccatgaaatgtttgcccacaaaccgcaccatgtgcaccatacttgttatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggactttggaatacgagaagctgcacggtgggattgcgcatcctgagactctgctgcaattcgttcaagatatctctaaagacattgacgcccacctcacccaagcaagctaaacagtatcacat

SEQ ID NO: 14998 - DNA, 437 bp, Gossypium hirsutum
  unsure (1)..(437): unsure at all n locations
  Clone ID: uC-gsflnu33B059g10b1
ttttcagtgcccatgttgtgaggctgtacctaagggacctcagggatgctcaagccaaggctagaggaaatgcttataccttttgaagaataagatgataaatgacgataatgatgaaagcatttggattggacgttgttgtaggaaacaatttgggtggtcctgctgcggaatccctgtatgcattgtctgtgatgaactagatttatgttgttggtcactgccactggcattggagtaatgtacatttaatttacatcttgtttctgtcttaacgaatcagagtactggaagaaaatttgaaggctgttctatttactttcttgaaatcttatttcatcttaaagttattatgatttatgataaaaggggttggaccacaaaatgtggtgagggaaaatcctcacacgtaattagctgttgctcannananaaaa

SEQ ID NO: 14999 - DNA, 448 bp, Gossypium hirsutum
  Clone ID: uC-gsflnu33B059h01b1
cattattccaccttcggtcttcgacggcttcacccatttctagaatcagaggttagagcggtgcttctacgtcttctacctttgaatttcaaatggcccctcctcctctttgcctgcttagtcttgagttgattttttgcaatatcaaagagaaagagttgtcttctttcgaaagtgatgctagtgaggataaagacatgatcatcacactcccaaaaatcaaagagttgaacttgaatgtgattaacaacatatggaagcaagactccccatctcgtgatatatgactccttgttattacagaatgttgaaccgtctgaagaaaagcatgaagatagcctttaattgcatgaagctgggctaatcggacaaaaacagtggttcagcaagggacacacagtcgggatcatgttcaaaatgaaggccagatggtgaggtattttgatca

SEQ ID NO: 15000 - DNA, 353 bp, Gossypium hirsutum
  Clone ID: uC-gsflnu33B059h02b1
ccccttcgttcgagcatttcgtatatctgctactaaggaaaagagcatctcagacgctggctaaactcttcatgcgcaagaggatgcgcaagggatgcacatactagaatcatatgacagtggggatccactaccatgctccgagaagaatgatgctgagctctgctcttaaggatggcaagccggaccacagaagcggtatgatgcgcaatccgtggggctgactatacagacgccgactatcatcgctaactctacgtataagtcctggcatgacaagaacataatgtctcatagcgctgacgacacacgtactgcagacgacagctgatagcatgactggaatgagagga

SEQ ID NO: 15001 - DNA, 416 bp, Gossypium hirsutum
  Clone ID: uC-gsflnu33B059h03b1
ccttctcttccgcccacgcgtccgataggcacaaataggagttccttacttgtgttgtagaagccgaagaaaaaaaaatggtgaacatagcttttggtagcattggtgactcttttagtgttgggtctctcaaggcttatttggctgaattcattgctactttgctttttgtgtttgctggtgttggatcagctattgcttacgggaagctaacgtcggatgcagcactagacccaccaggcttggtggccatagcggtagctcatgcatttgcgttgtttgttggggtagccattgcagccaacatctcaggtggtcatttgaacccagccgtcacctttggtttggccatcggaggaaacatcaccatcttgaccggccttttttactgggttgcccaatgccttggctcaatt

SEQ ID NO: 15002 - DNA, 367 bp, Gossypium hirsutum
  Clone ID: uC-gsflnu33B059h04b1
gctttttgtgctggaacgagagctgggtgagaaccgtgaggagaacggtactgatgaccgtactgaaggacgaattgaacttattactaaaggtaccgcgagtggaaacaatggttcatacagctgggcataaaactcggtggaacagacataccggccactgtaccatgagcgagctcatgtctgaacgaatctgagctagaagcgaggctcgaagcgatggacgcactggcgacccgaatgacgagcctctgtacgggactgtgacccgcaagggcgccagtggtcggtgcagaggacgctatataacatacacgctcacgcaagcgtgtatgtgacgtattatgtcacctatagtgaaacctat

SEQ ID NO: 15003 - DNA, 551 bp, Gossypium hirsutum
  unsure (1)..(551): unsure at all n locations
  Clone ID: uC-gsflnu33B059h05b1
gatttatctcatccctgaagccaacgccttatgccttggttctttggaggaattatctaaagctcgaagatcagtcctcgatcctccttgggaaggattgaatttgattcctggtgatgtgctatggtcagatccatcaatgaaacctggtctttccccaaataaggagagaggcattggcctgttatggggccctgactgcacggaggaattcttaaaaaagttcaaactaaagctaattatcaggtcgcatgaaggcccagatgcaagagaaaaaaggcctggtcttggaggaatggatgaaggatacacaatagatcatgatgtggaatcggggaaactgataactgtatttagtgctccagactacccacaatttcaggcaacagaagagagatacaataacaaaggagcatatgttgtactaaagcccnctggttttgataatcctgaatntcatagntttgaagcaattaccccaagacccaaggtgaatccatactatgactttgaggaggtgattgattctgatgaagactggatttagcttc

SEQ ID NO: 15004 - DNA, 555 bp, Gossypium hirsutum
  Clone ID: uC-gsflnu33B059h06b1
gacctccagaaccttgagctccacaagttgcactctacttgccaagactggggcatctttcagttggtgaaccatggggttagctcatcactgctggagaaactgaagcacgaagtggaggaattttataggctgccattggaagagaaactgaaatacaaaataggggaaagagggtgggaagggtatggaaggaagatgagagcagatggcaaatatgattgggttgacactttgaatattatcactaacccactccataggcgcagccctcatgtcttcccacaactccctcctcctttaagaagtacgatggagtgttacttatcggaaatccaaaagcttgccacaaaacttattggtttcatgggaaaagcattgaaaattaaagaaaaggagattatggagttgtttgatgatgggttgcaagcggtgaagatggcatattatcctccatgcccacatccagagtcggtgatgggtcttattccacactctgatatgactctcctcactatcgtacgccaacttaatggagtggatggccttgagatt

SEQ ID NO: 15005 - DNA, 519 bp, Gossypium hirsutum
  Clone ID: uC-gsflnu33B059h08b1
tttttgctttagggctgaaaggccggcatgaaggtccgatcatggctagctacatgcacaaccagcagctgcgccactttaacccacgactccaccatcccgttccctaaaaaaccaccgcgcttatcggaacattaggtttccgatagttcctccgataatcgagggagcgccacctcatcttcagcttcttcaagtgacacgagctacagcagcctccctagcaacccttccctccagactctgccatctgtaccttccttacagcttttccctgataccttagtcttttccgtctctgacatcagcgtttcttcaattatgcctctacccaaccacccgatcacctgcgttgcggttcagggtaactacttgtatgttgcttctgttaacgaaattagcgtctacgatcgccaaacatacactcttgtcgatgcctacaacggcaacgattcatcctacggttccgttaagtctgtcactgtctgtgacggaaacgtcttcactgctcaccaggac

SEQ ID NO: 15006 - DNA, 576 bp, Gossypium hirsutum
  Clone ID: uC-gsflnu33B059h10b1
tttgctgctttgagagaagggttgcctcttcgaaagtccgagcacgccttttacttgaaatgggctgtccactcctttaggatcaccaactgtggtgtccaggacaccactcagatccacacccacatgtgctactccaacttcaatgacattatccactctatcatcgacatggatgccgatgtgatcaccatcgagaactcacgttctgacgagaaactcttgtctgtcttccgcgaaggggtgaagtatggagccggaattggccctggtgtctatgatatccactctccaagaataccatcgactgaagagatcgccgataggatcgacaagatgcttgcagtgctcgagaccaacatcttgtgggttaaccctgactgtggactcaagactcgcaagtatgcagaggtgaaaccggcactcaacaacatggttgctgccgctaagttgctccgaacccaacttgccagtgccaagtgaaagagggctttatgaaagattgaaatgttcatgaatgataagaaaaatctctcaattgttcaatttactgggtttcttgatgaaatatttgta

SEQ ID NO: 15007 - DNA, 437 bp, Gossypium hirsutum
  Clone ID: uC-gsflnu33B060a03b1
tcctcgcgtccggggctttaggctcaaaaggagttcgtgttatagccattgatttgcctggaaatgggttttctgaaaaatctaggttagagatcgaagaaggaacaaatggcatttttgcgaggtttaaggaagtttatagtttgattcaagacaagggtttgttttgggctttcgatcaaatggttgaaactggtgaactaccttatgaggagataaaatctagagttttggttaaaaagaatgttaaggttattgaaattggaagtgaagaaatggggatggttctggggcaggttataggaacaatgggattagctcctgtgcatttagttttacatgattctgcttttcttatggctgcgaattggattgctgagaattcaggattcatttaaagcataacttttatcgatgctggactaaaaccagcttta

SEQ ID NO: 15008 - DNA, 410 bp, Gossypium hirsutum
  unsure (1)..(410): unsure at all n locations
  Clone ID: uC-gsflnu33B060a05b1
ttttgtgctaacctatcagaaatatggcacacgaaggtgcataaagcagttggcttggttggtagctatcatccaaagtctcttgattgtggcatcccgaaaacattacacagttgatgtagttgtcgcatggtatactgttaatttagtagtattcttcatagacaagaaactgccagaattgcctgacagaaccagtggaaatttacctctgttgctaccattaagcacgaaggacaaggatagtaagaccaaagaagagaaccagaagctcttgaatgggaattctgtagaccctgctgattggaggcgnagaagtgaagttaatggcaagacaatggaagatgcaaatggactccatgccgatactgcaatgaatggtgcgtagatgatggaagcttgctgctatt

SEQ ID NO: 15009 - DNA, 169 bp, Gossypium hirsutum
  Clone ID: uC-gsflnu33B060a07b1
tttttattagttaattaatatagacaaccttctcataaatgctccaacatatagttatagctttaatagatgcacttccactttaacacatgctataccgcttctccacgaggctgctcgatcttctcgatgtttttcaataccctaaatgatataagtgtagaagcat

SEQ ID NO: 15010 - DNA, 391 bp, Gossypium hirsutum
  Clone ID: uC-gsflnu33B060a08b1
tgtatgatcacattcctcgagctgacaaaattgtctatttaccggcctgaacaagctccaacaccaccactaccagtgctaccacttccaacattttcacagctcaaatggcaacgaagagaactcatagtggtccttcatttcggtgacaacacattcacagactccgaacggggcaccggggaagaaaacccatcaatattcaaccccggcggtctcgataccaaacaatgggtcaccgtatctgccgaggcagggatttctctaatgatcctcaccgcaaaacaccacgatggcttctgcttatggccttctaaatacacccaccactccgttatatcgtcttcttggagaaacgggcacggcgacggtgtacaagagtttatcgact

SEQ ID NO: 15011 - DNA, 427 bp, Gossypium hirsutum
  Clone ID: uC-gsflnu33B060a09b1
tctttaaggcttgaagaatccgacatacccaagcttctctatcttcaagccatttgcaaagagaccttccgaaagcatccatctacttccttgaacttgcctagagtgtccacccagccttgcgagatcaatggctactacatccccaaaaacaccaggctgagtgtcaatatttgggccattggccgagaccctgacgtgtggggcaacccactggatttcacccctgaaaggtttctgagtgggagatttgccaaaatcgacccatgagggaacgactctgagttgattccatttggtgctgggcgaagaatctgagctggaaccaggatggggatcgtgctggttgagtacatattaggcactttgctgcactctttcgactggatgctttctcccggcactggggaattaaacatggatgagt

SEQ ID NO: 15012 - DNA, 420 bp, Gossypium hirsutum
  unsure (1)..(420): unsure at all n locations
  Clone ID: uC-gsflnu33B060a12b1
tcttcacccatagcttaaacgaacattttcacagtttaaaacacaatatgactaaagatattgagaccacggcggagcaaggcggcggagcggagttctcagcgaaggactaccatgacccaccaccggcaccgttgattgacatggaagaactcaccaaatggtcgctttatagggcggcgatcgctgagttcattgccacccttcttttcttgtatgtcacggtgttgactgtgatcgggtataaagtccaaaccgacccggtaaagaatactattgacccggattgtggcggtgttggtatacttggaatngcttgggcttatggcggcctgatccttatccttggctactgcactgctgggatctctggaggacacatcacccccgcggtgaactttggacctgttctgcggcgga

SEQ ID NO: 15013 - DNA, 142 bp, Gossypium hirsutum
  Clone ID: uC-gsflnu33B060b03b1
tccttgcgagcgctccaacactcgcaagactatgtgtgtttttaaaaaagcgcgaaatacaccacaacacccaaaagcttgcgcagaaatccatggccactgcagaggtcgcaacacgcaagactgcaaaccacgaggccaa

SEQ ID NO: 15014 - DNA, 228 bp, Gossypium hirsutum
  Clone ID: uC-gsflnu33B060b05b1
ctcacgcgtccggtagcatgttcagcgtgggaggtattcaagctagaaatgaagagtggcacgacgatatcgttaccagagaaggaaggggctaccctaaccattgcagttctacttgtctctgtctctaccgacggtatcattctaatatttcctcttatcttccctctcttcttctccattcacttgccctccttcgacccctgtttccatctttaccaccacctt

SEQ ID NO: 15015 - DNA, 118 bp, Gossypium hirsutum
  unsure (1)..(118): unsure at all n locations
  Clone ID: uC-gsflnu33B060b07b1
tnctggagaaacccaacatcacaaatcttcttcatttttagtttcagtggacattaatggagtacagcgcccctccctagtacagatgcagaaactgcaaaaatccatttgctcttat

SEQ ID NO: 15016 - DNA, 214 bp, Gossypium hirsutum
  unsure (1)..(214): unsure at all n locations
  Clone ID: uC-gsflnu33B060b08b1
tancgaccctccgaagtcatctctcactgatttttcaacctttgcggatttgaatctttgcttgagggatagggtgtacagagacagcaaacactaaaacagctctagatgctatcgacgagaactaacattgatccttcatagcgacaccaagtaaaccacaaacttcaccccctgcaccgatcaacgtacccccacaatatttacccccacc

SEQ ID NO: 15017 - DNA, 166 bp, Gossypium hirsutum
  unsure (1)..(166): unsure at all n locations
  Clone ID: uC-gsflnu33B060b09b1
tgnctctgtttgccatttgccttaatcatctttctctttctttaaaacctcttcctatttaatttccgactaaacttgcgctgaattccatggctactgcagaggttgtatcagctcagactgcaatccatgaggagaaacctgaagaagtggtcaaggctggaga

SEQ ID NO: 15018 - DNA, 461 bp, Gossypium hirsutum
  unsure (1)..(461): unsure at all n locations
  Clone ID: uC-gsflnu33B060b12b1
tnctgggcgatggagttaatgatgctcctgctctgtagaaagctgacatcgggatagctgtggctgatgcaactgatgcagcacgtagtgcttctgacattgtccttactgaacctggacttagtgtcatcatcagtgctgtcttgaccagtcgtgccattttccaaaggatgaaaaattacactatttatgcagtttccatcacgatccgtattgtgttgggattcatgctgttggccctcatctggaaattcgactttccaccattcatggtgcttattattgctatcctcaatgatggtaccattatgacgatatccaaagatagggtcaaaccatcacctctaccagatagctggaagctggcggaaattttcactactggaattgttcttggtagttacttgggcagaatgaccggtatattcttttgggctgcatacaagaccaactttttcccg

SEQ ID NO: 15019 - DNA, 283 bp, Gossypium hirsutum
  Clone ID: uC-gsflnu33B060c04b1
gtccagcaatggaagcctcatattacaccatgtatctatgtaatcctcttcatcgatctcacttcacaaatagctgtaaccttagcttatccaccatttctcaacgatagaaacgttgaatacatcaaatcttcatgcagcaccacaacatatcccaaattatgttaccggaccctctcagtctatgcgaccagcatcaacaccagccccaaattgttagtccacactgcactcaatgtaactcttagagccagcaaagcgacttcgaggttgatggtaaaga

SEQ ID NO: 15020 - DNA, 442 bp, Gossypium hirsutum
  Clone ID: uC-gsflnu33B060c05b1
tccttcgcgtccgagaaaaagaccttgaagctctgtatgtggagactaatacgttcatgttagcttcacatttatattgggcgttatgggccttaatccaggcaaggatgtcacccatcgattttgattatctcgggtattacttcttgcggtacaatgagtataagaagcagaagagaatgtgtttctcccttgcaaaatctcacatatctggttctggaaaagcataagactctgatagcgttcgcacgaatagccagtttctgtatgtcatggatttgcatgttttgagtattttgattccgtgtgtgttggtattcttggaaaatattcttccctaatttggatacctttatgagaaggaaacttaaaaacaagatcgaaagaattaagcatttccgggtcacccccggtttagcaggcaggtgactggcctagatgt

SEQ ID NO: 15021 - DNA, 242 bp, Gossypium hirsutum
  Clone ID: uC-gsflnu33B060c06b1
ctcacgcgtccgcccacgcgtccgcccacgcgttcgtccacgcgtccgggtatttagcagagcttaaggacggtgatgagaggaaagctgaaactgtggacagaattagctctgacaaggtattaaaaaatttttcatttggcgtttaaatagaaaattagcaaaactcaatttggagcttataagaaaaaatgcaacatacttggaaccttgattttatattagcatagcaaatccaagcg

SEQ ID NO: 15022 - DNA, 343 bp, Gossypium hirsutum
  unsure (1)..(343): unsure at all n locations
  Clone ID: uC-gsflnu33B060c07b1
tcttcttcctcatattgaactccgctcccatccaacgtaggcaagaaatctttttttcagaaatgttttcatgtgctccacatttcacttctttgaatttctctgaaatgttctaccctaagattataagctctatttgttcgccaaaggcggattttaaagtatttgcttctgcatcgaatgttaatgaggcgcccaattatataccagctgctcctattcttctccctgatggtngatggagtttggaagcagattccgggaggagttacagctgctaagggatttaaagcttcgggcttatatggtggattgcgggccaaaggagaaaaacctgatcttg

SEQ ID NO: 15023 - DNA, 290 bp, Gossypium hirsutum
  Clone ID: uC-gsflnu33B060c08b1
gagatcatagatttttcctctcgctttttgttcagagcaaaaaaaaaaatggcgttgcgacccatagataatgcactccccatcgtaccagacggtctcagacccaagaaacaagccaaagtgtcgattcaaccccagaaaaaagcttccgagatcagcgtaaacgatgagaacaaagctcctttaccgcaacccatagatgcctccgttgattatgtcgcttccgaggatctcaaaccctttcaagacccagaatcaaacatccaaagcttagttgaaggattagattc

SEQ ID NO: 15024 - DNA, 280 bp, Gossypium hirsutum
  unsure (1)..(280): unsure at all n locations
  Clone ID: uC-gsflnu33B060c09b1
tncctgngagatcattggtacctttgttcttgtcttcactgttttcgccgccactgatcctaagaggaatgcaagagattcccatgttcctgtgttggcaccactccccattggattcgctgtgttcatggttcaccttgccacaattccagtcactggcactggtatcaaccctgctaggagttttggagctgctgctatttacaacaaagagaaggcctcggatgtccaaagtttcccctgggacgtaccttttattgtatctgtttttccttctttt

SEQ ID NO: 15025 - DNA, 180 bp, Gossypium hirsutum
  Clone ID: uC-gsflnu33B060c10b1
ctggacgtctgtgcttttcttatttttaccaagttattattattcctcttcaaaatttgatgtggttttatttgaagtttgtttagcaagaggagatggattttgctatatccgatgaactattggggactatcgttccgattgttgtttactggatttattcaggaatatatgtgtgtt

SEQ ID NO: 15026 - DNA, 247 bp, Gossypium hirsutum
  Clone ID: uC-gsflnu33B060c12b1
tgcccacgcgtccggagcattctacgacatggttgagataggtgaaatcagtgtcattgcagaagaataaatgttcttttagtcttgtgaaactgtggacagctttagctgtgtttcgttattagcattctcttcatttggctcttagatagaagatgagcaaaactcaatttggagcttctaagaataatgtcatcatattgggaccttgatttcatatttgcatagcaaatccaagcgaattttc

SEQ ID NO: 15027 - DNA, 464 bp, Gossypium hirsutum
  Clone ID: uC-gsflnu33B060d08b1
ttgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttcgttgggaggcccttatattcctctcaaaactggaagaagaga

SEQ ID NO: 15028 - DNA, 394 bp, Gossypium hirsutum
  Clone ID: uC-gsflnu33B060d10b1
tctcctcgcaaaaccctagccccttccttttttctttcgtagtaatcatccatggagttctggggtattgaagttaagtctggacagcctattaaagcagatcctggtgctaactacgttatccatctttcccaggcttcacttggagagtccaagaacaaagcagaatccgttccactctatgtgaatgttgatgggaagaaacttattctgggaaccctttcccaccagagttgccctcaattatcttttgatttagtatttgacgaagagtttgagctctcccacaactggaaaaacgggagcgtatatttcctcggttacaaaactttcataccagaagaaggtgatgattttggtatgtctagcgaagaagaaagcgaggaggaagaag

SEQ ID NO: 15029 - DNA, 298 bp, Gossypium hirsutum
  unsure (1)..(298): unsure at all n locations
  Clone ID: uC-gsflnu33B060d12b1
taccaggcgtagagcggacgcgcactacgtggtttgtttttatgcgggcgcgattatcattggaaacaacggtgaagttatgcctggtcaatgggaattacaggttgggccatctggaggaatatctgcaggcgatcaaatttggatggcacgagacatactaccgtgtatcaccccaatcncaagacctgggcaanaatttgatgcctaanncaaaacccctgactggaatgacggtgtggcgcgttctgttctccgcccaatgtcacatcagaaacgaacgtcggatcaatgttat

SEQ ID NO: 15030 - DNA, 379 bp, Gossypium hirsutum
  Clone ID: uC-gsflnu33B060e01b1
gttaaccacgaaactggagggctggaaccaaagattgggggactttttgcacatagaccaagggagtataccatggaggatatactgacacacttgataaaggagatggcagcaccacataaccgaaagctggatcaacctcccgagggtacctacttctagctctcaagattatcggacatcctggatctaagcgcatttctggtatgcaatatatagtttgtaatgcttgttgatctttaaagaaaatagtggggaatgccccaaaaagcttctccaattactttcccctggtttcatcttcattatccttttcttatcaaactcttgctaaggaatgcttgttaatttaaaagaaaaaaaacaaaacaaaagggcg

SEQ ID NO: 15031 - DNA, 379 bp, Gossypium hirsutum
  unsure (1)..(379): unsure at all n locations
  Clone ID: uC-gsflnu33B060e02b1
tcctcgcgtccgcccacgcgtccggtggagacgaaacagaagaataatagtcccatgccttaccatggttgggttggaccatgcaagcaggtttctgtgttgtatgaaggctttggagttggagatgcctccaactatgactctgttaaaagttttgctcaacttatgtggcctaatggtcacccacacttttgtgacactattcataccctagggacgcaaatggaggagttgaacaagttaatttggttaatgttaattgatagttatggattagnggaatgactcattgaagatgaactacacaacgctggtgcggatgatgaaatatatggcccctccaccaggagaagatgaaagaggactttttgcttatact

SEQ ID NO: 15032 - DNA, 457 bp, Gossypium hirsutum
  Clone ID: uC-gsflnu33B060e04b1
ttttcgcgtccgtggtgctgagattgttggtacctttgttctggcctatacggtcttctccgccactgatgctaagcgtaatgcacgagactctcacgtccctatcttggcaccgatgcctattgggttggctgtgttcctggtccacttggcaacaaattcccgttactggaacaggcattaatccagctaggagcctcggcgcagctcttatatacaacaaggaccaagcatgggatgaccattggatattctggttaggacctttcattggagcagacttagcagctttgtaccaccaaatagtgataagggccatccctttcaagtccaagtaagggagtgaggaaagaaacaggtgcttgataagcgtcagcctacgatgatgagttctccattatcattttctcttccaaggagtgagttagatgtttattcttcatctatgtaaataatg

SEQ ID NO: 15033 - DNA, 153 bp, Gossypium hirsutum
  Clone ID: uC-gsflnu33B060e05b1
gtcgatgagtggccgaataaaatggttgtttacttgttttttttccaagagacaagtttgttaatgcgcagtgagtaatggtgcaatggtactagtttgatacgatcgacccattgcttttttttttagcttcatcctttttgcctttccttg

SEQ ID NO: 15034 - DNA, 469 bp, Gossypium hirsutum
  Clone ID: uC-gsflnu33B060e06b1
tcccacgcgtccgcccacgcgtccgcccacgcgttcgcccacgcgtccgaaaggattaaaacttagatgtataagtagctatccgaacatacgacacacctgagagattcaggcagacatcacccttccatccatagcttgtgggctggctagcatggttgaaacactcaagagcattgtttctgcacgaggtgactgaaaatttcatttgaatttgcttctgtcggtataatatctgtcaaccgagccgatcatttatgcaggttatttatggaaacgggagatctagtataatagatgtcgggttatataatttttactatggcttggctatctcatacatgattgagacatttttgctcatgtttttatgagttgatgtctgaatgtcttaaagccgagccaagctttcactaatgtctagaaatcgttgcccagaaagttttggactgatgctgctactggattc

SEQ ID NO: 15035 - DNA, 478 bp, Gossypium hirsutum
  Clone ID: uC-gsflnu33B060e07b1
tctggggttcagacccttgtcgccaagtttttaatgttaggtaaagctggtcaccatacaccagttttcgagaagtaccgtcagaaggcggagtacttcatgtgttcattgatcggaaagggtagccgtaatattcagaagactcccggtggtttgatttacagacagagatggaacaacatgcagttcgtgacaagcgcttcgttcttggcaaccgtctactctgattatctaacttcctataggggaagcttgaagtgtgctgctggcaatgttgcaccatcggagcttctttcttttgcgaaatctcaggtggattaccttcttggagacaatccaagagctacaagctatatggttggctacggaaacaattatccaagacaagttcaccaccgaggttcttcgattgtttcgatcaaggtcaaccctaaatttgttgcctgccgacaaggttacgcaacttggtttacaagga

SEQ ID NO: 15036 - DNA, 518 bp, Gossypium hirsutum
  unsure (1)..(518): unsure at all n locations
  Clone ID: uC-gsflnu33B060e09b1
tattaccttctattgttatcattcttcagcatcacattaacagctcagttggacatccccgagtccatcctcccccacgcctacaatcccttctatcaagtttataccacgttaacccaagattatttggtgcttgagcagcctgcttttttcaaggcacttatgacgttggaacttgtttaccaactccctctcgctttgcttaacatctatgggttgttatactctaagccctggttcaacaccacctgcctcctctttggtgcctctatcgttgcctctacgacagctatggtgggagacattctcaattcccagaaggcatcagccaatttgatggccatgtattatccaccgtttcttccattaggggttctggctatagtgcgaggggtggttggacaatcgagcaaggctgctccatccattggcaatggaccttcgtcggctgtgaaaaagaaggcttaaagttgatccccgatcagtttcaaacggcttncttaagagaccatgctaat

SEQ ID NO: 15037 - DNA, 124 bp, Gossypium hirsutum
  Clone ID: uC-gsflnu33B060e12b1
tcgattattccccagccgataggctagtggtggtttttttaacccccccaggcgtttgtaaccgacgaaacaaggacctacaacagtgcgagcacaaagcacggagcgtgagcaagcaccgact

SEQ ID NO: 15038 - DNA, 469 bp, Gossypium hirsutum
  Clone ID: uC-gsflnu33B060f02b1
ttgattccaacaaaaaaaccttccaattttcctcttcacccatctcaaatcttcaatttttctttgccttttggtgatcatcttctccactcacacaaattggtagctttaattgtatagaatgaaattaagtgcaagtgaggatgatttagggtcagacattcatgttccagcagatatagattggcatatgcttgataaatccaagttcttcttcctcggtgcagcttttttttcaggtgcatcagctggtctttaccctgcaatggtgttaaaaacccgacaacaagtttcatccactcaaatctcttgcttcaaaatgtctttctctattatgagatgtgaaggattaagaggattctatagaggtttttggtacaactttaatgggaacaatcccagcttgagcactttacatgggagcccttgaggtaaccaagaccagtgttggcaggagcactgttaggta

SEQ ID NO: 15039 - DNA, 253 bp, Gossypium hirsutum
  Clone ID: uC-gsflnu33B060f05b1
gtcatctccgttcttcactggaaaaacataattaatttgttacaaaataattctccaccatgagctctccgggaagtggaatgtttagtggatttacaaagttatgtaagggattggctgtgatattaatcggtggccacgttgtggttcagcttcttcctacttctgttacttaccttgctcttattcccgccaggactattccttttggttggaacctcataactgctggttacattgaacaatcagcgca

SEQ ID NO: 15040 - DNA, 150 bp, Gossypium hirsutum
  Clone ID: uC-gsflnu33B060f07b1
tagcttatctcaaaagaatctttcgtgacctctttatttgtgaaggcttccagtctgattatggattagattggaccatgttgcggggaaaacaggggcactagaccactcctcctgctcgagccctgggaactggtggtggaacaagca

SEQ ID NO: 15041 - DNA, 337 bp, Gossypium hirsutum
  Clone ID: uC-gsflnu33B060f12b1
tgaaaatggccaagagccaagactatttcttcaaggagttctcaagggccattactctcctctctgagaacaatcctctcactggtagcaagggtgagatcaggaagcaatgcaatcttgcaaacaagcttcactaaaatgcctcgccaaagagaaagccgagagtggccgaataaaatggttgtttacttgtttcttttccaagagacaagtttgttaatgtgcagtgagtaatggtgcaatggtactagtttgatacgatcgacccattgcatttttttttagcataagccaggttgccttctcttgatgttggtcatgggcgtagtggatgtag

SEQ ID NO: 15042 - DNA, 236 bp, Gossypium hirsutum
  Clone ID: uC-gsflnu33B060g01b1
tttcatgcgtacgcacacgggttgtggcgtagtttttttatttagggtgcgcaggataaagtctcttcacattgattgaacatgaaggtgtgtaataaaaatttgattgtatcagcattgctttgcattgctattgcaggagttttgggtcaagctcctagtaatactgctacgtctacgccggtgccaccacagaccagcggcttgttctcctcctccgacgagctaaccaccgt

SEQ ID NO: 15043 - DNA, 513 bp, Gossypium hirsutum
  Clone ID: uC-gsflnu33B060g05b1
ttcctcgcgtccgaccactcccacattaaatattgttgctgaaacaatggcgttttcagctctgacaggtaagcttgaggcagatgtagagattaaggcttctcctgagcagttccatgaaatgtttgcccacaaaccgcaccacgtgcaccatacttgctatgacaagattcaaggatgcgatttacatgaaggtgaatgggggaaagtcggtaccattgtccattggagttatgtgcatgatggaaaagctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagattagtgcactggactttggaatacgagaagctgtacgatgggattgcgcatcccgagactctgctgcaattcggtcaagaatgctctaaagacattgacgcccacctcacccaagc

SEQ ID NO: 15044 - DNA, 311 bp, Gossypium hirsutum
  Clone ID: uC-gsflnu33B060g06b1
tcacgcgtccgcttttctttttcatcattcatggttgaccgagaccgtgaccggtgaccgcaaccagcctcaagagattcagctacttgaccctccaccccactaccgacaaacagaaccatcaagcacccagattggcgctgagctgactctgctccctgtgggtggatcattggtcgttttggcagccctaacactgaccctgccccttaatccgggctcatgtatcaccatacaccctataaatgcccttgagcagatgccatagcccctggcaccatcgccatgttaaaagcgacccggggacaccc

SEQ ID NO: 15045 - DNA, 477 bp, Gossypium hirsutum
  Clone ID: uC-gsflnu33B060g07b1
ttggacatttgccaccctagttgctgttaatgttcctttaaggactggtcctgagcctgactcaaaagtgattggaaatgttcagggtatttccctcttagccggatcaaatgcatcgagcacgcagtacataaaatgtggatttaataccggtaagtttaacggcagctctctaagcgtattttcaaggggagaaccagggctcgccgtggtcggcggaagaggacgattcatgatggcaaacgggactgcactatttaaccctatccttataaatgccaccaatgtcattatggaatttaacttcactgcagtttattactaaggagccatttacagactcaaatctattggattgcgaaaaaggtcgcatgactccgctccactcggatagaataagcgtatgagattgacattttcatacttcattatttgaactttattaatttattaccaatataatttattgcaggattt

SEQ ID NO: 15046 - DNA, 366 bp, Gossypium hirsutum
  Clone ID: uC-gsflnu33B060g09b1
ttattgcttgtaattcatttcgttgtaaatgtgtttttgtagtaatcatcaaatctttcgaagatgtcaggcagaggcaagggtggcaaggggctcggcaaaggaggtgccaagaggcataggaaggttttaagagacaacatccagggcattactaagcctgccattcgccgtttggctcgtcgaggaggtgtcaagaggatcagtggcttgatctatgaagaaactaggggagtattgaagattttcttggagaatgtgattcgtgatgctgtgacttataccgagcacgccaggaggaagaccgttaccgccatggatgttgtttatgccttgaaaaggcagggcaagactctctatggtttt

SEQ ID NO: 15047 - DNA, 442 bp, Gossypium hirsutum
  Clone ID: uC-gsflnu33B060g10b1
tcttcgacgagcacggcgtcgatcccaccggaagttacactagagatgaatcgtcgtcctctgatctacagttggaacgtatcaatgtgtattacaatgaggcttctggtgggaggtacgttcctcgtgctgttctcatggatcttgaacctggtactatggatagtatcagatccggtccctatggacagatctttaggcccgataatttcgtgtttggacaatccggtgccggtaacaactgggctaaaggtcattataccgaaggagctgagttgattgattctgttcttgatgttgttcgtaaagaggctgagaattgtgattgcttgcaaggcttccaggtatgccattcacttggaggaggtacaggctcaggcatgggaactctcctatatcgaaaattcgagaggaatatccagataggatgatgatgacattc

SEQ ID NO: 15048 - DNA, 414 bp, Gossypium hirsutum
  Clone ID: uC-gsflnu33B060g12b1
tcccacgcgtccggaaggagcagagcagatgttgtggtggagtatcttccggaccacaatgagaccatctctggcgttcttgacaggtttgccgccatgggtattgacacccctggagtcgttgccctcctaggagctcacagtgtcggcagaactcactgtgtgaagctggtgcatcgtttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatactggacaacaagggtttgttgattgtggatcaccaactggcgtacgacaaaaggaccagaccttatgtgaagaaaatg

SEQ ID NO: 15049 - DNA, 208 bp, Gossypium hirsutum
  Clone ID: uC-gsflnu33B060h03b1
agcccttattgacctaacctttgcatatatcttgagagtgcgttttacatcttgcgcaagcctgtggcatccaccatcaatacattggctggcgccctgtacaaggtgttcagtgcttcacctgatcaagcaaggaaggaaatgcgccaagcttgctttgattatctaagccttggtggggtatttctaacaggaccaatctccttgc

SEQ ID NO: 15050 - DNA, 415 bp, Gossypium hirsutum
  Clone ID: uC-gsflnu33B060h04b1
ttctttgcgtccgcctaacttttgttctctgtctgtctctctagaacccttcaattttcaatttcatttttccaaatttctcccctttttttttctaaaaatagagaaaattttgggaaaaaaagaaaaaaaattcccagcgtgggagtgagtgtttatgttttttttttttatgaattttgtactgtggggggttttgaatgagaactgaaatacttttgggaaattgaaaatcttcaatcggcggactagatggccaccacggagttgcagatgagtcctcagctggagcagatccatggcgaaatccgcgatcttttccgtgctctttcaaatggcttccagagactggataagatgaaagattccaataggcaaagcaaacagctggaagagcttactggcaagatgaggg

SEQ ID NO: 15051 - DNA, 200 bp, Gossypium hirsutum
  Clone ID: uC-gsflnu33B060h08b1
ctttcttgtacgcgtgggtaaaaaagcaagcgtgtgttttttttctccattaggcgtgttctctgcttaaacatccgagcaccaccccacccatacccaaagacgggggccttcttttacgacaaaagctcctgtacctgcaatccttagacatcaattcccacaaagctgtgaacttaaaccctttcctccggtccacc

SEQ ID NO: 15052 - DNA, 502 bp, Gossypium hirsutum
  unsure (1)..(502): unsure at all n locations
  Clone ID: uC-gsflnu33B061a01b1
tttctaaaaaaaaaaagtataacttcgtgaaagtataaatgttgaggtgtaaagggtaaattcatgattgtatcttttattttaattccatagaaggttaagttttgagaggggtcgagatttcattggtgaaagtcgcactagtcattcgaataaatctagaaatcaaaatagaaggagaagagagagctgatagagatcggatcagagatgtcatcacacaataacaattcaacttcggccaacgatcccagacaaccgtcggcggcaaagccatacgtggcgcagcctgtttcgcctcaagatctccctgtcgattattccggttttatcgccgtgattttcgggattgcaggcgtcatgttcaggtacaagctgagctcgtgtctagcgatcattctgcgcccaatcactggcgaacatgaagaacgttgagaacgatctcaagcagatctctatggctatgatngttgctatcatgggattagtacaaactatttcg

SEQ ID NO: 15053 - DNA, 456 bp, Gossypium hirsutum
  Clone ID: uC-gsflnu33B061a02b1
tcacacacttgctaatattgctacttggagtggtggctctcgccactccctcttttggtacctatgagtctcccaactatgggaagccccctactcctgtttataaacctcctaaggtgaaacccccaccttatgaacatcctgtttataaacctcctaaggtgaaacccccaccttatgaacataagccccctgtctatgaaccaccaaagaaggaaaagcctgagcctaagccaccagtttatacacctccaaagaaagagaagcctgaacccaaaccaccagtatatgaacctccaaagaaggaaaagcctgagcctaagccaccagtttatacaccaccaaagaaagagaagcctgagcccaaaccaccagtatatgaacccccaaagaaggaaaagcctgaacctaagccaccagtttatacaccaccaaagaaagagaagcctgagccca

SEQ ID NO: 15054 - DNA, 268 bp, Gossypium hirsutum
  Clone ID: uC-gsflnu33B061a04b1
taactcagaacagctcaaaaaagcttgcaacattttgaagaaacaaagattcaaacatgtcgaaggaagtgagtgaagaaggggtgagccgaaaggactatgtggatcctccaccggcaccgctcatcgacgtggctgagatcaagctttggtctttttacagagctctcatcgccgaattcatcgctactctcctcttgctatacgtcaccatagtcaccgtcatcggccacatgaaacaacacgatgcatgcgaggtggttggtct

SEQ ID NO: 15055 - DNA, 266 bp, Gossypium hirsutum
  Clone ID: uC-gsflnu33B061a05b1
tcccacgcgtccggattcttcactctgtgtgctacccatcaatcaatcctcacccacctcctgttttcttcttttccttccttctcttttcttcctgtcatacatagtaagccgttcctcactttgtcaagccttcacttttctttgctttgctttgcttttctgtgttcctcactgtctctgtgtatatagccccaaagtgcatgtttcatccaatcccaccactttccacttcacccctcttcttggcccatctaagggttttc

SEQ ID NO: 15056 - DNA, 170 bp, Gossypium hirsutum
  Clone ID: uC-gsflnu33B061a06b1
tcccacgcgtccggttttgatcccaagagacactaccatccccaccaagaaagaacaggtcttttcaacatactccgataaccaacccggtgtattaatccaagtttacgaaggtgaacgaacaagaacaagagataacaacttattaggcaaattcgaactctgcggca

SEQ ID NO: 15057 - DNA, 508 bp, Gossypium hirsutum
  Clone ID: uC-gsflnu33B061a08b1
tcccacgcgtccgcccacgcgtccgaaaaaaagaagaggaaagccaaaactccatactttctattttgcttttttattatatttttttttggttcaattcagtttcgccatttcctttgcatgtagatgctctttggttagtccctatcgccgctacttggactcactttccgctgctatcttttttccggctttctcatggctaataacaccaacgaggcccccgccgccgatgatttcctcgagcaaatcctcggcctccctaactttgcgccctccgaaacgggcttagctggatccgacgctggattggctgcaaccgctgctggagctggagctccaatgtttttgcagctcagctccggtgatggcgccgctcatatcggtggaatccgcggcggtggaggcggtgcgtttcatgggcaggttttccccttgggcttgagcttggagcaagggaaaggcgggtttttgaaacccgaggaagcttcccgtagtgggaagcggt

SEQ ID NO: 15058 - DNA, 132 bp, Gossypium hirsutum
  Clone ID: uC-gsflnu33B061a11b1
tctttctataagctaagaagctccttttgctgaccaaaccttctcctgtcatccttgaacttgatcctctttatcctctgtgcagccgctcttgcttacattatccttgtcaaaatgccaccaacttcactg

SEQ ID NO: 15059 - DNA, 510 bp, Gossypium hirsutum
  Clone ID: uC-gsflnu33B061b01b1
taacagagcagcagcagcagccatggttctcaagacggagctttgccgatttagtggtgccaagatataccctgggaaaggcatcagatttgttcgtggagattctcaggttttcctcttttccaattcgaaatgcaagaggtacttccacaaccgtttgaagccttcaaaacttacatggacagccatgtataggaagcagcataagaaggatattgcccaagaggccgtgaagaagagaagacgtgcagccaagaagccttactcccgatccattgttggtgccaccttagaggttatccagaagaagagaagtgagaaacccgaagtccgtgatgctgccagggaagctgctctccgagaaatcaaggaaagaatcaagaaaactaaggatgaaaagaaggcaaagaaagcagaagtagcggcaaagcaacaaaagactcagggcaagggtaatgttccaaagggtggagcaccgataggccccaagctctgtggctgtggcggaaa

SEQ ID NO: 15060 - DNA, 490 bp, Gossypium hirsutum
  Clone ID: uC-gsflnu33B061b02b1
tttcacttttacaattcggagaggggttgggacacctgattgtgtcagtgtcaactatgatgattttgttaatgatgtagaagtgggtgacatgcttcttgttgatggtggtatgatgtcattagtggtgaagtctaagacagaggattcagtgaagtgtgaagtagttgatggtggtgagctcaagtctaggaggcatttaaatgtacgaggaaaaagtgctacactgccttctattactgaaaaggactgggatgacataaaatttggagtagacaacaaagttgacttttatgctgtttcgtttgttaaagatgctcaggttgttcatgagttgaagaattatctgcagagttgtgatgcagacattcatgttatcgttaaaattgaaagtgcagactctattccaaatttgcattcaattataacagcatcggatggggcaatggttgcaagaggagatcttggtgcagagcttcctatcgaggag

SEQ ID NO: 15061 - DNA, 477 bp, Gossypium hirsutum
  Clone ID: uC-gsflnu33B061b03b1
aacgcaacacaaaaacagtcttcatggtcaataactggcctattttaattgctatacactagcttacttcatggaattgtcattatgaagcatcaacgttggactagcgggtcggcaccttcttcagctgcccaatctgccacagccaacgatcccaacattgcccacaacgcaaccatgtttgccatatcctagcatgccgtatcccactaccctaacaactttgcctattacaataccgccattgccgaacatgccttaaattccagctatgatcccatctatgccattacttctatccaccacctgctaaaactagcccttgagacattgctttgcttacatgttgcttgatagagcatatggagatcatcagctggtgtgtgactctatatactaagaaccgtactacctgacgtgtgtatatgagtgagcatcttgatgctcagattgatttcatgtatgtggacatggcag

SEQ ID NO: 15062 - DNA, 166 bp, Gossypium hirsutum
  Clone ID: uC-gsflnu33B061b05b1
accacgcgtccgggttagacaccaagatagactaccatccacaccacggaagaacagggctagtaaacatactccgttaaccaacccggcgtattaatacaagtttgcgaaggtgaacgaacatgatcaggagataacaacttattaggcaagttagaactatgcg

SEQ ID NO: 15063 - DNA, 189 bp, Gossypium hirsutum
  Clone ID: uC-gsflnu33B061b06b1
taaaaaaaaaaaaaaaaaaaaaaagggagggaaatttaaaaaaaaaagggagtaaacaaaacaattgggcggccggccttgcggacccaaggttactgaatccgggcatgcgacggtgtaagtacaaaatcgtgcgacctcaactcattaagctagtcgcagctatacggggtccaaactggtaaaccc

SEQ ID NO: 15064 - DNA, 491 bp, Gossypium hirsutum
  unsure (1)..(491): unsure at all n locations
  Clone ID: uC-gsflnu33B061b09b1
ttctatcgcgtccgctgcgccagtggtgtgcttggcagttgagaggggatggagtgagtcttctagtcctaatgtgaggggtccacccgctctcatattcaacttttctcagctggacgaaaagctgaaggctgggtacaaggccacaacagatggaaaatttaccgaggctcttcggctttttctcaacattcttcatacaattccattgattgttgtggagtcaaggagggaagttgatgaagtcaaagagttaattatcatcgccaaggagtatgttcttggtctgcagatggagcttaagcgtagagaattgaaagacaatccggtacgccagcaggagcttgctggctacttcacccattgcaaccttcaaatacctcatctcagacttgctctgcgaaatgcaatgaccatctgtttcaaggcgaaaaacctggctacagccgctaactntgccaggcgtcttctagaaacaaaccctaacgaga

SEQ ID NO: 15065 - DNA, 248 bp, Gossypium hirsutum
  Clone ID: uC-gsflnu33B061b10b1
ttattaaaataagcttttttctggttttcccttattttgtcttgtttttgtttcttggtgtgggatatgagtgttttccattttgcctcgtgggtttttggattgaactttaagaattatgcgttgaacggtcgtaaatttttggcgaagagagaagaaacttgtttcttcattgtttatcaaagcagagcaggcttgagttttctttatgtttgcagggagagagtggaattccttttattttcgct

SEQ ID NO: 15066 - DNA, 164 bp, Gossypium hirsutum
  Clone ID: uC-gsflnu33B061b11b1
tatcaaccacattttgctttgattttctggtgatgcacgcgaactggctggatgtttttttaggggcggatgtgctgattgcactgagcaactgccatgaatatgcgaagccattggtgaagatcgcaaatgactggaagctgcgtgacaaagggcgggaatgt

SEQ ID NO: 15067 - DNA, 262 bp, Gossypium hirsutum
  Clone ID: uC-gsflnu33B061b12b1
ttttgaggcaccgtggacgtggaacggacgaatttgggcaaggacaggttgcaacttcaactcgaattggcaaccggcttgtgaaaccggtgactgtgatggaaggctccaatgcaatggactaataggaatacctccagccacactagtccaagttgcacttcaaggtgataaaggcaagccaaatttctacgacgttagcctggttgacggctacaaccttcctgtctcggtcactacacgacctttttcacccaaatgc

SEQ ID NO: 15068 - DNA, 418 bp, Gossypium hirsutum
  unsure (1)..(418): unsure at all n locations
  Clone ID: uC-gsflnu33B061c01b1
tcggacgcgtgggcggacgcgtgggcggacgcgtgggcggacgcgtggggtcggcctcgttgggtctttgtcttcgtattctcaactgtgagtttcatcctttggtatgtatcctgtggtctcttgactgtgctctgggcgcttgccattgcactccttgccactatcctccatgcaagttttagaacacctaacctgaaggctcgtcttaacactttccgtgaggagttccgtgcagtttggcgcaattacagtgagctgtagctcatatagcctatagcatctcttgaacatttggtgtagtaaatcatgggactgcttcaaaaattttcttgtcatgggantggtgttcctcaggcagagaaggaaggttgcgataatgtggaaactcgtacaacatgttattgtaaggctggat

SEQ ID NO: 15069 - DNA, 521 bp, Gossypium hirsutum
  Clone ID: uC-gsflnu33B061c02b1
tagaagacggagttgccgacattcaaagaagcctatggagaacatctagttctcgcgtagaagtgtgatatacttatagcacgaccttgaccatggcataatctggttctcgatggataggttgattgtgcataatgggaagcaaccggtttctagtctatgaatacatgcaaaaagggaacctacaagatcacttaaatggtacggttttctactcaaatctgtttccagtgcagctgatcacctattcaacatctatcaaagttaaactgctccaataggtattggggaaacaaaaatggattggccctcaaggctcaaattggcacttggtgctgccaggggacttgcttatctccactctagttctgctgttggaatccctatagttcacagagattttaagtccaccaatgttcttctaaatgccaactttgaagcaaagatatcggattttggactagccaaactgctgccagagggtcaggagacttctgttactgccagatttctcggcacat

SEQ ID NO: 15070 - DNA, 194 bp, Gossypium hirsutum
  Clone ID: uC-gsflnu33B061c05b1
tcccacgcgtccgaacccttcaaacttcttaggtcccaatctgcaattaaaccctttagtatatggtactatctatgccttcccttttatgtcttccctttatggctccagttttctcttcgtttcttgctttaactctcattattccattaagcaatgctcaaggtccaccttcccctggattctccccaagc

SEQ ID NO: 15071 - DNA, 165 bp, Gossypium hirsutum
  Clone ID: uC-gsflnu33B061c06b1
ttctttccacgcgtacgcccacacgtccgaggggttatttgttggcggtggcatatacagggaagaatcaggttccttgggaatgcaggtcctaggaataatgataatctgaagctttgtatgaccacatagagacgagctcggttcacactattgctcatggat

SEQ ID NO: 15072 - DNA, 510 bp, Gossypium hirsutum
  Clone ID: uC-gsflnu33B061c07b1
cccacgcgtccggttccgaagttaactgagtatttgcaaaagcattggagggatttcaggaagcctgaaagtgcagtgatgcgtcctctgtatgacgaagtggtgtacttgaatgagcatcataagagaaaattaaggcaagaatttggagtggtgccatggtcatttgaacagaatttggggcaagctgtctttctccctgctggttgccctttccaagtgaggaatctccagtccaatgttcagttagggcttgacttcttatttccagaaagtgtgggggaggctgtaagattggctgaagatatccgctgtcttccaaatgaccatgacggaaaacttcaaattttggaggtggggaagatctcgttatatgcagctagttcggccattaaagaggtccagaaattggtgctggatccgaaattgggtgctgagcttggattcgaagatcctaatttaacctcagcagtatcggagaatctggaggttgtgaagcgaagtcaaata

SEQ ID NO: 15073 - DNA, 412 bp, Gossypium hirsutum
  Clone ID: uC-gsflnu33B061c08b1
gccgccgacttacgctagtaccagcaggaacagcaggagggcgagaacgtacgctaggacatccaagcccccgacgaatgcaccaactttacatcccttccacggaagcgagcctttattccacaacgaaggcgcaagtgttcccacggatagaccataccaagattcgaccgcttactgcctaccaggggcacatggatgtaatgacacatccttgtcctagaggacaaaggagcctaatgtatgctcagggcgaaggagacatgaggagatgcaactacgcttgatacaacacctagggggaaggagagcctagttggatcgccactgacaagatgacatgctagatcaccgaacacaagctggaggccactgctaaaactggcaagaatggctatgtcttactgaagca

SEQ ID NO: 15074 - DNA, 219 bp, Gossypium hirsutum
  Clone ID: uC-gsflnu33B061c09b1
cccacgcgtccgggagaggcaagaagagtatgtgccctagatatttgattatcatgattcaagaatgaaaaaggaaacaggagtttgacatatatagtggttcatatatttaaagatgaggaagattgaagtttatgaagtctttcctgtgttttattaaaaaaaaaaagcaaaagatataaatataagacaccaaaaagaaaaaaaaaaaatacaatt

SEQ ID NO: 15075 - DNA, 443 bp, Gossypium hirsutum
  unsure (1)..(443): unsure at all n locations
  Clone ID: uC-gsflnu33B061c10b1
atatgtcaggcaggaaggaaacagtgttggatttggctaagtttgttgacaaaggtgttcaggtcaaactcaccggtggtagacaagtcacggggaccctaaaaggatacgaccagctactgaatcttgccctggatgaagcttaagatttttttagacacccagtgtccctctgaaaacactatgtccccttgtttttttttttgggggacaaaaaaaacccttgttttcttcccttgccccaacaaaaataaaaattttttttctccccaagggggcgggggggggcgggtttaaaaaagaaaaaaaaaaaaaattttgttcttcttttttttttttttagtaaaaaaaataaattntcaaaaatatagagggtgttttttttttggggggggggggccccccagaaacccacaaaccaccccannntaattttttttttt

SEQ ID NO: 15076 - DNA, 213 bp, Gossypium hirsutum
  Clone ID: uC-gsflnu33B061c12b1
tctctttcaagtttaattttcctaacaaccaaaccggaaaatgtctggctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggt

SEQ ID NO: 15077 - DNA, 77 bp, Gossypium hirsutum
  Clone ID: uC-gsflnu33B061d01b1
cccacgcgtccgcccacgcgtccgcccacgcgtccgaaaatggaaaaaaaatgcattggcccatgtggatatctgtg

SEQ ID NO: 15078 - DNA, 493 bp, Gossypium hirsutum
  unsure (1)..(493): unsure at all n locations
  Clone ID: uC-gsflnu33B061d03b1
aaactttttagttctcaactctctcaaattcaccatggctgacaagtgtggcaactgcgattgcgctgacaagagccagtgtgtgaagaaaggaaacagcttggtcattgagactgaggagagctacatcagcaccgtagtggtcgagcctctggcagagaacgatggcaagtgcaagtgcggaactagctgcagctgcacaaactgcacatgtggcagtcactaagcagacatatagaatgatgaagtttgggacctaaaaagaataaaagttgggttgaataatttgtgtcttttgttgtagtttgagtgtgttttcttgtctatctgtccgatgattgtctatgtctctcattttatacaatgatggaatgaccatgtcaatggcctttgtctgattaatgaactattattagtnaaaaaaaaaaaatatataataatatatttatttataaaaattattaacaatttaataaataatggggcggccgtt

SEQ ID NO: 15079 - DNA, 418 bp, Gossypium hirsutum
  Clone ID: uC-gsflnu33B061d04b1
ttcttgacaaacccagagccaaaagaccggccaaggtattgctgcccatcgcgctatgagaggccccatgacttgactgtgctacacgcatggtgaagaacccgccggcggttgaaggtcaagaatactgagaccatagccgcgctggcacagaaacaccaagaactagaaacatggccggtgccaaggtgaaggtggagggcatcaaccagcagaccgctgatagttacaaccatgaggaaggacacacatggtgcaaccggacaatacgagatgcctgtataacgagaaacatgtggaatacagctgtgacgcatgctcatccttagagctccacagcgaagggcgctaacatgccaacaggacacgaacggacgctcgtggacataaccaactacatcggcatcgcatagaacac

SEQ ID NO: 15080 - DNA, 509 bp, Gossypium hirsutum
  Clone ID: uC-gsflnu33B061d06b1
ttcttcccacgcgtccgagaaaatgaagggtctgcaggcacttatattggcaatggtaatggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttttcctttatttctttttatgtgttgtgtttcgattgggatcttatagtcgtgtgatttctcaccaataatcatatattagtattgtttccacc

SEQ ID NO: 15081 - DNA, 508 bp, Gossypium hirsutum
  Clone ID: uC-gsflnu33B061d07b1
gttttcgtttgcagtagtgactctccaaaccctaaccctataaacctactagttctgcccctcttttaattaatttctctgaaaaaatgggagaaacaagggacaacgacgcttatgaggaagagcttctcgactacgaagaagaagaagagaaagcccctgactctgtcactgctaaagtcaatggcgatgctggcaagaagggctatgttgggattcacagttccggattcagagatttccttttgaagccagagctgcttcgagccattgtggactctggatttgagcacccttccgaagttcaacatgagtgcattccccaagctatactgggatgggatgttatttgtcaagctaaatcagggatggggaagactgcggtttttgttctatcaacattacaacagattgaacccacaccaggacaagttgttgcccttgttttgtgccatactagggagttagcttaccagatttgtcacgagttcgagaggttcagtactta

SEQ ID NO: 15082 - DNA, 437 bp, Gossypium hirsutum
  Clone ID: uC-gsflnu33B061d08b1
tctcaaagcctacaaaaaaaagagcaaaaaatggcagaaagaggcggcggagagcgtggcgcttttaggcgcggcttcggtggaggaaggggtgaccgtggtccaagaggcaggcgccgtggccgtaaggacgaagaggagaaatgggtacccgtcacgaaactcggccgtttagtcaaatccgggaaaatcacgtccctcgaacaaatttaccttcactctctccctatcaaagagtaccaaatcatcgaccagctcgtctgcccttccttgaaagacgaaggcatgaagatcactcccgtccagaaacaaacacgtgcagtccagcgcacgcgtttcaaggccttcgtcgtcgtcagagactgaaacggacacgttggatttgggtgtcaagtgcatcaaagaagttgcgacggctataagaggggcgattatat

SEQ ID NO: 15083 - DNA, 368 bp, Gossypium hirsutum
  Clone ID: uC-gsflnu33B061d10b1
ttgctggaggaaggaaaggcgggggcccaaagaagaagccggattgtcgatcggtgaaagccggattacagtttcccgttggtcgaactggacgagacttgaagaaaggccgatactctcaacagtgtgggaaccggcgctccggcttaccttgctgctgttcttgaataccttgctgctgaggctcttgagttagctggtaatgctgcaagagacaacaagaagaataggatcatttcaaggcatgttctattagcagtgagaaacgatgaatagcttgtgaagcttttagctggtgcgactattgctcatggcggtgttatacccaatattaacccagttcttttaccatagaaaaacgagaatgc

SEQ ID NO: 15084 - DNA, 478 bp, Gossypium hirsutum
  Clone ID: uC-gsflnu33B061d11b1
taacccaaaattttttttaaaaaaaattctaaataagtgatggggtttccggccaatggctcatcggacaaaccattgaagttcctgatctacggtcgaactggttggatcggtggtttattaggcaaactctgcgaatcccagggaatcgattacgagtacggctccggccgtttagagagccggatttcgcttgagtccgacatagccaacgtgaaaccgacccatgtattcaatgccgccggtgtcaccggtcgtccgaacgtcgattggtgcgaatcccataaggtggagaccatcagaaccaatgtggtcgggacccttaccctcgctgacgtctgcagagacaaaggcctcatcttgattaattatgctacaggttgcatctttgagtacgatgaggctcatcagataggaacgggtatcgggtttaaggaagaggatactccgaatttcaccggctccttttattctaaga

SEQ ID NO: 15085 - DNA, 422 bp, Gossypium hirsutum
  Clone ID: uC-gsflnu33B061d12b1
tcctacgcgtccgaaaatgcaccccttgccagcagcaagtcccatctccgccgccaccgtctccaccgccgcctgcatcttcgccacctcctcccgctaataaccccaactactgcccaccacctccatctccacccacctctagtggtggtggcagctactactactctccaccaccaccagctcaatccgggggtaacaacaacaacaactatgctcccccaccgcctggtggtgtcattggcggcatgtactaccctccaccgacgtacaaaaactacccaacaccgccagctgagaaccccattgctccttacttcccattttattaccacactccatgacccccttcagggtctgaaaagctgttagcttgttgggttgtaacgatgttgggttttttcccttatgtcttttgacat

SEQ ID NO: 15086 - DNA, 442 bp, Gossypium hirsutum
  Clone ID: uC-gsflnu33B061e01b1
ttcttgttttccttcaaaaccctaatagctgtcctcgcctactgaacgtgttcgaaaatggccggttctgagggattgactctacgtggcaccatgcgtgcccacaccgacatggtgacagccattgctactcccatcgataactccgacatgatcgtcacttcctcccgcgacaaatccatcatcctttggcacttaaccaaggacgaaaagacctacggtgtccctcgtcgtcgtctcaccggtcactctcacttcgtacaagacgttgtcctctcttccgattctcagttcgctctctctggttcctgggatggtgagcttcgtctctgggacttatctgccggtatctcagctcggcggtttgtccggcacaccaaaaatggtctcttccgtggcttttcaattgaccaccgtcaaattggttcttgctctcgagatc

SEQ ID NO: 15087 - DNA, 503 bp, Gossypium hirsutum
  Clone ID: uC-gsflnu33B061e02b1
cccacgcgtccgaaagatggtagtgaaggttaccatgaagggcgagaaatcccggtctaaggcgttgaaaattgtagttggtctctcaggggtggagtcggcttcgttgaaaggcgatgacaagagccaaatagaggtaacaggggatggtgtggatgcagttaagctaaccagtctgctaaggaagggcgtggggtacgccgagctggtcagcgtcagtgccgctgataagaaggatgataagaaagacgagacgaagctaccgccacccttctactattatcagtgtcaaccggtgcctccgtacggatacgtcgaaaactatggaccctcttgctacatcttgtaatcacagacacacgaaattttacacttcacagtcgacaacaacatatatatattacttggcttaaattcctcagttcctgttcatctcaaaattagacctttaatgtctgtgtttcctatgcaattgattttgatggtgtgttttcattattgaa

SEQ ID NO: 15088 - DNA, 455 bp, Gossypium hirsutum
  Clone ID: uC-gsflnu33B061e03b1
tcccacgcgtccggccacactaatggtcgagggatcaagggcacggaccttgagtgacatgaatgatgagggactcgaggcgtacaggccatcggcgagacagatgtacccaggtcgacccatcccccgagcgttgaaaggctgtgaaaggggctgactggccctgcttgtgttcttataagaattgatggtcggtaggtagctgggggattgatccaaaactggcaggggagttgcctccaaagcgcatgctcccaatccacataatacggcatttttaggaaagggccattggtgacatatactgaaacctgaaggattacagcacatctggggcatgaaaggtttggcaccaactatatatacaagagaccaagtataaccatgcattattgccatatagctgaagacaatcgacatatatgcattagggcacgcatccagaacagcatgaa

SEQ ID NO: 15089 - DNA, 483 bp, Gossypium hirsutum
  Clone ID: uC-gsflnu33B061e04b1
cttatgctattggtgtgcctgagcccttgtctgtctttgtagacagctatggaactggaaagattcctgacaaagaaatcctccaaattgtgaaggagaacttcgacttcaggcccggtatgatcaccatcaacctggatctcaagaggggtggcaatggccggtttttgaagacagctgcctacggacactttggaagggacgacccggacttcacctgggaaggtgtgaagcccctcaagtgggaaaagcctcagtcttaaaatccagctttggctgtcctcgaatgtctctaatctcatacatatgatgccccccattcattttcattttcattttcttatttgttctctttcacctttaattgtgtcctgtcaatgtcgtgttgcaaaaatgtatgagaattttgcttatattgatgccactggaagtaaacaatcttcctcttatgattgcttaatggaattcttggctaccttaatc

SEQ ID NO: 15090 - DNA, 518 bp, Gossypium hirsutum
  Clone ID: uC-gsflnu33B061e06b1
ttcttcccacgcgtccgcccacgcgtccgccggaagttctttctcggagagaatatgatgacaaaagattgatgagaatgtggcaagggagattataaatcatagatcactacgtcatccgaatataattcggttcaaagaggtggttttgactcctacacatcttgcaattgtgatggagtatgcagctggtggtgaactctttgagcgaatttgcaacgctggacgattcagcgaggatgaggctaggtatttttttcagcagttgatctcaggagttagctactgtcatgccatgcaaatatgccatcgagatctgaagttagagaataccctgttggatgggagccctgctcctcgtctgaaaatctgtgattttggttattcaaagtcatctctactgcattcaagacccaagtcaactgttggaactcccgcatatattgcaccagaagttctttctctccgttttctctccttacttgtatggcagccaatttgaagagtggtggagggat

SEQ ID NO: 15091 - DNA, 98 bp, Gossypium hirsutum
  Clone ID: uC-gsflnu33B061e07b1
ctttctttagtggattttcaggtttaaaatatttggtttaatgaattgttagtcacaccattattatggaatttaattttattgttagtattatttcc

SEQ ID NO: 15092 - DNA, 489 bp, Gossypium hirsutum
  unsure (1)..(489): unsure at all n locations
  Clone ID: uC-gsflnu33B061e08b1
tcccacgcgtccgcccacgcgtccggggtctgcaggcacttatattggcaatggtaatggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttttcctttatttctttntatgtgttgtgtttcgattggtatcttatagtcgtgtgatttctcaccaataatcatat

SEQ ID NO: 15093 - DNA, 418 bp, Gossypium hirsutum
  Clone ID: uC-gsflnu33B061e09b1
aaaggattgtaggcacagttgtacgttcagtgcaagatgatcaaaaggaacaagacattaaaatcttggatgctgaggttcaagctctggaagagctttcaaagcagctattcttggaaatctatgagcttcgccaggctaaggaggctgctgcttattcacgaacatggaagggccatatgcagaatttgcttggatatgcaggttcagtttattgtgtgtacaaaatgattaagtcattacaaagtgttgttttcaaggaggctggttcagttgaccctgttacaatgtcaattaccatattgttgcagttctttgatattggaatagatgctgcattgttatcacagtatatttccctgctgtttattggaatcttgatcacaatatcagtgcggggtttcttaacaaatctaat

SEQ ID NO: 15094 - DNA, 518 bp, Gossypium hirsutum
  Clone ID: uC-gsflnu33B061e12b1
ttgtcgagttcgatatgtttggataaaatggttagaaatttcatcgaagatagccacaacgacaagcaaccgccaccgcagccgcctccagctaagtacggccgtaaccgctgtaattgctttaatggtaacagcaacgatagctccgatgacgagtttgatgagttcagtgagtcttccaacggatcaccgcctgatacttgcgaaactgtcaagagtctggtacaatgcgccactgtcgtcgagagaaacctcttagctgacacggcgatgatcgttgaaaagaataaaaactgtaaacggaaagatgatttgaggaagatcgtgaccgacggtttactttcacttggctataactcttcaatttgcaaatcaaaatgggacaaatctccttctttccctgccggtgattatgagtatatagatgtggttatggaaggggagagaatgttgatcgacgttgatttcagatcggagtttgagatggcgcgatcaaccgggacttacaaagcgatcgt

SEQ ID NO: 15095 - DNA, 455 bp, Gossypium hirsutum
  Clone ID: uC-gsflnu33B061f02b1
tcccacgcgtccgcccacgcgtccgcaggaaaacaagaaaagcagagccgcatcactttttgctagctaagctactgtgggagttattgttcttcagaacagcttctgcagtagctaataataacgttatatattatataaattttatacatcctttttaccctacgactccatatataagcaagtaaaaataaatatggctcgctctgtttcttcctttaagttccttggtgcttctgtttttgatgctctttatgtctccatatcaaggagaggttactcaggtgcaccgccggcggcagtgacggctagctttggtaggcctggagcgatggggaaagtggaacgaagatatgcgatgaaagagtcgtcgtcgtcggagacaagggcttattcttcagcttgtgcgcctgaccctgttacggggtattaaccgccggagaactgtggggctg

SEQ ID NO: 15096 - DNA, 492 bp, Gossypium hirsutum
  Clone ID: uC-gsflnu33B061f04b1
atttacggatagtcaattgggactgaagtcttgcgaactgctatctatgatatagaggtagattatacggacatcaaagaaagaactttgttaaaggtacctagttatgaaaagccagtggagtttggagtgttgacctcctttgcttaccctttggagggagaattgggtgaaattgttgttgccactactagggttgaaacaatgcttggtgacacagctatagctattcatccggaagacaagaggtacagtcatctgcacgggaaatttgccattcaccctttcaatggacgaaaacttccaataatctgtgatgcaattctagttgatccaacttttggaactggtgcagtaaagataactccagctcatgatccaaatgattttgaggtgggcaagcgccataaccttgaatttattaacattttcactgatgatgggaaaataaatagcaatggtggcgcagattttgttggaatgccacggttt

SEQ ID NO: 15097 - DNA, 483 bp, Gossypium hirsutum
  Clone ID: uC-gsflnu33B061f05b1
ttgccttctgtatctgctcagtcatcccagttcacaaccatcagtgtgaactggtcctccattagtagtcagccaaaagaggtagacaataaggtgaaagatggggagcaaccaaaatctgaagaagtcaagacatcagaaaagacaataccaccttctaaaccaaccggcacacaggaaaaatcaaaaaaacaatggagctgcagcagaccctcttggagatgctcgagccaaggtccaagaggagataacccgtgaatttgccgcagtcatggcgagtggaacattgcgagctagtgaggcagcagcactagcaactaggaaagtgatgcagaaatatggacacttgaatgttgctatgcaacaaagttagaagcaggaaaaagaaaaaaacgatttttttttttgtaagtactgcgtttacctttgggaatctggatctggacaaaaatgaaatcattgtatgataactattcaacttat

SEQ ID NO: 15098 - DNA, 379 bp, Gossypium hirsutum
  Clone ID: uC-gsflnu33B061f06b1
ttcttgtgcgtacgatggctgcagtggctagggttttatcatgggccgcacggctgacggaaccgcaggggcttgcggaagagaagaaaacggccatggctcagaaatattcacttgctcatatgcttcgtcgtccgatgctatgctgattttgcgacgggaaatgagaactcaattatggttccgcactaatgaatggttactccagccggtacacaatttaatggcatttgaacatctcatgttggcttctctattcctgcactatttcattcatagactggaaatttgtatcttgcagcataggactaaccaacacaaaggtgtccaaatgttgcatctgcgcacagagcgaagacttatttttcgcacaatggat

SEQ ID NO: 15099 - DNA, 503 bp, Gossypium hirsutum
  Clone ID: uC-gsflnu33B061f07b1
tcccacgcgtccgcaataattgaagcaagagataaccttggggggggggcggcggagggagaggaacatctctgaaattactttcacttttgccggcgggtgcaaaatgagtgcatcaaggttcatcaaatgtgtcactgttggtgacggtgccgtcggcaagacttgcatgctcatctcctacaccagcaatactttccctactgattatgtgccaactgtctttgacaactttagcgcaaatgtggttgtggacggcaacactgttaatcttggattgtgggatactgctggccaggaagactacaatagattaagacctttgagctatcgtggagcagatgtcttcttgttggcattctctctcattagcaaagccagctacgaaaacgtgtctaagaaatggattccggagttgaggcattatgcacctggtgttccaattattcttgttgggactaagcttgatcttcgggatgataagcagttcttcgtagatcacc

SEQ ID NO: 15100 - DNA, 456 bp, Gossypium hirsutum
  Clone ID: uC-gsflnu33B061f08b1
ttgttgcactactccaaactaaccaaggaaatcggagaaaaagttcagattgtaggagatgatcttttggtcaccaacccaaagagggttgcgaaggctattgccgaaaaaacttgtaatgcccttcttctcaaggtcaatcaaattggatctgttaccgaaagtatcgaagctgtgaaaatgtccaagcaagctggatggggtgtgatggccagccaccgcagtggtgaaacggaggatacttttattgctgatctttcagtcggtttggccacgggccaaattaagaccggagctccatgcaggtctgagcgtttagccaagtacaatcagcttctgcgaattgaggaggagcttggtgcggaaagctgtctatgctggagccagcttccgtgctccagttgcaccctattaagatgcttgtttagatgataatttgctgagactggatgcgtg

SEQ ID NO: 15101 - DNA, 447 bp, Gossypium hirsutum
  unsure (1)..(447): unsure at all n locations
  Clone ID: uC-gsflnu33B061f09b1
tcacgagtgcatcccttaagttattctgggaatggatgtgatttgccaagaaaaatttgaaatggggaaaatagctgtttttgttctatcaactcttcagcaaattgaacctgttgctgggcaagctgctgcacttgttctatgtcacactagagaattagtgtaccagagtttccgagtagtacaactgctgagtcatgttttggtgctgcaatcaaggttcatcggcatcttgtcctgatgagagtgtagtttatgaagctttaaactttgcattgtcgtctgaggtattagaattcctagttcaaaacttagcgatttgtcttttataaaatacctttgcattttcagtgttgtttaggttcgcaaacaaatgttgtatttggactttgtgttagtaaaagacttgctatattntatttatatttatatttaatctaattttta

SEQ ID NO: 15102 - DNA, 497 bp, Gossypium hirsutum
  Clone ID: uC-gsflnu33B061f11b1
attaaaggagttaaaaatggcttgtcctccgactcacaaagtggtaaaaggtgtgcttaagaatggttctgatgactgccttgcgagcttgatgtattcgaattaccaaggtgctccagttacgattaaaaaagattcattacccactccatttgcgcagaatatgctagtcgacggtctgtacggaggcctggtgtatgatgttgttagggctaagtggattattctttggaccactgattgtaaggtggctactaagatcattccgaccgaaaaccatattgtttgggaggatatagtgagcattctttagccctacgacagctctgacaacttgcccttatcatgtgggggtgcattttccgccgaagctcatatacatgcaaatggagatggatctctaaacctgacagcacaaatcatgtggagcggttgcaagtaacctgactctttttgcatcatatattgctccatgcatatctctatcagtttgtgct

SEQ ID NO: 15103 - DNA, 501 bp, Gossypium hirsutum
  Clone ID: uC-gsflnu33B061f12b1
gtaagagctgtcctttttctctctctatattttctcatctccttttccaccgccgttgatctcgatccgtatccccgttttcaaaaaagctccaaaaagatggccaatgctgcatcgggaatggctgtgcatgatgattgcaagttgaagttccaagaacttaaggcaaaaagaacccaccgctttattgttttcaaaatcgaggagaagcagaagcaagttatcgtggagaagcttggtgagccaactgagagctatgaagattttactaaatgtcttcccgctgatgaatgtcgttatgctgtgtacgattttgattttctaacagccgagaacgtcccaaagagcagaatctttttcatcgcatggtctcccgatacatcaaggatcaggagcaaaatgatatatgctagctccaaagacagattcaagcgagaactggatggaatccaagtggaattgcaagcaacagatccaaccgagatgggtcttgatgtcttc

SEQ ID NO: 15104 - DNA, 356 bp, Gossypium hirsutum
  Clone ID: uC-gsflnu33B061g02b1
tttttcggacgcgtgggcggacgcgtgggcggacgcgtgggcgccttcagagcagagtaatttcactgcagttgcggattatcattgttatgtatgtgtgtgtgtatcttgtaatgacaaacatagtattatgtttgttgaatatgttttgctatgtttttgctctttcccctttgtgtcttagattatctttttttgtataccacttcacatcgcaattatgttttggttggaggaaacataaaaagtaatgtctaaggccaacagcagacgcatattcttttattgctattctaaaagtatggcgtccattgttgagctttcaaaaccgactggctaatgagtggcgatgattt

SEQ ID NO: 15105 - DNA, 62 bp, Gossypium hirsutum
  Clone ID: uC-gsflnu33B061g03b1
accatcccacgcattcgatgttatatagcgtcaattgagtcaactacactgagccgagtgtc

SEQ ID NO: 15106 - DNA, 222 bp, Gossypium hirsutum
  Clone ID: uC-gsflnu33B061g04b1
ttcttgcggtgggaggacttccaagcctgttgttattgctgactgtggacagctttgaaaaagggcttattgaattgtgtttccttcataatatctggtctttttaggctccttttttttatgctatgctgcttctatggctactgggttttggtgttctttaagaagttgcttgatgtagctttttcattaactgccataaataagataggctctattttc

SEQ ID NO: 15107 - DNA, 463 bp, Gossypium hirsutum
  Clone ID: uC-gsflnu33B061g07b1
ggtggaccatatcagatggtgatggtgtgtccatcttcggtggtagccatgtttgggttgaccataactccttatcaaactgcaaagacggcttgattgacgctatccatggctccaccgctatcaccatttccaacaattacatgactcaccatgataaagtcatgttattgggacacagtgattcgtatactcaagacaagaacatgcaagtcactattgcctttaatcactttggtgaaggccttgtccaaagaatgccacgatgtagacatgggtatttccacgtggtgaacaatgactatactcattgggaaatgtatgccattggaggaagtgctaacccaacaataaacagccaagggaatagatttactgcacctaacaacagattcagcaaagaggtgaccaaacatgaggatgcaccggagagtgaatggaagagctggaattggagatcgga

SEQ ID NO: 15108 - DNA, 513 bp, Gossypium hirsutum
  unsure (1)..(513): unsure at all n locations
  Clone ID: uC-gsflnu33B061g09b1
tcccacgcgtccgcatgggaatgcttgcctcttatgatcaaagtgttgagttttgcaaggattcgcttggcttaggagaagctgctacggtgctaggtgcaagtactgtttcaggtttctttgctgctgcttgcagtttgccttttgattatgtcaaaacacaaattcagaaaatgcaacctgatgcttcgggaaagtatccatatagcggctctttggactgtgccatgaaaaccctcaaggctggaggaccattcaaattttacaccgggttccctgtatattgtgttaggattgctccgcacgtcatgatgacttggatattcctcaaccagattcagaaggcagagaaaaaaatagggttgtagagcgtggtcacttctcagagacgtggagtaatgctggactaattgattgcgtcaaataaaatcctggtttttgctggttctggctaatcatgcaaattttgaaatacatttcaagtcaatgttgncttattcttctgattaaata

SEQ ID NO: 15109 - DNA, 398 bp, Gossypium hirsutum
  Clone ID: uC-gsflnu33B061g12b1
tcttcacgcgtccgcccacgcgtccgggctacgaaaactcaaagaatcgaaggagaacctcaacccccccttttgggtccgatgtcggcgatggaaaagtgttctccgacacgcgaccaagagatccaaggtatgggcgtgtcagacgcatggagggagcatatgctggtggtggtgcgcgaggcggccattggttggccgagtgtgctgttgaggcttgagggctgctgctgttttctcttctctgcagggggctaggatttgggctttagggtttgtatttaattgggttcggtggtctagtctgggccgggcataattgggcctatacaaggtgtgcttgattgaaaaagttactataatggaggaggaaagaggttctgatgggtgtggtcatg

SEQ ID NO: 15110 - DNA, 444 bp, Gossypium hirsutum
  Clone ID: uC-gsflnu33B061h01b1
gctctggtgaggatgcttgtgttcgagtgtggaaattgaccccgcaatgataaagaccaataaagaaatgccttgatcggttggtggatgtgctgcattttatccgagatatcgtttttgtgagcttggtcggcatcaggtatgcaaattgaaaatctttaataggagttggttgagtttgtgacattaccagcctttctagtgtgtagtgtgtgttgtatggtacctggtatcaagttttcgatctcgagaccattgtttccccatgcaaacaaagatggttctcacttctcacatcacatggttttgcatttaaatgatggcgtgatagggtcgcataatatacttcatttcttatatatctttgagcgtgttaaattatgatgtgtgattgttgtatttgactcttctctttttttccattgcattactgctcaaaatttt

SEQ ID NO: 15111 - DNA, 522 bp, Gossypium hirsutum
  Clone ID: uC-gsflnu33B061h02b1
tacacttcaccttgaaaaagtcaaatttcccagaaaataaaaaactttccagcaaaatgtcaggaagaggaaaaggaggtaaaggtctcggaaaaggaggagccaagaggcatcgtaaggtcctaagggataacatccaaggtatcactaagccggccatccgtcgtttggctcgtcgtggaggagttaagagaatcagtggcttgatctatgaagaaaccagaggagtgttgaagattttcttggagaacgtcattcgcgatgcagtgacttacactgagcacgctagaaggaagaccgtgacggccatggatgttgtttatgctttgaaaaggcaaggccgtactctctatggatttggtggttcaagttttcggattcttgttcgagttatattgtactatgtaatctttgattatcatcaatggacttcgttaagaaaaatctattctcgcttattttgaagctttctatttactcgtttccgacgaaatggttttttacttcgaagtgaaaccatga

SEQ ID NO: 15112 - DNA, 218 bp, Gossypium hirsutum
  Clone ID: uC-gsflnu33B061h03b1
tgcggtgggaggacttccaagcctgttgttattgctgactgtggacagctttgaaaaagggcttattgaattgtgtttccttcataatatctggtctttttaggctccttttttttatgctatgctgcttctatggctactgggttttggtgttttttaagaagttgcttgatgtagctttttcattaactgccataaataagataggctttattttc

SEQ ID NO: 15113 - DNA, 516 bp, Gossypium hirsutum
  Clone ID: uC-gsflnu33B061h04b1
ctcttttcccaacttgtttccctctctcttcataccttttcaaactcttcaaataccagcaaacgatgcccattcccttctgcattatccttctcttctagccttcttttccttcctttttcttttcttgggggtggggtatttcaacaatggcgaaggctgctaatgttgacaaggtgaagcggttaagaggttgggtgcaaaactacgattggggaagatgtggggcggaggcacaggtggcaaggctattggctttgaattccggggccgaggttaagcccgataggccttatgctgagttttggatgggaacacatgactcggggccaagttttttggctgatggctatggagaaggtcaaaatgtgggtttaaaagagtggattcggaagaatccgaatgtgcttggtcataaggttttggaaaaatgggggcccgatcttccttttctcttcaaggtactttcagtggcaaaagccctttcaatacaggctcaatcggataaagaattgg

SEQ ID NO: 15114 - DNA, 510 bp, Gossypium hirsutum
  unsure (1)..(510): unsure at all n locations
  Clone ID: uC-gsflnu33B061h05b1
cttttctctctctatttctcaccacttcatctgcatattgaacagtatgggagaaagcttgatgctctctggttctagacagtgaactattgaaaggagagtttagctctgtctgattttacaatgccagttccccttgcgccatatcccacacctccagcaccctacactcctcctgctgccaatggtgctcaaagccaacttgtgtgttccggttgtcgaaatttattgctctatccagttggagcaacctctgtgtgttgtgctgtttgcaatgcagtaacagcagtgccgcctcccggcacagaaatggcacagttggtttgcggaggctgtcataccttattaatgtacatccgcggagcaacaagcgttcaatgttcgtgttgtcacactgtcaatctggccttggaagcaaatcaggtggcacatgtaaattgtgggaactgcangatgttactaatgtaccagtattgagcgagatccgtaaaatgtgcagtttgcaatttt

SEQ ID NO: 15115 - DNA, 520 bp, Gossypium hirsutum
  unsure (1)..(520): unsure at all n locations
  Clone ID: uC-gsflnu33B061h06b1
cttttctctctctatttctcaccacttcatctgcatattgaacagtatgggagaaagcttgatgctctctggttctagacagtgaactattgaaaggagagtttagctctgtctgattttacaatgccagttccccttgcgccatatcccacacctccagcaccctacactcctcctgctgccaatggtgctcaaagccaacttgtgtgttccggttgtcgaaatttattgctctatccagttggagcaacctctgtgtgttgtgctgtttgcaatgcagtaacagcagtgccgcctcccggcacagaaatggcacagttggtttgcggaggctgtcataccttattaatgtacatccgcggagcaacaagcgttcaatgttcgtgttgtcacactgtcaatctggccttggaagcaaatcaggtggcacatgtaaattgtgggaactgcaggatgttactaatgtaccagtatggagcgagatccgtanaatgtgcagtttgcaattttgtgacatcag

SEQ ID NO: 15116 - DNA, 518 bp, Gossypium hirsutum
  Clone ID: uC-gsflnu33B061h07b1
ttttggttcgagattccttaggattagccaatgacattgtcccagattttgctttcggatgtataaacgtcatctctggtggatcagtaccaccgcaaggactgttgggtttgggtcggggacccatgtcacttatttcacaatccggggccctctactctggtgttttctcatattgtctacccagtttcaagtcctactacttttcgggttctctcaaactcgggccagttggacaacccaagaacattcgaaccaccccactcctaaaaagcccacaccgaccttcactgtactatgttaacctaaccggaataagtgtaggccgggttcaagtccccattgccccggaatacctagcgtttaaccccaacaccggggcagggaccataatagattcgggtacggttgtaacccgattcgtccagcccatttacaaggcaatccgagatgagtttgtgaagcatgtgaaaggtccatttactgccattggagtatttgacacaatgcttgatgct

SEQ ID NO: 15117 - DNA, 243 bp, Gossypium hirsutum
  Clone ID: uC-gsflnu33B061h08b1
ttactaaaataaaaaaaaaaaaaaaaaaggagggatataataaaaaaaacatttattaaaaaagggctgatgggaaaaaggaggctaaggtatatctgatggtggtgccgaggggcattttatggtcctaagggttaacatccaaggggtgactaagccgggcatccggcgtttggctccgcgtggaggagttactgactttagtgggatgggctttattttcccataactgggctgggggat

SEQ ID NO: 15118 - DNA, 524 bp, Gossypium hirsutum
  Clone ID: uC-gsflnu33B061h09b1
tcttgttgttactgcttctcatagacagggacttttgatagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatcgtcaagaaaccctacaccaacgtcaacgaaacccttgaatggaccatcgaacgagacgtgccgacggcgacgttctttatccgagcctacgctttggactccgacgaccacgaggtggcgtacggtcaaaacaccgacgccgagaagaaaaccaatctgtttgaaatccaagccatcaccggccgccatgtttcgctcgatatagcgtcggtttgtttcagtgctttctccgttgtgtcgttgatggggttcttctttatggagaaaagacaggcaaggaaatctcagcagtagtgtgatatat

SEQ ID NO: 15119 - DNA, 500 bp, Gossypium hirsutum
  Clone ID: uC-gsflnu33B061h12b1
ttttctctttttacttctaagttctctcttgagtcaccggagctgctaaaggatggagtccaacggcggcggcgcgtcacctatccgtcgagaaatcgaagctttgaaggaagaaaaagcccggattgagcaaaggatttcggtcctcgaagctcagctccaagaagaagcttcattagcacctcagcagcagcaaaacgacggcgtctgcaatggtttttgtccttcggaaatatcctccgtcgatgccaatctggctcacgggttatcggcggatagtatttaccgttacagccgtcatcttttgcttccttcttttggagtccaagcacaatcaaatcctttgaagtcttcaatattggttgttggagctggaggttggggttcgccggctttattatatcttgcagcttgtggtgttggtcgcttgggtatcgttgatcatgatgttggtgagcttaataatatgcataggcaggttattcacactgaagcataca

SEQ ID NO: 15120 - DNA, 293 bp, Gossypium hirsutum
  Clone ID: uC-gsflnu33B062a01b1
ttgcccacgcgtccggcgatgtgcaatttgactgttccaatttccttttcaatgttcaattaaaaccctagcctcttccttttgcttctattggggggggggaaggaatcatgtattccgatctaatatgctgaagccttcctgcaaataatacgcatccttccaagctctggacggttgaggaccaaaagatgatagaggatgacgaacccgtgagttgcccgacaccttttctgcctcctttattctttacaactttccaggccaggctttcaatttatacccgatccccc

SEQ ID NO: 15121 - DNA, 424 bp, Gossypium hirsutum
  Clone ID: uC-gsflnu33B062a03b1
ttttccacgtttccgccaagattataaattggggatctatttgagtatttgaatagtttagattacaaggtagtgcggggaacaagttcataatgtcgatgggtttaccggtggcggttactgtgaactgcgcggacaacactggggccaagaacctctacatcatctctgtcaaaggaatcaaagggcgtgtgaacaggctcccatcgtcttgtgtcggagacatggtcatgggcaccgtaaaaaaaggaaagcccgatttgaggaaaaaggtgttggccgccgtcatcggccgacaacgcaaaccttggcgtagaaaggacggcgtttacatgtactttgaagataatgctggtgttatttgtaatccctagggagaaatgaaaggatctgctattactgggcccattggaaaggagtgtgc

SEQ ID NO: 15122 - DNA, 335 bp, Gossypium hirsutum
  Clone ID: uC-gsflnu33B062a04b1
cccacgcgtccggaaatggcagctacaattgcatcgagatcttcttttcttcgtccaattctccgaacagcaacaacatcgacaaaagcaagaaccaaaatcccattttcagctccaagttcttcacttcgatccaatttcagtcttcatcagacccggatttctcctccctctctttctcggttcgttcgacgagaactcagcactcttcaaccacttcacagtgcggttgcatcggcttgccttgtttccaagcttccttccgatgctaatagttgtgctgaaggtcgatttgctaactatatcagtcccatctagtagcaagcgcttgtaga

SEQ ID NO: 15123 - DNA, 246 bp, Gossypium hirsutum
  Clone ID: uC-gsflnu33B062a05b1
tgtcgtcttcttttccaaacaatcaaaagattcagaacccactcttttcgaccatggcagtatcaacattctcttttgctttgagccttgccattttctcaatctgggccgatgatgcagctcaccaccatgcgacagcgccgaacccttcttcgtcttcttgctcctcctcttactacactggggactgctcgactctgatactggacatggcggattgattggcgatcgcgacaagagggagcg

SEQ ID NO: 15124 - DNA, 434 bp, Gossypium hirsutum
  Clone ID: uC-gsflnu33B062a08b1
cccacgcgtccgccaagattataaatttagtatcgatttgagtatttgaatagtttagattacaaggtagtgcggggaacaagttcagaatgtcgctgggtttaccggtggcggctacggtgaactgcgcggacaacactggggccaagaacctctacatcatctctgtcaaaggaatcaaagggcgtctcaacaggctcccatcggcttgtgtcggtgacatggtcatggccaccgtaaaaaaaggaaagcccgatttgaggaagaaggtgttgcccgccgtcatcgtccgacaacgcaaaccttggcgtagaaaggacggcgtctacatgtacttcgaagataatgctggtgtcattgtcaatcccaagggagaaatgaaaggatctgctatcactggtcccattggaaaggagtgtgctgacctgtggcct

SEQ ID NO: 15125 - DNA, 468 bp, Gossypium hirsutum
  Clone ID: uC-gsflnu33B062a09b1
gttcacgttcgggatcgcgttcggatcaaggcaatcttttttcttcgacagttcgtttcagttgtctccttgcgaccgccgcctctctctctccaactccaattctcctgtcgctctctttagacctaaagttgacgagatatctctcctcaccatcaacgggtcttccttctctccggactccgttggtgggtatatggttgcattttctggtcgaaaatacgctgcaaggtccctgcccgcttttgtcgcaaacagttcatacactgtaacaagcttcactcttgtgcttgagtttaagaaaggaaggttgcaaaacttgttttggaaaagggatgggatgtgctcaatgctcaggaaattcaattttgtgtgtttaaacaagcaaaactgtgcaatcaacacgagcagctgcaaaaaccatggagggtctgtcgattgcagtctcgggatacagctagcattttt

SEQ ID NO: 15126 - DNA, 334 bp, Gossypium hirsutum
  unsure (1)..(334): unsure at all n locations
  Clone ID: uC-gsflnu33B062a11b1
gaaaaagttgcaggttacggtgggttaattacctgcaccctggcctcaaaacgggaaagatgactccccatgaagagcgcctcgtccttgaacttcatgccaaatggggaaacaggcggtcgagaattgctcgaaaattaccagggcgtactgacaacgagattaagaactattggagaacccatatgagaaaaacggctcaagaaaagaaacgggccatccccatctcaccatatctatgatcttcaaactgacagtcatcatcatcaactgttactgcagncgattccttgccctcctctggtactggaaatattgtaagctttttatgaca

SEQ ID NO: 15127 - DNA, 511 bp, Gossypium hirsutum
  unsure (1)..(511): unsure at all n locations
  Clone ID: uC-gsflnu33B062b01b1
cccacgcgtccgcacgcacttaacaaatggaacatggcacagggtctagctgagctcatcctgcccggtccgttactcaggtaggaaatcactcgctgtctcttacagatcatgtgcaaacccggtcttttcccctgcgtttctcccaaagtccacttcacataattccagcttcattaaacagttaagtctcactccagtcataacgaacaatagaatccagaaaagacacagcaaattaactgtcaaagcggcggcatcaactccagccgccgtaactccgccgtcccagcaaccatggcaaggtgcagcattaaagccattgatagcctcgattgctacaggtgtcattctctggttccttcccgtccatccggtgtctctcgtaacgcttggcaggtactttccattttcctcgccacaatcgtcggcatcatcactcaaccattaccactcggagctgtggctttacttggactaggcgcttncgtnctcaccaaaaccctaacct

SEQ ID NO: 15128 - DNA, 490 bp, Gossypium hirsutum
  unsure (1)..(490): unsure at all n locations
  Clone ID: uC-gsflnu33B062b02b1
aaaaaaaaagttatcatacaaagatgtgtaacaacatgacttggagcccatctcatcccatcttagtttcttcaaagagaaggcatagatcaaaacaaagtaaagttcaaatctacaggctttccaggaaaaggtgtgaagaagaagatgtgaagaaagacatggaactaatgaacttgaagctgtatttggagaatcgaagcattatagaagagaatgagaagttaagggagagagctaatcttctacatcaagagaacttggctttaatgtctgagcttcaaaacaagtttcctcatttggatcgtttttccactacccttttggttcttctgcaaaaacactgatatgaggtttcaagaaacaacaatccgaaccctcttctctatctactatatatataccctnttagtctcttaaagcttccttgcctttttttgatgatgtctgttagcaatctggaaattggagctatgacgtttggtttaac

SEQ ID NO: 15129 - DNA, 513 bp, Gossypium hirsutum
  unsure (1)..(513): unsure at all n locations
  Clone ID: uC-gsflnu33B062b03b1
accttcacgtctgctcattctccttccctgttgttctcttatttcttgctgtcagttgagttgtttgctacccatttttgacaaagcaagggtctgtaatggcatcacctgaggttggcagagataaatctccatttatgcttcaacccaaatctctgccttctccggtctcaaaatcctcaaaaacaagctcctttaatgctcaaataatcctcagggttttcgctgctgctttcacattggctgccatctgtattatgaccacaagctcccaatccttccctctactcggcttcactattaaagctcactatagcgactcatctgctatgaggtttttacttgtgacagacgctactgtatgcgccttctctgtacttnnngcgctctttggttaccgtttgagccgctcaggatcagatctgaagtattgcttctatctttttcttcatgacatggtgattatggggctggcgacatcaggatgctcggcggcgactgcggtgggatata

SEQ ID NO: 15130 - DNA, 490 bp, Gossypium hirsutum
  Clone ID: uC-gsflnu33B062b07b1
gcgaaaaaaaaagttatcatacagagatgtgtaacaacatgacttggagcctatctcatacgatcttagtggtgatatcagagggtctctttcaagagggagtttgctacgccaaaaaagattacaacttggcaaaacacccagaaatcgatgttccaaatcttcaagtaataaagctgatgcaaagcttcaaatccaaggaatacgttcgtgaaacttttgcttggatgcattattactggtaccttaccaacgatggcattgaatttttaaggacataccttaatctcgcctctgagattgatcctgctactctgaagaagcaaactatgcccggtggtggttcgtccatgggtccttgtgatagccagccacgtggtccgccacgctttggcgacggtgagaggcgattcggtgacagggatggataccgtggaggttcacgaggaggcggagattttcgtgaaagggtggtgcgcctgctgattat

SEQ ID NO: 15131 - DNA, 508 bp, Gossypium hirsutum
  unsure (1)..(508): unsure at all n locations
  Clone ID: uC-gsflnu33B062b09b1
agaaagatgcatatgttggtgatgaagctcaatcaaagagaggtattttgactttgaaataccctattgagcatggtattgtgagcaactgggatgatatggaaaagatttggcatcataccttttataatgagcttcgtgttgccccggaagagcacccagttctccttactgaggctccacttaacccaaaagctaatcgggagaaaatgacccaaattatgttcgagaccttcaatgcccctgctatgtatgtagctatccaggccgtgctctcactttatgccagtgngtcgtacaaccggnattgtgatggactcgggtgatgggtgtcagccacacagtgcctatttacgagggttatgccctcccacatgccattcttcgtcttgacttggctggtcgagacctcactgattacttgatgaaaattctgccgagcgtggatattccttcaccaccacagccgaacgggaaattgtgagagatgttaaggaanagctgtctt

SEQ ID NO: 15132 - DNA, 476 bp, Gossypium hirsutum
  unsure (1)..(476): unsure at all n locations
  Clone ID: uC-gsflnu33B062b10b1
cccacgcgtccgcccacgcgtccggccttttcaaatttattacaagaaattatttcagctttcaaacatatttctcttttgccgcaaaaaccaacttcaacaaaatgcctctcagactcgaaattaagaggaaacttgctcaaaggtcagagagagtaaaatccgtagatctccatccaacggaaccatggattctagcaagtttgtattctggaactgtgtgcatctggaactatcagtcacagaccatggctaagtcatttgaagtcactgagttgccagttaggtcagccaagtttgttgcacgcaaacaatggngttgttgctggagctgatgacatgtttattcgagtatacaattacaacacaatggataaggtcaaagtatttgaggcacacaccgattacattagatgtgtcgctgtccatcctactcttcttatgtgtggcatcatctgatgatatgctcataaagc

SEQ ID NO: 15133 - DNA, 474 bp, Gossypium hirsutum
  Clone ID: uC-gsflnu33B062c01b1
tcgcaattgcagagaactgtcagttgctcagtgatctcgatgtgtccaagtgcacaataaccgactctggaattgcagctcttgctcgttctaatctgatcaatctgcagatcctatctgggtctgggtgcaatctgggctccgacaaaagcctgccatcacttggaaaattgggtcagaccctcttgggggtaaatctacagcagtgcaaggcaatcagcagtggtgcagttgacctgctagtggagcagctatggaggtgtgatatccttttctaaacgatgttgcagtatgggattggcaacaactcgggttttgacccttcgagaagcttcagaatagcctttgttagtattagcagtttgtgtagtttttgggtccatcatctatgggtcttccattgtccaggactcagtccccttttccagggaatacggccattttccttggttcttttttgcagggctttttaca

SEQ ID NO: 15134 - DNA, 374 bp, Gossypium hirsutum
  Clone ID: uC-gsflnu33B062c02b1
aaaaatgtccccgggggaggttttggctgtgcagtttgtcttacctcttctttcggacttggcaattttcaaaagggaaacaaaaatgattatcaaagaaaactaaaggcgggagtggaaacgaaataattgcttttatctttttcattttaaaggtcattatagcatttttaatagatataactgtggtttcaggttttgagtgctccatatcttcaaacctcgccgacaaataatatgcaggcaagcattaaaccggcccaggtacagaaagaagattaattatgccttgaactgctccttacttgggtttacttctcgtgttaaaaacactagtcatccctatttatggaaccgattttagttcgatgtct

SEQ ID NO: 15135 - DNA, 334 bp, Gossypium hirsutum
  Clone ID: uC-gsflnu33B062c06b1
cgaatatgaggatgactatgatgatgaaaatgatagcatgagtgcagacatcgcggcaaacatgatggtggatgtaccgaactcttagtcaagattgaatccagttagtatgcttacagaagagccaaagcaaaaccagtcagctgaagctgaagacggatgggttgtagtttcatcccggaaaaacaaaggtagaaggaattaagctataatttttgttacccatgctccctattcctggtatatacatgttttctatagacatttttggtgctctaattattagtgtttgtaacttttttttaacaatcttatattgaacgaaggttactgt

SEQ ID NO: 15136 - DNA, 375 bp, Gossypium hirsutum
  Clone ID: uC-gsflnu33B062c08b1
tcgaaattactggatctcttcacatgaccatccaaaccgtcgttcttattgaaacccttaccgtcctgggagctgaagaacgctgtgctcttgcaagagtttctgtactcgagatcacgctggagataacgtagctcgagactaacccaatgatgtggttaagaacaggcgggaacacgaggagcttgacgaaatgcagcacgggagctttcgtgtggagcagctctaggcttccggcattgcacgcctgggattaaagaagctcaaggatgctgggctttgacggttgaatctggtgcttataccccaaggaaagatcttctttagatcaaaggaatcagagaagctaaaggtgacaagattatggaagccgct

SEQ ID NO: 15137 - DNA, 506 bp, Gossypium hirsutum
  Clone ID: uC-gsflnu33B062c10b1
ctttcacttataactttacagcttagggaactgaaaaatgaccaacctcgagcttctgatgttgaggaagatcggtaccaagtgctgttaggacggagacagaatttcaaactgcatgcatttgtagctattttatcattcctcgtatttggcttggttcctcctgtcgtctatggcttctcgtttcgcaatagcgatgataaagacttcaagctagcagcaatggccggtgcttctctaatatgcatcattttgcttgcactagggaaaggtcatgttagaaaaccaaaccgagcttatttcccaactgtattttattacctcagccttgggataacggcgtctggcatctcatacgtagttggtcaactgttgaaaaaactcgccgagcagctcggtttgtttgactcgagttcaactgtcagcatgccgtttttggagacgataccaatggagatgggaagggcatcctattgaagttatgggattggatccgaaggaatttg

SEQ ID NO: 15138 - DNA, 423 bp, Gossypium hirsutum
  unsure (1)..(423): unsure at all n locations
  Clone ID: uC-gsflnu33B062c11b1
cccacgcgtccgggatggaggagagtgggcaggcggtggattttaatgccgtgctggataggctgaatgtgcaatcctctggtggtactcagagagggggatggtaaatgccactgcttggttgaatcgaccttgaatggtacttgaataaaaaaggtgggtttttctaatgtatatgttgggagggatatgagtatttgtatgttacctcctgctagaaattgtatgtgaccctgttgtatcctagtactcgtggtgatgctcttggatttcacacttgaattctagtaaccctttcaccgcaaactgtcttaaagccggctgtcagtttgatagatcaactgctatatttgtcagtccaagctttatttcccttgaaacaatctgttgtgtggataaaaaatggaatttaccngngaaaaa

SEQ ID NO: 15139 - DNA, 466 bp, Gossypium hirsutum
  Clone ID: uC-gsflnu33B062d01b1
attgaatcagttggagcaacttgggccaagtgaaggttatagaggctgttaagaatgtaaacactgcgtagagggttgtaccgtcggaatttggtcatgacatagatagggcgaaaccggtggagccggggctgaccatgtatgagcaaaagagcaagattagggggcagatagaggaatgcgggatcccgtacagatacatatgctggaactccattgctgcttggccctaccatgacaacactcatccagcagatggtctaccaccccttgataggttccaaatctatggtgatggcgctgtcaaagcatactttgtggcgggtttcgatattggaaagagcactgtcatgtccactgatgatgatcgaacactaaacaaaaccgtgcattttcaacctgcaagtaacctattaaacatgaacgaactggcttactatgggagacaaagatcgggcgggtgctg

SEQ ID NO: 15140 - DNA, 445 bp, Gossypium hirsutum
  Clone ID: uC-gsflnu33B062d02b1
acgcccacgcgtccgaccacgcgtccgacgcgagcaaagagtcaacgcttggattaacgcataaacacctcggagaacatggagggggctagagaactaatccggcaatctcactgttcttgcttctacattgactcccaaccgatgtcacacactggaggagaagtcagctcacaaaacatgacccaaacggacgatattggttacgatgcgattttggttcttctctccatggctgttttcattcttggtgtcgtcctcatcatcatcatctgcaggaagaaaccacaaaagcccgatcagaaacaattagagctccccgccaagttttgtgccagctcctatcagttaaccgacatagatgcagcgacagatggctttaaccctagaagggatcgtcgggaaaggccgcttaggtaccgtttatgcagccatatcgccgagc

SEQ ID NO: 15141 - DNA, 114 bp, Gossypium hirsutum
  Clone ID: uC-gsflnu33B062d04b1
tcgaaaaaaaaaaaaaaaaaaaaaaaaaaagtaaaaaataaaaaaaaaaaaaggacggaaaaatatataaagaaaacaggtggcggcctcgtgcttacaacgtatgggcgctgg

SEQ ID NO: 15142 - DNA, 512 bp, Gossypium hirsutum
  unsure (1)..(512): unsure at all n locations
  Clone ID: uC-gsflnu33B062d05b1
cccacgcgtccgcaaaattcagcaaatatggaagccaacaggggccagaacggtattcaacagctgctagctgcagaacaagatgctcagcacattgtcaatgctgcaagaaatgcaaaaatggctagactgaaacaggccaaggaacaggcagagaaagagattgctgaatatcgtgctcaagtagagtatgagttcaagaagaaggtggcggagagtagcggatactcgggggctaatgtgaagcggctcgagactgaaacagatgcaaagatcaatcacttgaaaaacgaagctgcaaggatatctcatgatgttgtacagatgcttttgaagaatgtgacaactgtgaggaactagggggtcttccatgaagactgatggtttaattttctacaacattctatcaattcccaaaactcagagctcatgcttaggaacaatnntatgtcattattttatgatttggtggtatttttggtttgtgccatgttccctgtctgaaataaact

SEQ ID NO: 15143 - DNA, 517 bp, Gossypium hirsutum
  unsure (1)..(517): unsure at all n locations
  Clone ID: uC-gsflnu33B062d06b1
gccacgcggtccgcaacatactagctatggaaacctacaaactcatttctatccttctttccttcgcaattattgcattctccacttctgcaagaatgcttgatgagcaaccctcgaatccggtcgtgccacctgttgctacggccaccccaatagtcccacagcctaatcctactggagccgttgttggcaaccctgntgtggctgcaggtgcagccactggtcctattcccacaggaaccactgttgggaacccaggtgtaggtgctgcagccagtggtcccattcccacaggacccaatgttgccaactctggtgctggtgcagccactgctgaccaccccttgatcttcttcatgcatgatatcctaaggtgggtcaaaccccactgctatagcaatcactgggtgtggtcaacaaccctgcagtcaacggtcaacttgcattccccaaaccaaatggtgctaaccttccggtcaacaatggggtagacgaaaatagcggcaacaatggtttc

SEQ ID NO: 15144 - DNA, 438 bp, Gossypium hirsutum
  Clone ID: uC-gsflnu33B062d07b1
acgcaccacgcgctgccaccactcgtccgatttgagcaaagagtaaacgcttggattaacgcataaaccctagagagaacatagtgggggatagagctctaatcgagtccgtacaatgtttttggtggaagaagacagcggtcgccgtaacctattgcaagagaggtcgcggtctgatcaagatcaacggttgtcccatcgagttagttgagccggggatccttcgtttcaaggccgtggagcctattcttgtcctcggtcgccaacgtttcggcggcgtcgacatgaggattcgagtcaaaggtggaggtcacacatctcagatctacgctatccgtcaaagcattgccaaagccctcggtgctttttaccagagtacgttgacgagcaaagcaagaaggagattaaggatattttggtcaggtacgataggacttg

SEQ ID NO: 15145 - DNA, 186 bp, Gossypium hirsutum
  Clone ID: uC-gsflnu33B062d09b1
ttttacaccgtttttaatttggagagaaactggcggggcgattggagatcttaatgggttcaagggcacaataaccgactctggaattgcgactttttgctcgctctaatgtattgaaactgcagatgcttactggtggcgggtctgcaaagggggatgccaaaaggctggcatggcttggaaaat

SEQ ID NO: 15146 - DNA, 457 bp, Gossypium hirsutum
  Clone ID: uC-gsflnu33B062d11b1
tttcccacttgttcgcaacatactagctttggaaacctacaaactcatttctatccttctttccttcgcaattattgcattctccacttttgcaagaatgcttgatgagcaaccctcgaatcctggtcgaagccactctgctggtaccgggcaccccaaatagtcccacagcctaatcctactggagccgttgcaagtagactatgagtggaagaagaaggtggcactgagtactatgatactcgggggctaatgtgaagcggctcgagactgaaacagatgcaaagatcaatcacttgaaaaacgaagctgcaaggatatctcagtgatgttgcacacacgctttagaacactgtgacaactgttatgcactgatatgctatgtggtgcagaccgcactgctattgcaatcactgcgtgggtcaacaacccctgctgtcaacggatgcttaggaac

SEQ ID NO: 15147 - DNA, 444 bp, Gossypium hirsutum
  Clone ID: uC-gsflnu33B062e01b1
ctgactttctctatttgggtagctatgataacgcctctcgctctgagcttctcaagactcaaggaattactcgcgtccttaataccgtccctgcatgtcaaaacctatacaggaattcatttatctatcactgcctgcaagatgacaaaattttacaatttgatgatgcaatacaatttttagagcaatgtgagaaggataaggctcgagttcttgtgcattgcatgtcaggaaaaaataggtcaccagctatcgtaatagcttacttgatgaggtctaaaggatggaggcttccgcagagctatcaatgggtgaaagaacgtagatcatctgttgagttgagtcaagctgtctatcaacagttgcaagaatatgagcagaagctctttcgatcatctggaagtatcaatccttctttgcctgcattcccaccaacggctggag

SEQ ID NO: 15148 - DNA, 109 bp, Gossypium hirsutum
  Clone ID: uC-gsflnu33B062e02b1
ttttgaacgtttggtttgtaaaacagacaagttgacaaactatatttcaatataaatatagtttggacaagggataatagacttaaagggcctgagcttatggaagaat

SEQ ID NO: 15149 - DNA, 531 bp, Gossypium hirsutum
  Clone ID: uC-gsflnu33B062e03b1
cccggactggcccggtcgacccacgccgacttacgcgtttggttggagcatgtgttggatgaacacaacgcgaggagagaaggggcggaagattatgttgcgaaggacatggcggatgtgcttttgcagctttctgaggaccccaatcttgaggtcaagcttgaaaggcatggtgttaaggcatttactcaggacatgatagctggtggaacagagagttcagccgtgactgtagaatgggcaatctcggagctattgaaaaaacccgaaattttggcaaaggccacggaagaactcgacatggtgatcggcagggagcgatgggtcgaagagaaggatgttgtgagcctaccttacatcgactcgatagccaaggaaacaatgcggttgcacccggtggcaccaatgctagtgcctcgcgtggctcgccaagactgtgaaatagccggttatgacattcccaagggaactagagcctttgttaacgtttggacaattgggagagaccctaacctttgggacaaccccaat

SEQ ID NO: 15150 - DNA, 493 bp, Gossypium hirsutum
  unsure (1)..(493): unsure at all n locations
  Clone ID: uC-gsflnu33B062e04b1
cttacttttatattgccaagctcttttggggtttccccgcttgttcttctcttaattgcgttctatattgaggatggcttgtactaagagaactctggctttccttttgatgctggcttttgtaggagtctctcttggtgcagttcacaaagtgggcgattccaccggctggactagtcttgggaatattgactacctcaagtgggcttccaccaagaatttccatgttggcgactctcttctttttcagtacaaccctcaattccacaacgtgatgcaagtgacccacgacgatttccagtcatgcaacggaacatctgccatcgcctcctacacctctggatccgactccgtaaccctcaaaaggcctggccacttttatttcctttgcggtgttccaggccactgccaagccggccagaagtcgacgtattggtcaatcatcgtccaagccccaatngcagtcctagccatccatttaggtcatcgctgc

SEQ ID NO: 15151 - DNA, 494 bp, Gossypium hirsutum
  Clone ID: uC-gsflnu33B062e07b1
acgcagacgcgtggttgataagactggagacttgctgaattttaccatcctggcaaagagtataatgttcgtgtggcttctcggtactttaaagggcctgagcttctggtagatttgcaggactacgattattccttggacatgtggagccttggttgtatgtttgctggaatgatattccggaaggaaccattcttctatggccatgataactatgatcagctagttaaaatcgccaaggtactagggactgatgagttaaatgcatatttgaacaagtaccatttagagttggatcctcaacttgatgcacttgttggaaggcacagccgtaagccttggtccaaattcattaatgcggataatcagcatcttgtttctccagaggcaattgattttcttgataagttgctgcggtacgatcatcaagacaggctaactgcaagagaagccatggcccatccttacttctctcaagtcagggcagcagaaag

SEQ ID NO: 15152 - DNA, 536 bp, Gossypium hirsutum
  unsure (1)..(536): unsure at all n locations
  Clone ID: uC-gsflnu33B062e08b1
cgtggtgcccctgcccggactggccgggtcgtcccgggcgtacccaaacatgtgatggtttcgaggaaaggcgagctggaaatgaaggatgtaatgtattcagcggttgcccgtcaggacggacagctactatagttctacgcggtggagcagatcagttcattgaagaagctgagaggagcttacatgatgcaattatgattgttagaagagctttgaagaactctactgtagttgctggaggtggtgctatagatatggagataagtcgatacttgaggcagcatgcacgcacaatagctgggaaatctcaactttttattaactcttatgcaaaagcacttgaggttattccacggcagctttgtgacaatgctggatttgatgcaactgatgtgttgaacaaattaaggcacaagcatgcacttccatctggtgagggtgcaccttacggagtggacatcaacactggcgngatagcagattcatttgcaaactttgtgtgggagccatcagttgtaaagatcaatgcaatc

SEQ ID NO: 15153 - DNA, 465 bp, Gossypium hirsutum
  unsure (1)..(465): unsure at all n locations
  Clone ID: uC-gsflnu33B062e09b1
actggataagaaggacgaataagggaaagttgaggatgttgatgaggagaaagagaaggaagaaaagaaaaggaagaagattaaggaggtgtcgcacgagtggtctttggtgaacaaacagaagcccatctggatgaggaagcctgaggagattaccaaggaggaatatgctgctttctacaagagccttacaaatgactgggaagagcatttggccgtcaagcacttctcagttgaggggcaacttgagttcaaggctgtcctctttgtccccaagagggctccttttgatctctttgacacaaggaagaagcccaacaacattaagctctatgtgagacgtgtctttatcatggacaactgcgaggagttgattcctgaattcctcagnctttgtaagggttattgtcgactcagaggaccttnctttgaacatctcagagaaatgttgcagcaaaacaagat

SEQ ID NO: 15154 - DNA, 393 bp, Gossypium hirsutum
  Clone ID: uC-gsflnu33B062f01b1
ttggtcgacggagaaggaggcagctacccttcgtggaacgacaagctggtgatggaaatgccgttacagacgcggtttgtaaccctcctagtcaaatgcaaggggtccagaggggaaaaaacggtggggttagcgaggataccggtgatggatttcgtcggagggtattcgccggctacttgtttgcaattcttgagttacaggttaagggatcccaaggggttgaagaatgggattattaatgtttcattgagagtaaaagagcctttgcaggattgttcttcacaggctgcggctgctggtgtgtggtaatgcggcgacgatagggatggggaattcccattgatggacgaagagattatggaatggttactgggattacaatatggactg

SEQ ID NO: 15155 - DNA, 354 bp, Gossypium hirsutum
  unsure (1)..(354): unsure at all n locations
  Clone ID: uC-gsflnu33B062f02b1
ccgttatatcttggactaccatcatatcagcacttgcattccatggacttggcacacaagctctcgacgtgttctctcggatggaaatggctcaagttaaaccgaatgatatcactttcatcgcagtcctctctgcttgtgctcatgtaggattggtggacttgggtcgatattatttccatgctatgaaatacaggtacgggattcaacacgagattcagcactatggttgtatgatcgatttacttggtcgagccgggtatctagcagaagcactcaaactagttagtgagatgccgtttcagccaaatgcagcttnttggggggccacttcttgctgcctctaatattcat

SEQ ID NO: 15156 - DNA, 344 bp, Gossypium hirsutum
  Clone ID: uC-gsflnu33B062f04b1
gatccattggaacctggttcccaagcagcagcccatgttgctgagatccgtaagaggaagggattgaaggagcagatgaccccactttctgagtacgaggacaaactgtaaggttgagaataactcagcttctgccgctatattttctgctgcaattttttgttttcggtgtctgtctcttaatgttcttgttagtagttttgggtgccttcacccatactgtcttatcatgcaaggtcatttcagtccttttagacggtttttacaatgtacttcgctctccatctgtgttgttaatttttattgttttgatgaaatgtatttgagtcaacattgatcgtctt

SEQ ID NO: 15157 - DNA, 52 bp, Gossypium hirsutum
  Clone ID: uC-gsflnu33B062f06b1
tcgcggacgcgtccgcccacgcgtccgatacatatcagttttagcttcgctt

SEQ ID NO: 15158 - DNA, 259 bp, Gossypium hirsutum
  Clone ID: uC-gsflnu33B062f07b1
caactatgtaaagttttaaaattgtaactcaactattcaattttgcatttttttcattgccaactggctaacagtgacagcttttaaaattggtataatactaactttaaccttcaagatttataaattgtattaatttagttttgatttttttaaaaaaagtctaaccctcatcatttacacgtgtaatttgttattttttgtaattttgcttttctttgtaccatgttacttaaaaaaaaatgaacgaattaatagg

SEQ ID NO: 15159 - DNA, 473 bp, Gossypium hirsutum
  Clone ID: uC-gsflnu33B062f08b1
acgcccacgcgtccgcccacgcgtccgagacgttccctaacatcccaaaaatccaacccaaagtcacttccttccatcgagctacaaccaaaagaaaaagaatgggaaataaagcctccactgccaaaatcattgaaatgcagtcggcgagtcaggggagagcccaactagaggcctgcaagcaaagtaacaagttgctggtgatagatttctcggcgacctggtgcggaccctgcaaatggatggaaccggtgattgaagaatatgccaacttatatgatgatgttgagttcatcaagatcgatgttgataccttggaggatgtggctcgtcaattcaaagttgaagcaatgccgaccttcgttcttgttaagaaaggcaaagaaatatgcaggctgtgtgggtgctaaaaagactgaactccagaagctcattgagaacacagggttggatattagcttgtttttgggggg

SEQ ID NO: 15160 - DNA, 140 bp, Gossypium hirsutum
  Clone ID: uC-gsflnu33B062f09b1
acgcccgcgcgtgctgtcttttttttgaagggaagctatgataacgcctctcgctctgagcttatcaaaaattaaagggaggtttccgcttcatggtacctggccctggatggttaaacctcatccggaaattatttatg

SEQ ID NO: 15161 - DNA, 508 bp, Gossypium hirsutum
  unsure (1)..(508): unsure at all n locations
  Clone ID: uC-gsflnu33B062f10b1
cccacgcgtccgagaaagcgagagagtgataaatggatttattagcaactgaactgctgggtatgaccttgactaggctcctgctgcaagctttcctctccattaaaaatggaaataaatcaagccaacgcaagctcccgcctggtccacgccggattccaatcttcggcaacctcttcgatcttggggataaaccccacaggtctttggcaaagtttgctcggattcatggccctgctatgagtctcaaactcggcagcttaatcaccgtcgtcgtctcctcggaaacaacggccaaagangatccttcaaaaactaggatcttatattctgcaaccgaaccattgtggatgcagctcgagccagccaacactatgaatttgggctgccatggttgcctgtgtcgccgctttggagaactcttcgcaaagtcagtaatacccatattttctctagtctgaaactcgattccaatgaatacctgcgtcggcacaagattcaacaactg

SEQ ID NO: 15162 - DNA, 508 bp, Gossypium hirsutum
  Clone ID: uC-gsflnu33B062f11b1
gtcttaaccatgttacttaccttatcgagcagaacaaggctcaattggttgttattgctcatgatgtggatcccatagagttggtagtgtggcttccggctttgtgcaggaaaatggaggtcccatattgcattgttaagggaaaatcacgtttgggatcgattgtccacaagaaaactgcttccgtcttgtgtttgaccacggttaagaacgaggataagctggaattcagcaaagtactcgaggcaatcaaggcaaacttcaatgacaagtacgacgagtacaggaagaagtggggtggcggcatcatgggctccaagtcacaagcccgaaccaaagcgaaggagaagcttcttgcaaaggaagctgcacagaggatgacatagaggaattaatagaccttttgccgcatttcgtgtttttgatttaatagtcttttgtagtaaggtacgatcgattttcgactcgggtttactctcttttccggaggacattatatacttttggg

SEQ ID NO: 15163 - DNA, 471 bp, Gossypium hirsutum
  Clone ID: uC-gsflnu33B062f12b1
tcggaccgatttaaattttaaaatttctttcacaatttgaattttttaaataattttttactaataaataataagttgattttatataattcatgctaaatgatttttttattctaattgagattcatggattttatattaacatttatgcaaataatatatttagtatattacaaataattagattccactaacacatttttatctatgtgtaatttagaaaagtgtatatatatatcatataataatttaagaaaatatttttatcaaataaaatattgaattacaaaatatattaaaaattataaaaaatttcaacgtattcataatcttcatcatctacgccaatgtatacaaaaattcaaaaataattttaatatattctaattaatacatacaactaaactcatgtatcggcaggtaagaaaactcgaatatcatatagaagataccgaagacatgtatgaagac

SEQ ID NO: 15164 - DNA, 66 bp, Gossypium hirsutum
  Clone ID: uC-gsflnu33B062g01b1
cccgtaccgccccggactacccacgccgtttcacgcgtttttccacgcttacccaagggggaagtt

SEQ ID NO: 15165 - DNA, 389 bp, Gossypium hirsutum
  Clone ID: uC-gsflnu33B062g02b1
tttaccacgcgtgcgtccacgcgtactgttgaagcctgagtagctggtcaacagctttaagaccactgatggtcgaggggtgattgtacatattgagaatggtgcatgtatcacaattgcactaccctaccaatgtgattgtttatggtcttcatattcatgacttgaagcgcactggcaatgccatggttagaagctgacccactcactctgggatggggacaatggctgatggggatgcaatctctatctttaggtgaggccacgttcgagtttggtcacaagtctctttctaattgggccgatggtcaggttgtagcttacatgggctcaactgccattaccatttccaacaatcaaccttacccatcacaatggggtgatgttgc

SEQ ID NO: 15166 - DNA, 403 bp, Gossypium hirsutum
  Clone ID: uC-gsflnu33B062g03b1
tttcacctccccaccttgaacgcaaccctacatttcacctacaatgccaccaactcttccctttccatagccttctcagcacctccggctaaagccggcggctggattgcttgggccgtcaaccccacggggacaggcatggcaggttcacaagccctcctggctttcagaaacactggatctatggttgttaaaacctacaacataagctcctacagttccattgtggcagggaagctttctttcgatgtttgggacttggcagccggagccggcagccatgggaagatggttttatatggctcattgaaagtggaggaaagtgcgtactaaattgaaccaggtgtggcaagttgggccagggatcgctggtggtcacccgatgaagcatgagtttgataaa

SEQ ID NO: 15167 - DNA, 455 bp, Gossypium hirsutum
  unsure (1)..(455): unsure at all n locations
  Clone ID: uC-gsflnu33B062g04b1
gttttatagggattctctttgaaaaacaatggttggccatgaagctgtggaggttgccaagacggttctcgaagtggccgacgtcgcttggaccgccatggaatgttgtcaccacctccaccaccgtcacaaccccgacgatgattctcctgaaaatcatgacgctttcaaactcgaaaaagaattggaaaccctaaaatgcgaaaatcaacgtctcaggaatcttctggaacagaacctcaaactcctcaacaatctctctgaatctcctgtttatttaaacgactgtcctcctgacctctatgctcggttggtatctaccgtggaatctaaagactttttgctccgactcaaatctcttaacggatccaatactanaatcgagtttccattcaaggaagctacaggggatgataagcattctgctgaaattctgattaatgttaaccaaaatg

SEQ ID NO: 15168 - DNA, 507 bp, Gossypium hirsutum
  Clone ID: uC-gsflnu33B062g05b1
tcgctttttgagctttcgaggttgtctattagaattctttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctctgtcttgtgtaatagaaagctttgttgtggtgaaaataatgtataagccatttggttgggagcaaattttccttttgtccaaaggatt

SEQ ID NO: 15169 - DNA, 412 bp, Gossypium hirsutum
  Clone ID: uC-gsflnu33B062g06b1
ttgctgctacactctgatgtggtaagtgtcatcgaaagatcaaatctggatgcctgtcaaaatgaacgagcgctgatgtatccaagcagatccagcacatggtgagattcatccgccaggaagcggaggaaaaggctaacgagatctctgtttccgctgaagaggagttcaacatcgagaagcttcaattggtggaagcggataagaagaagattaggcaggagtacgagaagaaggagaagcaagttgaaatccgaaagaaaattgagtattcgatgcagcttaatgcatctaggatcaaggtccttcaggctcaagatgatgtggttaatgcaatgaaagaatcagcatccaaggaccttctcaatgtgagccatgatcaccatgtttacaaaaggcttttgaaagatct

SEQ ID NO: 15170 - DNA, 383 bp, Gossypium hirsutum
  unsure (1)..(383): unsure at all n locations
  Clone ID: uC-gsflnu33B062g07b1
ttgccttcctttatccaccatcactggagtgtttggaatgaatgttggtggtgttccatggaccgtgcaaaaggaccctgcattgaaagacggattccgaaacgtcatggtactatgtttagcgatgctgattctagtgctgctatgctttatttttccggctctttattcccgattgtacgcctggcgtcagagacggtctttgctgaaaatactggtcgtataaccggaagatcgttcctcaggagaagtgtaggaattcaagaanagtggcagcggtcggataccttaagatttgatgagtttgaagaaagtcgatgatatcatcgtatttgtcatcggattaaaggctaatcggatgttcaactgtttggcgatcatgt

SEQ ID NO: 15171 - DNA, 480 bp, Gossypium hirsutum
  Clone ID: uC-gsflnu33B062g11b1
tgcttttttacagtagaacaatgatgggttcgagaatcaaaatctcagctctgggtgttactatgcttctgctgttgattgccccaacttccaacgctgccatttcgtgcagtgttgcgataaaggacctgaggccttgcgtgaactatcttacgaaggggagcggaaaaccaccgtccgcttgttgtgcgggagcctccgctctggcatccgccacctcgtcgtctgccgacaataaggctgcttgtgaatgcatcaaatgagcgtctaagaatattaaacccaataaccagttagctcaggctcttccttctaattgtggaatcactttgcccgtcaccatttcaccaaatgttcgattgttccaaggtttggttgagagctttgcatgctgaacactgggagtgtttggatgggcatgaagtaattaaaaaactccattgtagaagctcaattgttatgcttatcaataaactggaa

SEQ ID NO: 15172 - DNA, 318 bp, Gossypium hirsutum
  Clone ID: uC-gsflnu33B062h01b1
atcagcttttgccattctgatctttggccaggatttgccagatgggaattaccaaaggctgcaaaattcagggaataaacagaaagataaattctctcgcgtgttctaccatgggatcacaaattacagaggatggatcttggccttgacttatggatattgtttcggggtgggagttgacagtggacaacatcattgccgagtacttttacgaccggttcaatctgaaactccatacagcaggaattattgcggcaagctttgggttagcaaatctagtttcacgacctgcaggaggggtgctgtctgatatgaggc

SEQ ID NO: 15173 - DNA, 496 bp, Gossypium hirsutum
  Clone ID: uC-gsflnu33B062h04b1
tgctgagtgggctgcacattgtcacaagaaaggcatccttgatcagatcatggatccttatctcaaaggaaagatagcaccagaatgcttcaaaaagtttgccgagaccgcaatgaagtgcgtggccgaccagggtatcgacaggccatcgatgggtgatgtgctgtggaacttggaatttgctttacagctgcaagagagtgcagaagagagtggcaagggaatcgatgcaatagatatcgaggaaggaacctacgacataacctgtaaaggcaagaaagatgtatcccctggttttgatggtactgtaacagattcaaggagtagtgggatgagtacaagtatgagcatgagcatcggtggtcgcagcctcgctagtgaagactccgacgggttaacacccagtgctattttctcacagataatgaaccctaaggggcgttaaagcgacggcaaatggccagaactgagtagccaacagatcaaaaccagtaag

SEQ ID NO: 15174 - DNA, 435 bp, Gossypium hirsutum
  unsure (1)..(435): unsure at all n locations
  Clone ID: uC-gsflnu33B062h05b1
gctttcttctctttcttctcaatattttcctctgtggagaacccatccccctcctttagggtttagcagttaaaaagagaaaagcaaaagtatggcgaccgccactgtccccgctgccgcaaggcagctttctcctaaggaagccgacatccaaatgatgttggccgccgaagtccatctcggtaccaaaaactgtgacttccaaatggagcgttacgtcttcaagcgtcgcaatgacggaatctacatcatcaaccttggcaagacctgggagaaacttcaacttgctgcttcgtgttattgttgccatcgagaaccctcaggacatcattgtccaatctgcaaggccatatggtcagagagctgtactgaagtttgcacaaacactnggttgtcatgcaattgctggaaggcacactcctggtaccttcacta

SEQ ID NO: 15175 - DNA, 297 bp, Gossypium hirsutum
  Clone ID: uC-gsflnu33B062h06b1
ttgatcagttgcaggggtctgctagactcagcctgattggattgccattgccttctccaacaagaatgcatctactcaaatgttgaggctccctgcttgaaacgtatgcagctctcattgttggcgcatatactgctcacgcttgtaattaggtgggagttaaaaactgtagaatcagtgctattggctgataagtatgttagtactttgtaagaccagctttaatctacaattatttgttaggtccttacaacaaatctgagactcgaatgcatagttggacttagatgtggaaaa

SEQ ID NO: 15176 - DNA, 365 bp, Gossypium hirsutum
  Clone ID: uC-gsflnu33B062h07b1
ttgaaggctttgcagctcatttacagtagcaaacaaagcaaaaccaaagggggtttgattgccggaacggcgactaccaatgtctttcgcaattcacagttcaagaacacaatgaaagcaatgcagtcacagtgttgcagccctgatgaagtgatatttggtcctgatttccaccaatccttgtactgccatctcttgtgtgggctgattttccgcaaagaaattcagttcatttcatccaccttttcccatagcattgttcatgcttttcgaaccttcgagcaagtttgggaagagctttgtgctgatataagggaaggggtattgacaagccggatcaacgttccttcggtccgatcagcgat

SEQ ID NO: 15177 - DNA, 329 bp, Gossypium hirsutum
  Clone ID: uC-gsflnu33B062h08b1
tcaaaatcttaaacccagatttgttctctctctctctgtctctctatttccaatcaattaattcctccattggaggagcttagggtttgttggtgatctggactttgctttgtctgaaaaataaacagaattataaacgaacaccaacgccatgggaagatttgaagagagaggattcgattcagtggtttgccctaagcctatccgaacctttagatggactaccaacagctgttatcagactgagatggctgattcaaaaactggcgcagagcttcttgatataatccttcccgagggagggtatggggccgagaatcccaccaacc

SEQ ID NO: 15178 - DNA, 208 bp, Gossypium hirsutum
  Clone ID: uC-gsflnu33B062h09b1
tcgcccacgcgtccgaactcgggaggaagcgttctagttgatcgaggattacgatggcttgcctgctacgctatggccatcttatagagtcttgaagatgctattcgatgtaccctttgctacaaaaccgtgacttggaaaaccctacgtagatcaaactcagtctgattgcgagacatttacgaattgtctggtaactttataggca

SEQ ID NO: 15179 - DNA, 342 bp, Gossypium hirsutum
  Clone ID: uC-gsflnu33B062h10b1
tgtgaagccatgtgcatagatggaactaagcgcctttgccatattcgaggaaagatgcacaagaaggcttggattgccgctggagatataatatttgctgggcttaccgactatgaagatgatagaggctgatgcgagccttaagtgcatgcgcgatgaagcaaggctcttaagggcatactgtgagcttccagagaacactcgtcttaatgaaggtattgtcgatgaggaagatgaacgaggtgcagatgattacattgagttcgaagacgaagatatcgataaaaatagggttttggaattggttttgtttgaatgatttgcttaaatgttggaagagag

SEQ ID NO: 15180 - DNA, 384 bp, Gossypium hirsutum
  Clone ID: uC-gsflnu33B062h11b1
tttcggatatttaggtcctcttgttgtgaaaaaatggcagggctgccttcaatcgtcaatagtgttgtgttagctatcagcagctgaggagcaccaaagactttgacatttgttgtatttggagtttgcatatttggtaactaaaaaggatcattgaatccatagctaaaatagtgctttttggcaatgttaaaacgggaattttattttatttcgctgattctttgaagagtgttccactcagacatctattagaagttccttcgctcgataataaaggttatccttaagagttgtaaatgaacattacgttcggttcaatgagtagttttgtttttgtccatttatcaaattaaattaataataacaaaatttgaaggctta

SEQ ID NO: 15181 - DNA, 443 bp, Gossypium hirsutum
  Clone ID: uC-gsflnu33B062h12b1
ttcccacgtttccgattactgactcgctttgaagcacggaagccaatggcaaaacttgtggcggcgtccttactggctttcattggcatctccatgcttgaagcgatgggcttggcatcccacggacatggaggtcatcattatgatcaaaaacattacggcccttgaagcctcaagagttaccaatgtccattacagtgctcgaggagatgcagcaaaacccaataccataaaccatgcatgttcttctgtcagaaatgctgcaacaaatgcctctgtgtgccccctggctattatgggaacaaagctgattgcccttgctacaacaattggaagaccaaagaaggaggacccaagtgcccttaaaaattcttatttcataatttatgcctaatgcttacattgttattattaccgactgttttttttttttggaaatgtga

SEQ ID NO: 15182 - DNA, 194 bp, Gossypium hirsutum
  Clone ID: uC-gsflnu33B063a01b1
ttctcgcgtccgcccacgcgtccggaagcccgtggcctgaccggaggcaccgagggttcggctaactgaaccgggcagcacgtcgccgccgtaagacagcggtaaacaaggcgaaacgggcggccgatgctgtatgctggccgcccttttttcaaaaaataaaaaaaaaaaaaaaaaaaaccatagttaggaat

SEQ ID NO: 15183 - DNA, 316 bp, Gossypium hirsutum
  Clone ID: uC-gsflnu33B063a03b1
tttttaggtatggaaaacctgaaagggcgaatgaggatatgtggacacggtccacagaatgggcccaggatgctggtgttcagaccctttagatggccaggatccaatgaattgccaccttacgctgggaccaacgatatcggtgtctatgatgactgcatggtaattggttcactccacacggacttcgcccacatgttctaccatggccgtactgacagagtacattacgttacctatggcaacgacgtagttgaggccaacacgcaggttggaggcgggcttattgggattcagatcgatggctcacatgaac

SEQ ID NO: 15184 - DNA, 482 bp, Gossypium hirsutum
  unsure (1)..(482): unsure at all n locations
  Clone ID: uC-gsflnu33B063a04b1
tttctctttttccgacgaccacactcaaagatttgtttcttttaatccattacccaacgaagcagctcatccgccgtctctcccgcgtcgccgatgcttcctcccagtatagccttctcagttccgacaccgactccacgcgccatcgcatcacgcgtcgggctgaatctttccgtatcgcggtcgcttccttgaaaaagccggtgcgccgttctgtccccgacggtcacgtgccggtctacgtgggggaagagaggacgcggttcctggtgaacgcagagttgctgaaccacccggtttttgttagcttgcttaataaatcggctcaggagcacgggtatgaccaaaaagggagtctttatattccgagccacgttctggttgttgaacgggttatggatgcgttgagactggtggctgacctacgtgaccctcaggacctnctttgttcttcttcgaccactggtttctcgatttataag

SEQ ID NO: 15185 - DNA, 305 bp, Gossypium hirsutum
  Clone ID: uC-gsflnu33B063a06b1
ttctttctccctagaagaacactacacgagtgggtttgtactgcaaaaggagatcgatttcaaagccttttcaccatgagagctaagcggtagaagaagcgtatgaggcggctgaagaggaggagctgacagatgaggcatggacctaagtccttcaattgtatcttccagcacgcaatgtgatctatgttgctttagatatcctgttgcttgacggatactttactatataaggatttaagttatctatatcgtaacctttgtgatcttctggacacttgctatttcgtattaacaacttatgg

SEQ ID NO: 15186 - DNA, 526 bp, Gossypium hirsutum
  Clone ID: uC-gsflnu33B063a09b1
tttttatagaagatcatacaagtttattagacaaagaagtgaacaagcaaatatgaagggttgtaaaaggttcgtgttgattgctgttggaggtcttggatcttgggatgagccactgaattctggtgaaatctatgattctttatcaaataaatggagtgaaatccagaagctgcctatagactttggggtcgtttgtgctggtgttgtttgtaatgggatgttttatgtttgctctgagaatgacaagttagcgggctatgacatagaaagaggtttctggattggaatccaaacctctgcatttcctccccacgttcatgagtactatccaaaacttgtttcttgtaatggttccttgtttctgctgtctgtctcttggtgcgagggagatgggcatattggtcggagaaacaaggccgtgagaaaattgtgggagctagatctgatgtatcttacatggaccgaggtctcagtacaccctgatgcttcaatgactggaaccctgtttttgttgctgacagga

SEQ ID NO: 15187 - DNA, 295 bp, Gossypium hirsutum
  Clone ID: uC-gsflnu33B063a12b1
tcctctcacgcgtgcgaaaaaaaaaacaagggtgggtttactgaaaaagagagatggattacaaaaaccaattattttgataggggggggtcgtccttaaggacccaagcttgctacgcgggcttgcagactgatttctcttttattggggcacctaattttaatttactggccggcattttacaccatgttgactgggaaatcctggaggttgcccgattttttacgccttgaaggactttcgccttctgtctgctggcgttatagctatttaggccctccccgttttttcctt

SEQ ID NO: 15188 - DNA, 499 bp, Gossypium hirsutum
  Clone ID: uC-gsflnu33B063b01b1
ttctcgcgtccgcctcactccgccatcttcaataatttcttccgttgatctttgttagagattagctttttaatttttcattatgggaaagatcaagatcggaatcaatggatttggaaggatcgggcgtttggttgctagagttgctctccaaagcgatgatattgagctcgttgctgttaacgatcctttcatcaccactgtatacatgacctacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagcctactggtgtttttactgacaaggacaaggctgctgctcacttgaagggtggcgcgaagaaagttatcatttctgctcccagtaaggatgctcccatgtttgttgtgggtgtcaatgag

SEQ ID NO: 15189 - DNA, 207 bp, Gossypium hirsutum
  Clone ID: uC-gsflnu33B063b02b1
ttctcgcgtccgcatggcaagaaaatcccatgtcgaatcgtctgctattactattactatcagtactgatctaagaataaaactggcagctttgtactgtgttttcatttgaatatttgtatgctaggtttgattatgctgttatgagtgggggagcgcagcgttctgtttttatgtaatgaattaaatctactatgtgcttttatt

SEQ ID NO: 15190 - DNA, 550 bp, Gossypium hirsutum
  unsure (1)..(550): unsure at all n locations
  Clone ID: uC-gsflnu33B063b06b1
ttcggttcccctcagtaccccgatgtccacaaggccttcaacaacaaggttgagtttccggatgaagatcagtgcactgagcggtccccaacggcaaactcccgaaagaaggttcaggtggttgagcatgcagagaccgttgatgaagccacccttgattctcaagctgatagctacatccagcagaaacacaaagcctttgaactgtgcaaatggaagaccttcaaaatgcactagagtttgagacttttggagtaagcatgtcgatcatgatttaatgacaggccacgtaacctaaatatatgaagtattgctgctcatacactatttaaataaatgacctgtcactgtcttggggtgctaccaagactcgcgtgntctcttttctctgttttttataagataactaagctcttaaggtagttgcttggatagcagattattgcttttagtgtgcccgattgtagtgctgttaatgaaatatttatgatcctatattagctcccctttaccattattgtaatttaactttttttggcccctaatttat

SEQ ID NO: 15191 - DNA, 520 bp, Gossypium hirsutum
  Clone ID: uC-gsflnu33B063b07b1
tctttcacgcgtccgctgagattgcctaaagatgcaactgaggctccgattttgcctaccgataatttgcctcaagattttgactggagagaaaaaggagctgttacacccgtcaaaaatcagggttcatgcggatcatgctggtcttttagtacaacaggagccttggaaggagctaactttttggcaactgggaaacttgtgagcctcagcgagcaacagctcgtggattgtgatcacgagtgtgatccagaagaagcaggttcatgtgattctggatgcaatggggggttaatgaatagtgcttttgagtataccctcaaagctggtggacttatgcgtgaggaagactacccttacaccggcactgatcgagggacctgcaaatttgacaacaccaaggttgctgccaaggtggccaacttcagtgttgtttctttagatgaagatcaaatcgctgctaatcttttcaagaatggtcctcttgcagtggctatcaatgcggtgttcatgcagacct

SEQ ID NO: 15192 - DNA, 473 bp, Gossypium hirsutum
  Clone ID: uC-gsflnu33B063b08b1
tcgttaaaaagtgaggatcaagcatagatggaaaacatgggagttctaggcaaggcgatggattaccttctattgatatcactcttcagcatcacattaacagctcagttggacatccccgagtccatcctcccccacgcctacaatccgttgtatcaagtgtataccacgttaacccaagattatttggtgcttgagcagcctgctttcttcaaggcacttatgacgttggaacttgttcaccaactccctctcgctttgcttaacatctatgggttgttatactgtaagccctgtttcaacaccacctgcctactctttggtgcctctatcgttgcctctacgacagctatggtgggagacattctcaattcccagaaggcatcagccaatttgatggccatgtattatccaccgcttcttccattaggggttctggctatagtgcgaggggtggttggacaatcgagcaa

SEQ ID NO: 15193 - DNA, 266 bp, Gossypium hirsutum
  Clone ID: uC-gsflnu33B063b09b1
tcttcacgcgtccgcaaggtttagtcaagttaatgcatgtaaaccgctcttaagaggttacgttcaacaagtgtagagttcggatcctggtttttgcaacatcaaggcagagcatggtttcacttcaaatagaaaattacaggttttaagaaaaggtcgccccttgttaatattatgtacatttgctatatgaatgactacgcacgttaatatagaaaagaaaagaacaaaaaaaaagcacaacaagaacattaaaggcttataag

SEQ ID NO: 15194 - DNA, 519 bp, Gossypium hirsutum
  unsure (1)..(519): unsure at all n locations
  Clone ID: uC-gsflnu33B063b10b1
tatatgggtgtgttgaaaaagaagggaaacccagttataacatgaatgagttcttgccttatggtaagattgggcttgaagcttttcaagttttcttgagctatttatatactgggaagcttaaagcttctcccatggaggtttccacttgtgttgatacacactgtgcacatgatgcttgtcgacccgccatcgattttgctgtggaattgatgtatgcttcttctatatttcaaatacctgagatggtttcactttttcagcgacggcttcttaatttcgtggataaggctctcgtagaagacattattccgaccttgtggttgctttccattgtcaatgcagtcagcttgtttctcaatgtgttgatagagtgacaaggtcggatcttgatagcatctccatcgagaaagagcttccttatgaagttgcggagagcattcggttacttcgctgcangccttccactgaagctgaagatggtgaggcagtggttgttcctttgagagagaaacaaat

SEQ ID NO: 15195 - DNA, 455 bp, Gossypium hirsutum
  Clone ID: uC-gsflnu33B063b12b1
tcgttgcattcaccaccaagaaagactacggaaaagaagagagggaagctcaatgggcacttgctcagaggacattacatggacttcaaccaccagaagcttctaacctcttcaatgacaagagtagctacagagagttgtctgagattgccgagcaggccaagaggcgagctgaggtggcaaggcttcgagagcttcacactctgaaagggcatgtggagtcagtggtgaagctgaagggactggacattgatacaatccaacaacattatacagtttagaaagttgctgctgaatgagaaatgcaggtccaagctagagcaagaagaagtaatgttcaagttttaaaattttctacattagtcacaacatgtatgctataattttcctgcccttcccatttagttttttactttgcctgtcttatgtaattcaaggccgaaaaaggtgtttta

SEQ ID NO: 15196 - DNA, 554 bp, Gossypium hirsutum
  Clone ID: uC-gsflnu33B063c01b1
tttctttatagaagcaaaagagcccatctctatatagactacctcaggatctgcaacatcggtacccaaggtactgactttcgctctgaattcctctgggtcaggaatttggagagtgatcactactgaatcaaaatcaaactttggggggaaatggagttttccaagatttttacgatttgtttttctgtattgctgttgtactcctccttggcctatggtcaagcaaggagccctcctccggtcgcaatgagcccaactccagcaccagccccagcaccggcaccggcatatgtaaacctcacttatttactctcagtggctggtccatttcacactttccttgactaccttgagtccactaaagtgattgacacctttcaaaaccaagccaacaacactgatcaagggattacagtttttgtaccaaaagacagtgccttcaagggtcttaggaagccttcattgtccaatctcaatgatgaccagattaaatcacttatcctttaccatgccttgccaatatttacgcccttgcagacttcaatgaactc

SEQ ID NO: 15197 - DNA, 500 bp, Gossypium hirsutum
  Clone ID: uC-gsflnu33B063c02b1
ttatctagctccaaccagggttcaacaagggcactggactgggtgccgagatcattggtacctttgttcttgtctacactgtcttcgccgccactgatcctaagaggaatgcaagagattcccatgttcctgtgttggcaccactccccattggattcgctgtgttcatggttcaccttgccacaattccagtcactggcactggtatcaaccctgctaggagttttggagctgctgtcatttacaacaaagagaaggcctgggatgaccaatggatcttctgggtcggacccttcattggagctgccgcagctgcattctaccaccaatacattctcagagccgcagccatcaaggctcttggatctttcaggagcaatgcttaagtccagctttcattttcttacgaacttcaaccaaaaaagaaatggagaaccttgagttcagtgtggaccattgaaatgtaaataaatatttatgaacaagggtgtcttattttc

SEQ ID NO: 15198 - DNA, 534 bp, Gossypium hirsutum
  unsure (1)..(534): unsure at all n locations
  Clone ID: uC-gsflnu33B063c05b1
tttctcgcgtccgagaacaccagtagtcaaagttctacccaggtttctgggatgcatctcgttgctaacaatggtggagctaacataaataactctcttagtgctgcatctgcatcaacatctgctgttacagtggggcttctaccccagaattccatgaactccaggcagcagaattctatgaataatgcaagcagtccctatggtggaaactttgttcagattgcttcccctggatcatctagtacaattccacaatcacaagcgaatccttctccatttcagtcaccaacgccctcatctaataatcctactcaagttcctcatggtgctttagcagctactagtcacatgaactcagcaaattctcctgtgaatatgcccgtgcagcagacagctctttccagtgaggctgacccaagtgaatcgcaaagctctgttcagaanatcattcatgaaataatgtctggccaactgaatggtaccggaggtatgggtgtgttngcactctaggcaatgatgtgaagagttaaa

SEQ ID NO: 15199 - DNA, 222 bp, Gossypium hirsutum
  Clone ID: uC-gsflnu33B063c06b1
tgcctaggaagaatggggtgtggatggttatgggtcgatgaaagggctgattcggcttcgatcaccagaagctggtcatgatgacgaggaagatgacgatgggggaaatggtgggggttcgagtgatcatcctgtggattcacatgtggaagcggcgaggcattttttctctgagttggggaattatgaaggagaatcttcccttttttgggtttacaaaaa

SEQ ID NO: 15200 - DNA, 122 bp, Gossypium hirsutum
  Clone ID: uC-gsflnu33B063c07b1
tttccgccctttttttttttttttatgaaagcttgaatatacaaaaatattaaaaaatatatcaaacacatctatatccgacattcaaacccgacttatacctaaaacatattgagtgcttc

SEQ ID NO: 15201 - DNA, 394 bp, Gossypium hirsutum
  Clone ID: uC-gsflnu33B063c10b1
tttcacgcgtccgatttgattgctttgtatattgaagtttcctttctcgatcttctatttagccaaacaagatgcagatcttcgctaagactctaaccggcatgacgatcactctcgaggtcgagagctccgatacgatcgacaacgtgaaggccaaaatccaagataaggaaggcatgcctccagaccagcagcgtctgatcttggccggaaaacagctcgaagacggccggaccttggtcgattacaacatccaaatggagtcaactctccacctggtcctccgtctgcgcggtgggatgcaaaccttcgcgaaaacctcgactggcatgacaatcactctcgaggtcgagagctccgacacgatcgacaacgttcaagcgaagatccaaga

SEQ ID NO: 15202 - DNA, 528 bp, Gossypium hirsutum
  Clone ID: uC-gsflnu33B063c11b1
tcccacgcgtccgaaaccatagtacagcaaaaaaaaaaaaaaaacaccctaaagagacaatgagaaagctgctagcctttgcctttcttttcttcttcttttgggataaaacattagctcaaatagctccggcgccgccgataaaggtggacaacatcacttccatcctcgaaaaaggtggccaattcaccactttcatcaagctattgaaagccacacaggtggctgatcaactaaacaaccagctaagcacaccggaccctaacgacgggttaacggtgtttgcgccgagtgacagcgcgttctccggactcaaacccgggacgttaaactcactttccgacaaagagaagcttcagttggttcagttccatatactcccgacgttaatgtcgacgtcccagtttcaaacggcgagtaaccctttgagaacccaagctggggatgttaaaggtgggaaagtttccgcttaatgtaacggcggacggaaaccaagtgaatgtgacgaccggagtggtgaatgcgact

SEQ ID NO: 15203 - DNA, 368 bp, Gossypium hirsutum
  Clone ID: uC-gsflnu33B063c12b1
tccacgcgtccgggaagacaacagaatgtatgaattatttaataaaatgtggtggtgtataatataggcgatgtttacgagtactaagagatgccgtgatcgtcggatcatctttggttgtcatcaacctgttgtttctttaagctaagtgtgcaatcaatattttgtagtggaagttaattatgaatgagaatcttccctttttttggtttaaaaaaaatgtatgataaaaaaagcatcaatttagttgggaggacctaacattactcttaaaactggaagaagatacggtagacggtgctgcaccaatgctgtggaggagtatcttccgtaccacaatgagaccatctctggcgttatcgacaagt

SEQ ID NO: 15204 - DNA, 346 bp, Gossypium hirsutum
  Clone ID: uC-gsflnu33B063d02b1
gcttgtttgtcagcattgcattttgcatgtggatatggcgaggtgaaatgtgcccaagtccttattgaagctggagcaaaaggggatgctttggacaagaatatgaatactgcacttcattatgcacctggttatggaaggaaagactgcgtggcccttttacttgagaacggtgctgctgtcacactccaaaacatggatggaaagactgccatagatgtggccaagctcaacaaccagcatgaggtgcttaagttactggagaaggatgcttatctgtgaagtggaacggcaggaacagccaaagtgtttgtttgcgccctagcatgtgatctaccatttggca

SEQ ID NO: 15205 - DNA, 456 bp, Gossypium hirsutum
  Clone ID: uC-gsflnu33B063d03b1
gcgttctctcatccgtccacgcgttcgcccacgcgtccgtttctttgaagtgatcaaccatggggtgcctttggaattacgccaaagagtcttgaaggtggctaaagcgttcttcgatcttcccatagaggaaaaaaggaaagctaagcgagatgacttgaattttacgggttaccatgatgaataacatactaagaatgttagagactggaaagaggtttttgatatgttaattgaagacccaacatttctcccagcttcgccggatcccgatgatgaggaaataaggacgtacagtaacaaatggcctgagaatccccctgagtttagggagacatgccaggagtactgtatagaggtggagaaactggctttcaaattgctggaactcatatctttaagcttaggtttgcctgctaacccggtgagtgatttctttatacaccaaactggtat

SEQ ID NO: 15206 - DNA, 432 bp, Gossypium hirsutum
  Clone ID: uC-gsflnu33B063d04b1
acttattgtgcacaaaataacctaaacgagataatatgatagacatctaataaacggacgagtgatggatactgtatgttcatcaacatgataactcatttgcaaacatattagcttcagcgctttgcatattgtattgttgtacgactctactcccacttctactgctggttatgatgcgctagatccaactggaactatcactatcaaacgggacgcatgcagatggaccccaaatggctatgtagctgttgttacaatgtacaatctacaacagtagtcgggtattctggcacctggttggacattgtagcgtgacatgggccaaaaaggtagtaatctgcagcatgatgtgaagccataccactgaacaaggtgatcgttcataagacaaaggaaacgtccctgattgctgtcaaaaggatcccacag

SEQ ID NO: 15207 - DNA, 482 bp, Gossypium hirsutum
  Clone ID: uC-gsflnu33B063d06b1
tctctcgcgtccggtcccagcctctttttatgctgggtcggcctttataacctcgccgcctccgagttccgtcccgatgccggtgttttgcaccaagaagatcagcgttaccgtaaagaacgacgacgccacgagcgacttaaggaggatattaaggctcgatttgtagtcatacccagaaattaattcgtgtcagtttctcgttttcatcgtttgggttctctcttatatttcgatcatcccttattttttcaaggggaaagatcgaaacaggagtagattttagcttttcaaatcatgttctttatgttgtatagcgtaacttgggtcttagatttgttgatttgcttggtttagaatgcaaaggtgtgtctgggttttcgtctatcaactcttttcagttttttttttaatttcctcataagaaaatgtaatttctaagttgggaacaaggatatattttgtggggtatcatttgaatt

SEQ ID NO: 15208 - DNA, 539 bp, Gossypium hirsutum
  Clone ID: uC-gsflnu33B063d08b1
ttccaacgaccactgctatggaagtagatgatcctccaagggcccagcagcctactgccattggctctcttgaaaggattgaagcatttaaagctatatttggtcagcatatgcgtgtgaaccataaggataccatatctatttctgaagtagagaatgttgtcaatgccggagctgatggccattactcaagggcagagatctttgctatattagagaagctgcaagatgataatatattgatgatagctggtgaaacagtgcatatgatagtatgagatgtaaggaaagacctggatggcttctttcatgcaatcactttacagcattgtgggattggggatggatctattggcatgaaattcttggtttgtacagctccatgatttatcctaaaattgtcttaaaagtgactgttggctgtactctgtagcagatgaaaggtgaactggggatggatcccctcttgctctgcaaggaagatgcataaatttggatgacatatgataattcactaatgctttatttatttacttgga

SEQ ID NO: 15209 - DNA, 516 bp, Gossypium hirsutum
  Clone ID: uC-gsflnu33B063d09b1
ttttcacgcgtccgggaaaagcgaatgaagttcctgcgatggcgaattcagctcttggagaagagtataaggaagcttgatttcagtcctggtggtgtttccaccattttccaggttagtgatctcaaaaactcgcctggacccgggaaaaaggagcttagattggcaacaaaacaggctcttcaggttcttcaagataattatccagagtttgttgcaaaacaggtgtttattaatgttccttggtggtatctggcattctatacaatgattagtccatttatgacccaaagaactaagagcaagtttgtcattgcactgccatctaaatctgctgaaacacttttcaaatacataccacctgagcaagtgccaattcaatatggcggtttgagtgcggattattgtgattgccatccagaattcagtgatgctgatcctgccactgagatgactgtgaaaccagggacaaagcaaactgtcgaaaaacaatctttgagaaatgtattcttgttg

SEQ ID NO: 15210 - DNA, 531 bp, Gossypium hirsutum
  Clone ID: uC-gsflnu33B063d12b1
tttcttggaaaacatacaacgaaaaagaaaagttggaagagagagagaaaaaatgtttgcatacgatcgcgtaagccactcgagtgccaacaaggcggatgagatagatctagaatcaggggagactttgtacccgggactcagctacggcgagaaccaactccggtggggttttatccgcaaggtttacggcatcttggcagcgcagttggttctaaccaccgtggtatccgccttcgtggttctttcggctccggtcaacgagctccttcgtggaaattctggcctcttgctcttcctctgtttaatccccttcgtcttgttgtggcccttgcatgtctatcaccaaaagcaccctgtgaacttggttatcctcagcctcttcaccgtgtcattgagtctcacagttggtgtgagctgtgcaaataccgatggaagaatcgtgctagatgcgctaattttgacagctgctgtggttgcatctcttactggctacactttctgggcatcgaagaagggcaaggacttcag

SEQ ID NO: 15211 - DNA, 356 bp, Gossypium hirsutum
  Clone ID: uC-gsflnu33B063e01b1
ttctgcagtccggccgaagcggcggcggcggtggtggtggaggatttggaggaaacggtgggtacaaccgtggaggcagtggatatggtggtcgccgtgaaggtggatatggaggtggtggttacggaagtggacgccgtgatggtggtggatacagtgacggtggatctcgttactcaggagaccgctgttcttgggcttatgttaaagcgtgttaggatttgagtgagcttctgctcttattttagggtttaatgggtttgtttgttagtgtgtggcttctatcgatattttttcttgtatcatcaggagttttaaaacataaaagtggaatgaagtatatgccttcttttcaa

SEQ ID NO: 15212 - DNA, 397 bp, Gossypium hirsutum
  Clone ID: uC-gsflnu33B063e04b1
tatttataaaaaaaaaaaaaaaaaaaaaaaaaaaaaaaaaataaaaaaaaaaaagaaaaaaaaaaaaaaaacaaaaaaaacaaaaaaaaagaaagaacaacttcttgggggcggggcggctttgggggccccgcgttccctcccgcgtgctcgcgggatctttttttttttcgggggccccctagattcatccccgggccgtgttttacacccctggggatggggaaaccccggggtttccccccttttttgggtgtggcgccgcccccctttttcccgagggggaattttgtaaaagggccccccccttttcccccttcacaggatttgggccctctgttgggcaaggggccccccccctgctggggcctttttggccgggggggtgggggggtcc

SEQ ID NO: 15213 - DNA, 492 bp, Gossypium hirsutum
  Clone ID: uC-gsflnu33B063e05b1
ttttgccaagagcttggaactgaaaacatcagctatgtccactgcgatataacatgcgaatccgatgttgaaaatgccgtaaacttggctgtctccaagtacggaaagctcgatatcatgttcaacaatgccggcactcatggtgacaacgaaacaagagtgacacacgccagcactgaagacttcaagaaagtgtttgatatcaatgtgttgggtggtttcttgggtgccaagtatgctgccagggtcatggttccggccaagaaaggttgcatactattcacatcaagtcttgcttcaaaaatcagcttcggtagcccccatgcatacaaggcatcgaagcatgccgttgcagggttgacgaagagcttggccgtggagttaggtgagcatggaattagagtcaactctatttcacctcatgcaatttcgactccaatgttccaaaaatcaattgggatacccgataagaagaagggagaggagatgatt

SEQ ID NO: 15214 - DNA, 384 bp, Gossypium hirsutum
  Clone ID: uC-gsflnu33B063e06b1
ttttgaccattggtgccagtttttacaggctcgacataacaaagcgatctctcgggacacatggtctcaacttttggagtttgctagaacggtagaccctgcactatcgaactacgatgccgaaggtgcatggccctatcttatagatgaattcgtggaatacttgaatgagaatggcatcattcaaagtggacagttcaagtgattggggagccataaatgataaaaaaggactgctcagtgccggccacggttgataatatcgcggaatttttgcaatctatcgttagtgcggtccgcattgtgatgccaatgacagaggtaagtgtttgatctttctgaaaaataagatgcaagatacccggtgtgattttattatatatg

SEQ ID NO: 15215 - DNA, 517 bp, Gossypium hirsutum
  Clone ID: uC-gsflnu33B063e08b1
tttggattggaggctcgagtcccattcttagacaagcaattcatcaatgttgccatgtctatagaccctgaatcaaagatggtaagcaatcaatttatttttgtcttggaattgcttggtccactatacatgcttctctatttcatgaatcagataaaaagggatgaaggacgcattgagaagtggattcttaggagggccttcgatgatgaagagcatccctatctgccaaagcatatcctttacagacagaaagaacagtttagtgatggtgtgggttatagttgatagatggtctcaaagcacatgctgaccaacatgtaaccaataagatgatgcgtaacgcatctaacatcttccctcacaacacaccaatgacaaaagaagcttactactacaggatgattttcgagagattcttccctcagaattcggcaagattgaccgtacctggaggagctaccgtagcatgcagcactgctaaagcagttgagtgggatgctgcctggaagaataa

SEQ ID NO: 15216 - DNA, 497 bp, Gossypium hirsutum
  unsure (1)..(497): unsure at all n locations
  Clone ID: uC-gsflnu33B063f02b1
tttgtctcgtgggcggacgcgtgggcggacgcgtgggcttgaaggaagctgatttgaagggaaagaaagtgtttgttagagtcgatctgaacgttccattggatgataacttcaacataactgatgacacatggatccgtgccgctgttcccaccatcaagtatttgatgggtcatggctctaaagtcatcctctctagtcatttgggacgcccaaagggtgtcactcccaagtacagtttgaagcctcttgtgccaaggttatctgaactccttggagtcgaggttaaaatggcaaatgactgtattggtgaagaagttgagaaaatggtggctgcattaccagatggcggtgtattgctgcttgagaatgtgaggttctacaaggaggaagagaagaatgatcctgaattcgcaaagagctagcttctctcgctgatctctatgttaatgatgcatttggcactgcgcacagagcccatgcttncacagagggag

SEQ ID NO: 15217 - DNA, 481 bp, Gossypium hirsutum
  Clone ID: uC-gsflnu33B063f03b1
ttcttcctaatctgcaaccaaatcatggatccaaagctactgttttccactctgactctcctaattacatgtttctgcggttgtggaatcggccaaccttgcccccgtactcgaccatgcccttcaatgttgaccccaccacgccctactagaaccgactcttatgttcgaccccgaacgccactctacgatccttcccttcgtctgttacctcgtcagtgaaacaacaatcccggtcccttagccaatagagccaggattctcgccattacccaagaactcagacgaaacattacctgtgacccttaaaactacacccctacttgggttggcaacaactactgcctgttcaaaggcttcatttgcgacactgtaccaaacctcaacataactggactcgcaggcattgatgttaatggcgcaaggtttggtgagaacttgaatttttatcgttcattcaaaacttgcctgatattgctat

SEQ ID NO: 15218 - DNA, 292 bp, Gossypium hirsutum
  Clone ID: uC-gsflnu33B063f04b1
ttcttacacatcagtggtgctgacgtggaaccatctgggtcctcaacgggtggagtgtgagacaggtcacgaacttgatacgggctaacgagcaccctcacttagtcatgtggtgctcgttcaccgaccagaagatgaggcaaaccatgctcaatgaagcaagtgcacccatttagctccagatgaatgtgtacatgtggccgaagaacctctcagagcatggagctactgtagacctagatcagctagtgactaaccgaaccaaactgaccacagatcatcgatgcctaca

SEQ ID NO: 15219 - DNA, 523 bp, Gossypium hirsutum
  Clone ID: uC-gsflnu33B063f06b1
tctttctttattctgcacatcttaaccttaaccacatcataagatagagatctcttaaacggtcgagttatggagactgtcttttcagcagcaagtagatccatttccaagctcattagcttcaccgctttgcttcttttcttgttttcctgctctactttcacttctactgaagcttatgatgcgcttgatccaactggaaatatcactatcaaatgggacgtaataagttggaccccagatggctatgttgctgttgttacaatgtacaatttccaacagtatcgccatattcaggcacctggttggacattggggtggacatgggccaaaaaggaagtaatctggagcatgatgggaggccaaaccacggaacaaggggattgttcaaaatacaaaggaaacgtccctcattgctgtaaaaaggatcccacagttgtggatttattgcctggaactccttataaccagcagattgcatattgctgcatagggggggtattaaattcatgggttcaagacc

SEQ ID NO: 15220 - DNA, 485 bp, Gossypium hirsutum
  unsure (1)..(485): unsure at all n locations
  Clone ID: uC-gsflnu33B063f11b1
tctttcacgcgtccgcccacgcgtccgggcatttactgctactgtgttatcatgggctatcctcgagtatggagatcagatggcggcagtgaatcaactggaacctgctcaacaatctctcaagtggattactgatttccttataaatgctcatcctaaagacaacgttctctatattcaggtgggtgatcccgacttagatcataaatgttgggaaaggcctgaaaacatgaaagagaagaggcctctcacacaggtgaacataactgttccagggacagaggttgcagctgagactgctgctgctatggcttcagcatctctggtgtttaagacatctaactcggcatactcaagcacacttcttaagcatgccaagcaactttttaatttcgcggacaaatatccagcttcttatagtgagaacantccagaagttgctacatattacaattcaacagggtatggagatgagctcttatggg

SEQ ID NO: 15221 - DNA, 559 bp, Gossypium hirsutum
  Clone ID: uC-gsflnu33B063f12b1
tctaatctcattaaacatgacaggccctccccacaaatgagaaaaaaaatggtctaagtggatctccctgacgaagtcaccttgatggttgaaagctttctcctatgcatctgtttacaactaagtaggagaccgttgtcaaacatttcatcaaaattccgatcactctcttatgaaaccccattcgtgccatcatttcttttataaaattcactcaacccccgtcgtatgctttactcatgtccaacttgactaccataagacctttatttcccacttctcttttgtttaagagtatgaagaatttcatatgcaagtagaatattttctgagatcaatctgcctcgtacaaacgcactttgagccccatcaatgtattgttgatagctcctctgagcttatttgcaattgtttttgctttaattttataaagcacattgcacagactaataggactgaaattcatcatagtagtaggattatcatttctagggataaagattatttgggtcacattaatttgttgaaaatgcatacctttattcagattttgtaatag

SEQ ID NO: 15222 - DNA, 362 bp, Gossypium hirsutum
  Clone ID: uC-gsflnu33B063g01b1
aacactcttcaagcttttcattacagactctttcaagaatttcctgaaagaaaagaagagaaagaagaagaagatgttgctggggaagaggccaaggccacctatgaaaagaaccacaagcatgacagagatcacttttgatctaaacaccaccaccaccaccaacgccgaaccttcaccctctgatccacataacccttttaacaactaccccaaacaggcttcccctttcggtggcgcagcaccttctgtagctgttgctggcggtggtgttggacttgaagggttggatcaacggttgttggcgacggtgtcacctagagttcatagaaggcattcagctgattttatggaaacaccct

SEQ ID NO: 15223 - DNA, 523 bp, Gossypium hirsutum
  Clone ID: uC-gsflnu33B063g04b1
ttcatcccctaaccttcctattcctactcctcctcaccgcctccgttctcgaatcttcgacttcttttgaacccaatatccgcctcccgacaacggcaacgatcgttcctcgatccgacattgatgacgacctttactgtgccagctggcagttagccgtcgagaccagtaacgcaggaagttgggccgcaatcccctcccgctgcgttcccttcgtcagagattatatgaccggtcaacgctacgcttccgactgcgaggtcgtcgctaattactccctcgcttacgcttccaccgtcaagatcgcatccgacggcaaagacgcctgggtcttcgacgtcgacgagactttgttgaccaatttaccctactatcgagatcacgggttcggatcagaaatttttaacgagagctgttgggatgaatgggtggcagaagccaaggccccagctataccatcgaagttgaaattgtataatgggttgaagcagatgaggttcaaaatatttgagcttaccggccg

SEQ ID NO: 15224 - DNA, 557 bp, Gossypium hirsutum
  Clone ID: uC-gsflnu33B063g06b1
ttctctcttggtgtggccattgcaaaaaccttgctcctacctatgaaaaggtagcaacggcatttaaatcggaagaagatgtagtgatagctaatctagatgctgacaaatacagggatctagctgaaaagtatggaataagtgggtttccaacattgaaattcttccctaaaggtaacaaagctggcgaagactatgacggtggcagggatttagatgactttgtttctttcatcaacgagaaatgtgggaccagtcgtgatgcataagggcagttaacttcaacggctggtattttgtcaagtttggatgcattagtgaaggagtttgtggctgcttctgccgacgagaagaaagtagtcttctccaagattgaagaggaagttgagaagctcaagggttctactgcgaggcatggaaagatatacttgaaagctgctaaaagctgtttagagaaaggtgctgactaccccaagaaggaaattgagcggctgcagcgcatgcttgacatgtcaataagcccagcaaaagctgatgaattcacgctcaagaagaca

SEQ ID NO: 15225 - DNA, 417 bp, Gossypium hirsutum
  Clone ID: uC-gsflnu33B063g08b1
tcttgcagcatcggcatggcaggtcattgcaactccgctcccttttcttgcacagcctcgagaaacagagaccccacaccgttatgacgcactcttacccacccgtctcttctgacttgttcaacccccaatcagcttccatccagatagattaaagctctcaacttgcaggtgggataaggcggcttctgctgtagtttctgaagaaggcgcaggcgggtcaagctcttctgggactgatgtattcaacctcacttacctagaggggaatagtcggctgtgggatatcagcggagtgagagaactcaggttaaacttgctcttatgttccgcatactgatagcaagggaagccggcgagttgaataccgctgtcactctcactgaaatgcttcgtgaaataattggaagagagagg

SEQ ID NO: 15226 - DNA, 385 bp, Gossypium hirsutum
  Clone ID: uC-gsflnu33B063g09b1
ttaatgaaaaagacatcttaaaccctatccttgaggttcatactgattccgtagccggaatacaatgaaaaggtacaactataacaagagccatatccacagcggactcatgaacggcaagggaggtacctacattcttaacaacttgttgcgattcacaatacgtgcggtcctaacccccaaagccaaccaaactgttcgtgtgaggatcccattcttcatacctatatgaccctcaaaaccagaacccattgcgatgcttagatgcgtaaatggccaaacatcacatcgaactaaacaaggggaagaaaatgacaccaccatgaccatcaatgaggatgaaagtgaaaccgaagaaggggaatccacatgggaaaacgatgaa

SEQ ID NO: 15227 - DNA, 374 bp, Gossypium hirsutum
  Clone ID: uC-gsflnu33B063g10b1
tctctaagctggtttcaggcatcctttactttgggtacatggtaattgtttcatatgccttctttgtcctaacagggacaatcggattctatgcttgcttctggtttgttcgaaagatctactcttcagtgaaaattgactgagatcaagaatgtagaaaggggatcagacatcaaacctatgcgaattacgggatggacgagacaatgatacagtacagaaaattttatttctgatcgtctctacagtcttcttttattttgctgaatttgcgtgttgtaggcttggcctgttattttatgtacactgttatgtaccgtactgttttaagtagtttctccaatgagtaaaatttgtgatctagtcttgtagat

SEQ ID NO: 15228 - DNA, 548 bp, Gossypium hirsutum
  Clone ID: uC-gsflnu33B063g11b1
tcttccacgcgtccggaagatctggtgaagcacaaagacagaaatgattgttggcttttgatctctggaaaggtgtataatgtaacccaattcttggaggaccatcctggtggagatgaagttttgcttgctgctagtggaaaagatgcgaccgatgatttcgaagacgtaggtcacagtgatgatgcaagagagcagatgcagaagtactatattggtgaggtcgatgccaccaccattcccgtacgaaggacatacaaagcacagacgtcaaccgcggcaactcaacaagacgagcctggctttctgtttaagattatacagttcctggtacccctcttgatcttaggcttcgcattcggtttacagttcttggggaagaaggaaaaaaccgaaacttagataactttcccatcatggaacctgcttgttcgtatgtatgctcgttaaagctgctgctgctgttgttgttgttggtggtgctgtaatgttcgtgacagtctataactgattgctattaataatgtcttagaatgtcgtttcgatct

SEQ ID NO: 15229 - DNA, 538 bp, Gossypium hirsutum
  unsure (1)..(538): unsure at all n locations
  Clone ID: uC-gsflnu33B063g12b1
tcttccataaagagacctatctgtcgtccggcctccgttcaacccaagattaggaccgaaagattcgcctctttctcttctttctagttctccgattagctttctcgaaaggcttactgaaattttgaaaaaatttcacaatctttagaatcttccaagcctcgatctaaaaacccggctgttgaatcatcatggaagttcggtcgtggcttgtcgtcaccgctttcaatgtcttaactactgttcgggttttagaatgatgcttgaacctagagaacctagaaacgcgaaatgggtcttcgtgttgattttttttctcgtcattttctatttgtttggttgcgtgttgtaatggattgatgagttttgtgatttttgttgcgttcatttcagtaaataggtttagttgtgaatggctaaagaaattggttctgggagttgagaggtaatagcagtgggcgatgttattagaaaaaaanatcnnntctncttcctctttcttcacttactcaccccccattcttttatataacccccc

SEQ ID NO: 15230 - DNA, 429 bp, Gossypium hirsutum
  Clone ID: uC-gsflnu33B063h01b1
ttcatctgccataagcgaaatcaaaagccagcagcgctgcagctaaaagagcagtcgtttgacaattattcgccatgggtaaggttcacggatctctagctcgtgctggtaaggtgagaggccaaactcctaaagtggccaagcaagacaagaagaagaagccccgtggccgcgcttacaagcggatgcaatacaaccgccgcttcgtcaccgcagtggttggatttggcaaaaagaggggacctaactcatctgagaagtaagagatctatgtaggtgaaagaaggcaagaagccttgttgaaagctttgatggattttaagtctttgttttcttttgataatgtttttatgatactggtttcaaggattggattgaactaccattctgtttgctagatattatgtgatattgttatcaattatctta

SEQ ID NO: 15231 - DNA, 457 bp, Gossypium hirsutum
  Clone ID: uC-gsflnu33B063h02b1
ttctgttgatgaggaagatgatgaacagggtgccacttgtggctcatgtggggatagctacggcactgacagaattctggatacgctgagatatctgcgagagatggttccatgggacttgcgttcctgaggcacctgcacaggctgtgcatatcactcagtataagtgcccaagttgcagtagcaagcgggctagggtttgaaagtaggtccagaaattggactcacatcctgttgaaacgaagcaggcatggttcatagaatagctgttacggcttggaagtaaaacagagtagcccgttttagttgatgaatgaatgtggctgactgcagctgggattcttaagttttgctactctagcatccactctgtttaatttcattgggaattgcgtttcaaactcatgctggcagctagaaatataccatatatatatatgctgcatttctttggttt

SEQ ID NO: 15232 - DNA, 530 bp, Gossypium hirsutum
  Clone ID: uC-gsflnu33B063h04b1
ttctcgcgtccggcttggtcatgttgactgcgattctgagaagtctctcatgagcaggttcaatgtgcaagggttccctaccatcttagtatttggtgctgacaaagacagcccagttccttatgagggtgctagaaccgcctctgctattgaatcatttgctctagagcaactagaaacaaatgtcggaccggctgaagtgacagagctgactggcccagatgtgatggaagagaaatgtagttcagctgccatatgcttcgttgctttcttgcctgacattctagactcgaaggctgaaggaaggaacaagtacttggatatgttattgtcagttgcagagaaatttaaaaggagtccttacagctatgtttgggctgctgctggtaagcaaccggatctcgagaaccgtgtaggtgttggtggatatggttatccagctcttgtagccttgaacgtcaagaaaggagcatatgctccactcatatgtgcatttgagctcgagcatatcattgagtttgtgaaggaag

SEQ ID NO: 15233 - DNA, 274 bp, Gossypium hirsutum
  Clone ID: uC-gsflnu33B063h05b1
tcttctcgtccgcccacgcgtccgcccacgcgtgcggcgaacaagtaccgcgagggaaagatgaaaaggactcattgggccagacatggtaccaacaagtttgtcactatcaggtagagagctaaaaggatggtatcgacagcgggtctgcatcgcatgtatatatatctcggcctcctgtggagatgtttgttgcctgtgtagtttcatgaattttctcagtcatgattatgtagtaaacacttgaacatgatatttctagccaaccttttta

SEQ ID NO: 15234 - DNA, 499 bp, Gossypium hirsutum
  unsure (1)..(499): unsure at all n locations
  Clone ID: uC-gsflnu33B063h08b1
tctttccttcttcccttccattttactttggtttagttgccataacgtcaccttgcaatacaacccacaatgaggcaacaatatgtcttcactactctgacgttgctcatcctgttttccctcagttgttcaacaacattagcccaatctccggcactggccccggcaccttctggcccgacaaacgtcaccaagatcctcgaaaaagccggtcaattcaccctcttcattcgtcttctaaagtccactcaagtggccaaccagctgctcggtcagctcaacaattccaacaatggtatgaccgtttttgcaccaacggacaatgctttctccagccttaaatcgggcacattgaattcactcaccgatgaacaaaaagtgcagctggtgcaattccacatcgttccaacataccttacctngtctcagttccaaaccattagcaaccctttgagaacccaagctggtgatagtggcgatggcaagttccctctcaatg

SEQ ID NO: 15235 - DNA, 318 bp, Gossypium hirsutum
  Clone ID: uC-gsflnu33B063h09b1
tcttttacacgtacgaaagatgaaaatgagcggcggttgtaacgaatgtgctggcggaagcaaacggtagaaaagaaggaggatgataaaaagaaagaaagtgatcatattgctgagcttgttaaggcttacaaggcccataatgctcacatgactacatattatcgagtcgtaagtgcggaagaaaatcctttttccagttttatcaggtaaatccgctggacttataaaggatgcaacacatcagctgaatgaaatgtaaggagatgctgtatagagagtgaataaattttgatcaatgttttgtagagcttattg

SEQ ID NO: 15236 - DNA, 486 bp, Gossypium hirsutum
  Clone ID: uC-gsflnu33B063h10b1
tcttttttttttttttttttttttttttttttttttttttgattaagttacgtaatttatcatctcttatagtaagaacaaacttatcttccaattctttctcttaatacataaatcaatccataaagctaatgaatgggtaaaaaataggagggtctttattgaataaacccccaaccaaagcaaaaccttctctcctgcctgaccccctttggtgaaaggttaattcacttctttgctgtagctaacttaattcaactcaaacaacactgtctttcctcccttcctcgggcaattttagcaaggcgaaccttaccaatcccgccaacgaaacatattctaaccgtacttgactgtacccaacgcttcacttggctggcttggctgatgaatacccaccaaagttgccccatccttttattttcatgcaaacccttcccacccattcattgctttaattgtcctcccttacattaaaaccactgc

SEQ ID NO: 15237 - DNA, 225 bp, Gossypium hirsutum
  Clone ID: uC-gsflnu33B063h11b1
tcgttcacgcgtccggccactgtgggttttaattggataaaaaagaagtgcagtaaaaatacccagaaataaacaccttggtccatacattatatgaaacaattacttcttttgtttccgttggtttcctttcctttcgtatatgaaacaagaacctgcatgttcatgtctggttctcaattgtattgattaatgatttcatttttaatgtgtataatttgtttt

SEQ ID NO: 15238 - DNA, 331 bp, Gossypium hirsutum
  Clone ID: uC-gsflnu33B064a02b1
tcacgcgtccggcgaaaggttgggtcactggtaattctgatggcgttggctcatgggttacaaccgcgatagactttcagatttcgatttcacacttttgagcaacctccggttagtgcatggagagtctcaatggttcttctttgctgtaattttgttagtctttctttcagtctttgactgagcttttcttttaccaaaaaatgtggtgacgttaaatttttataaatagatgaaccataagtcgtcctcttctagtttaaaaaaaataaaactacactatcttacaactactaattcctatctaaagaacaccaatcctcctaaaacg

SEQ ID NO: 15239 - DNA, 438 bp, Gossypium hirsutum
  unsure (1)..(438): unsure at all n locations
  Clone ID: uC-gsflnu33B064a05b1
tccacgcgtccggcaaaatcttcggcttgcttatcttcgtagtttggaatcattagaccttgttaaacaaatagaagtttcagagttcctcttttcaggagatattgccgctcttatctacctatgtaatcctttcacgatagttgcatgtgtgggcttgtcgacatcaccaattgaaaatatggctgttattctgtgcctttatggagcatgttcacgacttattcccttggcggcttttgggtgggtcattgcaactcatttgtctctttatcctgctattctgataattccggtgatctttttattaggatgtggtccagattctcctcctaggaaattgtttctgcaaaggcaccaacanaaagaagtgttgaatcagtcgaagctcccttcctcgttctcatggggaccagtcattcattttgcattttgggc

SEQ ID NO: 15240 - DNA, 410 bp, Gossypium hirsutum
  Clone ID: uC-gsflnu33B064a06b1
tcacgcgtccgcccacgcgtccggtttgtctattgaattctttccttcactttctctagaaaaagaaaatgtcttcaggttgcaattgcggatctaactgcagctgcggtgacaactgctcatgcagcaggaaccttaaccttggatactcggagaagacaaccagcactcagaccatcatctgcggagttgcgccagtaaagatgacctttgagggaccagagatgagcactactgaatcaggacatggatgcggctgtggatcaaactgcaaatgtaatccatgcaactgctgaaaagcttgatgaaagccatagattatgaaaaaagaaagcagcaaaataacaggcctctgtcatgattattttcaaggatggatgcctgcaaggcctataattatgcctattgtc

SEQ ID NO: 15241 - DNA, 84 bp, Gossypium hirsutum
  Clone ID: uC-gsflnu33B064a07b1
tccacgcgtccgctcctccggtcaaagctgagtgaagatcgcgtgagagggatagtaaggcacgcggtggacatagagagggag

SEQ ID NO: 15242 - DNA, 180 bp, Gossypium hirsutum
  Clone ID: uC-gsflnu33B064a10b1
tccaggcacatctgaagccataatttccaacgtgtctgtgcttcatggtctcaaaatgtgtagccatgcagcagtttaatcatgtatgtacggcggctataatagtattagattagccattagctgattttacattgaagaactgcttggctttgcacttcataatggtggtgagagctt

SEQ ID NO: 15243 - DNA, 379 bp, Gossypium hirsutum
  Clone ID: uC-gsflnu33B064a11b1
tcacgcgtacgccgaagagatgcactaggagtgcctttaggaagctttcactggagacaacgaaacaatcaacgttaagaacgttgctgttaaggatataaaacgtggctttgatgctccaaactacaaggatgatccggccagggaagctgccaacttcacctcacaggttatcatcatgaaccaccctggccaaatcggaaatggttatgccccagaccttgactgccacacctctcacattgctgacaaattttctgagctgatgaccaagattgacagacgatctggcaaggaactcttgaaggaacccaagctctagaagaacggagatgcaagtatggtaaagatgattcccaccaaacccatggtggttgag

SEQ ID NO: 15244 - DNA, 111 bp, Gossypium hirsutum
  Clone ID: uC-gsflnu33B064b02b1
ttgtttatttccagttgaacgtgtaatcattcgtgtttcccgaataagattgaagatcatttgaaattttgaaaaaaaaagcatttgaaggaagaatacaaggagaatgag

SEQ ID NO: 15245 - DNA, 365 bp, Gossypium hirsutum
  Clone ID: uC-gsflnu33B064b08b1
tgtcaggttaaggcaaagcaagtcacattccacaggaagaagaatctgcaatactatgaaatttctgccaagagcaactacaattttgagaagcctttcttgtaccttgccaggaagcttgcaggtgatcctaatcttcacttcgtggagtctcctgcacttgctcctcctgaagtacacattgacttggctgcacagcaacagcatgaggctgagcttgcagcagcagccagtcagccccttccagatgatgatgatgatgcatttgaatagagaggggttttgagttgcctgagaaccattcaacacatttctgctgctttttcattaccacttctcgctagcatgctctctttttcactttt

SEQ ID NO: 15246 - DNA, 468 bp, Gossypium hirsutum
  unsure (1)..(468): unsure at all n locations
  Clone ID: uC-gsflnu33B064b11b1
tcttcatttggaccagccttggttagctggacatgggataaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttgaaaccggattttctccgatctcatttgagtttcctatctctttccttgctttttgtgattaatttgtggcccggcgatcttgtttacttttttttcattccccatcctctattatgatcatcatgcatggcagaatgttgttacaattgcatgccctgaaaaaatagtatatgagtgactcactgtaagtcttttttcttatattattcaaaaccagcatcagggctgttnaacatacatttaggtttcaaattaagggtttacgggaccttcacccc

SEQ ID NO: 15247 - DNA, 391 bp, Gossypium hirsutum
  Clone ID: uC-gsflnu33B064c03b1
tcacgcgttcgattctcaaggacctcaagaaagaattttgttgtaatggcactgttgtccaggacccacaattagggaaggttattcaacttcaaggagatcagaggaagaacgtctccactttcctcgttcaggctggtattgcgaagactgatagaatcacaatccacggttgataagatatagctacgagaggctgcggaagaataaaaacgtctatcatgttctaagacataagagctacccgatcaagtatttgttatattggtaggtggtacatgatcattcatgcttggaactctcccagttacctagatttctttggtagttgctagaggcacctttggtgccttatgtttctgatcagttcgaacatatcccacgcatattt

SEQ ID NO: 15248 - DNA, 73 bp, Gossypium hirsutum
  Clone ID: uC-gsflnu33B064c05b1
tccacgcgtccgataacagcatacatgaaggggccttttggggagctatgaaaggatatgcacgacgaacacg

SEQ ID NO: 15249 - DNA, 385 bp, Gossypium hirsutum
  Clone ID: uC-gsflnu33B064c10b1
tgataattaagatagttgtgtatttagattatgaacatgatatacgtgcgaaattggggtaaatttgcatgttgaatgatgtttatttgtttaaattagttaatggaaaatctgtatagttttttctaaaaaactacaaaatacaaaaaaaagatggcacaataataaaaaaaaagatgaaagcgtaggttcaaagactattggcattaatgtctgacgagtttaggactgaaggcgtcctgcattgaagatgcaagatggggagttctatcagaacataacagccagctattatcctccttgtccgtggccagatttgacgatgggcctgcaatctcattctgatataggtgccataacgcttctaattcacgacaatgttggt

SEQ ID NO: 15250 - DNA, 565 bp, Gossypium hirsutum
  Clone ID: uC-gsflnu33B064c11b1
tccacgcgtccgattttaactataattatatcacctttactttccctttagttgattcgcagtgatgaagatgatcataaagcacgtgcacactcgtattaacatcaaaccaggatccacttgatcatcccaatatcatcatttaattagttcccgttgcagctataatttatcagacaagcaagttcttaaatgggttgattcaaagtttgatgattgattgtgaagaataagtgaagtgaaagcacagaaaataacagcaaacacaacagaaacagcatccgaggccgacgtactttcatgggaaccctgaaatccaagcacctgatggtcttcaaaccctcgtactcatgaaccctgcttatgttcagtactccgacaccactccgccgtcgcagccaaacaccctcgttttttacgctccaccacttccccaaactcaacaatttggtcggtgtcccacttacgggttcttttcaccgtcaaaccaagacccttctttccaccgaaatctcccccttggcatggtccttgtttcacgggttcctatacaacctgggacaac

SEQ ID NO: 15251 - DNA, 330 bp, Gossypium hirsutum
  Clone ID: uC-gsflnu33B064d01b1
tccacgcgtacgctctctcttcatctctctgagcctaatagtctttagctttgcgcttcgagagagaccatgctggtttaccaggatctcatctgcggtgacgagcttttgtctgactcattcccctacaaggaaatcgagaatgggatgctgtgggaagttgagggaaagcgggctaccttctgaggtggtgcctttgagaccactatcccgaccttgcactactagtcagctctggtgttcgaacggtatgcccttgcactgtaaagatggcaaacccagcttacaaagtctacttatcgaaccacatgacaaggacagagcagtctg

SEQ ID NO: 15252 - DNA, 521 bp, Gossypium hirsutum
  Clone ID: uC-gsflnu33B064d02b1
tccactcgtacagcaacacagtttcactggaacgtttgttatccgcaccgctgagtctcctacgaaagctcaaatgtgaaccctggattcccttaccagctctatagatagtgcgttccttcctcctgcggacttgagggacctgcctcaagacgcagagattgaaaccgcgatttctttaacggaggttcgatctctgtcgttcgttcgggatgctttgaagtcgctggctgcaaagacaaaactcgtcggatgggtggttgatctttttgggacagacgcatttgatgtccccggagaattcaacctctcgccgtacatattttaccccttcacggccatggccttgtctttgtttcatgacctgccgaagcttgaccaaatggttttgtgcgagaacaaggagttgcctgaagtgaggattccaggctggatacctattgcggcaaagactgctggacccgtttaagaaaggaaaaacacgttacaatggtgttcatatgcaagaggattaaatggct

SEQ ID NO: 15253 - DNA, 403 bp, Gossypium hirsutum
  Clone ID: uC-gsflnu33B064d03b1
ttcacgcgtccggtcagccacacagtgcctatttacgagggttatgccctcccacatgccattcttcgtcttgacttggctggtcgagacctcactgattacttgatgaaaattctgactgagcgtggatattccttcaccaccacagccgaacgggaaattgtgagagatgttaaggaaaagctgtcttacattgcccttgactatgaacaggagctagagacctcaaaaacaagttcatcagtagagaagagctatgagttacctgatggtcaggttattaccattggtgctgaacgtttcagatgcccgaagtgcttttccaaccatccttgattggtatggaagctgcaggcatccatgagactacatacaattcaataatgaagtgtgatgtggatat

SEQ ID NO: 15254 - DNA, 407 bp, Gossypium hirsutum
  Clone ID: uC-gsflnu33B064d04b1
ttttcttgtaaatcctggagcaaagccatgaagaaatccatggagatagctgattcagcctcttggtactgtgcccttgccttattgaccttaatactgatgggttgcatcaagacaagttccgtatcatcagatgaagctgcgagagggaagcagcttctgaagccaccctgtgacgaaatctatgtggtaggagaaggggagacacttcacaccatcagcgacaagtgcgacgatccttttatcgtggagcgcaaccctcacatccatgatcctgaccacgttttccccggacttgttatcaagatcatcccttctactgctgagaaactctagaggtagccatacgtcttctgaaaatatttgtgttaattcgtcccttatcaaggccccggttggtaaatttg

SEQ ID NO: 15255 - DNA, 118 bp, Gossypium hirsutum
  Clone ID: uC-gsflnu33B064d06b1
tgatttgttgctttacacccaatggagaatgaattgttttaaccatagagtcttattacttaccctattgctacccatagttgttattttagtggaaggtcaaggcactagagttggg

SEQ ID NO: 15256 - DNA, 309 bp, Gossypium hirsutum
  Clone ID: uC-gsflnu33B064d07b1
tccacgcgtccggagattttaacgatgcttaatgtcctgtgtcgccaaccaactgcttcaaaatattaaaagctatcatcacaaatatcatacatacggctcccagatctgctcttacctctcaattccagtataaaaggtaagggtttctaaaatatcaacgagaaaaaaaaccgtgaatactgtgatggcctctgagagggaagtttttggtctttcgggtccattacacctaaccaatatagattggaataatgcacatcatcgaaggtcagtagcagccagtttggttgagggtgtggatatctt

SEQ ID NO: 15257 - DNA, 323 bp, Gossypium hirsutum
  Clone ID: uC-gsflnu33B064d08b1
tccacgcgtacgcccacgcgtccgaagtgctgcaaatatttgaacaactatctcactaccacctatcggactgtaccaccctgctgactcaacaatcagccagagaactgaaaggtgagacaagctgggctctacatagccgaatttgtaacggaatactttcatgaaagtgtaacacaatgaagagtgcagggaactcgagttagtgctttgctttcaaaagaaaatcaaaccattaagtgtgtggatgcatattgctgtgctattagaacacacattgggtgtactaattgcaaaaatttaaaaatgtacatgttttctgt

SEQ ID NO: 15258 - DNA, 525 bp, Gossypium hirsutum
  Clone ID: uC-gsflnu33B064d09b1
tcgttattgagctgctgtcctgccacctggatttaagggcggtagggcatagtataaaatagcacacacgagtttatcttagactcaattgaacttaattttaactagcacacatatgaggtaagtttttgtttttaaattatttagaatctaattatccctaatgttagtaatttataatattattactggtaggtattaatatttttgttatgtaaaaaaatctaataaattataattattgatgaatagttatgttgtaaggatagaactctagcacctgaaaatattgtattaagatgaatctttatgtgaagttacgaaaagtagcagacttttacagccttactccggttccccggacaacttcgctgcttacacggtcgctcttcagcctcatgataggaccatgggactcgatttgccttcaggcggccatttgacttatgggtattataccttcggcgggaagaagatttctgtttcgtctattactttgagaagttgctttcaaggtgaactcca

SEQ ID NO: 15259 - DNA, 160 bp, Gossypium hirsutum
  Clone ID: uC-gsflnu33B064d10b1
ttcctttcactgtaaaatgtaaatcttcttgctgtgttttcccccctacttgttggaggttcgaggacagattcttaagttttaaatgactctgtcatatgtggcttctgagcgaataaaaaacagtgaaaaaaaatgacaaaaatcgtatatgttgaat

SEQ ID NO: 15260 - DNA, 398 bp, Gossypium hirsutum
  Clone ID: uC-gsflnu33B064d12b1
ttagtttcaccgccagcagtggggtaaaatgagcagcattgaggtggctaggtgcggggaatgggagccgtgcactcagctttgttggagggaatggtagtagtaaaagtgttagcagtgctggcaggattggatcattgggttcttcgagtccgagtaattcaatgactaatacaaattttgatgggaaaggaacttatttaatcttcaatgtcagtgattctatttttattagtgatttgaattcgcaggataaggatccaataaaatctatccatttcagtaattcaaaccctgtctgccatgcctttgatcaggatgccaagaatgggcatgatttgcttattgagttgaattccggtgatgtttattcagtgtcattgagacagcagttgcaa

SEQ ID NO: 15261 - DNA, 313 bp, Gossypium hirsutum
  Clone ID: uC-gsflnu33B064e01b1
tccttttgtgaagtttggacaggctgctttggccaaaaaaggagaagattattttctgattaaacctgattgcgagagggttcctgagaatccggaaacatcttcttcggaatttgcgattcttgatgggcataatgatctatcagctgtcattgttgcagaggagaacttattgggcaatgtcttgagtgcaattacacagggcatcaatagggaggagtggctgtaagccttacatcgggctctgggggcacgattggagatgacagacattgcggtttaggagacaggtgatacttctggaacaactgtt

SEQ ID NO: 15262 - DNA, 292 bp, Gossypium hirsutum
  Clone ID: uC-gsflnu33B064e03b1
ttcatctttaaaacacgcacccaaaaaataaaaccctttgaaaaccaaagaaggaagaagaagatgtcgtggcaagcttatgtagatgatcacttgatgtgtgaaatcgaaggaaaccatctctctgccgtcgctatcatcggtcaggacggcagcgtttgggcccaaagcgccagcttccctcagctcaagcctgaagaaatgagggccatcatgaatgactttaatgaaccgctttcactcattactaccgaggtgtacgatgagggggcactctacatggtgatccaag

SEQ ID NO: 15263 - DNA, 367 bp, Gossypium hirsutum
  Clone ID: uC-gsflnu33B064e09b1
tgttcatctatgccccagttttttgttcttgttgcatgcatgtgttgttgttgtttatgtaaaagcagattttagacataaaaatcgtccatcccactgtcttctatatatttctttcaagatttgtaacatcatcatggagaccaacttatgttctactgtcatatatgttcttgtatgtaatgtaattgtcgagaccctagtagtgaaggaaacatcagtgtttagtttgaaaaaaaaaaaaaaaaaaaaacaattaacaaaataaaatcaaataaaaacaaaaatacaaaaactctaaaatcaacaaaataaaaaaaaatatccttaactttcaataacaaagggggggcctttttaaaggacc

SEQ ID NO: 15264 - DNA, 316 bp, Gossypium hirsutum
  Clone ID: uC-gsflnu33B064e11b1
ttactcgcaggcagacaggctcagctatatgggtgagttttaatggcacatctctccggtgtgaccaccggtcttacattgacggaatctattagtatggtggctgcgaaaaggtcaaaacagatccacatgcatgggcatcacgtgaagtgccagacattaaacaatgctttaatgatcatatccgatagaacacaaactgtacttagccaacttccaacatgagacaagctgtcatggctttcaatcctagctgctgtcatgactgttacttatgcttccattggcctaggactctccattgataaagctgcac

SEQ ID NO: 15265 - DNA, 434 bp, Gossypium hirsutum
  Clone ID: uC-gsflnu33B064e12b1
ttaacatcgggatcgatccttcaccgtacgtgatcaaattacaatgttgagctctcgagtgaagattcaatgggggttaaattcattggtagcgctaaggttattaacccaaatgctgtgaaccgtccagatggggtcatccatggcatcgaacagttactaatccctcaatcagtacaacaagatttcaacagtcggagaaatctccgttcaatctccgccgtgaaaccagaaggtgcacccgaagttgatccaagaactcaccgtttgaagaaacctgccccgccagtgaaacccggttcaccacccgttcttccgatttacgacgcaatggctccaggtccatcactagccccggcaccagctccaggacccggtggacctcaccatcatttcaaccgaatgagggaagtcaaagatttcatttaaacact

SEQ ID NO: 15266 - DNA, 450 bp, Gossypium hirsutum
  Clone ID: uC-gsflnu33B064f01b1
tccacgcgttcgcccacgcgtccgtccacgcgtgcgcctacgcgtacgcccacgcgttcgggttccgtcatggttcccttgtgatgcggttgccagattcggaagtgggccagattcaaaccgttatttttggcaccgtcaatggtgcaattggcgtgattgcttcacttccacatgatcagtatgtgtttctggagaagctgcaatcgaacttaaggaaggtgataaagggcgtgggagggttgagccatgaacaatggaggtcattcaacaacgagaagagaactgcagaagccataaactttttggacggagacttgatcgaatcattccttgatctgagccgtgggaaaatggaggaagtttctaaaggactgggagtttctgtggaggagctgtccaagagagtggaggaactgacgaggttgcattgagtcgatgatgcgtttt

SEQ ID NO: 15267 - DNA, 109 bp, Gossypium hirsutum
  Clone ID: uC-gsflnu33B064f02b1
ttcgcataactagccagcatatcttttcattccttgtatgtaaataaatccagcccaaaaatgcaccaagaaataagctaccagcaagcatgatcaataaagaatatgg

SEQ ID NO: 15268 - DNA, 368 bp, Gossypium hirsutum
  Clone ID: uC-gsflnu33B064f03b1
gttcacgcgtacgcatacgtgtacggaacgggtggtcgttgaagctaggtaagatgacatgattaaggtgttgaagattgggatactgtgcgcagtcaagctggcaaatttgcgccctactatgagtgaagagaccaagtttctcacgcatgctgacgacagcattagtatttatgcggggcacgtaaatgaaataaccgggcgcaggtttttcaaggtgctgactgagatatctcaggtgttaccaaacttaacctgctggaaataaatccccttttagctagctggacaatatactgaaaaggcccgctaccaatcgtctttccaaacagttacctaacctgaatgcttaatgggaccctccctga

SEQ ID NO: 15269 - DNA, 83 bp, Gossypium hirsutum
  Clone ID: uC-gsflnu33B064f04b1
ttatatgtaccaagagaagcaaatacggtggcgcatgaaatggtgatggaaggaaagaagttcgatggtcctcaatactggat

SEQ ID NO: 15270 - DNA, 166 bp, Gossypium hirsutum
  Clone ID: uC-gsflnu33B064f06b1
tccccttctgtttcttttttcacgagtctctccattcaaacgtaaaaaacggcgccgtatttacgcttgttggtgaaagtgcgagatggcgataggagctgagcacaagccacagtccgatgttagagtttgtgggtttaccaagctgacttgcctggaaaccgat

SEQ ID NO: 15271 - DNA, 464 bp, Gossypium hirsutum
  Clone ID: uC-gsflnu33B064f07b1
tttcctttcttcgagttttctctgtttgcttccgtcacaactccaaaaccgtacacaaaatgggcaaggatctaagcgacgagcaagtctcatcaatgaaggaggctttcactctcttcgacaccgacggtgacggcaagatcgctccatcggagctagggatcctaatgaggtctctcggcggtaaccccacccaagcccaactcaaagctattatcgctgaagagaagctcacggcgccctttgacttccctcgctttttagatctcatgtccaagcatatgaaacctgagcccttcgataggcagctacgcgatgctttcaaggttctggataaggacaatactggctttgtctccgttgcagatctgagacatatactgactagcatcggagagaagctggagccctcggagttcgatgagtggatcaggaagtggatgccggccagatgggaagatccg

SEQ ID NO: 15272 - DNA, 292 bp, Gossypium hirsutum
  Clone ID: uC-gsflnu33B064f08b1
ttctgggacatgcatcggcattgagatgagagctagtgtaagacatgtctgggacatgcatcagcctcgcgatggacaagctagtgtaagacttgtctaggacatggcgtcaccttactgcgtgtcagtgtaaaacctatctgggacatggcattggcatctatagatgagagccagtgtaagaccatgtcatggacatggcgtcggcatcttagcccatgttaaggctatcgagtatccggcagtattccaaatggtttaaaataacggcttacgatttatatcgcactga

SEQ ID NO: 15273 - DNA, 528 bp, Gossypium hirsutum
  Clone ID: uC-gsflnu33B064f09b1
tgagaatttcacagatcctgaagcagagctaaatcatcaacgaaatgttgcattgaagcacattgagcaacacaagctgagtgggatagttcatttcgctggacttaccaatgtttacgatcttgatttcttcaaagaacttagacaaattgaggtgtttggcacttggccaatggccctgctatcagcaaacgagagacgggttgtgattgaaggacctgtttgtgattcatcacaagttataggatggcacctaaggaagatgaataaccagacagatgcagaaacagatgctgatacgaaacctcctattcatatatcaagttttgcatttaacagttcaatcctttgggaccctgagagatggggacgtctcacatcggtccaaggcacttcacagaactcactgaaatttgtgaaacaaattgtaatggaagatgagggcaagttaaagggtatcccacccgaagagtgctccaaataatgctatggcgtcttcatttccccattggagtgtgcctagaaatc

SEQ ID NO: 15274 - DNA, 135 bp, Gossypium hirsutum
  Clone ID: uC-gsflnu33B064f11b1
taacaccctcccggaagtgtggcgagcgaggggccgtatagcggggaatacgcgacatcccctggagaaagacagggcgaagaaagcctctacttcaaccagatgcactatgatggggatagccaacaacatggg

SEQ ID NO: 15275 - DNA, 100 bp, Gossypium hirsutum
  Clone ID: uC-gsflnu33B064g01b1
gtagtttgtgagttccgctgatctgactatgcaggctacacgtgccagaacagctggaatcttctttcgagggtgtccgtactcgaaggaggattagaga

SEQ ID NO: 15276 - DNA, 207 bp, Gossypium hirsutum
  unsure (1)..(207): unsure at all n locations
  Clone ID: uC-gsflnu33B064g02b1
ctcacgcgtccgctttgatctaaatcaaattggtttcttagagatagaagatctgcgagattccttaaacgatgaaantngataccagtgaggaagttatcaatgccattatgcttgatgttgatactgacaaggatgggcgcataagttacgaggagtttgttgcattgatgaaagctgaacctgattggagaaaagcattgagac

SEQ ID NO: 15277 - DNA, 303 bp, Gossypium hirsutum
  Clone ID: uC-gsflnu33B064g03b1
ttgctgcacaggttccccaggaacccatcattctcagattttttttcagtgtttaatagtgaaccgatgtccactgttggagaagctgctggcttttacgctgctcttaatctttatgatgatggcaatcccattaccggtgagaagatttctacactaattaaagctggaaatggctttggtggatcctactggccaagcttgtttgctaagctttttggggaggggaacattggggatcttataaccaatgttggagctgctggtggtggtgccccagtagctgcagctgcacctgttgct

SEQ ID NO: 15278 - DNA, 239 bp, Gossypium hirsutum
  unsure (1)..(239): unsure at all n locations
  Clone ID: uC-gsflnu33B064g04b1
tccacgcgtccggacaccgatatggtcgacgatttacttgctttttacagtgaagaagctaaagtaaacgaatccgaggatctacanaactccatcaacctcaccaaagataacatcaaagctattatcatggatgtgatgttcggcgggacggagacggtggcatcggcgattgaatgggccttgacggaaatgatgaagagcccggaggatttgaagagggtacagcaggagttggc

SEQ ID NO: 15279 - DNA, 390 bp, Gossypium hirsutum
  Clone ID: uC-gsflnu33B064g07b1
cttcactttaacggatttcgacctttcacgcagcttaaagaagaagcaattatcagaaactgtagctgacctcaaaatggatccgaatttatcgcctgccattccggttcgacgaaactttatccgatgggtccccgccgtagctgataacaaataccgcaaagcttataagaaaccaaaaccagcccgagtcagcccagtgagtcgaaggaaacctagtttctcaaacggggaacgttccaactccttcgtgggcaccgaggaatacgtgtcacctgaagtagtacgtggagatggacatgagttcgccgtcgattggtgggctctcggaattctaacctacgagatgctctacggtgcgacacctttcaagggaagagcacgaggaga

SEQ ID NO: 15280 - DNA, 314 bp, Gossypium hirsutum
  Clone ID: uC-gsflnu33B064g09b1
tcacgcgtccgcaaagaggcagcactaccttgtcccataagaaaaattttggcaaaggaaaataagaaccggtatgtgattaatttgcctgcttatgccgggccaacaagttattcaagcacttaactacaatcctggtgatagctggaggttactcaagcaagaggtacacttattagactaccacatgggatcggagaaattatgcaaattattctactcagcaggtatactactggtggtacagggttgaggttttggtggagacataatccaagattagctaaattcatgcatggggacaacttggttga

SEQ ID NO: 15281 - DNA, 455 bp, Gossypium hirsutum
  unsure (1)..(455): unsure at all n locations
  Clone ID: uC-gsflnu33B064g10b1
tgttgatgaaaagggtaagaaaaaagttgggtcttttttatggaagaaatgaaggtggaaattttaaattttacaggaattatttgaaagctagtgaatttggagtttactgatagattgaaggaaagggcagcaaaaagagttgttttttttctttctattatttttttaggaaaaaaagcgaagaaacagatcaaatcaaaaaaagtagaagcaacatagaggaatggcgatgcttgtagagccaccaaatggggagaagccaagagggaagcactactattcaatgtggcagacccttttcgagattgacacaaagtacgttccaatcaagccaatagggagaggagcatacggngtcgtttgctcatccatcaacaaggaaaccaacgaaaaagtggctataaagaagatcaacaatgtattcgacagtcgtgttgatgcgttgagaactt

SEQ ID NO: 15282 - DNA, 427 bp, Gossypium hirsutum
  Clone ID: uC-gsflnu33B064g11b1
tatttggatgctagggacccacagggcaccagatgtttttattcagagaggcttttgaaacagcattgcattcataaacacatgattcttctgttaaacaagtgtgatcttgtttctgcttgggctacgaaggggtggcttagagttctatccaaagaatatccaactctagcgttccatgctagcgttaacaagtcttttggcaagggttctcttttatcggtactaagacaatttgcccgcttaaaaagcgacaagcaagcaatatttgatggatttattggttatcctaacgttggcaagtcttcagttatcaacacactccgcacaaaaaatgtctgtaaggttgctcccatcccaggggagactaaggtttggcagtatataacactcactaaaaggatttacttaattgactgccctggag

SEQ ID NO: 15283 - DNA, 505 bp, Gossypium hirsutum
  Clone ID: uC-gsflnu33B064g12b1
ttcatcctgtttttaatgaaaaagggtctttcagaatggatcccccattgatcaatgagtcatccttttcagcagccaatccttcagcttacagcctcgctgagatttggcctttcccgatcaacccaggctctgacccaactgctgtaactggaggtgggttggggctccggataggtaatttgggtgggtttggggaaacttcgggtcttagagatgggtccatggaggaatctactgtgactgaacagagtgttggatgtggaggtgggagaaaaaggaaggaattgagctctgaagatgagtcttccaagattgtttctactactactagtgccaatgaattgaatgattccaatggaaaacggatgaaaactccggtctcaaagaatggaaatacgggttctaaagaagccgaggtggaagcgagttctgcagatggtagcaagccagataagatagcaaacctgccgaaccacctaagcagactattttatgttagagc

SEQ ID NO: 15284 - DNA, 86 bp, Gossypium hirsutum
  Clone ID: uC-gsflnu33B064h01b1
caaaaatataataatagcactaatcatggagtccaaacatgggagtaggagactatcattaatgatgctggtggttatgcttgggg

SEQ ID NO: 15285 - DNA, 459 bp, Gossypium hirsutum
  Clone ID: uC-gsflnu33B064h04b1
tttagcccccccttgccgaccaggaaattaaataagttcagattttaaggtttctgcttcatcatggtcaacgcgactaaagggctgttcgtttcttgtgacatttccatggcacagtttatcgtgaatttgaatgcatcgctgccagctgcacataagtttataatacatgtgctggatagcacgcacttttttcgtgcaacctgatgtcgccgggatgatacgaagtgccatatcccagttcagagaccagaattcatacgagaagccaacttgacttttgaacttaatatcctttctttaatggagctcatatatgaaaaaccaataaagaacaacaaagaaattctagtgcatgaatatgtgcaattgctggcttcctattttcattttgacttcagaccctgatataattgaaggctatatttggatttggatttggaatttggatttatttat

SEQ ID NO: 15286 - DNA, 515 bp, Gossypium hirsutum
  Clone ID: uC-gsflnu33B064h06b1
ttcctttgttctttggggctactcttttccttttatgcagctttgctaatgctcagccacctgctcttactttaacaatcgttaacaactgtcctttcaccatttacccagctatccaaaccaacgcccggctacccggtcctcgaacgcggcggttttgccctttcaacactgacccaccgcttcttccccgcacccactgcccactggtccggccgcatctgggctcgaacaggctgtacctacgacaacggccttttctcttgtgccacgggagactgcggccaccgcatagagtgcaacgggctcggcggcgcctccccagtgacgctggcgcagttcagcttccaccacggaggcgaaaaggacctgtcttcctacgaggtcagcctcggggacggtttcaacgtcccatgacgttgacaccgcacgagggcaaaggcgtttgtcccgtggtcgggtgcagggtcaatctgctgagacgtggtccgaggtgtgaagctgaggtcggagcc

SEQ ID NO: 15287 - DNA, 129 bp, Gossypium hirsutum
  Clone ID: uC-gsflnu33B064h08b1
tcgtgacgcgtgggcggacgcgtgggtttttttggaataaacaatcactcgtaatccatagaagatgataagaaaaaaaaaaaaacaatggaataaagaaagaaagaaggaggacaaatatatgaaaaa

SEQ ID NO: 15288 - DNA, 518 bp, Gossypium hirsutum
  Clone ID: uC-gsflnu33B064h10b1
ttcgtggttctgtacctcgtactttacctggcttgataaatgacattatgagcaaaggcaggcgaatgacttatgaagagctttgtaatgcagtcctgccacattggcctaacttgaggaaacataatggagaacgatatgcgtattctactcattctcaagctgttcttgattgcctaagaaatcgacaagaatgggctcagttagttgatcgtggccccaagactaattcaagtaagaaaaggcgcaaggcagatgctgaagattcagacgataatgaattcggcaagggaagaagtacgaaagaggtagaaagcaaaagcctcgagtcacagaaagaagagttccccaaaggcaaaaggaaagcgaggaagcgcaggcgattggctttgcaaggaagaggaataaaagatgtccgcaggagaaggaaagtagatttcagtgatgatgatgccggacccttctctaactcaagtgaggagagcatgttcagtgacgatgagatccaaatcctactt

SEQ ID NO: 15289 - DNA, 465 bp, Gossypium hirsutum
  Clone ID: uC-gsflnu33B066a01b1
aagtgaggatcaagcatagatggaaaacatgggtgttctaggcaaggtggtggattaccttctattgttatcattcttcagcatcacattaacagctcagttggacatccccgagtccatcctcccccacgcctacaatcccttctatcaagtttataccacgttaacccaagattatttggtgcttgagcagcctgcttttttcaaggcacttatgacgttggaacttgtttaccaactccctctcgctttgcttaacatctatgggttgttatactctaagccctggttcaacaccacctgcctcctctttggtgcctctatcgttgcctctacgacagctatggtgggagacattctcaattcccagaaggcatcagccaatttgatggccatgtattatccaccgtttcttccattaggggttctggctatagtgcgaggggtggttggacaatcgagcaa

SEQ ID NO: 15290 - DNA, 387 bp, Gossypium hirsutum
  Clone ID: uC-gsflnu33B066a02b1
gtaggctaagcatgggagacaatatcgtgtcgaatatgctaaaaatgcgatgatacgacttgctcaatcttaccttgtggaggccagatggactcttcaaaactacaaaccatcatttgaggagtttaaggctaatgcattgccaacttgtggttatgccatgcttgctattacatctttcgtcggcatgggagatattgtaacaccagaaacctttaaatgggcagtcaatgaccctaagatcattcaagcttctacaattatttgtaggtttatggatgatgttgctgaacacaagttcaaacataggatagaagacgattgctcagcaattgagtgttacatggaagaatttggtgtaacagcacaagaggcatatgatgtatt

SEQ ID NO: 15291 - DNA, 476 bp, Gossypium hirsutum
  Clone ID: uC-gsflnu33B066a05b1
ctcagaagacagctctttggtttgcctccacgttaccgtgattcagtccgggcaataactccgggcctgcctctgttcctctacaactactccacccaccaactccatggtgtttttgaggctgcaagctttggtggaacaaacattgacccaactgcctgggaggacaagaaatgccctggcgaatctcgattccctgctcaggttcgcgttattacaaggaaaatctgcgagccacttgaagaagattcatttaggccaattctccatcactacgatggtccaaaattccgccttgaactcaacatcccagaggcgctttccctgttggatatatttgctgatcaacaagattcttgtatttcttaagcaacaagatgcttgagcaaaacttaaacactaggcatatcgatacaaatacagatacacacagagataatgaagagaagagtttgaagaataagtagagaaaaata

SEQ ID NO: 15292 - DNA, 473 bp, Gossypium hirsutum
  Clone ID: uC-gsflnu33B066a07b1
gtcacactttagtcacaatttttactgtgattttgttctttcttcttatcactcccataattgttcctattgcattgagtttctccgaagagcctagagatccggtagaagaagttcttctaccaaagtcggagcaacaagaagctggaaaacctgagcagagtgatcaggaacatgaagtgatattcagtgaggttgaagatgagaaacctgtggaagtagacttgcttccagcatcagaacggcaaaaaagaattgctcagttgcaagcagaacttttccaggctgctgctaaaggagcagtaagggtgaagagaaagagaggccctcatagaggagaagactttaccttgatgcaggctttgatcaaagcagacttttggctcatctttttctctcttctattaggttcaggatcaggtttgactgtgatagataatcttggtcagatgagccagtctctggggtatgat

SEQ ID NO: 15293 - DNA, 81 bp, Gossypium hirsutum
  Clone ID: uC-gsflnu33B066a08b1
atcacgcgtccgattttgattcttctcgtctggtggagctgcacatggaccagtacgagaaagtagagaagattggtgagg

SEQ ID NO: 15294 - DNA, 200 bp, Gossypium hirsutum
  Clone ID: uC-gsflnu33B066a10b1
cgtccggcctcagttctacgctgcttgtacctttggcgggatccttagctgtggactcactcacatggccgttactcctcttgacctcgttaagcgtaatatgcagattgaccctgcaaagtacaagagtatttcatctggttttggagttctactaaaggagcaaggagtgagaggcttctcccgcggctggtttcatc

SEQ ID NO: 15295 - DNA, 63 bp, Gossypium hirsutum
  Clone ID: uC-gsflnu33B066a11b1
actcaggaatggaggtgccgggtggggaggcagtggtttactccgggcactcacttcgggcct

SEQ ID NO: 15296 - DNA, 367 bp, Gossypium hirsutum
  Clone ID: uC-gsflnu33B066b02b1
agatattttgtttctatgcaagtggttgaagctttgagtttatctatctagctagttgtagttcgtaatctggctacctccatcccttctattccttagccaagcatttaaaaaagcctgcacagcatgtaatatagtgttttcatctcttcaattacaaacccctaaaaaaagaaaaaaaatacaaaatgaggtaaaggatcattagttatatagtagaatgtatccatagaatttgttaaatattattgttctcgattcttagtggtcgtggacaagattaaaagaattgttgtacctacacctttataaaagtcgtcaaatcatgtaagagtcgttttttttagctatcatcaaatattaattc

SEQ ID NO: 15297 - DNA, 470 bp, Gossypium hirsutum
  Clone ID: uC-gsflnu33B066b03b1
atacgcgtccgcccacgcgtccggttctctagaacctgtaaaccgaagaagactcggcaaatagttggccctgttataacaagagatgatttgcctaagagtagaggtggccacttggagcaaaaggagaaactgggattgaatcctgttccaaggagacattcaaaatcacaaacgccaccccctgagccggtggatgcgtatcaaaaagtggaggcaaagcaagatgatgccctctctggtttaagcgatctactgggagagttgaagggtatggctgtcgatatgggatccgaaatcgagaggcaaaataagagtctgaatggtctccaagatgatgtggatgagctaaatttccgtgtgagaggagcaaatcaacgagctcgccgattgcttgggaagtaacactgcagttttgagattcaggctgacatgtctgtttcactcttctgtcattgtgatctcacaca

SEQ ID NO: 15298 - DNA, 466 bp, Gossypium hirsutum
  Clone ID: uC-gsflnu33B066b05b1
ccgctcgtaagtccgctccggcgaccttcggagtgaagaaccctcaccgcttcaggccaggaaccgtggctttgagagagatccgtaaataccagaagagcaccgagttgttgatcaggaagcttcctttccagaggctggtgagggaaatcgctcaagatttcaagactgatttaaggttccaaagcagcgccgtcgctgcacttcaagaagcggcggaggcttatctcgttggattgtttgaagacactaacctgtgtgcaattcatgctaagagggttactatcatgcccaaggatatccagcttgctaggaggattagaggtgaaagagcttagattgtttgtatttacttgattgattgtgaaattaggttagatctagtgtttggtatccgtttttggaatttgctttctcggcaaaaatccttgtaaacggtcgtctttctatggagttctagtacttt

SEQ ID NO: 15299 - DNA, 140 bp, Gossypium hirsutum
  Clone ID: uC-gsflnu33B066b06b1
ccgatggagaaccatagttgattataatctttatgttggactactgagacaggccggtgtcaccaatgttgggttttatggaaatgttatgctcctttatccattggtatccatatattattaatatgaagttggcttcc

SEQ ID NO: 15300 - DNA, 345 bp, Gossypium hirsutum
  Clone ID: uC-gsflnu33B066b07b1
gtgcgagcttcgaaagggaatcgggttaaaattcctgaaccgggacgcggcggctgacggcaacgttagggagtccggagacgtcggcgggggcctcgggaagagttatcttttctgtttaacggcctgcccaccctggaaacggctcagccggaggtagggtccagcggccggaagagcaccgcacgtcgcgtggtgtccggtgcgcccccggtggcccttgaaaatctggaggaccgagtgccgttcgcgcccggtcgtactgataaccgcattaggtctcccaggtgaacagcctttggtcaatggtacaattgtaagtcagggcacgttgcaaaatggatt

SEQ ID NO: 15301 - DNA, 464 bp, Gossypium hirsutum
  Clone ID: uC-gsflnu33B066b08b1
gtgatactgttactttcatgttcgaaagtcctacacaagacaagatatcggattttgagatgaagctgatggatatagatagtgagcatcttgggattccagaggcagagtatcaatctattgtgaggatgccttcagctgagtttgctaggatttgtaaagatcttgctagcattggtgatactgttgttatctctgtaaccaaggaaggtgtgaaattttccacaagaggtgatatcggaactgccaatattgttctcaggcaaaataccaccgtagataaacctgaagaagcgacgatcatagagatgaacgagccggtttcattgacatttgcattgaggtacatgaattcatttacaaaagcaactccattgtcaagtacagtgacgattagcttatcttcggaattgccggttgtggttgagtacaagatagctgagaagggtcatattaggttttac

SEQ ID NO: 15302 - DNA, 434 bp, Gossypium hirsutum
  Clone ID: uC-gsflnu33B066b10b1
gcgtgggtcaagaggcagtgatactcgaaggagaattcgccgctctagttatgcttcatcaacttctgatgagggttcagtgcattctgtagaatttgcagaatatagagtagatgagactgatgatgagtttgtgagcacaagtggctcctcaagaggtagcaccagctatcaaagttctcaaagacgccgatcccgcttttatgataattagccgcatacccaggaagtgaagctgaggattgatcctgtccatgtggtgagcaataaggtaattgctgctgcagacagttttagattcttaaacatgtaaaaatacccttggagcctgttatgcttgttttggttcagacttgaatttcatgtggttctattttgctcattttcgataatatatattacgcaaatagacatccaatgggtaaaccttcccc

SEQ ID NO: 15303 - DNA, 378 bp, Gossypium hirsutum
  Clone ID: uC-gsflnu33B066b11b1
aagcgggattttgggtttatacattatgtttaaagatcaagtgctttgaaagctgtcaaagatacagagaagtatgaaatagatggccaagtcttggaagttgtccttgccaaacctcaggctgataagaaaactgatgcagcatacccttacattgctgggcttaatccaaaccaccttcaacatcctgggtatggtggttatactggaactacatatggctctccaagtgctggatttggtgttgccactagttttcagcagccagcaatatatggaagaggcccaaagcctataaatatggctatggtgtccatggttttaccagatggtcgaattagtatatgtctctcaacagtcattattgcatatgcctac

SEQ ID NO: 15304 - DNA, 426 bp, Gossypium hirsutum
  Clone ID: uC-gsflnu33B066c01b1
aacatattgggttaccttttcttgatattggctttactaacaagcctctcttctagccttcctagtgaatactccatagtggaacatgagattgacgcatttctttcggaggaaagggtgttggagatcttccaacagtggaaagaaaagaatcagaaagtgtaccggcacgccgaggaggctgagaaaaggtttgaaaatttcaaggggaatttgaagtatatcctagagaggaatgcaatgagaaaagcaaacaaatgggaacaccatgtgggattgaacaagtttgctgatatgagcaatgaggagttcagaaaagcttacttgtcaaaggtgaaaaagcccattaacaaagggataaccctgtcaaggaacatgaggagaaaggtgcagttttgtgatgcacccttcttcttggattggagg

SEQ ID NO: 15305 - DNA, 186 bp, Gossypium hirsutum
  Clone ID: uC-gsflnu33B066c03b1
ttatgcctcgttgtcctggaacctagaaccagtagaaggatatagttgtggatttacattatttttaataaactaatggatcaaattttattcgaatttctgttaataagattatatggaaatgtaattttataatagaattgtgatcgttgtaaggatgattttatattggactattatttcatc

SEQ ID NO: 15306 - DNA, 467 bp, Gossypium hirsutum
  Clone ID: uC-gsflnu33B066c06b1
aagacaacaaaaaattgaacataaggtttgtaagtcataaagactataaagcgtaaccgattcaattatgtttaaacagaagagaacacagaacaacagtctgaaaacatctgataaacaaatcgaaccatgtcataggtaacaaatcctggtactactaccatgagttgaaagcaggtcactctagcagcaagcccctttcctatctcgacaagcccagtcttaaaagaatactctttcatccaattaactctcagcctgaggttcatctgcttttgattgctcacctccttcctctggcagatccgaggtccacaaggtgaggttgtccctaagaagctgcatgataagggtgctatccttgtaagattcttcattaaggctatcaagctcagcaatagcctcaacaaatgcttgtttagccagatgacaagccctttcgggagaatttaatatctcatagtaga

SEQ ID NO: 15307 - DNA, 121 bp, Gossypium hirsutum
  Clone ID: uC-gsflnu33B066c08b1
cgtccggcacatttctagggtgtaccaagggtgttgaagggagtgcccctttctgcaagggacatggaggggggaaaagatgtgcattcgaaggaggcggggtttgtactaagagcgtgta

SEQ ID NO: 15308 - DNA, 319 bp, Gossypium hirsutum
  Clone ID: uC-gsflnu33B066c09b1
ataacgcgtccgtaacttgaagcttataaaagaaagctttgctaaatcatttgcaccatttccaccagggtgtatgttccacagtgagcaaggattgatgagttttgagcatccaaggagcaaaatgaaggcaatgccaagaattgacagtgaaggggtgatgtgtggtgccaatttcatggccgatgctcagtcgagaacaagtaggatgccccgagttggtagcgaagccaattgggcactgcgaggctccaaagcttgaataattcaatactaaatgacccacattttattatttgtggtttttttttttgggggg

SEQ ID NO: 15309 - DNA, 395 bp, Gossypium hirsutum
  Clone ID: uC-gsflnu33B066c12b1
accttcaagtagtaatgggagaacagctgaagttgcgaggaactctttccggccacggcggatgggtcactgccatcgccaccactcctgaggaccccaacatgatcctcactgcgtccagagacaagtgcatcatcgtgtggaccctgaaccgcgaggaggacaactacggcactgcccgccgctctctgcgcggacacaaccacttcgtgtcggacattgccatcagctccgatggccagatcgctctctctggctcttgggacaccaccttgcgcctgtgggagatcaacactggcaagtgcacccgccgtttagtgggccacaccaaggacgtcctctccgtggcgttctcgtctgacaaccgccagaacgtgttcgtcttcagagaccac

SEQ ID NO: 15310 - DNA, 409 bp, Gossypium hirsutum
  Clone ID: uC-gsflnu33B066d01b1
gtccgcaattttgtaagcaagtatggctaaggacgttgaggttggtggtgagttccaagccaaggactaccatgatcctccaccagctccattagtggacggggaggagttgacaaagtggtcattttatagggctgtaatagccgagtttattgccacgctcttatttttatacatcactgttgttgacagtgatcggatacaagagtcaggttgaccctgataagggcagtgacgaatgcggtggtgttggcattcttggcattgcttgggcttttggtgggatgatctttatccttgtttactgcactgctggtatttttggaggacacatcaacccaacagcgacctttgggcttttcttggcttggaaggtgtccttaagccgagccatattttatatggctgc

SEQ ID NO: 15311 - DNA, 217 bp, Gossypium hirsutum
  Clone ID: uC-gsflnu33B066d05b1
atatccaatcattttaacggagtgtacatacagttatcagccttccatacggtgatcatacgtattattcagccatttgcagagatgcattgctggttctaagaccaggaaagagatggcttttgatttggtcctctcggaggtatcttgccgtttgcgaatcacaactgcatgtaggtctctaaattatcaattaaatgcaatttatgcatatttt

SEQ ID NO: 15312 - DNA, 444 bp, Gossypium hirsutum
  Clone ID: uC-gsflnu33B066d08b1
ttaacacaagttacaaactcaaaagccccattttctcactttcaaaaaacttcccacattcaccatgtctgacaggtgcggcaactgcgactgcgctgaccgcagccaatgcacgaagggaaacagcaacaccatgatcattgagactgagaagagctacatcaacactgctgtgatggatgctccagctgagaacgatggcaagtgcaagtgcggaactggctgcagctgcacagactgcacctgtggccactaagccaacatacaatggtcatgcttcaggtcatggcatatatagggatctaaataatgaatttaaggttgaataattcgtctgtttgagtttgcgtggcgacttatatctgtcagtaacctttgcatccttactatgatgtaatggctatgcttatggcctcatctggtaatgaagtattcttactattt

SEQ ID NO: 15313 - DNA, 456 bp, Gossypium hirsutum
  Clone ID: uC-gsflnu33B066d09b1
ccataatctccttaagtacgagtttgatctccagtttgatatccccgttacttatcccgccactgccccggagcttgagttgcccgaactcgatggcaagactcagaagatgtatagaggagggaagatttgtttgaccgtacatttcaagccactttgggcaaaaaattgtcctcggttcggtatagcgcatgcactttgtttgggacttgctccatggcttgctgcagagattcccattcttgtggattctggtatgatcaagcataaggatgatgcgaccacttcgaatgagtcttagcatttctgttgttgaaacgtttaaggtgtaccttgagtttcaaaaataaatgcttatacgattttacagtgttttttttgttaaagtgtcacattatctggcgaactctttggctttgtactttaaatgcacatatgatctggattatttttttg

SEQ ID NO: 15314 - DNA, 228 bp, Gossypium hirsutum
  Clone ID: uC-gsflnu33B066e01b1
ataccttctggccgatccgtattctttacctggacttttttgcatctccttgatccccgaccagcagtcccgcttgaaaatggctgcaaaatatattattggttctgttgaggcatcatttgctgttgcttatgtaattgataaactctgtagctgatgagaagatttttggagggactacaccccacactgtttacaacaaggaatggtgggaagaaactgtcaaga

SEQ ID NO: 15315 - DNA, 257 bp, Gossypium hirsutum
  Clone ID: uC-gsflnu33B066e03b1
gtgacattttctttgaataccaagtataaattcttcactttttctattgatggctgaggttaaagggaaatgggtcaagcttaaccagaatggaactggtcctggagccagaagctcacacgccataaccattgtgggacaaaaggcgtatgtctttggaggtgagttcaccccaagagttctggttgacaacaagctctacgtatttgatctcaataacttaacatggtctgttgccgatgtaactggcgatgtgc

SEQ ID NO: 15316 - DNA, 422 bp, Gossypium hirsutum
  Clone ID: uC-gsflnu33B066e05b1
gagtcaatgaacaaggactgaataaagggaatcctgctcacttcactatattccctggtgatggcaattgttcaggggatggacaaaaatctccggccgtcatatctctgcaatcagctccatcagaacagcattctcgctttgaactaggatttggtcagccgcccatggtctgtgcaaaatatccttacatggatcaatgctatggagttttctcaacttatggaccttcagtttcgggtcgtgttatgctgccattaaacatagcatcagaggatggaccgatatatgtaaatgccaagcagtacaatggaatccttaggcgtcggcaatctcgtgcaaaggctgttcttgagaataaactcactaaagctcgaaagccatatatgcattactcttgccatctgcacgcttatgcgtcg

SEQ ID NO: 15317 - DNA, 337 bp, Gossypium hirsutum
  Clone ID: uC-gsflnu33B066e10b1
cgtccgcccacgcgtccgttcgcgtgctattttttcgtggttgtttcgctgattgcttcgcctaaccaaacattgtatttgacgaagatatcaacgtttctgttccgtttgattcagttctggcttgtttcgatccggtttccttctgattttacctgcatttcacgttctgttttgaattttggagaagtctaaaagttgtctgttagggtttccaagaagaaaggaagaggatggaaatgatgaagtgtatgtgaaagctgagaaggagataggagaaacgaggcgtgataatggacgattgaggaggtttatttgttgctgttaggaggatttc

SEQ ID NO: 15318 - DNA, 129 bp, Gossypium hirsutum
  Clone ID: uC-gsflnu33B066e11b1
caactatttgattatcaagctttaaaattacaataaatgaggttggcatttagttctcctgttaaaaaagttgatgcaggggaaaccaagaaactcttttcttttttttttccttaaaatgataatagt

SEQ ID NO: 15319 - DNA, 265 bp, Gossypium hirsutum
  Clone ID: uC-gsflnu33B066f01b1
attcatccatttttcttctttgctcctcttgcttctaaacttagaaacaaaacatctagtaccattagaatcatgggtgttgtgagttatgagtttgaggtaacctccccaattgctccagccaggctttttaaggcttttgtccttgaggctgccaagatttggcccatggctgctcctcatgcagtcaagagtgttgtgctccaacgtgatgctagtcttggtagtatcgtaacgatcacctttgttgaatgtcttccatacc

SEQ ID NO: 15320 - DNA, 212 bp, Gossypium hirsutum
  Clone ID: uC-gsflnu33B066f04b1
ctttccagtttcaattttctcacaacaaaactgataaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttg

SEQ ID NO: 15321 - DNA, 301 bp, Gossypium hirsutum
  Clone ID: uC-gsflnu33B066f07b1
ccatgagaattcaagtgactaggatagccacactccttgtgttggtggcattaattttgggtcaaaaaggagctgaggccaggaaaggaaggatattggagtcgtttgagtacatagctatgagttgcagagcgcactctgcatcaataactgattttggaggaattggtgatgggaaaacatcaaatactaaagcatttcaagatggcgcaaatcatctgagccagcatgcaaatgatggcggggctcagttatatgctcccgctggacaatggttgactgggagctttagcctatccag

SEQ ID NO: 15322 - DNA, 465 bp, Gossypium hirsutum
  Clone ID: uC-gsflnu33B066f08b1
aattcctttaatgtcagaaattttccaagctttggcctttttatgttcttttaatacttggattaattcctctttctccttgggttgcagattagaagtaataataactggtgatgtagaattatttccaaggaatatgtattctaagtggtttggtaattgtttaagttccagtttgggaggctcctcaatagagggtttttgcttaagttcatcgtttatcttaattccctcatattctacttgtcttgacgaatggttattaggttcttcacctatctccttgccttgagctagatacggtttcatcgtctcctcttgtacaatttcctgaaaagagtcttgagtaatatgatcaatagagtcaatgaaataacatgaatcatcctgttccctagagaatctcatagcatcgtaaattttaaacataatctccttgtcacctactctaagtactaacttacc

SEQ ID NO: 15323 - DNA, 341 bp, Gossypium hirsutum
  Clone ID: uC-gsflnu33B066g10b1
aatactacgagagtttgcaagcagaggaggcaacacagcaaccagctgctgtatcttcttagatgcataatttagtagtagatcttgcagcgagttttattacatgtgtggtaggcttgtcctatggtgtcaagttcctaatggcagcagcaccagtaatggattcaacatctccatctctacttttatgcctttgttcaactccctggtgattggagttttgtttttaagcggataatattgtagcaagacaaacaattgatgctggtttgaaatctcattcttttctcaaaaaacaaaaacattcacataaaaaataaaatatacaaaaaaataatatg

SEQ ID NO: 15324 - DNA, 249 bp, Gossypium hirsutum
  Clone ID: uC-gsflnu33B066h02b1
cgtccgggcttggccatctgctgaaacttgaggacatactggatatttgacattcgcaaggaagtgtaccttgaaaaaagtataactttgcaatcaatgcaaacacttagttttcatcctactattatgattgattcttagctatgacacattcccgagtattctgtattattacatcttcagttgatttagcaaataaagtgtgaatgactaatgattctgtattattacatcttcagttgaactttt

SEQ ID NO: 15325 - DNA, 462 bp, Gossypium hirsutum
  Clone ID: uC-gsflnu33B066h07b1
cgcgtccgtgggcttcatccagtccaaccactcggtcattatgtacaacagcacaatgataagtttcaacatgctcgaggctgctcgaatcagtggagttaagaggtttttttacgcctccagtgcttgtatctatcctgaatttaagcaattggaaactaatgtgagcttgaaagaatccgatgcctggcctgctgagccacaagatgcttacggcttggagaagcttgcaacggaggagtggcgcatgcactacaccaaagacttcggaattgaatgtcgcattggaaggttccacaacatttacggcccttttggaacttggaaaggtggaagggagaaggctccagctgccttttgcagaaaggctattacttccattgacaagtttgagatgtggggagatggtcttcagacccgatctttcactttcattgatgaatgtgttgaacgtgtacttag

SEQ ID NO: 15326 - DNA, 385 bp, Gossypium hirsutum
  Clone ID: uC-gsflnu33B066h08b1
ataacttcatctctcgagaccctggttctcagtttccacctgagtcaggaaggtatcatttgtatgtatcttatgcttgcccttgggcttccaggtgtcttgcatacttgaaggtcaaaggccttgacaaggccattggttttacgtcagtcaaacccatatgggaaaggacaaaggaaactgatgagcacatgggatgggtttttcccacttctgatacagaagagccaggtgctgcacccaacccctttaacggagcaaagagcataagggaactatacgagcttgcaagtacgaactatactgggaagtacacacttcctgtcctatgggacatgacgttcaagactattgttagtaacgagagtgctgagataatccccat

SEQ ID NO: 15327 - DNA, 373 bp, Gossypium hirsutum
  Clone ID: uC-gsflnu33B066h09b1
ggtagagaaatgacttgtgggatatgtttcgaaaactattcttatgataggctgcacgctgctgcatgtggtcatcctttttgtaaatcttgctgggcaggttatattagtacagccatcaatgatggtcctggatgtttgatgttgcggtgtcctgatccatcctgtgctgctgttgttggtcaagatatggtaaatgcattggcttttgtagaagacagacagaagtacttccgttatttcattagatcttatgttgaagacaatagaaagaccaaatggtgtcctgcaccagggtgtgattatgctgtggaatttattttgggcagtcggagttttgatgttacttgtcactgttcatatagcttctgtt

SEQ ID NO: 15328 - DNA, 188 bp, Gossypium hirsutum
  Clone ID: uC-gsflnu33B066h10b1
gggggtggggaatcaacagaaccctgagcaacagttagctcaggaagacgccaagaggcaggcagatgaacggaggcaaatgatgcttagtcagattctgtccagtgaagtacgcgaaagacttgctcgaattgccttggtgaaacctgagaaggctaggggtgtggaggacgttctactttgacctg

SEQ ID NO: 15329 - DNA, 342 bp, Gossypium hirsutum
  Clone ID: uC-gsflnu33B066h11b1
gttcgtgttccctgccattaatgtcaacgactttgttactaagagcaagttcgataacttgtatggatgccgtcactcactttccgatggtttgatgagagctactgatgtgatgattgccggcaaggtcgccgttgtctgtggttatggtgatgtcggaaagggttgtgctgatgccttgatgcaagccggtgctcgtgtcattgttactgcgatcgatcccatccgtgccctttaggctctcatggtttgccttcacttgtcctgtccctatcagatgctgtattctaggcttcatatcttctctactacattcattaatcatcacatctttattttctt

SEQ ID NO: 15330 - DNA, 444 bp, Gossypium hirsutum
  Clone ID: uC-gsflnu33B068a01b1
atacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaacgccatagattatgaaaaaaagaaagcagcatatataacaggcctctgtaatgatatattgtcaaggatggatgcctgcaaggtctataattatgtctctgtctgtgtcttgtgtaatagaagcttagtttgtggtgaaaataatgtataagccatttggttgggagcaaattggccttttctacaaaggatttttgctgattattcatggtgacttggtttatggttttatctgttgttgtgaaaaatcttattaaaaatgtagtattcggttagctgcctctttggttt

SEQ ID NO: 15331 - DNA, 129 bp, Gossypium hirsutum
  Clone ID: uC-gsflnu33B068a04b1
gtacaattctgggtgattggaggtgtaatatgacatttttcagccaaatacccagtctctgttaatggtctaaaactcttcttatcgagtctccatggctaaacttgagcacactaataactgataaaa

SEQ ID NO: 15332 - DNA, 98 bp, Gossypium hirsutum
  Clone ID: uC-gsflnu33B068a05b1
atcacgcgtccgcccacgcgtccgattttctgcagggaaaactagaggaagcagaaaagacctccctttcatgcaatacaggaagctaaagaaggatt

SEQ ID NO: 15333 - DNA, 441 bp, Gossypium hirsutum
  Clone ID: uC-gsflnu33B068a07b1
tttctcctgaaacccaaacgaaccctaaaaaatggcaccaaaagccgagaaaaagccagcagagaagaaacccgcggaggagaagaaaacaatagctgagaaagctccggcggagaagaagccaaaggctggtaaaaagctaccgaaggaaggcggagcagccgccggagacaaaaagaagaagaggatcaagaagagtaccgaaacctacaagatctacatcttcaaggtccttaaacaagttcatccagatattggtatctcaagcaaagctatgggtattatgaacagtttcatcaatgacatctttgagaaactcgctcaagaagcttcgagactcgcgaggtacaacaagaagcctaccattacttctagggaaatccagaccgctgttagacttgtacttccccggtgagctttgcgaaagcattgcccgttttc

SEQ ID NO: 15334 - DNA, 223 bp, Gossypium hirsutum
  Clone ID: uC-gsflnu33B068a09b1
tttgtttcccagcaaaaatcaacctttgctgatctggtggaattccttttttgtgctgaatcttcgtggtgggatctaagccttaaggtcttccttaatgtgggttttctggttttacgtgaaggattgtgccctttgatggccttttaaataattcctagtctttgtttaccggttgcatctatgtatggtttctctttgaatggaatttgcatatttacct

SEQ ID NO: 15335 - DNA, 80 bp, Gossypium hirsutum
  Clone ID: uC-gsflnu33B068a11b1
gtaataaaaaagcaacacaaaaaaactaaccgggataaattataaacatataacccccctacccaaaaaaccaataaaca

SEQ ID NO: 15336 - DNA, 379 bp, Gossypium hirsutum
  Clone ID: uC-gsflnu33B068b02b1
tcacgcgtccggtcaaaacaacagaaaacacgcaagaaagatcgataatgaacacgttaacgatgctccacgattacgaaaaaaatatcaaacaagatcctcagagcttagaaagagctgaagcattggaatcattgttggagatttgtgctagtttacttaaacagcaaagacttgaggaacttgcaggggttttaagaccatttggtgaagaagctgtttcatcaagagaaacagcaatttggttaacaaagagtttgatgaatgctaaaagcaaaatcccagtagatcataggaattgaattgtaagtttttaacaaaagaatccagcaataggtaactcaatgatgttttctttctgtgtgtatttctttcaatt

SEQ ID NO: 15337 - DNA, 426 bp, Gossypium hirsutum
  Clone ID: uC-gsflnu33B068b03b1
tttcaatcaatcaaatggagttaggggaactgtgggcgatcttcggtcccggcgtcgctggcgcagtgttcggtgccggctggtggttttgggtcgacgccgtcatatgcagctccgtcaatgtctctttcgtccactatttacctggaatatttgcttctatcgcggctttgatgttcaattgcgttaggaaagaggatattgattactctccttatgatgaaggcgagtggaggttgaagctctggcttttctttgcttatgttgtatcctttgtctcactagctgcttcagttggcctcttgatacaagactcactagtgaaatctggtccttcaatgtggacgggtactgcaggcatcttacagtgtgtgtttgtcttaatcagtgggctgatatattggacttgtcactttagaaataaca

SEQ ID NO: 15338 - DNA, 108 bp, Gossypium hirsutum
  Clone ID: uC-gsflnu33B068b07b1
ctcacgcgtccggtcaacgggctagaaaacccgtaaggcgcaaggaagctgattggcgggatccctcgcgggtgcaccgccgaccgaccttgttcttctgagaagggt

SEQ ID NO: 15339 - DNA, 77 bp, Gossypium hirsutum
  Clone ID: uC-gsflnu33B068b10b1
ttcagtaggccatgttacctttgctatgggatggcctttagcaaagaatacccgcactccctccaacaccctaataa

SEQ ID NO: 15340 - DNA, 84 bp, Gossypium hirsutum
  Clone ID: uC-gsflnu33B068b11b1
atcggattcccgcccggcatgcgggagggctttgcggtcttgagcttccggacgaggttctggatgttgcctaaatccaatata

SEQ ID NO: 15341 - DNA, 354 bp, Gossypium hirsutum
  Clone ID: uC-gsflnu33B068c03b1
ataaagccttcttttgtcaaggagcgtcgtgcaatgaagagagaatatgaagaattcaaggtgcggatcaatgcccttgttgccaaagctcagaaaatgcctgaagaaggttggacaatgcaggatggaacgccatggcctggaaacaacccaagagatcatccaggaatgatacaggtgtttctaggtcatagtggggggcttgatactgatggaaatgagctacctcgccttatctatgtttctcgtgagaagcgacctggctttcaacaccacatgaaagctggtgccatgaatgctttgatccgagtttcagctgtttctccaatggggcatatttgttgtatgtccatt

SEQ ID NO: 15342 - DNA, 402 bp, Gossypium hirsutum
  Clone ID: uC-gsflnu33B068c04b1
ttgattgaaattcataatctcccaaaaatgatcagttaatttttcgtcattgaggtgtttttagggtttttattcttccaacttttaattgaagactatcattcattcattttagttgatccttctgaagtaacaaccaaaagagcggtttaatcgatttttaattcgtttagattaacttcatggcagaggctccccggggccgtgttactattactctcggacgtagtggccaggttgtgaagaggtccggagctgcatcggatgattctcttcctgttgctggaactaagcggtctgtaagggatagattaggaggcaatatagatagttccttgttgaatggcggtcagctcaacaacaaaagacaaagaggcgatggtcaaagagcaagtttgaatg

SEQ ID NO: 15343 - DNA, 55 bp, Gossypium hirsutum
  Clone ID: uC-gsflnu33B068c06b1
ttgacacctccgctcaagcaagaattgagctttgcacttgcaggaaatcagccac

SEQ ID NO: 15344 - DNA, 148 bp, Gossypium hirsutum
  Clone ID: uC-gsflnu33B068c07b1
tcacgcgtccgcttctttcctcctagccaaaaaaaaaaaaaaaaagcctctttcctgtctctcgttctttttcctgttcaatcatgtcttgcttcattagcaaatatgctgatgagttggctaaaaactctgctttacattgtacccc

SEQ ID NO: 15345 - DNA, 129 bp, Gossypium hirsutum
  Clone ID: uC-gsflnu33B068c09b1
tgctcacgcgtccgtatgatttttggcaattttcaggtgagagatgtcttagaaatttgagggggtgtttttgccattccacattccctctcttttttatctctataccctcccttatctctctcccta

SEQ ID NO: 15346 - DNA, 278 bp, Gossypium hirsutum
  Clone ID: uC-gsflnu33B068c11b1
tttgcaacccaaagtaccacaacaacaccactttgttcaccatcactagtaattccatcacactttgactggcatgagtacgggctaggacacagctgtgtgcctcacatccaatgcccacacagcttacgacacgggcatgtcacttggccatgtgtgccacattcacactttgactggtatgagcacggtctaggacacagtgtgccttacatccaatgcttacacggcttaccacacatgcatgtcactcggccatgtgttgcatcaatcacact

SEQ ID NO: 15347 - DNA, 406 bp, Gossypium hirsutum
  Clone ID: uC-gsflnu33B068c12b1
ttcacgcgtccgctcaagcaagaagcgagctttgcacctgcaggaaaacagccacaaagataaagctgaattccaagaagcaaagatgttgagcgtctcaattgcgtccccagctaccttaactctccctccaaaacccaaatcctcaattcccaaaacttccttcaccggcgttagaatccagcacttatgtccccaacggttgccttctcaggcgacctgcttttggcaaccgtcaccttcgtcctccgtggtcatgatggctaagagagaagaagaaatgaaggaaataagagccaaaaccactgaggaaatcaacgatgaagtggttgaattaaaaggtgagcttttgatgcttcgtctccagaaatcggttcgtaatgagttcaagtctagcgagtttggg

SEQ ID NO: 15348 - DNA, 393 bp, Gossypium hirsutum
  Clone ID: uC-gsflnu33B068d01b1
ctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattactcaaaagaagacccctttttttttacattattatccctataaatttcctatttgaaattcaagtcatttaagcataaggttgcactgtaatactaactatatattttatgttgttagttgttactagtggtttaagtgttttgtttttttgtaccaaattgtcactccattaaaatgagagtggctaaactttgctttattttattaatgaagat

SEQ ID NO: 15349 - DNA, 364 bp, Gossypium hirsutum
  Clone ID: uC-gsflnu33B068d02b1
tcacgcgtccggtcgccgagtcgaagaggattcaagcccctttccccacagcaaaaaatgaagtacaacccacgagtctcctcctctcgccgcaagagccgcaaggcccatttcacggcaccctcgtcggtccgccgtgtgttgatgagcgccccactctcatccgatttgaggtccaagtacaacgtccggtccatgccggtgcgcaaggacgacgaggtccaactggctcgtgggacttacaaaggccgggaagggaaagttgttcaagtctaccgtcgcaaatgggtaatccacatcgagcgcatcacccgtgagaaagttaatggtttgaccgtcaacgctgggattaacccatccaagg

SEQ ID NO: 15350 - DNA, 403 bp, Gossypium hirsutum
  Clone ID: uC-gsflnu33B068d06b1
ctcacgcgtccgtgctcattcatggtgacttggtttatggttttatctgttgctgctaaaatcttataaaaatatatatcggttgctgctcttggtttgtatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacggggcgccccttttaaaggacccaagtttccttccccgggcatgcaacgcaaaagtttttttttggggcccccaaaattaaattcattgcccgcgttttaacaacgtcggaactggaaaaaccctggctttccccaactaaatccctttgaaaaacatccccttttccccagttggcttaataccaaaaaggcc

SEQ ID NO: 15351 - DNA, 410 bp, Gossypium hirsutum
  Clone ID: uC-gsflnu33B068e01b1
ttcacgcgtccgcaaagctcgattgagcatatatgacccgcaggtgaccgaagaccaggtccaacgggatctttccatgaacaagtttgactgggaccatcctcttcacttgcaacccatgagtcccacgactgtcaagcaagtcagctgtgtgtgggatgcttatgaggcaaccaaagatgcccatggaatttgcattctgaccgagtgggacgaattcaagaaacttgacttcaagaggatatacgacaacatgcaaaagccggcttttgttttcgatggaaggaacatcgtgaacgcggatgagctgagggagattggtttcatagtgtactcaattggtaagccactggatccatggctcaaggacatgcctgcagtagcataaatgtctatcgattacagatggg

SEQ ID NO: 15352 - DNA, 182 bp, Gossypium hirsutum
  Clone ID: uC-gsflnu33B068e02b1
ctcacgcgtccgcccacgcgtccgtaagtggtgggtatccatggatttgatgggttcttaaatcttaagtttgttatgcttatttttggtagtttttttctctataattttatgctccatttttgaaccattatagttgtttcaaccttaaaaaaaaactcaaatccacctctcacaaaatt

SEQ ID NO: 15353 - DNA, 230 bp, Gossypium hirsutum
  Clone ID: uC-gsflnu33B068e04b1
ataaaaacaaaaaaaaaaaaaaaaaaaaaaaaaaaaaattaaaatattaaaataaaaaaaacaaaaataaaaaaaaacaaattacataaaacacaaatacaaataaaaaaaaattaaattgggggcctcctttttaagtcccccccgttctcccccctccctccgccctcttttcattttcttttgggcccctcctgttccactttctcggcccccctcttttcccctct

SEQ ID NO: 15354 - DNA, 388 bp, Gossypium hirsutum
  Clone ID: uC-gsflnu33B068f01b1
agtggaaatggagattcttccacagcgatcatcattatcctcaactttgaatcccaacgctccattgttcattccattagcatatcggatggtcaaggatttctctgatcaatggtgggctctcgtccaatcatccccttgcttccgcgactactggcttcaagaacgcttccatgatcccgaaaacgacgacgtttccgacgacgacgatgatcctctcttcccggatgacctcgatgacatatttgagcaatacgacgacgttttactcgacccaagacaggaaaaggaaaagaaattggtaccgtttgggacatcgaagtggcggaaggaccgagttgtgactgagtcacggaggtttatcgaaaaagcacccaagattgtgact

SEQ ID NO: 15355 - DNA, 51 bp, Gossypium hirsutum
  unsure (1)..(51): unsure at all n locations
  Clone ID: uC-gsflnu33B068f03b1
atanaagataacccccaaaaatgtgtggaggtgcaattattaactatttta

SEQ ID NO: 15356 - DNA, 184 bp, Gossypium hirsutum
  Clone ID: uC-gsflnu33B068f04b1
ctcacgcgtccgcccacgcgtccgtagtggaagatgaaaagaaccacggatcctttgacttcatctttgtggatgctgataaagacaattacctaaactaccacaagaggctaattgagctggtgaaagtaggcggtttgatcggctacgacaataccctatggaatgggtcggtggtagcacc

SEQ ID NO: 15357 - DNA, 71 bp, Gossypium hirsutum
  Clone ID: uC-gsflnu33B068f06b1
ctcacgcgttcgccgagagccgttcgcgcccggtcgttctcataaccgtatcaggtctacaaggtgaacag

SEQ ID NO: 15358 - DNA, 174 bp, Gossypium hirsutum
  Clone ID: uC-gsflnu33B068f08b1
ttgacgcgtgggcggacgcgtgggctctgtcttttatattccctctttaccaggtccgtttctctatcacaccagcaacaaccttaagcttgaggatgacttactcctactcttctcaaaatccagcgattgagcagcatagagctataatttcaaacaagcttggataaaagc

SEQ ID NO: 15359 - DNA, 74 bp, Gossypium hirsutum
  Clone ID: uC-gsflnu33B068f10b1
atacaacaagccatcaagctctacaacaaacatggaaacacagctgtttcttcggttccaaaacccttacatga

SEQ ID NO: 15360 - DNA, 122 bp, Gossypium hirsutum
  Clone ID: uC-gsflnu33B068f11b1
tgcgtattagcattaggattccactgagtgctataacatacttaaaattgctgtgggggaaatttgatatatataatatagcattaatgatgaagagtccaaacaaaacttagagtcattat

SEQ ID NO: 15361 - DNA, 304 bp, Gossypium hirsutum
  Clone ID: uC-gsflnu33B068g01b1
gtttgcctaagcaccttgatgagaaggtggctgctcttcaccttggaaagcttggggctaacctcaccaagctcaccaaggatcaggctgactacattagcgtccccattgagggtccttacaagcctcctcactacaggtactgaggagagaatacgagagagagagagggagagagttggactagaaaaaggaaccatacaacgggatggtttgattgtttgtttttactaaaatttattgatgatttgtggttagatggttagattttgattttgataggagtttgcgtgtgggatggatg

SEQ ID NO: 15362 - DNA, 411 bp, Gossypium hirsutum
  Clone ID: uC-gsflnu33B068g02b1
atatccccatctctctcgtctctgggtctcgtaagtgggtgaatagtgttgtaattagtgccaatggctcggattgggacctctgcagctcacattgtgttggcaatatttgctgtggccatgtttgttgtgtccgggaccatggcacaggatattgctccttctcctgcaatggctaccggagcaggctctgctttgccggtttccgctgtcttcttatgctcttccatgttggtctctttaattgctctcttggtgcattgaattcaaagcttttcaagactatatgacattggctacccttaatttcattctcactggtgatgaggggagtagcctctaatcttcttcgagataatatttgggtgttatcaattttcaatttctctattcctaaagttttagatactt

SEQ ID NO: 15363 - DNA, 148 bp, Gossypium hirsutum
  Clone ID: uC-gsflnu33B068g03b1
atactacttaaccctagttttactttccctttatcagtatatatatactacaactgtaacttatttttgtcatttcaggtgttaaagtttttgtggatgatgaagtgctttgttgctttttttttctgttattctgctgtttatggca

SEQ ID NO: 15364 - DNA, 147 bp, Gossypium hirsutum
  Clone ID: uC-gsflnu33B068g04b1
ctcacgcgtccgggctgaattgcttatccctgcaagtgaattatcacaacatatcagcactgctggaatggaggcaagtggaaccagcactatgaagctcgtgatgaaaggctgcatactaattgccacctccgacgctgccaatgt

SEQ ID NO: 15365 - DNA, 99 bp, Gossypium hirsutum
  Clone ID: uC-gsflnu33B068g06b1
gtaatgagaaatgggttcttagaagagcctttgatgattaaaaccatccttatttgccgaagcatatctaatacaggcagaaagaacaatttagtgatg

SEQ ID NO: 15366 - DNA, 237 bp, Gossypium hirsutum
  Clone ID: uC-gsflnu33B068g07b1
ctctcgtcggttcttatctcaaaagacccaatttccttctcctcctcctttgaaatggtttttccccatgtgggattataacaaaccagttaatgttaagcaaaaccctggggttttgccatcttcgttggctttacaaacgatgggaactttatacagacttgtgacgaaagccatccccgacctcactgacatttcccgtttttccaagttttccttcctatgcatcttacattg

SEQ ID NO: 15367 - DNA, 119 bp, Gossypium hirsutum
  Clone ID: uC-gsflnu33B068g10b1
ttccccgtctcctatatctagccctcatgctctctctggttcatccactcctcttactggtggcagtggcgccattccatttcatcaccaaaaacagccaatggcctatttgcatgaag

SEQ ID NO: 15368 - DNA, 405 bp, Gossypium hirsutum
  Clone ID: uC-gsflnu33B068h02b1
ctcacgcgtccggaccgggtgggctatgatcagcctagtaaagcagtagagtggctgattaaagcagctgctgatgcaattgcggagcttccttcacttaacacttcatttcctgataccccaaggcaattgagtgatgatggaactgaacaagggtttgactcggctgaagtagagttagatggcgatccgaataattaccaacaaaaccaaagtcagcagcacctttccttgtccaaatcagcttgcagtagcacgtccgagattagcaagaactcgggtttatccctttccaggtctgagaaccgtgttaaggcccgggaacgggcaaggggaagagtagcaaaagaaaaagggtaagagcaaaagactgacattgcacatcaacaaaaagggaaccccatt

SEQ ID NO: 15369 - DNA, 394 bp, Gossypium hirsutum
  Clone ID: uC-gsflnu33B068h03b1
gtaaacttagcgacttgctactcgctactcgctactctttaattggctaaccgggtcaatcttagcgtagtcgccacgaccgaggaaaaaacacaaatttttctcgtgtccacgacgcgttcgagaaaatgccacaatcagtatcttgaccattcactttccacgaaattgtctgccccccaaaactaagctcttcacagtataaaaatcatcgccattccccgcaaaattcatcatatttctttataaactttccccgtttctcttcggttccccttaaaaaagaaaacccagaaattctcctttcttcttttcctttaatatttacttaaatttgctagttcataatttttcgcagatgacgagtttaataaaggtgcttgttgttcaagtt

SEQ ID NO: 15370 - DNA, 471 bp, Gossypium hirsutum
  Clone ID: uC-gsflnu33B068h07b1
ttcacgcgtccggaccggttgggctatgatcagcctagtcaagcaatagagtggctgattaaagcagctgctgatgcaattgcggagcttgcttcacttaacactgcatttcctgataccccaaggcaattgagtgatgatggaactgaacaagggtttgactcggctgaagtagagttagatggcgatccgaataattaccaacaaaaccaaagtcagcagcacctttccttgtccaaatcagcttgcagtagcacgtccgagattagcaagaactcgggtttatccctttccaggtctgagaaccgtgtaaaggcccgggaacgggcaaggggaagagtagcaaaagaaaaggggaaagagcaaaagactgacattgcacatcaacaaaatgtgaaccccatttctcaaaactcttccttcactgagttactaaccctgtggcatttggcagttgttaggcaaacaaaa

SEQ ID NO: 15371 - DNA, 259 bp, Gossypium hirsutum
  Clone ID: uC-gsflnu33B068h09b1
gtgcctctcccaattttttcttcactttgaggtttgagcagatcggatggcaccaaagaaagataaggcccctccaccttcttccaagccagcaaagtctggtggtggcaagcaaaagaagaagaagtggagcaagggaaagcaaaaggagaaggtgaacaacatggtgatgtttgaccaggctacttatgataagctcctatctgaggctcctaaatataagctcatcactccctcaattttgtctgatcgtatgagg

SEQ ID NO: 15372 - DNA, 495 bp, Gossypium hirsutum
  Clone ID: uC-gsflnu33B070a03b1
aacagaggttgaaataatgcctgggtttttctttacatggctgctttgtttcatcatttttaatggttactcagagggtagccatggatatcagcaacagcaatctgctgttgttgttggaactgtttactgtgatacatgtttccagtctgacttctcaaggccaacccatttcatttcaggtgcaactgttgcagtcgaatgcaaagatgggaaaagctcaagggcaagctttaggcaacaagtgaaaaccaataggcatggggaattcaaggttcatttgcctttttctgtgagcaaacatgtgaagaaaatcgagggatgtgaagttaaactgattaaaagcagtgaaccatattgtgcagtggcctcatctgctacttcctcttcactccatctcaagtcaaggaagcaaggaacccatgttttctcagctgggttttttaccttcaagccattcaaacaaccaaccttatgcagccaaaaaccaagtgt

SEQ ID NO: 15373 - DNA, 425 bp, Gossypium hirsutum
  Clone ID: uC-gsflnu33B070a05b1
atcttctctccattggcatgtttcaagcggatcgattccttaagatttacatccgccttatccgttgctctagcagttgtgtttcttgtcattactgttggaatagcaattatcaagttgattagcggaactgtaatgatgcctagattgcttcccgatgtcactgatttgacctcattctggaaactcttcaccgtagtccccgttttagtcactgcatatatctgccactacaatgtccacagcatagataacgaactggaagattcaacccagataagaccggttgtgcgaacagctctggctttatgctcaactgtttacataatgacaagctttttcggatttcttctatttggtgacgccacaatggatgatgtgcttgccaactttgataccaaccttggcattccctatagttccct

SEQ ID NO: 15374 - DNA, 133 bp, Gossypium hirsutum
  Clone ID: uC-gsflnu33B070a06b1
ggccggagtgaaagacaagacacagagagagagacagagagagagatgtcgggaggaatagcgcgtggtcgactcgccgaggaacgtaaggcatggaggaagaaccatccccatgtccttggaggttttttta

SEQ ID NO: 15375 - DNA, 99 bp, Gossypium hirsutum
  Clone ID: uC-gsflnu33B070a07b1
gaaaaggttgttagtatctgtgttaatggaatcgaagccaatttccatatgtttcttgatcataaagggaagcatattttttaagggaagtagatggtg

SEQ ID NO: 15376 - DNA, 81 bp, Gossypium hirsutum
  Clone ID: uC-gsflnu33B070a11b1
cgtccgcccacgcgtccgatccggaggcgagtcggagagagagatgctgcgaggaatagcgggtggtacgcaccccgaagt

SEQ ID NO: 15377 - DNA, 460 bp, Gossypium hirsutum
  Clone ID: uC-gsflnu33B070b01b1
cgcgtccggctatgtccgcattgtgtgaggcaaccggtgctgatgtgagccaagtgtctcatgctgttgggaaagacacaagaattggacccaagttcttgaatgcgagtgtgggtttcggtggatcgtgtttccaaaaggatattttgaacctggtctacatctgtgagtgcaatggcctcccagaggttgcaaactactggaaacaagtcattaagattaatgactaccagaaaactcggtttgtgaaccggattgtttcctcaatgtttaacacagtttcagggaagaagattgccattctcggatttgctttcaagaaagataccggtgacactcgggagaccccagggatcgatgtatgcaaagggctgttgggcgacaaggctcttctgagcatatatgaccctcaagtcaatgaggagcagattcagagggatcttgcaatgaaaaagttcga

SEQ ID NO: 15378 - DNA, 220 bp, Gossypium hirsutum
  Clone ID: uC-gsflnu33B070b03b1
cactcagaaaattgggagattggaaaaagagaaacagagaagagaaagaatggcttggatatggttggaagcagcacttcccctcggaatcatagctggaatgctctgcgatatgggcaatgctcagtatttcatccaccaaagcttatcacggccggcccaagcacatcgggaacgatatgcgggacgtcttcatggaaagaagggataagatgctctt

SEQ ID NO: 15379 - DNA, 219 bp, Gossypium hirsutum
  Clone ID: uC-gsflnu33B070b05b1
ggcgtcgaatccggtaatccaagatgcccgattcaacgacgagcagccggtgctacctccactaacatccccgggaccctcctcaaggggaggatgcgtgagggtgaaattcgggcagatgccagcttgctgtacgaatcgagggatctgattgcctcaccagagatggccgccatcgtagatccttcgacgtggtttatgatacactctatgggacga

SEQ ID NO: 15380 - DNA, 202 bp, Gossypium hirsutum
  Clone ID: uC-gsflnu33B070b06b1
caaagtccaaaacaaatcaactttcgataacctttttcttaacctcaaatcgatctctgaatctatacaaaaaaaactaaccaaaatctatctccatttcaatttcgcactgaacccaaaaaaaccagagtccctttctcagaaaagagatggcaatgaaccatgcggcagcggtgaaggtggggttaggtttactaggtct

SEQ ID NO: 15381 - DNA, 491 bp, Gossypium hirsutum
  Clone ID: uC-gsflnu33B070b08b1
gcgtgggtttacactcccccttcagatatcttcattttcatcttcttcctctttctttctgttctttgttttcttcaaatactgccctttcattttccttagttcttgttaaaaagaaaatgtgtgggattttagctgttttgggctgttctgatgattctcaggcaaaaagggttcgggtgctggaactttcccgtaggctcaagcaccgtggtcctgactggagtggcctctaccaacatggagactgttatttggcccatcaacgccttgccatcattgatcctgcttccggtgaccaacctctctttaatgaagacaagtctattgttgtcactgtcaatggagagatttacaaccatgaagaactaaggaagaagttggcccaccacaagttcaggactggcagtgactgcgatgttatttcccatctgtatgaggagtattgtgaagactttgtggacatgttagatggaatcttctcatttgtg

SEQ ID NO: 15382 - DNA, 99 bp, Gossypium hirsutum
  Clone ID: uC-gsflnu33B070b09b1
ccacgcgtccgccaagatgaacccggttcaaatacagtggtttattggagtgaaggtagcccagagaagatgaaggctgcggggatactcagctcttat

SEQ ID NO: 15383 - DNA, 286 bp, Gossypium hirsutum
  Clone ID: uC-gsflnu33B070b10b1
acagcatataaaaagcttattaaagggaaaaaaaacaccgatccaatgagttacctgaaccgggtttggatggcgacgagcatggcgatggtacaaggtcacggtgaaaaccaaggtcaaaactggaaatcaggcatcaagtttctccaaaggggccaaaggaggcccttcgacggagaatcttcgaatctccggccgatttccggttctgatctaaccggcgtggtcgggaaccgtgacggccaagccgatgagtcgatccgtccagtcatgtatcttaattgtt

SEQ ID NO: 15384 - DNA, 480 bp, Gossypium hirsutum
  Clone ID: uC-gsflnu33B070b11b1
cacgcgtccgagaagcctgagcctaagccaccagtttatacgcctccaaagaaagagaagcctgaacccaaaccaccagtatatgaacctccaaagaaggaaaagcctgagcctaagcctaagccaccagtttatacgccaccaaagaaagagaagcctgagcccaaaccaccagtatatgaacctccaaagaaagaaaagcctgagcctaagccaccagtttatatgccaccaaagaaagagaagcctaagcctaaaccaccagtgtatgaaccaccaaagaaggagaaacctgaacctaagccaccagtttatgcacctccaaagaaagaaaaaccagaacccaaaccaccagtttataagccttcaaagaagccaccagtgtatgagcctaagccaccaaagccaccggtttacacaccaccaaagaaagagaagccagaacctaaaccaccggtacatgagtttcccaagaaacca

SEQ ID NO: 15385 - DNA, 191 bp, Gossypium hirsutum
  Clone ID: uC-gsflnu33B070c01b1
cgcgtccgctttcccaaacagtaaataaaagaaaaagaaatctaaaagtcgaaaaaagaaaaatcgagaggaacgaagaaaaaaaactcaaaatcaccttttttgctctgaatcctttttttttctattccatattcgtgtcaaaaaaaggcctcttacagtgttagaatcggtcttgtataacagaatcg

SEQ ID NO: 15386 - DNA, 366 bp, Gossypium hirsutum
  Clone ID: uC-gsflnu33B070c03b1
gggctgctctggtaaaaaaactattctctattccgcctcaacccgaaacagctttctcaatcaacgaccatctgcgagtaatggataacatagtagattccttaaacaaagcctaccaagaattcgttgcagcagcagctaatgtcctcgaaactaagggatcttcggctgcccaaaagacggaatccaccgatacggcattggaaagctttaaacaaaaatgggaaacattcggactggcttgcgatcaagctgaggagtttgttgagtcaatcaaacaaaggataggatccgagtgcttggtcgatgaagccaccgggaattcgtcggagcggttgactggcctgccccccatcagtgccgtcc

SEQ ID NO: 15387 - DNA, 490 bp, Gossypium hirsutum
  Clone ID: uC-gsflnu33B070c07b1
tttggtagacaagaaaaaaagaagaaaagaatggcaaagtgtttcaacgtggttcagaagcagaagagagcccaaatagcggagagaaaaagattaattcatggtgaccctgcaacaaagaagctaaagaacaaatcccaatcactctccgtctctggaaaacgcaaacgcaagcttctcaaaaaatggcgcagggagcaaaaggaggttatagagaagggtttggtgactatggaagatgtggaaatggtggctgctgaaggtttggaattttcttttcctcctttttttaagtggttgatttcatgtctgttttgtacttcaaaaactgcaattactgctgaaggtttggaattttactaatttgggttagctgttaggtgctgaatgctgattgataaactcaaaaacacattatatttataagcttataagctatattataaaagctgtttgatattataatataagtttttaagtttaccctgca

SEQ ID NO: 15388 - DNA, 121 bp, Gossypium hirsutum
  Clone ID: uC-gsflnu33B070c09b1
agaaacgaagtgatatggtccatggttggggctcaaaccaccgagcaaggcgactgttccaaattcaaaggaaatgtgccccactgttgattgaggaagcctgttgtggtggatctacctc

SEQ ID NO: 15389 - DNA, 174 bp, Gossypium hirsutum
  Clone ID: uC-gsflnu33B070c10b1
gccttggtttgtgttggaggctgcactgcactgcactccctatcgcaaaacttggtttcaaacaatgctaagacgcacaagttccatctgtgactgttgactgacaacaaaccccatgaggaagtctggttctctttgaaccatattgtagtatttttgtttttgctccttctt

SEQ ID NO: 15390 - DNA, 360 bp, Gossypium hirsutum
  Clone ID: uC-gsflnu33B070c11b1
cgcgtccgagttgatattcaaaaaccactttctaaccatactattcccagttgaccggttttccgagatgggtccttcttcacgaacatatttcagcaataacggctttacgtgtctgcagattttggattatatctattccttttatcaggagaacatgtcgagtcatgaaatagaagctgctatccacacggactcgaggcatgctgaccggcttcgagcattgtactctagcaaagagacagttgaatgcggtggaaacatgattttcaaacgaatcgatttcttaggaagtcgtagaagcttcgaaatgttaaagcgtgttagtggggataattacatgtattttatttgagcttc

SEQ ID NO: 15391 - DNA, 391 bp, Gossypium hirsutum
  Clone ID: uC-gsflnu33B070d01b1
attgctcgttacgccccctcagcgtggattagggattccgcttgcttttcatattttcttttccatttcttgtcctcatcaagcttccgagtctcccacgtttcccttccagggaaagggaacaaggagttttggtaaaagaaggaacaagacccacactctctgcattaggtgtggtcgccgtagcttccatctctagaagagtcattgctctgcctgtgctttccctgctgctcataactggagtgtgaaggcaaatataagaaagaccactggaaccggtaggatgaggtatctactccatgtccctcgcaggttcaagactggtttcagagaagttccggtgttggatcatgatctaggtactggagcagcaccgaggaattaggtt

SEQ ID NO: 15392 - DNA, 494 bp, Gossypium hirsutum
  Clone ID: uC-gsflnu33B070d02b1
gcgtccgcccacgcgtccgcccacgcgtccgcccacgcgtccgcccacgcgtccgctctatcaacagtcaaccaacacggtttctacttcttcatcttcacagtaactgaaacatggagagtggaaggaagaagagaaaaatggggaatgaagaggaaaaagactatgaagatgattatgaatatatgtttgtggtttagtccttctctttctttctgtatttatctgttttttttccttcttttttattttatctttttttttcttatctttttctattatttttttgttttatttctacttttttcttattttttttatttttctcttttcctttttatttcttattcatctttcttttcttttattttaattttattttttcttctctttctttttttttttttattttttttcttcttcttctcatttctttttcatcttctttttttttttctctattatatttaccttatttttcacctttttctttt

SEQ ID NO: 15393 - DNA, 278 bp, Gossypium hirsutum
  Clone ID: uC-gsflnu33B070d04b1
gatctcaattctcaaattgtagcgcccttttatatcaagcaatggctctggtcttgcatgctggaaaaacaaacaaaaatgcctttaaggcactcattgctgcagaatatagtggtgtgcaggtcaaaatggttgagaattttgagatgggtgtgtcaaataagactcctgagttcatcaagatgaaccctttggggaaggttcctgtgttggaaacacctgagggtcctgtatttgagagcaatgccattgcttattatgtttgctcgctcaaaggt

SEQ ID NO: 15394 - DNA, 253 bp, Gossypium hirsutum
  Clone ID: uC-gsflnu33B070d05b1
tctacctaactctatatctcagatactgtattcatactacctcttaactctatgacagctgtacaaacagcaccctactgccctccttttgctgatgttgcagaggaggagtaagaatagaggaacccaaaggcttttgtatgattaaattgaaagcatttccattattttctttgcgtgtagttctgagagtgggaggtgccttaattgatttttcttacccttcacaactcttctatctatgttttttttt

SEQ ID NO: 15395 - DNA, 333 bp, Gossypium hirsutum
  Clone ID: uC-gsflnu33B070d06b1
gcgtccgcccacgcgtccgcccacgcgtccggtcactacctatacataagatgagagaccatgttctgatctaccttctactagcatggctcctgcttatacattatcaactccagggatccgatatcagtgttcgagctattgactcagtgccagcagttcacttcaagttcagcacacctagaagcctaatgccaagggcacgtgttagaaatgcattacctacctgggttgaaatgaagaagattcataaatccccatccagccccaacccagtcaaaaatcgccggtcaccatctaaacactaaggtgatacataacagagtggtagtc

SEQ ID NO: 15396 - DNA, 408 bp, Gossypium hirsutum
  Clone ID: uC-gsflnu33B070d07b1
cgcgtccggcggattcgttgcctcattgctggtcaagttgttgctcgagaagggttacgccgttaacactacagtcagggaccctgacaaccagaagaagatctctcaccttgtaacactacaagagttgggagacttgaagatctttcaggcggatttaactgatgaagggagctttgatgcccctattgctggttgtgaccttgtcttccatgttgcgacacccgttaactttgcttctgaagatccagagaatgacatgatcaaaccagcgactcaaggagtggtgaacgttttgaaagcttgtgccaaagcaaaaacagttaaacgagtcgtcttgacattatctgtcgcagctgtgtttttcaacacactggatgggacagatctcgtcttgacagagaaaga

SEQ ID NO: 15397 - DNA, 59 bp, Gossypium hirsutum
  Clone ID: uC-gsflnu33B070d08b1
gcgttcgcccacgcgttcgggttgacggaccaggtgatgcagacggcccggtcgctccg

SEQ ID NO: 15398 - DNA, 287 bp, Gossypium hirsutum
  Clone ID: uC-gsflnu33B070d10b1
tcatactgattgtacttttatcagggtttccgggtctgagttagttcagaaatacattggagagggctctcgaatggttagagaacttttcgttatggccagggagcacgccccatcaatcatatttatggatgagatagacagcattgggtccgctcgaatggaatctggaagtggcaatggcgacagtgaggtacagagaacaatgttggagcttcttaaccagcttgatggatttgaagcattctacaagttcaaggctctgctggccacctaatcgtgttgac

SEQ ID NO: 15399 - DNA, 313 bp, Gossypium hirsutum
  Clone ID: uC-gsflnu33B070d11b1
cgcgtccgcccacgcgtccgcccacgcgtccgggctatcaaccacatttaatagctcctgaacaaggatatcgtcgtttgattgaatctactttagttactatcagaggtccagctgaggctgctgttgatgcgactcattccattctgaaggatctggttcacaaggctatgagtgaaactccagagttaaagcaatatcctgcactcagaggagaggtgggaaatgctgcgatcgagtctcttgaaagaatgagggatcagagcaaaaaaagcaacacttcaactgtttgatatggaatgcttgtacctta

SEQ ID NO: 15400 - DNA, 411 bp, Gossypium hirsutum
  Clone ID: uC-gsflnu33B070d12b1
acgcgtccgtaggaaacagattttgtccatttgggataaggcagatattgtcaaggttagtgatgtcgagctcgagttcctcaccggtagcaacaaagtcgacgacgaaactgccatgaaactttggcgacctaactttacactgctcttggtcacccttggtgaaaagggtagccgatactacaccaagaatttccgtggggcagtcgatgctttccatgtcaataccgtggacacaactggcgccggtgactcctttgttggtgcattgctatgcaagattgttgaaaacccaaccattcttgaggatgaagcaaaattaagggaagtgttgaaatttgcaaatgcatgtggagcattattactcccttataacataaacttttctactaaacttcattctttgggcgg

SEQ ID NO: 15401 - DNA, 156 bp, Gossypium hirsutum
  Clone ID: uC-gsflnu33B070e01b1
ggctcggggttccaaagaagaactgattgaaagctattttgcagcaacagaagttacaaatataaagtgctattgcttcttttcctttttataatcaaattccaatatgcttatcttcaatgcataataatggcagcaattgagttattttggatt

SEQ ID NO: 15402 - DNA, 81 bp, Gossypium hirsutum
  Clone ID: uC-gsflnu33B070e02b1
aaatagtatttagtattcaaaacgtttttagtttaggttcaacaccaaatcatgtcattgagacgctttttttgggggggg

SEQ ID NO: 15403 - DNA, 346 bp, Gossypium hirsutum
  Clone ID: uC-gsflnu33B070e03b1
tatactcggaggcagataggatgctggacgtgacccaggcctatccactcgtgaccacatgtatgcctgcgtcacgaactgatcactccacatgcactatggatgctgatctgatcggcactggcgtgatcgcacttgaatcgatgacccgtgtgagtgtaggatgagtaacccacgctatcttcatggttactcttcaccatagaaagccattcatactcaagctccacgttactggatgacatgaacagtctcacctctgacactcgaattcaccttcatgatctgagaactgcgtgtgttaactatcactgcgagggagaatcggcacttcatggtggcagac

SEQ ID NO: 15404 - DNA, 115 bp, Gossypium hirsutum
  Clone ID: uC-gsflnu33B070e09b1
acggaagaatactctgaaatctacgatccaaaatgcctaagcagattcatgagatcaaggacttccttatgactgatagaaggaaagacgcacgctctggaaagagcaagaagag

SEQ ID NO: 15405 - DNA, 84 bp, Gossypium hirsutum
  Clone ID: uC-gsflnu33B070f01b1
agccaggcaagcgacttcgaggttgatggtaaagatctcgagattccacggtttgcaaccaaggggagcagccgccatggctga

SEQ ID NO: 15406 - DNA, 499 bp, Gossypium hirsutum
  Clone ID: uC-gsflnu33B070f02b1
agcaagagcagtaaaaatccttgatcagcaacccataaggtttcttttctgtttttgtttttttgtcaatcaatcaatcatgacaggcaaagccaagcccaagaagcacactgccaaggaaatcgcagccaagatcgatgccgccactaccaaccgaggtggtggcaaggctggattagctgaccgttctggggtggagaagggtggacatgccaagttcgagtgtccctcactgcaaaacaactgcttcagatttgaagacgatgcatattcattatgatgccaagcatcccatgcttccttttgaagaattaaacgcttgtgaatctttattctactcatggtgctgattttttcatgccttgtcccggtgttagtggttgttttcttttttatatttccccatatactcatttctttttctttttactttattttcttctctctcctttctttttcttatctttctcttaatattcatctttttccatcttcttta

SEQ ID NO: 15407 - DNA, 479 bp, Gossypium hirsutum
  Clone ID: uC-gsflnu33B070f05b1
aatattctcttttgtttactgagttgcttttaatggagtcggatggaattatcagcctctttgattcgtgttggtttgagatggaaatattcaaaaaacagacatctccatcaacatctacggtttcggaaccaaaccaaaatctccgagttgaagaaacatcatcgaaaccagagtttacacgcaccccatctctccatacaaggtccatgagcgaccagttgagcttaaacagcacaagcttcataggttcagcttcgttgtcgcccgactcggttctccactcaccaaagctgcataaaatcatctcgggcaaagaaatgacggaagaagagttgcaagataacgggagtagaatccaagaagaacccaaaaaggagacagcagcaagcaacaggagaagtagtagaaggaaaaagggtacaagcaagagcttgtcagacttggaatttgaggagctaaaagggtttatggatctg

SEQ ID NO: 15408 - DNA, 496 bp, Gossypium hirsutum
  Clone ID: uC-gsflnu33B070f06b1
cgcgtccggttcatcccttcattaaaaaaaaaacccctaaaaaaccaacagtgaggtgcagggaaatagaacacaaaatggcgacagttccaggacagttgatttgggaggtggtgaagaagaacaattgttttttggtgaaacaatttggaagaggaactgctggcgttcgattcagcaaagagcccaacaatctctacaatgtcaactcctacaaacactctggtttggcaaacaagaaaaccgtcaccattcaacctgcaggcaaagaccagtctgtgctcttagccacaaccaagtctaagaagcagaacaagccttcgagcttgctccataagtctgtcatgaaaaaggagttccctaggatggccaaggcagtcaaaaaccaggtgacagacaactactacaggccggatttaacaaaagctgccctagcaaggttgagtgctgtgaaccgaagcctgaaggttgccaaatccggtgtcaagaagaggaa

SEQ ID NO: 15409 - DNA, 499 bp, Gossypium hirsutum
  Clone ID: uC-gsflnu33B070f09b1
atacaaaaaaagcagataggtagataggttgaactctcttttctccccttagaaccaaactttcaccgaccttcactttctgcctaccatgacggccaaggattgcggcaaccatggcaaaggccggcggcagctcatccgaaggctcttcggttgccttctagtcttcctccttatcgttctcatcacaatcctcatcatttgggcaatcctccgccccacaaaaccccgcttcatccttcaagacaccaccgtctatgctttcaacgcctccagtcccaatttcctcacttctaatttccaagtcaccgtatccacccgaaaccccaatgacagaatcgggatttactacgacaggctcgtcatctacgccacctaccggaaccaacaaaccacccttaggacagctctccctccaacataccagggtcataatgagatcaatgtttggtcccctttcatctacgggaacatggtccctatagctcccgatttctcc

SEQ ID NO: 15410 - DNA, 197 bp, Gossypium hirsutum
  Clone ID: uC-gsflnu33B070g05b1
ccacgcgtccgcccacgcgtccggcagtggtgaatggaacattgacactaagaggaggttactatgattttgttaatggagattttgagcaatggaagatgtgtaccaaaccatgccacccatattaaggtcctttttgccccatgcattatctaaaatctaatttaagctactgcgaatgtctcatttactacatc

SEQ ID NO: 15411 - DNA, 325 bp, Gossypium hirsutum
  Clone ID: uC-gsflnu33B070g06b1
aaacattatcacgtagatgtcactacttttgtctgaaacaacacacaccaagagcgagagaaagccttcaaaacaaaagaaaaattagaacatcaaacatgattggtccaggcagacctctcttcgtcctctttggatcttccatcgttcagttgagttacagccacgaaggttggggtgcaattcttgcacatgcatatgctcgcaaggcagacataattctgcgaggatacagagggtggaactcgaggcgtgctttggaagttctagataaagtttttcccatggatgctgctgttcaacctttcattggtgatagtttatt

SEQ ID NO: 15412 - DNA, 105 bp, Gossypium hirsutum
  Clone ID: uC-gsflnu33B070g08b1
gcgtccgtgttgagccagctcaaggaattaaaagctgaactttctctacttcgtgtcagcgaaggtcactggtggtgctcccaacaagctctccaagattaagga

SEQ ID NO: 15413 - DNA, 148 bp, Gossypium hirsutum
  Clone ID: uC-gsflnu33B070g10b1
aaaatggaagggaaagaagaagatgttagactgggagctaacacgttctcagaaaggcaacctattgggacagcagctcagtcccaagatgatacggattacactgcagtcaccccaagctcccctctatgagcctagtgagatgact

SEQ ID NO: 15414 - DNA, 118 bp, Gossypium hirsutum
  Clone ID: uC-gsflnu33B070g11b1
agaacaaacaagagagatagaggaagtctcaaatttcaacaatatttggcagcatcgggatgcttgaaacagcggcagaaatgtggggcgaaaaacatgtatgcaacaggtagtgtga

SEQ ID NO: 15415 - DNA, 508 bp, Gossypium hirsutum
  Clone ID: uC-gsflnu33B070h01b1
tttggcacctcaagacaagggctatttcgttgtaaatgatgtttttagatttgtcgatgatacgaaacatcaacctgggagccaggacccagttaatggttttgaggcttctcttactcctgagcaagaccattctcctgttccagagaatcacattgagcaaccggctgcattgcctgaagaatgtaattgaccagaagtgtacaatccttccgagaatggagatggctctattgaggaagaggaatcaccagcggctgaggttgttgatgagattcctgatgattcaaagatggtttctgattctaagcctgaaatggaggaactgccaaagaagtcatatgcgtctattttaaaggttttgaaagagaatgcagtccctgtattggcacctacacatccccctgtgaagcctgcagttaagagccaggagcatccttgaattgctgcaccaccttttgctccaatgcctagccttgaagctcaggtttctagcaacaatgttact

SEQ ID NO: 15416 - DNA, 403 bp, Gossypium hirsutum
  Clone ID: uC-gsflnu33B070h02b1
gcgtccgaaaagctctttcaccaggcctagtatacgacatctcgaccgaagaatacatcacattcttgtgctcactcggctacaccgtcgaccatgtcaagaccatagtgaaacgccccaacattacatgttcgacgaaattcaaggaccctggtgaactcaattacccatcgttttcagtcttgtttgggggcaaaagggttgttcgatacactcgtgaattaacaaacgtaggccctgcaaggtccatatacaaagtcacagttaatggaccatcgacagtagggatcttagttaggcccaagacactcattctttagatccgtgggtgaaaagaagagattcacagttccctttttagcttaaagaggaaccagccctatggcttaacccgtattttggt

SEQ ID NO: 15417 - DNA, 59 bp, Gossypium hirsutum
  Clone ID: uC-gsflnu33B070h03b1
ctgatctgaatcacggagtggtttattgtgttaagaccgatgagacctcaatgcatgaa

SEQ ID NO: 15418 - DNA, 256 bp, Gossypium hirsutum
  Clone ID: uC-gsflnu33B070h06b1
gcgtccgggaggacacccaaatactctttcaacggtatgaaggtcatagaggacgtgcgcggagtgctgaacgtggggcatggaagcggttgctgcggcgctgaggcacaaaagctgcctagggtttctgctgtcgaaaattgctagggctaggcatacgagccagtcgtaggattactgtactttgggccaatgggtttgtaatttattgtatttctatttccaggtttatgcatcttgggaccgggctacaatg

SEQ ID NO: 15419 - DNA, 144 bp, Gossypium hirsutum
  Clone ID: uC-gsflnu33B070h11b1
gcgtccgcccacgcgtccgcagtcttttacgcggttatcctctattggaccgctcaactacttggctcaaccgtcgcttgcctcttgctcaagatcgctactagtgacatgaccgtaccggctttaggaacttcatcgagagta

SEQ ID NO: 15420 - DNA, 490 bp, Gossypium hirsutum
  Clone ID: uC-gsflnu33B070h12b1
ctgaggcagacaccccgaaggtttctggcaatgcccgttctatttttgtggcaccaactcccggtatgcctgtaagtcagatttgggttcagaaatcatctcttgctgctgaacatgcagcagctggcaattttgatacagcaatgcgtttgctgagcagacaacttggcataagaaacttttctcctttgaaatccttgtttcttgatcttcacactggcagccatagctatcttcgtgcattctcatccgctccagttgtgtcgttggcagttgagaggggatggagtgagtctgctattcctaatgttaggtgtccgccagccctggtattcaatttctctcagttggatgaaaagctgaaggctggttacaaggccacaacagctggaaaatttactgaggcactccggctcttcctccgcattcttcatactattccgttgattgttgtggagtcaaggagagaagttgatgaggtcaaggagct

SEQ ID NO: 15421 - DNA, 467 bp, Gossypium hirsutum
  Clone ID: uC-gsflnu33B072a02b1
gggtattaaattttccaaagagggtcctctctctctctctctctctttctggaatcagaagaataattcttcggcatctcagaacacttttatttttaattattcaaattatttttttacctttttttttcatataaaactaaaaaattcttttgttagtttagtttactgtaaatttgaaagcaaaatttttagattcagttaaaaaaaattcaaaatcatgacttcagctgtcgagatcaacggtgaacaactagttaacgctcttcccgatctctcgattcaagatcagattgaagtgaagaagaaaggggctgttgttgaagaaggttgcgaaaaccacagtggaatatgcgcgatttgtttagataagataatgttgcagggaactgcactcgtaaaaggttgcgagcatgcttactgtgtgacgtgcatcctttgatgggcaacatacagtcagatgccta

SEQ ID NO: 15422 - DNA, 310 bp, Gossypium hirsutum
  Clone ID: uC-gsflnu33B072a04b1
gatgtggcatcaagtttccttttatcctatcgccatgagagccaagtggaagaagaagcgcatgagaagactgaagcggaagcgccgaaagatgagacagagatccaagtagacagaaccaccagcccctctgttatacgaggtttctcaatgtcttagctaatatcggtgtacttttagggtccacttagttatctgccatttttatttcagttttaagttttttttttctcttgggtttctattgtctttcaagttggtgctaacccggcagtgggatgatgtatcatcgttgagaacagtgaattgc

SEQ ID NO: 15423 - DNA, 403 bp, Gossypium hirsutum
  unsure (1)..(403): unsure at all n locations
  Clone ID: uC-gsflnu33B072a05b1
cttctcgtccgcccacgcgtccgattgaattctttccttcactttctcgagaaaaaaaaatgtcttcaggttgcaattgcggatctagctgcagctgcggcgacagctgctcatgcagcaagaaccttaaccttggatactcggagaagacaaccagcactcagaccatcatctccggagttgcgccagtgaagaccacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatganttattttcaaggatgaatgcctgcaagggctatgactataattatgtctc

SEQ ID NO: 15424 - DNA, 351 bp, Gossypium hirsutum
  Clone ID: uC-gsflnu33B072a06b1
gtttttcagaaaaacagaatccccctccctccctccctccatttgcacacctatgtttcttcacttccaacaaatctgaaaccatctccaaaattaaagaccaaaaaccgccatgaccgatcaccaccagcgggtcggccagctacggtccacatctgagatcctgaaaaagttcgacgagcatttcaccgctcaccctttcacattgctcttgctttctttcctcctcctctctttacggtgcttgggtgaatccggttcccttctcctcaactccttcatcgaccgggacccttctttcaaatgcctcctttctcggctcgacctccatcattctcatccccacgcgcg

SEQ ID NO: 15425 - DNA, 478 bp, Gossypium hirsutum
  Clone ID: uC-gsflnu33B072a07b1
ttctacgcgtccgcccacgcgtccgcccacgcgtccgctctcgcccaataagaaaccaaagaaaacctttgttaaaccaaaaatggctctcaccaactcctccattcttcccaccaactccatccttcaatctcagccatcaacgccgttctctaaggctaagccattgtctgtccttcggatctccgccgtccattcttctgactcgcctaagaaccccgtcgtctccgaaaaatccgtcaagcagcccgctactgctccactcgccgctaccaaatctgctaccgcgcccaccactgctccaccgaagaatgcggttcctgggaaatggaccgtggatagctggaagtcgaagaaggctttgcagttgccggagtatccggatcaggcggagctcgagtcggttctcaagactcttgatgctttccctccgattgtcttcgcttgagaggctcggagtcttgaggagaagctcggg

SEQ ID NO: 15426 - DNA, 433 bp, Gossypium hirsutum
  Clone ID: uC-gsflnu33B072a10b1
gtgacgatggggtcgatttcattaaaggtttccatgaatgtttaagatggttcagggtttattttgaagctttagatgaaagtttcaatagaacaagcaacgaaaagttgatgcttgaacgagccgtcggccgggccatcgttgacttagtggcttgttcgccgtcagagtcgatagagcggcgtgaaccagccgcgcgttggtcaaggcggttccatgcaagtgggttcagtcctgtgggtttgagtgatgaagtgtgtgatgatgtgcgcgccttgttgagaaggtataaagatggttggtcgatgacacaatgccctgacgccggaatattcttgtcgtggaaagatcagagggtggttttggccagtgcatggcggtcttgaccactgcgaccgggggcagatggcggttttcttttactttccttttt

SEQ ID NO: 15427 - DNA, 439 bp, Gossypium hirsutum
  unsure (1)..(439): unsure at all n locations
  Clone ID: uC-gsflnu33B072b02b1
tgtcttgacaacaatcacctccaaccccaccaagaaaattttcgaaattactgcttcctctatcaactggttctgaaatccaaaccctaattttcctaatccgaaaccctaatcgaactaattttcaaatcagttaagaatttccggccgaatcaggaaccctagattccatggcgtcgaggaaaaaggaatccgaagggattgccttgctatccatgtacaacgatgaagatgacgaagaaatgggagacatcgaagaaggtgaccaccggcaaaaccaacaaactggggaagaagaagaacaacaacaagaagggcagccgctagaagaagaaaacgattacagagaatctaataacaatatggaagaagattcgagaaccaacgataatacgcctncttttcctcaccaaaacaccattctttcacaacaacagca

SEQ ID NO: 15428 - DNA, 402 bp, Gossypium hirsutum
  unsure (1)..(402): unsure at all n locations
  Clone ID: uC-gsflnu33B072b04b1
gntttttgttaacgaataaggatcttttaagatacgccggatccgctaaaatacgccgatccccgttcgtcttccgatcatatggggctgcttgaccagttgtgggatgataccgttgcgggtccccgacccgataatggtctcggcaagctccgaaagcactccactttcactttccggcctaactctgccaaggaatcggatggcgggagtgtaagatcgtacggtgatgaagcgccggaggaagcgacgagagtgacacgtagtattatgatcgtaaaaccgcctggttaccagagcggatcgcctccggtttcgccggccggatcgacccctccggtatctcctttttccggaggcagagaatcatatcggtttcggagaaggttcacatcggatgca

SEQ ID NO: 15429 - DNA, 477 bp, Gossypium hirsutum
  Clone ID: uC-gsflnu33B072b05b1
gtttctctcttcatctctctgaacctaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacattgagggagcaaccaagtttttgctttcaaaattgagggaccttcaattttcatcggagagagcatgcacgatgatgg

SEQ ID NO: 15430 - DNA, 378 bp, Gossypium hirsutum
  Clone ID: uC-gsflnu33B072b07b1
tccacgcgtccgatgaggtctctgcttgaagaagaccaaatggggtctgaataaggtgatggggattgtgtgggagatgatatttcgccattggtgcagtccagttttgctgcatctggttttcaattaattaatcaaaaaaaagatgattttcaaaaaaaaaaaaaaaaaaaaacaaaaaaaaaaaaaataaaaaaaaacaaaaaaaaaaaaaaataaaaaaaaaaaaacaaggacaagcctccactaaaagttccaccctaataactctattcatcgggggccgccctttttaggtacccaacctttcttccccttccttgccccgtctttttctttttttgtgccccccaaaatctatcctctcgcccctttttt

SEQ ID NO: 15431 - DNA, 201 bp, Gossypium hirsutum
  Clone ID: uC-gsflnu33B072b08b1
ctcacgcgtccgaaaaaaaaaaaaataaaaaaaaaaaatttaaaaaaaaaaaaaaggaaaaaaaatatggaggaatcaagattggtgtccgcgtttattcgacgaagtaggtattatatagtgttttttatattgggggggctgttttttgggttccaactttcttttctggggaaggcctggggttacccttgtttttgg

SEQ ID NO: 15432 - DNA, 470 bp, Gossypium hirsutum
  Clone ID: uC-gsflnu33B072b09b1
tctgtaaattggtggcattcttcaggtaggtgctcatggaactggtgcaaaattgcctcccattgatgaacagattattagcatgaaacttgttactcctgccaagggaacaatagaactttcaaaagagaaagacccagagttattttatttagctcgctgtggtcttgggggccttggagtggttgctgaagtgaccattcagtgtgtggaaagacaggagcttgtagagcacacaactgtctcaaacttgaaagacctcaagaaaaaccacaagaagatgttgtccgagaataagcatgtcaagtacttgtacattccatatactgacaccgttgtagttgtgacatgcaaccctgtttcaaaatggagaggtccacccaaattcaaacccaaacatactacggatgaagctatgcaggatatccgtgagctctacaaagatcttaaagaagacagggctagagata

SEQ ID NO: 15433 - DNA, 333 bp, Gossypium hirsutum
  Clone ID: uC-gsflnu33B072b10b1
tttgaaatcctctttcaatcaagggtgatgatgttgaagtagcatgtgtgtgattttcagctctaggatcagttcctggttgtgttaaaaccctaatcaggtctgtgcaagcatttgtgagaggaagtggttctttgttcatcatataacatgaaaaggaaaagcaagacaacagggctggccaggtattgtaacaggacaagctgggataatttatggggatgaggtgtgggaaaattttctccaaccttgcatattattatttatgttggacattaggacgcgtttaatggcttgagctctccattgcgatggcggaatttcaggcgactc

SEQ ID NO: 15434 - DNA, 397 bp, Gossypium hirsutum
  Clone ID: uC-gsflnu33B072c01b1
cttctttttgatctccacaattgcagcgtctccctcgtatcttcaccattgaaagcatgcagcaagccatctaatctaaacggtggattgaagggcgcccccttgaagcctgagaaaccatctacttcaaagaagctcccatatgttctctacagcgttgggcccttcgctttcgaacccacatgtcacaagaactagagtagaaatctataatcccactgttgagctcgtactctttttaccatttttcttttatgtgcttaaactactacgtacaagtctcttagcttattgtgatggcatcttgttcggtgtggtaagctttgggttgcaataagttattgtaatgtatggaaatagattagtgatgaataatcaataaattatcgggtgtctt

SEQ ID NO: 15435 - DNA, 462 bp, Gossypium hirsutum
  Clone ID: uC-gsflnu33B072c03b1
gttttctctgtaagaatgcccaccaaggttcttcacatcacgaccaggaagtctccctgtggtgaaggaacaaacacatgggatcggtttgagctccgtgttcacaagcgagttattgacctattcagctcccctgacgtggtgaagcagatcacatctatcaccattgaacccggtgttgaggtagaagtcaccattgcagattcttaaatgtgccttactgttgctttttggcctcacaaggtttttagtttatttgaaagagacttttgattgatgtgaccttatttgcttggatcaatctcaagcttggatgaatgttgtagggtttctatagttggtgtttttcccataatggaagtaaaattctaaatctgtgggtggctttatagtttcattcctttttgtaacctaaagattatgttgcgatattttgattttatgcattattttgcattaagg

SEQ ID NO: 15436 - DNA, 448 bp, Gossypium hirsutum
  Clone ID: uC-gsflnu33B072c04b1
ctttttcgtccggtttggggtcactgtggagcacacggatagctgggatcgattctttatccgaggaggtcaaaagtatatgtctcccggaaatgcttacgttgaaggtgatgcttcgagtgccagttacttccttgcgggtgcagcagtcacgggtgggactgtcacggtagaaggatgcggaacaagtagtttacagggtgatgtaaaatttgccgaggttcttgagatgatgggtgctaaagtcacctggaccaagaatagtgtaactgtcaccggacccccaagaaatccctcagggaggaaacacttgcgtgctattgatgtcaacatgaacaaaatgccagacgttgctatgactctcgctgttgttgccctttacgccgatggtccaactgccataagaaatgtggcaagttggagagtgaaggagaccgaaaggatgatt

SEQ ID NO: 15437 - DNA, 446 bp, Gossypium hirsutum
  Clone ID: uC-gsflnu33B072c05b1
ttcttcttcttcttcacctcctccttcatccttctctaaagaagaggaaatagctaatgaaactccatgtaactacacctatggcagatgggtacatgacaagatggggcctttatacaatggcacaacctgtggtacaattaaggaaggtcaaaattgcatcacacacgggagacctgacttgggttacctttactggagatggcaaccaagccaatgcaatctcccaaggtttgatcccaacactttcttcaacctccttagtaacaagcatatagcttttgttggtgactcgatggctaggaaccaattggaatcacttctttgcatgctagccactgcctcctatcctaacctggtttacaaaactggggaggataacaagtttcgtagatggcatttttcttcttataacattactgtatcagtttattggtcaccatttc

SEQ ID NO: 15438 - DNA, 449 bp, Gossypium hirsutum
  Clone ID: uC-gsflnu33B072c06b1
ctttttccttgttagagaaaacaaagatcttcatttccttttccactttccccactttttcaacaacaacaaaaaaaagaacccttcctttctcatagctatggcgtttagaaccttggatatcaacgttatctctgcaaaaggcttgaaaaacgtcaacctcatcgataaaatggacgtttacgccgtcgtttcactcaagggtgattcatcgaagcaaaaattgaagacgccggtgcataaagattgtggcaaaaccccgaattggaattttccggtcaagttcaccgtcgatgaatcattggctaaaaacaataagcttagcatcaagttcaaggtcatgtgtgaacgtatattgggtgataaagaacttggtgtagtcaacgttccggtcaaagagcttttggattcgccgggcgatggtgggtcaatgaaattcgttagttttc

SEQ ID NO: 15439 - DNA, 433 bp, Gossypium hirsutum
  Clone ID: uC-gsflnu33B072c08b1
tgtctgaattgcctgacagaaccagtggaaatttacctctgttgctaccattaagcacgaaggacaaggatagtaagaccaaagaagagaaccagaagctcttgaatgggaattctgtagaccctgctgattggaggcggagaagtgaagttaatggcaagacaatggaagatgcaaatggactccatgccgatactgcaatgaatggtgcgtagatgatggaagctgcctgctattactgtaattgtgctctgctcggatccatatgatcttttgattaaaggcttagcatcttccaatactggtaattgatttgtattcttaagaaaaacagaaactgagtagtgcacttgtacattgtgctgtccttccctgtctttgcataaaatcatcggccatcatcatgatcagcatcaacatatatcatggaata

SEQ ID NO: 15440 - DNA, 465 bp, Gossypium hirsutum
  Clone ID: uC-gsflnu33B072c09b1
gttggatctgtccgtgtatccggtcctgcaagaaacatgcctgatggtccaccaccagctgctacaatagggcctggctactctggtggatttgaatctttcaggggtggtggtgcacatgtgtatgactatgaacctcagaatttttctgttcctccagctgctgctagatacttaaatatgaactgtgctgttgaagctaaagttccggaaactgtgtcaagttctgcagtaggcaccagaggaagtactgtttttattagtagtgaggtttcaagggcaatcctaaagcttgatgatcctcaaactggtggctttgaagagttccctcgatcttctgagcatacaagtgctcagagcatttttcagtcgttcatggctttttttggacaaagcatgaatgcacaacaggattcatatccaaatacgaacattcaccaaagttctatcagaaatgagtgctaa

SEQ ID NO: 15441 - DNA, 378 bp, Gossypium hirsutum
  Clone ID: uC-gsflnu33B072c11b1
tttacgcgtccgaccctccacttggtgcttcgcctgcgtggtggaatgcagatatttgtgaaaactttgaccggtaaaaccattacgttggaggtggagagctccgacacggttgataatgttaaggccaagatccaagataaggagggtatcccacctgaccaacagaggttgatttttgccggaaagcagctcgaggacgggaggactcttgcggactataacattcaaaaggagtcgaccctgcatttggttttgcgccttagaggagggatgcagatatttgtcaagaccttgactgggaaaaccatcaccctggaggttgagagctcggatacgattgacaatgtaaaagcaaagattcaggacaaggaggga

SEQ ID NO: 15442 - DNA, 460 bp, Gossypium hirsutum
  Clone ID: uC-gsflnu33B072d02b1
tccttgcgtccgactttccgaaccagacaggcgcagatcctctcagcccagcgaccatgacaaagagaacgaagaaggccggaattgttggcaaatatggtacccgttatggtgccagtttgaggaagcaaattaagaagatggaggtgagtcaacacagcaagtacttctgcgagttttgtggaaagtatgcagtgaagagaaaggctgtaggaatctggggctgcaaggattgcgggaaagttaaagctggtggtgcttatactttgaacactgccagcgctgtgacggtgaggagtactattagaaggttgagggagcaaactgagagttgagctgctgctgactacgttatgttcacaaacttggtatgatgttcgtgtatgtgttggctacaaaccagttgagtcattttgttgacaattatggcgcttagttcttattttaatatttaactctg

SEQ ID NO: 15443 - DNA, 494 bp, Gossypium hirsutum
  Clone ID: uC-gsflnu33B072d03b1
ccttttcgtccgctactctagaagagaaacttagacctcataaggaatgccacagagtagagttagaaagtctatgccagtcctgtgaagaaattttcagaaaatttcgggaggataccaagaagaattttagtgatgctctgtttgaatggagatcaaatcttattctacatgcccaagtggctacaagtcctcttgatcttagtcacgtaaatttcaactgtctcagggacatttcttctgtgtctcttaattttaaagtttaccatcctgatggtgaagagtgagaagcatttcaaagagagtggaaacagtttgatgattttttcattcccactacacccaatgttgcagacaatgaagatagctcagccacaaaggatcaaaatcttgaagatcctccaactaaaagggtaccaactaaacctactaattagcctaatgagggagaggattgaaatttcttttgtaaatttgattttactttttcgtag

SEQ ID NO: 15444 - DNA, 409 bp, Gossypium hirsutum
  Clone ID: uC-gsflnu33B072d08b1
tctcgattccacttaacgcaaatagttcgagtttcgtaatcaatggctttgccgaaccaacagactgttgattatccgagcttcaagctcgttatcgtcggcgatggaggcactggaaagaccacatttgtgaagaggcatctgactggagagtttgaaaagaaatacgagccaacgatcggtgtggaggttcaccctttggacttcttcactaactgtgggaaaattcgattctactgctgggatactgccggtcaggaaaagtttggtggtcttcgagatggttactacatccatgggcaatgtgctataattatgtttgacgttactgcccgtttgacatacaagaatgttcctacctggcatcgtgatctttgcagggtgtgcgagaatattcctattgttctat

SEQ ID NO: 15445 - DNA, 152 bp, Gossypium hirsutum
  Clone ID: uC-gsflnu33B072d09b1
tttttagaagagtatgtgccctagatatttgattatcatgattcaagaatgaaaaaggaaacaggagtttgacatatatagtggttcatatatttaaagatgaggaagattgaagtttatgaagtctttcctgtgttttattattttatagc

SEQ ID NO: 15446 - DNA, 426 bp, Gossypium hirsutum
  Clone ID: uC-gsflnu33B072d12b1
ttaacgcttcaccattcacgccgtccccccccccccccttttttttcattttgcctgatttttcgagttttagatttcttatataatcaactacctaatcctctcgctctctcaaccacaagctaactagcaaacacacacacatactaacatctatggggagttcagggcagcaagtctcctggaaattggcggatcacccaacacttccaaaggggaagacccttgctctcatcgttctcgatggctggggcgaggacaaacccgatgagtacaattgcattcatgttgctcaaactcccaccatggattctctcaaacagggtgcccctgaaaagtggagattaatcagagctcatggtaaggctgtagggctccccacagaggatgacatgggaaacagtgaagttggtcacaatgctctcg

SEQ ID NO: 15447 - DNA, 273 bp, Gossypium hirsutum
  Clone ID: uC-gsflnu33B072e02b1
tctcgcgtccgaatccctgttcgggaagtaggaaaagatgaatcatggtgaagtgtacaaaaataaatatattggcatcaaaatccagtttgtgtctttttttattgaagtcgattctcatcttgtgctagtggtagtgtcctaaagagagacattgttgtatgaatgtaagcttgtgtattgttatatccatacctgaagtacagttttaatggttatggatggtggtggaacatgtgtattgatgaatattgatcctctgccacttttcag

SEQ ID NO: 15448 - DNA, 434 bp, Gossypium hirsutum
  Clone ID: uC-gsflnu33B072e03b1
cttttctagcctacatgtctaataaagaccaaattgatattaattatgctctcttcctaccaacgaaaggagcagatgatccaaaaactaagttgcattatgataacttgcttgatgctcagattgatgcagcctatgctgcattagaagatgccggatatggaaagatggaagtcattgtcacagagaccgggtgggcttcacatggtgatgagaatgaagctgcggcaaccgcaaacaatgcaaggacttataattacaatttgcggaaaaggcttgcaaagatgaaaggaactccactcaggccaaaaagtgtgcttaaggtttatgtttttgcaatctttaatgaaaatttgaagcctgggccaacgtctgagaggaattttggattgtttaaacctgatggaagcatctcatatgacatcgggtttcac

SEQ ID NO: 15449 - DNA, 488 bp, Gossypium hirsutum
  Clone ID: uC-gsflnu33B072e04b1
gttttgagaaacagagaagagaaagaatggcttggatatggttggaagcagcacttcccctcggaatcatagctggaatgctctgcgttatgggcaatgctcagtatttcatccacaaagcttatcacggccggcccaagcacatcgggaacgatatgtgggacgtcgccatggaaagaagggataagaagctcttcgagaacctctcgtcctccgattgatccctttttagttttcttctggaaacttggtcgatggagtgagagaagaaataaaaaatgctctatgatattctgtaatgctgaagaagactaaagagcagatgaactcgagtattttctttttcattgtaatgttaagcatgaacttctgaaatgttgcacttttggcaacacttgctaatgtttacgctggtggtgtattggagatttgttgcttccaaattccttgtgatcttctatttgcaggtctatgaatcattttggaat

SEQ ID NO: 15450 - DNA, 389 bp, Gossypium hirsutum
  Clone ID: uC-gsflnu33B072e05b1
tctcgcgtccgcaaaattggtcctggaaccacagagttgggcgttcaaccatcaccagtggttgcagcattcagttctagaggtccaaacccagtcactccagcaatacttaaaccagacattattgcaccaggggtcaatatcctagctgggtggactgctgctgttggtccgaccggattacagagtgacccaaggcatgtaaacttcaacatcatttcaggcacatcaatgtcttgcccccatgttagtggcttagctgcaattgtcaaggctgctcatcctgaatggagtccagcagccattaaatctgccctcatgaccacagcttatacagcttataaaactggtcaaaagatcgaagatgttgtcactggaggaccagcaac

SEQ ID NO: 15451 - DNA, 486 bp, Gossypium hirsutum
  Clone ID: uC-gsflnu33B072e07b1
tgtttcaggttctaaattgtccaaggctgtaagacgacgccttttgtttggttaagaaaatgataaacttttggctttgatgatttcaacaccaagatctgaagggtcctccgagatgtcagaatcatcaaagccacaaggtgttcaattaagtatcaccgaattttaccgtacaaccaaaacaccatcccaggaaaaactaggggaagatttagtcaaacagtcaagtagtccaggtgttgggtcatcaaaacagaagaggaaagtttcaggttctaaattgtccaaggctgtaagacgacgccttttgtttggttaagaaaatgataaacttttgccttttttgatgtacaagatatcccaccttaagatgtaaagtcatgtttaccttctggtcttataatcatcaaaaactcagcttatgcagcactttggattatatttgagtttgaatattctatagcttagagtgaagattgtttggtt

SEQ ID NO: 15452 - DNA, 401 bp, Gossypium hirsutum
  Clone ID: uC-gsflnu33B072e08b1
gttgggggaaaatatccatgaaagatttttgatgacaaacaactcaaatcaaaacccatcgaaaaataaggaaaaaagattcatcctttttccctcctccttctctgaaactaaaaaacactttcctgcaaatgcttcaatctctcctttccctttcttctccttcccctctctctctccctcccttccataacccatcttgctccccactcctccaaaaacccacttttttctcccctttatttccccattccaatgtccatcttcgcccattattagctctacctcgagaagaacctttcactacccccatagctgaagaaaaagaagaagaagaagaggttccaattgagttaccaccatcttattcttccctttcttctttttctcctctccaaact

SEQ ID NO: 15453 - DNA, 310 bp, Gossypium hirsutum
  unsure (1)..(310): unsure at all n locations
  Clone ID: uC-gsflnu33B072e09b1
tcncacgcgtccgaaaaaaaaaaaaaaaaaaaaaaaaaaaataaaaaaaaaaggacaaaaaaaataagggataacaagtttaataacacctaaatacaaaataagggctttcgttttgggggacctaatttcacttccctggccttcggtcttactgctttttgttttgcaaaccccttactggaacaacctgggcgtgtctttccttaattgcgccttggaacaccccgtttttacccgctgtggtcccccccgatagcccttcccttcagttgccttccctaattggcgaatggctcacgccctttgg

SEQ ID NO: 15454 - DNA, 419 bp, Gossypium hirsutum
  unsure (1)..(419): unsure at all n locations
  Clone ID: uC-gsflnu33B072e11b1
ttcacgcgtccggccacgcgtccgcccacgcgtccgcccacgcgtccgaaaggtataggtggtagtaataagagctctcagatatggaagaacgtcaagcccttcatcgagtggctccagaatgctgagtctgagaccgaggaggagtgattctctagctcttggtatggttgcatggctacttctaggtacaaatatgtttctctcttgatcttgttttttaaataaagtacagtgagcacggccctacatgctctctgtaatttgagtgtctggatttttcagctgcttatccttaagacatcttttccgtttgctttatatgagcaagttgaattcagtttgctattttatttttttatatattttttgtgccgttattttggttgatcaaaaaaaaaaaaaaaaaattttaantt

SEQ ID NO: 15455 - DNA, 344 bp, Gossypium hirsutum
  Clone ID: uC-gsflnu33B072e12b1
tctcacgcatgcggtaaatcatggaactatacctgcaactatggtgggtgttagggcgcatggtgttacatgcagagcgtgattcatagcgaggcacatgactaatcaggagactaggtgcgacactgtgggacaacatgcgttaacagatcctatgaatgatgggctgcatgatgggcatgctgatgtatttgatctgacctgtgatatgactagaggagggattagtgaggtatatagtggtgtcaacattagtgcagacatatactccagattgaagtacagattcaggccccgtcacatctccaatcatgaatacatggaaggagaaaagggaagagacc

SEQ ID NO: 15456 - DNA, 383 bp, Gossypium hirsutum
  unsure (1)..(383): unsure at all n locations
  Clone ID: uC-gsflnu33B072f02b1
tnttggttcagacaaacgcacgatgagtagatggatggctcttgactatgagccttcgtaagaatggctgtgccagaaccagcgaactgtagaaaagacaagcttcaagaacgatagcaactgagatggacgaactggaaaaactacgttcatgaagaggcatgtcactggagagtgagaaaagaaatacacaaccaaccatcgatgaggaggtggactccttggactaattcactaactgcgggagaaacggccaatacagctgggatactggtggacaggagaagaaggcgcgcactagagatggttacaacatccatgggcaatgcgcccaaaaatggttcgatggaactgccccgaatgacatacaagcatgttccaac

SEQ ID NO: 15457 - DNA, 433 bp, Gossypium hirsutum
  Clone ID: uC-gsflnu33B072f03b1
attactatcagtttctgctagaagctgcccgccaatgccaagattctgggctgtacgacaagtctatagagattcagaagagaattggagcattttcgatggcattggatacgataaataagtgcctctctgaagcaatttgtgccttatcacgtggtagattggatggtgagagtcaaactgctggcctcattcactccgggaacgagatcttggagactttcaaatattatcctgaagtcagtttccaagagagggaacatgtttcggagcaacaaaccatattaagacagctcgagactatattatcgatccataaattgatgagactaggccagtatcttgatgctctacgagaagttgccaagatcccattccttccattcgatccacgagcacctgatacatctgctgatgtgttccaaaatttatc

SEQ ID NO: 15458 - DNA, 528 bp, Gossypium hirsutum
  Clone ID: uC-gsflnu33B072f04b1
attttcttcaagagctatgttcaggaactacgacaagcatagaaagcaaaaaagtgaccctaaaggcaaattgtccgacgtgttcaggagctatgctgattctaatggggagctaaacaaggaaaagctgaaagacgcttttctacatctggatgctgccatgccgtaccggcaagccgaagaagccctccgtgtcgtcggcaaaagctattacattaacatcaaggatgaaaccgaccttaacacccttgtcgactatgcttacaataagggttacgggtattcaatttgattagctaatttataagcttattttctttttctttttcacttttaatcatctaatatgttttttttaaatatatgtaagtttcgtcccaaaagacattattatagaataaaagttttggggcttatgattgtgatgtaggttttgcatgtactttgcaaagactacattatatatatgtttgtgtggcaatgaacatgatgatgtttttatcaattataataatatgtgtcgattgt

SEQ ID NO: 15459 - DNA, 434 bp, Gossypium hirsutum
  Clone ID: uC-gsflnu33B072f05b1
ggttgctcattatcttttagcatggagggagaggccatggatttggcatattaaatagttgtttcttcatattaagaagttagagaggtaggagatggttaaagtggtaaaggcaaggagaaattttgtgcttgtaaggaagaattcgaaacaagcacattatgattgatcttggcatcgataataacaagattaactgggctctcaaggacaaacaggagttcagagacatcattgggactgtataccgtgaggcatggaaaggccgtggtttgaaagattactcgaaaaagtactgctattgagtattcttccaacatgtagttgatcagaatgtaaattgtatgtagatatgtgtgtcatttgcaatgtttggttgcatgaatgtggaggataatccaatttgaatggaactttgaaatatatattttatg

SEQ ID NO: 15460 - DNA, 439 bp, Gossypium hirsutum
  Clone ID: uC-gsflnu33B072f06b1
cttacgcgtccgcccacgcgtccgcccacgcgtccggtatattgaagtttcctttctcgattttctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagaacaggaaggcattcccccagaccagcaacgtctta

SEQ ID NO: 15461 - DNA, 406 bp, Gossypium hirsutum
  Clone ID: uC-gsflnu33B072f07b1
ttgttatccctgttgcctggacggctaaacatcacttaaaagaaaacacagatatcattctacgcattaacaagcgtacatggaggaccaggtataattatcacaaaaatcgtgattgtggagggctttctggtggttggaagtgttttgtgaatgacaataatttaatagaatatgatgtgtgtgtatttgagccttccaatataggaggaaaacctatcatcctggatgttatcatcattcgggttctggactcagcagttcaagcaccagtacctctgaccataacacaccctgcctcttgctaaatcgcagcagttaactctcagaatctgccagaaatgaaatagcagtttagtgatggcatcatctctaggtacgtcaagctatggatgtttgatattgt

SEQ ID NO: 15462 - DNA, 410 bp, Gossypium hirsutum
  Clone ID: uC-gsflnu33B072f08b1
gcttccatggcgaaaatgaggggttgcatagtcactgtggctttactcttgctgctacttctttgcttacaccaaacacctgtagagtgcaaagaaagactcattagacaactgtcttctcagccttcttcagctactaagcctcaagaattcaagattgggttcaaaagggtaattctcagcattgtgctgggaattttaactggattgattggagctattctttttgctttattgatcaaaattgctgttcagtacatcaatcaaaccccattccttaaaggtcctgttatattttctcccaaaatatcttccaagactctccaatcagcccttgcaaatgaaaaccagttgctaggttcaagctccaacgggaagtactataagacgggtcttgataacgggctcac

SEQ ID NO: 15463 - DNA, 449 bp, Gossypium hirsutum
  Clone ID: uC-gsflnu33B072f09b1
tgttcacgcgtccgattagttgcatgttgtatatctgccgcagaacaagccagcgttcccatcactgttcactttgaccatggtacttcaaagcaagaactattggaatctcttgagctgggctttgattcagtaatggtggatggttcacatcttccctttaaagataatatctcatacacgaagcacatatcaaacttggcccacttgagggatatgcttgtggaggcagaacttggaagattgtcaggaacggaagatgatttgactgttaaagattatgaagcaaagctgactgatattaatcaggctgaagaattcatagttgagactggcatagatgccttggcagtatgcattgggaatgtacatggaaaatacccagcaagtggcccaaatctcaaacttgatttgcttaaggatctatatgccctaagtttgagaaaaga

SEQ ID NO: 15464 - DNA, 399 bp, Gossypium hirsutum
  Clone ID: uC-gsflnu33B072f10b1
cttacgcgtccgttccccttgggttgcaaatcaatgccattgccagaatgaagaacaagcagagccattaccgaagaagcatgggagatactagggccattgaagtttggattttaagtacgccatctttcattggtcacttacagcaagatgatgatgctaatatgggaatgctcctttgcttgtggacacaacttgtgtattaatggatttttgtaatttttttccctttccttgtgcaagtgccttgtgtaacatggttatatttatgtatgtatatgtacatgtaaaaaaattgtgaattcagtcataatgttgtagtttgatttacacaatttgtttagtgaatttagctaaacaattaaatgaaaagaaaaagtcaaatatatgtttgttttc

SEQ ID NO: 15465 - DNA, 467 bp, Gossypium hirsutum
  Clone ID: uC-gsflnu33B072g02b1
ctttctcgtccgatcgtcctgatgaattgcaggaatccgatgttggtactggagctgggctgtttgaggttaaaaaaatcggggatgagttctttgcattcattgttgattgcaaagatccaaaagcttgtacggttctcttaaggggtgctagcaaggatctcctgaacgaggttgaaagaaatttgcaggatgccttgtctgttgctagaaacataattaagaatccgaaacttgttcccggaggtggtgctacagaattaaccgtttctgccacattgaagcagaagagttcatctgttgaaggcatagaaaagtggccgtatgaagctgctgctcttgcttttgaagccataccacgtactttggcacaaaaatgtggagttaatgtgattcggactatgactgctctgcaaggaaagcatgcaaatggtgaaaatgcatggattggcatagatggcaacact

SEQ ID NO: 15466 - DNA, 62 bp, Gossypium hirsutum
  Clone ID: uC-gsflnu33B072g04b1
cttgttctagattttagctgaacctttaaatgaaatgcaatacacgctaaactgttcaattg

SEQ ID NO: 15467 - DNA, 441 bp, Gossypium hirsutum
  Clone ID: uC-gsflnu33B072g05b1
ctctttggttctggtgatggcaagataagtggatgtagcagcaggttctcgtattctccatccataggtatgcgaacttgtggggcttgctcaaagcttttggctgagagatcttcgtgtagctgcaatgaaatttcagtggtagctgtacttgtatgtggacatgtttatcatactgaatgcttggaaactatgacgccagaggctgacagatatgacccagcctgcccaatatgtatgggtggagaaaagcaggtctcaaagatatccagaaaagctttgaaagctgaactggagttgatggctaaacatcttaagttattcaagaatagagttaaagatagttttgcggaaggtgattgtaatgattttaaccatcaacaaaatgccaagcgagaagggaaagctccaaagttagaaccccagtcaagccggagaagc

SEQ ID NO: 15468 - DNA, 458 bp, Gossypium hirsutum
  Clone ID: uC-gsflnu33B072g06b1
cctactcgtccgcggacgcgtggggaagattctggcaacccttgcatcttggagggttttgatggtacttataaatatggaggagaagaatataaagcatcagcgccgccatctggttcaagcatggaagaatgcaggagggtgactctcaaggctcttaaagtaaatgattcatgcacgcatatgaagtgcacatttggcggcatatggaacggcggaggtggagatggacagaagaatctgtttgttgcttcatttttctttgacagggctgccgaggctggttttattaaagccagcgatcctgttgcaaaagttcagccccattcgtttgcagatgctgctaaacctgcttgtcataccaagtatgcagatgctaaagcaatatattaagatttgggcgagagtaacctggcatatatatgcatggatcttgtttaccagtacacgttgctcgt

SEQ ID NO: 15469 - DNA, 467 bp, Gossypium hirsutum
  Clone ID: uC-gsflnu33B072g07b1
ctctcgcgtccgcccacgcgtccgcttgaagcttgtgagtcaggtagtatctttgagggtcttcttcctcaggggttgaatatctatgcaaccacagcatcaaatgcggaagagagtagctggggaacctattgtcccggagagtacccaagtcctcccccagaatatgaaacctgcttgggagacttgtatagtgtcgcttggatggaggacagtgacatgcataatctgcggacagagactttgcaccagcaatatgaacttgtgaaaaagaggactatcaatggtaattctgcgtatggctctcatgtcatgcaatatggtgatgtagggcttagcaaggacagtctctttgcatacttgggtacaaaccctgcaaatgataaccttaccctttgttgacgagaaactcttggtgccacctacaaaagcttgtaaccagcgtgatgctgatcttgtccattttt

SEQ ID NO: 15470 - DNA, 453 bp, Gossypium hirsutum
  Clone ID: uC-gsflnu33B072g08b1
ttgttttagtcgatcctaaggagagggggagccctgattatggtcgtggccacggtccaagtctttataagagagatagaggtagccctgagtatggccagatcaccagccgtagtcctcagagaagagagaggaccagctttgaccatgctcgtggctccagccgaagtcctttcaggaaagagagggctagccctgagaatatccaaggctctagccgcagtccttataggaaagagaagcgtagtgctgaaaatgatcgtagccccagtcgcagtccatatagaagagaaaggcccacttctgacaatggtcgtgcacccagccatagcccatatggaagagagagaattagcccagagaatggccgtggtagcagccctggttctatgccagaaagaaaggccagcccttatggtggtgaagctgaaagcccagtcaatgaaagatatg

SEQ ID NO: 15471 - DNA, 405 bp, Gossypium hirsutum
  Clone ID: uC-gsflnu33B072g09b1
ttattttggttctggtgatggcaagataagtggatgtagcagcaggttctcgtattctccatccataggtatgcgaacttgtggggcttgctcaaagcttttggctgagagatcttcgtgtagctgcaatgaaatttcagtggtagctgtacttgtatgtggacatgtttatcatactgaatgcttggaaactatgacgccagaggctgacagatatgacccagcctgcccaatatgtatgggtggagaaaagcaggtctcaaagatatccagaaaagctttgaaagctgaactggagttgatggctaaacattttaagttattcaagaatagagttaaagatagttttgcggaaagtgattgttatgattttaaccatcaacaaaatgccaagcgagaaggaaa

SEQ ID NO: 15472 - DNA, 441 bp, Gossypium hirsutum
  Clone ID: uC-gsflnu33B072g10b1
tttatctctttaactcctctgggttttttctttgtctaacaaagaaaagaaaatgacaatatctgcttcatttttgcttgcttctaccttgctgctcaccggctgtgttttgggtcctatatctcttgtttcagctaaacatggtgttccatcttatgctcataagaaaatcgcttctaaaccttttgaagggtatcttgaaaatggcaactttgaagaacagcccagcccgactgccttaaagaaaacagtactcaaaggagcacacgcacttcccaaatggactatcacagggctagtcgagtacatctcgggtgggcctcaacctggtgggatgttttaccccgtcgctcatggcgtccatgcggtgaagctcggaaacgaggccaccatttctcaaaccatacctgtaaaaccaggggtactgtatgcgctgacttt

SEQ ID NO: 15473 - DNA, 485 bp, Gossypium hirsutum
  unsure (1)..(485): unsure at all n locations
  Clone ID: uC-gsflnu33B072g11b1
tttccaccccgaccgcttgattttgatcagacggtaatcatgccgatcagaaacatagccgttggccggcctgaagaagctactcatccagatgctcttaaagcagctttagctgagttcatatcaacgttaatcttcgtttttgctggatctggttcaggcatggcttttaataagctgaccgacggcggtgcaacaactccggctggtctcgttgccgcctctctagctcacggatttgcgcttttcgtcgctgtctcagtcggtgctaacatctccggtggccatgtgaatcccgccgttacattcggtgctttcgttggcgggaacattactcttttacgtggtatcctttattggattgctcaactccttggctcaaccgtcgcttgcctgttacttaagttcgncactagtggcctgggagtaccagctttcggactatcatccggcgtgggagcattaaacgcgtttcgtttcgagat

SEQ ID NO: 15474 - DNA, 321 bp, Gossypium hirsutum
  Clone ID: uC-gsflnu33B072h01b1
attccatatgatggtactggtgtctatagaccacccaaattcgctcctgcggttgtggaagaggaccaaaagatgtcgagagaggagaggaatgctttaaggagggaaaaagaaactttgcgaaaagcttcaaggagtggttatattagggaaatgatggatgatttagaaggaaaacctgaagaggttagagaaattattggaactgaaagtagagaactcactagatatatggaaaagatggaaaggcgcgcgcagcaagaggaagaacttttcactcgtgctcccgtcacaaagaaggacaaaaagatcgagaaacac

SEQ ID NO: 15475 - DNA, 407 bp, Gossypium hirsutum
  Clone ID: uC-gsflnu33B072h04b1
agtaatatgtttcagttatcgctggtactttgagggttgactgtttcttgaatggttattttggctacgagcttcgattcagcttaagcaatccgggatcccagtaattgcatgtctagggtttgctagcagctcgaattcgaaggtgtttcattttccgcaactaaatagatcgtgtagagattgtgccatcaaatgagtgtcaagagtttgggctaaggaaatctgcttatcctggtttttatcatttggggtttcattcatgattgggaaaatggtcgagggtcctaaatttactggacttatgggaggaactgacaacaacgataacaattactatgattttactcaagggttttaccaaaagcttggagagggtactaacatgtctattgacagtttacaga

SEQ ID NO: 15476 - DNA, 227 bp, Gossypium hirsutum
  Clone ID: uC-gsflnu33B072h06b1
ggtattccacatgactgccctgactggtcacagtgttttgtgctaacagatgggggccctgcaggatctacaaaccggcatggggacaacaatcattatcattaatcgcagatatcatgactattgttaactatcggaataaaaatgaagaggatggaaccaaatccacttatcgagtctattgcaccttctacaggcaaaagaccaaactatcatgcctgaccatg

SEQ ID NO: 15477 - DNA, 66 bp, Gossypium hirsutum
  Clone ID: uC-gsflnu33B072h07b1
tatttaaaaaaaaaaaaaaaaaaaaaaaaaaagaaaaaaataaaaaaaaaaaaataaaataaatag

SEQ ID NO: 15478 - DNA, 554 bp, Gossypium hirsutum
  unsure (1)..(554): unsure at all n locations
  Clone ID: uC-gsflnu33B072h08b1
tgttatggttagcatgaacgagatggcggagattgtgcttagctttgaagataaaaagcttccaatccaccatatccccggtccagagggtgtccgtggtcgtaattcagacaatacattgatcaaagaaaaacttggttgggcccctacaatgaggttgaaggatgggctgagaattacatacttctggatcaaggaacagattgagaaagagaaggctcaaggcattgatctatctgtttacggatcatctaaggtggtaggaacccaagcaccggtccagctcgggtcacttcgtgctgctgacggcaaagaatgaagtaaacttgctttggaaccaagttttattatgatatagctatgctagtggcattgaatccaaaaagtattaaccaatatcaggtaagattatttattttggtcgatttagtttgtgcactatgatctttgttcaaggggagcttttatatttcactgtattcaaaatagctngcttgtgtaggttgatatgcttaggctttatagcctttatttataaatttttttcgcatttg

SEQ ID NO: 15479 - DNA, 362 bp, Gossypium hirsutum
  Clone ID: uC-gsflnu33B072h09b1
tgatggttttgaaaacccatcatcgcaccatcgccgaacagccttggctccaccgtggacagtggtcggagtcacgcaagatcggactcggatggtggttgaagggtgtcagacagcacgtgggtggcagcagaggctgtgctgaggctgctggtcagaagaccctaggtgcggcacacctagggttttggtatttttgtttttttctgttaacttagggctagggttagattgggcttggtttgggcttgttttgtaagtggttttttttgtgtttgttggattgtttattttgggcccgagtaaaatttgggtcttacagattttatattttatattagttacaatgaattttatttttc

SEQ ID NO: 15480 - DNA, 436 bp, Gossypium hirsutum
  Clone ID: uC-gsflnu33B072h11b1
tttttcatctctgttttgttccaagctctgggttatggcttcccaggctttttatcttattgtttcaatcattgttctcttatccgccattgttgtctcaggttcgggttcggtcgggattaactacggtcgtgtagcaaacaacttaccgtcaccggaaaaagtcgtggaactattgaaatcacagggaataaacaaagtgaagctttacgataccgacgcgacggttttgacagcgttagcggattccggtataaccgtggtcgtcgcacttcctaatgaactactttcatccaccgccgctgatcagtcgtttgccgacaactgggttgaagcaaacataacaaagttttacccaaagacaaatatcgaagccatagctggcggtaacgaagtgtttgtcgatcccgccaacacgacccaataccttgtaccg

SEQ ID NO: 15481 - DNA, 388 bp, Gossypium hirsutum
  Clone ID: uC-gsflnu33B072h12b1
tttacgcgtccgaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttgagggtggatgcccgtgtggagacaactgcaaatgcaacccttgcacttgcgggaagtgaacaacaaagagaagcagagtggcctttgtcattttaactaaataaattctattactttagtatgtatcagcaaatcttcatgaggatttggttcttaattatgtgtaatgtggcttttctgctatgtcagaatgtattatgatatttaagaaaagt

SEQ ID NO: 15482 - DNA, 312 bp, Gossypium hirsutum
  Clone ID: uC-gsflnu33B073a03b1
ttttattcgtcgcttcttctatcttcatctacatcttcattttcatttcagtgctttagggtttgcttttatcctattgttagggacaataattagaagcacgagataaccttggggggggggcggctgattggagaggaacaattctgaaatttactttcacttttgccggcggttgcaaaatgaagtgtatcaaggcttatcaaattggtcactgttggtgacgtgtccttctgcaagacttgcatgctaattttctacatcagcactacttttccctactgaaatgagccaaattgcttttataacttt

SEQ ID NO: 15483 - DNA, 303 bp, Gossypium hirsutum
  Clone ID: uC-gsflnu33B073a05b1
cgtccggtcatttgcccttttaagctttggagacatattaaggggtcttgccagtttgggacaaaatggagatcatcgcttataattgatttttgtatagtcaccggaatccttctacattccaacgtttaactagtttctatctttaacgctttctcttctttatggaagactttactttgatcagaagaaatttttcatggctgtatttcccggcgtgcattttttgaacctttttctaaaaatcattaactttggcaggatatattaacatttacctttggataaaataacaactggatg

SEQ ID NO: 15484 - DNA, 330 bp, Gossypium hirsutum
  Clone ID: uC-gsflnu33B073a06b1
tttattctgatggacctatcaaaaggatgatgtactgggactcagtctcgaagttggttgccccaggcggagtgttagcgattacatcttgcatccatacaaaagatgatatggtacaagaggtggaaaatttcaatcatagaaacgctggaaatgcttcgccaagacccaaatacaatcaaggaccgagaaacacacatagattgcccctctgtccaatatttgaaccatgttcaaacttattcaacaatttatgtttcgccggatctttgggagcacaatgttgctactggcgcattagtactggaacttaaagataacttgaaggtt

SEQ ID NO: 15485 - DNA, 228 bp, Gossypium hirsutum
  Clone ID: uC-gsflnu33B073a07b1
gcgtacggtgggccacacgctaaagagatgaagaccattgattttcgccacgtggctttgatgatgaagagcggtaaggtttgcaactgagcctatcaccggttctcatcgatagcaaggaagttgatttcgttcaaatataactaggattaaataaaaaagttttttttatttaggataattatttaatatatgggtggaagctgtttttctttatcttttcttctg

SEQ ID NO: 15486 - DNA, 299 bp, Gossypium hirsutum
  Clone ID: uC-gsflnu33B073a09b1
atgttcacgcgtccgtgctgtaggcttgcatgactgggggttcccgaagattttcaaggtagcttgtcccaaagcatattcttatgcatacgatgatccaaccagcattgctacttgcacccgcggcaattatttggtcactttttgtccccatcgatgctagaattgttattttatatatatttagggttagtttggatgggcggtctaatttggatgggcggtgtgtattacctcccgtgaggttaaaaatagcggtggcggtgtgaatagatacagtagctgtgatatttgaaaca

SEQ ID NO: 15487 - DNA, 371 bp, Gossypium hirsutum
  Clone ID: uC-gsflnu33B073a10b1
tttttaaaaagtaacaaggcaagtgatggatcacataagggtgaacctcgaactggaagggtattgtcgttgagtgacatactatatcgctcagaagctaacagtgatgctttacaagatggtccaagatctgaaagagaagactctgattttgatgaggagctggaattagattttgaaactttaatatcaggtgatgaagggcgtgatgttgaatccaacatatttcatggaagtttaaatcttagaatttatcgaagaggtgattcaactagagaaactggtgcatgtggaatctccttccttttcattacaaaatgggagtggcttatcaagttcacatccttatctttggtaatgggattgcaaat

SEQ ID NO: 15488 - DNA, 476 bp, Gossypium hirsutum
  Clone ID: uC-gsflnu33B073b03b1
tttgtattgcagatagcttatgttgaaggagctggttgaggtgcaatcgcgatggaagatattgaagttggggacattgctatggagactcctgcatctattacaatctctgaggatcttggctctaaatttgacacgctttaagtattatagaagattgctggatctgaccttctgagactatgtcattgttatcgtgcatgaaggagtggcacaactgtaatactcagttcacgatgtgctttgatacactaccagtatattttaatacaggattgagctttggagttgtagcaatcattgcttcggatggaaacttcgctttttgaggagatcattgctagcaaatgaactatttctgtgtgcaatatgaatgagttatttcctgtattatccaaggatcatttctgacatattttcaccctcatctataatcttcgcgagcagtctttattggtcttgccaagctctgtatt

SEQ ID NO: 15489 - DNA, 410 bp, Gossypium hirsutum
  Clone ID: uC-gsflnu33B073b08b1
tctttagcagatttacttgttcaatatctgaagaaattcgttgctcctgatgtgtctattcttagttcagattctgccattaatgattttgttgaagcagctggtactttctttcctatatacataggttttggcttgaatgaaacagtgatatataatttagctgttaagtacaagaaaaaggcctggttttcggtggcaaaggatttctctgatgatgccatggtgttgtatgactttgacaaagttcctttctttggtagctcttcatccaagctataagcagcaaagcgttttctatggcccatttgaagaattctttttgtgggattttggaaaacaaaatttgctttctctgggggtgcccttgaaccacgagacattgaagctattgaaagatgaggagagga

SEQ ID NO: 15490 - DNA, 101 bp, Gossypium hirsutum
  Clone ID: uC-gsflnu33B073b09b1
aaaaaaaaagaactataaaagagcaacctaaaaacaaaacaaaggccaacaaaatacaacgtaagtgaatgagaaaaaacctgtcgtaacccaactaaaaa

SEQ ID NO: 15491 - DNA, 350 bp, Gossypium hirsutum
  Clone ID: uC-gsflnu33B073c07b1
tttctctctgtagccgccgcctgcgtctctctcttcatctctctgaaccaaaaagtctttagcttttcgcttcgagagagaccatgttggtttaccaggatctcatcttcggtgacgagcttctttctgactcattcccctacaaggaaatctagaatgggatgctgtgggaagttgagggaaagtgggttgtgcatggagctgtcgatgttgacattggtgtcaattcttcatcccaaggtgctgaatgaggatgaaggtgtttgatgaccaatctgtgatggttgtttgacatttgttgacacttttcaggctttaggagtatccctctttttgacaagaagcagttt

SEQ ID NO: 15492 - DNA, 297 bp, Gossypium hirsutum
  Clone ID: uC-gsflnu33B073c10b1
tcgttaattcacagccttagaaaatcaacttattaaggtctgttccagcaaccaccgaattcaccacttaatcaggtggtcgatagcatatcaaaaacaatcaacggcgccttaggacctttccaaccttgatctcaacgaagtgaacagatccatggccgtttcgcaaggtacggatgtgctggcgtggctggtggtgtactggagcgtgctagggcagtggaggctgaatggttgcggcgcacagagagagccctagggtttctgctcttgaaatggttcgggccttttgggctt

SEQ ID NO: 15493 - DNA, 270 bp, Gossypium hirsutum
  Clone ID: uC-gsflnu33B073c11b1
acgcgttcgactggtaggtgcttttgaagaaactacaactggtgttaagaggctttatcatgatgcaagccaacggaaccttgatgttcccttgcattaatgctactgactctgttactaatagcaagttcgataacttgtattggatgccgtcactcacttcccgatggttttgatgagagctactgatgtgaagaatgcagtcaaggtcccctatgttctgtggatatggtgatgttggaaagggcatgtgcttgcttcctttgaaac

SEQ ID NO: 15494 - DNA, 266 bp, Gossypium hirsutum
  Clone ID: uC-gsflnu33B073c12b1
tttttcacgcgtacgagacatgctatggggtgatctctttctcatcccttcaaagaacacttgttgttactgcttctcatagacaaggacttctgaaagccgtggaagacaagatcacagtgagatggggattgaaccagagttttccggccgggaccgactcgtcttataagaccatcaaggtccagctttgctatgcacccattagtcaagtcgaccgtgcatggcgtgaaaccgaggaccattttatcaaagacaagacatgc

SEQ ID NO: 15495 - DNA, 202 bp, Gossypium hirsutum
  Clone ID: uC-gsflnu33B073d02b1
atcgttttttgatccctttggatgactccttgcgctgagagcttctcagcacgttagctgttaggtcagaagatgccaaggttgaatgatgaagttatagatgagaggggacctccttgattcaagaccagagaactgtccagttcgataagctctcatatataggtccattgcatggccaaggttcgacatgctccctttt

SEQ ID NO: 15496 - DNA, 281 bp, Gossypium hirsutum
  Clone ID: uC-gsflnu33B073d05b1
tcttttttccactccatgccgacttacaagacttggatctttaaatctttggagggctgggctgagaacaacattctgactcaccttaaaccagttgatgaaaatgtggcaacctcgcgactttcttccagatcttaattctgacggtatttatgagcatgtcaaagagcttatgtaaagggcaaaggaaattccccagatgattactttgcagctctggttggtgatataaactctgatgaagctcttttaactattaaacaatgtctaataccttggat

SEQ ID NO: 15497 - DNA, 215 bp, Gossypium hirsutum
  Clone ID: uC-gsflnu33B073d06b1
tttttccgaggcattatctagcttctgaagggcttgactttagcaatctgaataagatgaagaagaatccagtggagggcaatacaatcactgacataagtggttgttgcatgagatgattttgatggtcatttttgttggggatgaagaaggcgaatgcattgttttgtaataactatacttttgggatggtactgcccgtgattttttatatg

SEQ ID NO: 15498 - DNA, 227 bp, Gossypium hirsutum
  Clone ID: uC-gsflnu33B073d07b1
ttgtcctacgcgtccggacttcggtcgtcttgagatcgagttatctgaagttgaaatgcctggtttaatggcttgtagaacctagttcggtcctgcccaacctttcaaaggagccaaaattactggttcatttttacatgaccatccaaaccgccgttcttattgaaacccttacctacctctgaagctgaagtccgttggtgatcttgcaacatcttctttaccct

SEQ ID NO: 15499 - DNA, 361 bp, Gossypium hirsutum
  Clone ID: uC-gsflnu33B073d08b1
tttttcacgcgtccgcccacgcgtccggcattaactgttcatcagctggaggctcttgatcggtgggaacagcatgcacgttgtgcttacgaaatctttgagaaggaaggaaacagacctattgtcattgaagagctagctttggagctcggactgagcccatctgtgcctgttcatgctgttcttcatgactggattaggcacactgatgggaagctaagttttctcggattcgtcaaattattgtacggtgtatctagccgaaccatcgcaaaagttcaatagaagccgtcaaactttcgaagagctctactgagctggtttggctaattaaaggttcatgttaggtggttttgctagc

SEQ ID NO: 15500 - DNA, 459 bp, Gossypium hirsutum
  Clone ID: uC-gsflnu33B073d09b1
tctttaagttaaatatgcagaattcatattctgtttttttatatgcatatatacatgcagatcaaccagcactgatggatgggattatgatgatgaaggttaagcaagtactgctgaagaatgaattccaattcggtgcagctgccacctccatagccacttgttcatcttaatttggcgctatcctacctgagctcctttttgtattacaatttcttagtattttttttctttttttaaatataaaacatccattttattgacctttgtaagacctttttttgactcttgtaagatccattccagtatttccaacacttcttttccttccattgctatcccttctgagctgattgaaactttgaaaatggtcaaatattatgccaatacctttactaggatattattgaataattttattagcatatctaagggaatggaaatggcgaaaatctttta

SEQ ID NO: 15501 - DNA, 373 bp, Gossypium hirsutum
  Clone ID: uC-gsflnu33B073d10b1
tttttctgatgcacgaggactgccgacacctgaagcattgagcattgtaattcgaaatgcagtacggtttctcaacagtcatgctattggtgcattgactcaatattgcaaaacgtttagagcaagatagggattcttctgatcctacagtgagggggcaaattcaaacagaatcagcacaagcaggtcttacaatgcagtacttacgttcccttcttttagagcttggccgaaccataatgacgctgcgtatgggaaaatctcctgcagaattttcatttaatgctggacctgcagtttatatatctccttcagggtcgaaatcctataaatgggtcaagcccttttcccacttcaaaccagaattcctttt

SEQ ID NO: 15502 - DNA, 379 bp, Gossypium hirsutum
  Clone ID: uC-gsflnu33B073e02b1
tttttcttcccgactttcttttctcttaatttactgaaagttttttttagttgaaatggagattcttccacagcgagcatcattatcctcaacgtctgatcccaacgcttcattgttcattccattagcatattggatggtccaggaatttcttctgatcaatggtgggctcatcgccaatcatactctttgctttccgtgacttctgtgttttaagaaacgtttacacgtataccgaaaacgactactgtttccgtcgacgacgaagatctcctcttttccctgggacctcgatgacatatttgtgccatactacgacgtttttctcgactcatgaccggatgaaaaggtaaaagaaattggttcctggtcgggacca

SEQ ID NO: 15503 - DNA, 165 bp, Gossypium hirsutum
  Clone ID: uC-gsflnu33B073e03b1
tttatcatgcccatttccaatctacagctcccaaggcaaatatgcctatcagaaacatttcggctggccgggccgatgaggcatctcaccccgatgctcttaaggctgctttggctgaacctcatcgtaaccctgatcttcgctttcgctggatcgggctcagga

SEQ ID NO: 15504 - DNA, 263 bp, Gossypium hirsutum
  Clone ID: uC-gsflnu33B073e11b1
tttttaggaaaaggtctagttctggtgagaaattctccttccctagcaccccgaaccaagatcttgattcggagtttgaattcgggtgttttaccccggattcaccttctcaagatccatgttgaaccttaccagctgatcatttattctcaatggtcgacttttgccacatgcctttactttacaacctggaacaatgattgcaggcagatgttctcttgggacaagcagaacaagcagcattaacagtatggattcatttg

SEQ ID NO: 15505 - DNA, 339 bp, Gossypium hirsutum
  Clone ID: uC-gsflnu33B073f03b1
cgtccgcccacgcgttcggtactctcatcgaattgaccctataaaatgtttaaggaaaagctttttctttgtctatcctcaaaaaggggaaacttgggctttcttcaaagactgggatattaaatgggtttcagagccagaaaagcataaaccaccataccggtattattttgtagaggtcctaactgattctgacgaggaacttgtcattggggttgcacattagggtaaagtgaatggatatgtcagcatttttcaacaaaattaaccgttgacggggttatctcatttcaagtctattcacgggagctatataggttttcgcatcaagttccccta

SEQ ID NO: 15506 - DNA, 373 bp, Gossypium hirsutum
  Clone ID: uC-gsflnu33B073f06b1
tttttgacagcaggaacagactacccacaacattccgatatggtagcaatattcacacactaaatcacgatgaggaagacagccgtttctcggatagaaaatccttctggaatggaaattctacgcagtatggtggcaattgctacaacacataattaaggttctgctaggttttctaccaaggtgtttcattctggagggttgaaggtaaaaatatgatccttgctctattatattcgcctgttatctctgatgttttaagtatctggttcaataaatcgattgtttgtgagtaatttcaaatccataaattgtgcataccttttgcacccttattagctttatttattaatatataatatcttttccatct

SEQ ID NO: 15507 - DNA, 81 bp, Gossypium hirsutum
  Clone ID: uC-gsflnu33B073f08b1
tcgtataaaaaagaaaaaacaaataacaaaaataaaaaacaaaaaaaataaaaataaactccaaatcaaacaaaagtgata

SEQ ID NO: 15508 - DNA, 320 bp, Gossypium hirsutum
  Clone ID: uC-gsflnu33B073g06b1
ttggatattgtggagattcaagtccagactccagggagtggtctacggacctcggcccctcctgctgttcctcacgctgaatcctagaacttcgaacctacttcaacctttgcagtttctgccaaaactggacactattcaagacaagagtcaagtgatccatatgtgggttcatcacctccaaaatccgaaggaaggacaatatactaccatgtagcggatgaaaatggtgaggatgatgatgaggcagtagagggggacctctttagatataaagggcaatggaatggatgaaccaactcataaattgtaagaaaaga

SEQ ID NO: 15509 - DNA, 352 bp, Gossypium hirsutum
  Clone ID: uC-gsflnu33B073g11b1
tcttttgttgcagcctgtgttgttacgcttcgttggaaaaataacaccgtaaatcgagtttcttcaaagtgcatcttaacttggtgtgatggagtactatgtattttcctagtggcatgctgtggttttgctgttggagatctttatcgttatggcactcacttcatttttatgattgttgtggtggctatagccataatggcttgtgctgctctttgtttccgtcaggcttattcagatccttcagggttttcttgtccatgggttccgaatgtgccatctgtatgtatttttttcaaacatatacctttttgctcagatgcactatgaagcgtggatcatattcataatc

SEQ ID NO: 15510 - DNA, 345 bp, Gossypium hirsutum
  Clone ID: uC-gsflnu33B073h01b1
tttgtatgagctccccaatcttttgtttattgcaggcatccttattgtagttgttttgattggagaattcaagttttttgcctcagcctctcgtgatatgaacatgtactacgatgaatacgttgatcggagtcgtcaaagacttgggaattcgtccactctggagtggagaaccagaagaaaatgaaggtgatgaataaatggtaagatgggttccataaagaatggaaaaattgggatgttttggctagtgaggaattaaagaaaagagctgatgatttcataaccagggttaaatggcaaaggaggtttgaagattggataccactttaaaagaaccttact

SEQ ID NO: 15511 - DNA, 434 bp, Gossypium hirsutum
  unsure (1)..(434): unsure at all n locations
  Clone ID: uC-gsflnu33B073h03b1
cagcatgttcaacttctttgcatttattcttcaaaacccattttaaatctcccaaaaacctcttcttttatccaaattctatccattttcagaccaaagtttccaccttttcttccaacaacttaacattattctttaaaaacagcaaaactctttacggtacttggaaactcaagtctncagaagaagaagaaacagctgttgttgtacatgaacgagaagaaacaactgtttgcgaacaagagtctgtttttgttcctgtttctccttcagacactctcagaatgtacttccagattcctgctcaaggattgacaatgagacggtttaaaggttatgaaattaagcatggatgatgaataatgattttttgccaagaagaaggcagttgaggatgccttggaagcaaaacaaatagtaaccaatagctttgt

SEQ ID NO: 15512 - DNA, 326 bp, Gossypium hirsutum
  Clone ID: uC-gsflnu33B073h06b1
tttttgccgaagaggggaaaggttccatgtgaacggcacttgcacatgggttagtcgatcctaagagacgggggaagcccgtccgacagcgcgttcagcgcgagcttcgaaagggaatcgggttaaaattcctgaaccgggtctctgctgctgacggcaacgtttgggagtccggagacgttggcgggggccttgggaagagttattttttctgtttaacggccttgccaccctggaaacggctcatccggaggtagggtccagcggccggaagagcaccgtactgttgtgtggtgtccggtgcgcccccggtggcccttgaaaat

SEQ ID NO: 15513 - DNA, 422 bp, Gossypium hirsutum
  Clone ID: uC-gsflnu33B073h07b1
tcttttgtgctgagatcgtcaagtcagacccggttgtgtccttccgtgagactgtccttgagaggtcttgcaggactgtgatgagcaagtctcctaacaagcacaaccgtctgtacatggaagctcgacccttggaggaaggtcttgctgaggccaatgatgaagggcgaattggtccaagagatgatcccaaggtttcgttcaaagattttggcccaggagtatggttgggacaaagatcttgctaagaagatttggtgtttcggccctgagacaactggtcctaacatggtggttgaaatgtgtaaaggagttcaatacctttattgaaatcaaggactttttagtgcgggggtccagggggccataaaggaaggtgcgatcgccttaagagaacatgaggggtatttgctttgaagtct

SEQ ID NO: 15514 - DNA, 280 bp, Gossypium hirsutum
  Clone ID: uC-gsflnu33B073h12b1
tcttttgcttctcgcttttcagccgtagccatggtgaacgtacctaagaccaagaagacctactgcaagagcaaggagtgcaggaaacacactatgcacaaggacacacagtataagatgggcaaggatagttttgtttgtacaggggaagcgttgtatacgacctgaaacaatccggttacggaggttagaccaaaccagtgttccataagaaggcaaagaccaccaagaagattgtgctaaggctgcattgccaaggttgtaagcacgttttacaaca

SEQ ID NO: 15515 - DNA, 377 bp, Gossypium hirsutum
  Clone ID: uC-gsflnu33B074a02b1
tccgcccacgcgtccgcaaatagttaacagtttagcttaagttaatgctttaccaagttcaggaaattgatctgacaaactcaagtgaaatcttaattgaagcacatttcattctagttatgtttatgttttctttatgtttgatgtgtataacaagtaaggtgaaaataaagagtttttgtagagaaaattcaaccttgaaatttactaaaatgtatttatcttacatataaattcgcatgccccttcaagaagcaaagcttggtgggtatgacaattccttctaagagtatagaaccttgtgaattccatgcagggggggccccttctcggggaaccaggttaacccacccgagtttccgaccctaaagtttttt

SEQ ID NO: 15516 - DNA, 469 bp, Gossypium hirsutum
  Clone ID: uC-gsflnu33B074a03b1
gaaatgactgttatagctagctaagaaagcaagtcagccatggaaagaactctctttcacctattccttgttttgttagggttttctcatattataagcttgaatgcggtctcggttacaagaatcgaaagcttggtgcatggacctcaagttcatcatgttccagagaatcctcacccggtaattgcagagaaaagttctaaggaaggaagggtttttatggagttgaatgattatccaggttcaggagctaattatcgtcacactccaaggccacaatttggcagatgtgccgattgttgagtgtagatgtatgttttctcatagtgcttttggtccataatctctcattttattgcttcttaaatttgcttcttgtctgttttaagagttgggaagttaatctgtttttagagctatccatagaagtaagtttctggtaatagcatgaatgtttagatactttaaa

SEQ ID NO: 15517 - DNA, 173 bp, Gossypium hirsutum
  Clone ID: uC-gsflnu33B074a04b1
gaaatgccatactggcagtgctgctgctgtcaccgtcactgctgccagtgccggtggtggcgaactcaaaaaccgtttctccaacctattattgtacatttgttgggtgattattctctttgaatgacttgatttctgcctcctaaatagcccctgccattattggtttcttg

SEQ ID NO: 15518 - DNA, 408 bp, Gossypium hirsutum
  Clone ID: uC-gsflnu33B074a07b1
acgcgtgggcgggagttctgataggtgttataaaccaccgccagaggttcatcaggacagattagccaattcctctgtcagccttgagggtttcaatgtcggcagtccagatccttattgtgggagtagttttctgaaaaaatcaccaaccaggatgcactactctgttgcagaggctctctgagtaaatctctcctttcatatcacggacaagaaaagctcttcgcttttatcgatccttgtagataaataaagctttttcagctttccctatatggatgttggaacaatttacttaactgcaattacgcaatggttttttgacgattgtgtgggtttaaaagttcttttcctttgtaaaaagagtattactagcacctctttaatgagatctgaaacatatttctg

SEQ ID NO: 15519 - DNA, 464 bp, Gossypium hirsutum
  Clone ID: uC-gsflnu33B074a08b1
cgcgtccggagaatatcaatgttgctgctattgaaacaaccttatggtcaattgaatggggcattgctgagcttgtgaaccatccagagatccagcagaaactccgcaacgaaatcgacaccgtactaggacccggtgtgcaggttaccgaacccgacacccataagcttccatatctgcaggcagtgatcaaggagacactcaggctccgaatggccatccctctactagtcccacacatgaacctccatgatgcaaagcttggtgggtatgacatccctgcagagagtaagatccttgtgaatgcatggtggttagccaacaacccggctcactggaagaacccagaagagttccggcccgaaaggtttttcgaggaggaatcgaaggtagaagcaaatgggaatgacttcaggtatcttccatttggtgttggaaggaggagctgtccagggattattttg

SEQ ID NO: 15520 - DNA, 211 bp, Gossypium hirsutum
  Clone ID: uC-gsflnu33B074a10b1
acgcgtccgcccacgcgtccgtcaaaatcttgatggaaggaacatcaccgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaatggtggagggtat

SEQ ID NO: 15521 - DNA, 398 bp, Gossypium hirsutum
  Clone ID: uC-gsflnu33B074b01b1
cgtccgcccacgcgtccgcccacgcgttcggtttgtggtcgtacaacaggtattgtgctggattccggtgatggtgtttctcacactgtgccaatctatgaaggatatgccctttcacatgccatccttcgtcttgaccttgcaggtcgtgatctaaccgatgccttgatgaagattcttaccgagagagtttacatgttcaccaccactgctgaacgggaaattgtttcgtgacatgaaagagaagcttgcttatgttgccctggactatgagcaggaactggagactgtcaagagcagcttatctgttgagaagaactatgagttgcctgacggacaagtcattactattggagctgacagatttcgttgcccggaagtcctttttcagccctttt

SEQ ID NO: 15522 - DNA, 446 bp, Gossypium hirsutum
  Clone ID: uC-gsflnu33B074b03b1
gttccgttcgattcagtgatgaagaaaacaaagacattagaagacaattgggtgccttgttggaacgaggaattcgaattccatctaactgtcccagaactggctctacttcgggtagaagtgcatgaatacgacatgtctgaaaaggatgactttggaggccaaacatgcctaccaatttcggagctaagaagtggtatccgagcagttcccctcaacagccgcaagggcgagaagtacagctctgtaaagctcctcatgcgcttcgaattcatcgatccataggcacccaaagttgagttctggtccatacttccaaaccaaccttcaatctgtttgacgggatgtgagcttgtgtgcagttttaccttatacattacatgtttgctgcttgtttttattactcggacttgggtgcgaagtttttaaatttttccttctttttc

SEQ ID NO: 15523 - DNA, 321 bp, Gossypium hirsutum
  Clone ID: uC-gsflnu33B074b04b1
ggaggtgccgtacttgcatggatcgtcttgcatttggactcctagggctatgggcaagcacaagtgggcagagaggcgattgatgtatataggggccgagagaggcatttcgaaggccttgccgaagtcaacaggacgactatgaacattgatggaactgttggactgtacggtgcatcaaatggcctgtgaggagcaattacaagagaccgtcagctgtacaagctactgtacgctgctcatgtagcaagtggtgcctgtctgtaaaggagcacaccgggacctttgctagctgggagatggggtgcatcattacaaacg

SEQ ID NO: 15524 - DNA, 476 bp, Gossypium hirsutum
  Clone ID: uC-gsflnu33B074b06b1
cgtccgctctctttaatgaatctccaaatcgaaatttaaggccaaaaagacacaagggttactaattaaattaatcttcagcgaatatgttggtttatcaggatcttcttacaggtgatgagctcctctcggactctttcccatacaaagaaatcgagaatggaatgttatgggaagtcgagggaaagtgggttgttcaaggagctgtcaatgtagatattggggctaacccttctgcagaaggtggtgatgatgatgaaggtgttgacgatcaagccgtcaaggttgtggacatcgtcgacactttcagacttcaggagcaacctgcttttgacaagaagcagtttgtgaccttcatgaagaggtacatcaagaacttgacacccaaattagagcctgaaaagcaagagtctttcaagaagaacatcgagggggctactaaatttttgatgtccaagcttaaagatcctcaattt

SEQ ID NO: 15525 - DNA, 462 bp, Gossypium hirsutum
  Clone ID: uC-gsflnu33B074b07b1
gacccaagatcctatgaggttttgactaagaggtttataggagatgataatggaaatgtgaaaggacttgaggtggttcgtgtgcgttgggagaaggatgccagtgggaggttccaattcaaggaagttgagggctcagaggaaataatcgaggctgaccttgtcctgctagccatggggttccttggccctgagtcgacactggcggaaaaattaggtgtggagcaagacaatcgatcaaacttaaaggcagagtatggccgcttcacgaccaatgtggatggagtctttgcagctggagattgtcgacgcggtcagtcgttagtcgtgtgggcaatctcagaaggaaggcaagctgctgcacaagtcgacaaatacctgactaaggaagataaggacacaagtgtagagggtgagaaccaagattccgtcaagcggcaccaagacctttcccaaaagcag

SEQ ID NO: 15526 - DNA, 462 bp, Gossypium hirsutum
  Clone ID: uC-gsflnu33B074b09b1
ttgaaaagaacgagaagcgagaagggatggccttgcgtgtgggtatgagtcgggataacggcagaggcaggaaagggtggacgctgaccgccgccgtcactaacatcttcgaatttgtcagattggccgagttcgagatcctctttaccctcttcctcatcatcgcttttatcatcttcaaagatctcacatcgcggcctgaatacaatcaattgctcgtgaaaaaacccggcggtgtagattggtggccgtactaagaatgggaagtggatgcgatgggaattatgtcctgcataattccattccttaggattattttgtttcttttcccttcctctttcacttccagatggttgcttttttgttgattgttgttgaggtctatattctatagaggaaccccctcctggctttcatgcttgtaacccaactagcttcttctttttgatttagttgtttact

SEQ ID NO: 15527 - DNA, 426 bp, Gossypium hirsutum
  Clone ID: uC-gsflnu33B074b11b1
gcgtccgtccacgcgtccgcccacgcgtccgttttcagctccctttttgtctctgcattcttcctagcgtaaaaaaagaaagtaagatatgggtaaggatatagagagtagtgtagagcaagggtcaggcaaggactaccatgatccgccaccagcaccattgattgatgctgaagagctgactaaatggtcgctttacagagcagtcattgctgagttcattgctacccttctcttcttgtatgtcacagtattgactgtgattggttacaaggtccaaaccgatcctctcaagaacacagttgaccctgactgtgggggtgttggaatcctgcgtatagcttgggcctatggtggcatgaaccttattcttgttactgccctgctggtatctctggaggacatatcaacccggttgtgaccttt

SEQ ID NO: 15528 - DNA, 453 bp, Gossypium hirsutum
  Clone ID: uC-gsflnu33B074c01b1
caacagtttctgctagaagctgcccgccaatgttaagattctgggctgtacgacaagtctatagagattcagaagagaattggagcattttcgatggcattggatacgataaataagtgcctctctgaagcaatttgtgccttatcacgtggtagattggatggtgagagtcaaactgctggcctcattcactccgggaacgagatcttggagacttttaaatattatcctgaagtcagtttccaagagagggaacatgtttcggagcaacaaaccatattaagacagctcgagactatattatcgatccataaattgatgagactaggccagtatcttgatgctctacgagaagttgccaagatcccattccttccattcgatccacgagcacccgatacatttgctggtgggttccaaaatttatctcctcatgtcccagctcgtttgcct

SEQ ID NO: 15529 - DNA, 431 bp, Gossypium hirsutum
  Clone ID: uC-gsflnu33B074c03b1
gtccgcccacgcgtccgattagggtcttggcttacactcagattaggaaaatgaagggattgaagcagaagaaggcacacctgatggagatccaagtcaatggtggaacaattgctgacaaggttgattttgcttacaagttctttgagaagcaagtccccattgatgctgttttccagaaggatgaaatgatcgatattattggtgtcacaaagggtaaaggttatgaaggtgttgtcactcgttggggtgtcacacgtctgccccgtaagacccatagaggtttgcgtaaggttgcttgtattggtgcctggcatcctgccagagtcttctttacagttgccagggcaggtcagaatggataccaccaccgcactgagatgaacaagaaggtctacagggttggcaaggttggtgatgagacccacttt

SEQ ID NO: 15530 - DNA, 314 bp, Gossypium hirsutum
  Clone ID: uC-gsflnu33B074c07b1
ccatcaacagctaccgccatttgtgttcaagcccctgcagagaaaggatttaccagctttgccattgatttcctcatgggtggagtttctgctgctgtgtcaaaaacagctgctgctccgattgagcgtgttaagcttttgatacagaaccaggatgaaatgatcaaaactggtaggctctctgagccctacaagggtatcgttgattgtttcaggcgaacaatgaaagatgaaggagtggtttctttgtggaggggtaacactgctaatgttattcggtattttcccacttaagcttttgactttgcttttaa

SEQ ID NO: 15531 - DNA, 407 bp, Gossypium hirsutum
  Clone ID: uC-gsflnu33B074c08b1
cgcgtccgcccacgcgtccggtcataacttcattgttttaatttgtatcattcttgctttaatttcattgggagaattgatacagaataatatttttcttaaagtgtttttctttgagtgtttattgtatctctaaaggacatgaaaaagcttgtattattcaatcctttctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaagggacccaagtttacttccccgggcttgcaacgcaaaagtttttttatagggccaccaaaattaaattcacgggccgcgtttttacaactctggaattggaaaaaccttggggtacccc

SEQ ID NO: 15532 - DNA, 415 bp, Gossypium hirsutum
  Clone ID: uC-gsflnu33B074c10b1
cgcgtacgccctgttgagcttgactctagtccgtctttgtgaaatgactcggaggtgatcggaaatgttcagggtattgggctcctgtccggcatgaatgcatcgagcacacaatacatagattttggatttaataccggtaagtttaacggcagctctctaagcgtattttcaagggagaacctgggcttgcggtagtcggaggaagaggacgattcatgatggcaaaaggggttgcactatgtaaccctttccttataaatgccaccactgtcattatggaatttaacgttacggttattcatcactaggatgttatctccagactcaatcctcttggattttgaaagagtcatatcattctgttccacttgattagaataaatgtatgagatatatgttctcatctgattat

SEQ ID NO: 15533 - DNA, 443 bp, Gossypium hirsutum
  Clone ID: uC-gsflnu33B074c11b1
cgcgtccgattccagactacctcgaatctattgtattccaaatcgaaaaagatcgtggaaaaactactgatatttttcatatccccactcaagttctgctctgcgctgctatcagagagatgaaagatttttcggttggggatttggatttgggtaccttgaaaaagtggagcgcgacacttaattacgctaagaaatatggttttcaagtgggatttgctgataatctgttgaagaagaatttgcttgcctattttgcaattcaatgtctgcccaaatcgataaaaatattgctttccaagagcaaatggttgttttgttgatgctggcttgctgcagtctacaaaaatattggcttttacgatatctacatttacttttctgtatgtgtgaagtttatcttatttgagaataaagcttttgtaaactgagaaattatgttt

SEQ ID NO: 15534 - DNA, 462 bp, Gossypium hirsutum
  Clone ID: uC-gsflnu33B074d03b1
cgtccgtttccctttcacttccttccttgctttgtagcaattaagccaatggcaaaacttgtggctgctttcttcttggctctcattgccatctccatgcttcaagttatggtcttggcatcgcatggacatggaggtcatcattatgatcaaaaacattacggtcctggaagcctcaagagttaccaatgtccatcacagtgctcgaggagatgcagaaaaacccaataccataaaccatgcatgttcttctgtcagaaatgttgcaacaaatgcctgtgtgtgccccctggttattatgggaacaaagctgtttgcccttgctacaacaattggaagaccaaagaaggaggacccaagtgcccttaaaaattcttatttataaattatgcctaatgcttattgctaaccaacatatgtttggtgtttaatcatatggttattattacggctgtttttttt

SEQ ID NO: 15535 - DNA, 361 bp, Gossypium hirsutum
  Clone ID: uC-gsflnu33B074d04b1
agctgagtccatgagtaaagttggttgaaagggtgtaaattacctttgatgcgggaaaccgaaatgaggtatcaaatctccatcgtagcaacgatgaacctgtttagagtagaatgcttattttcgctgttgattaattattgaaaaatccttaagatcctggtgatatataagatttgcatttgcagttcagtgtaacaaaatttgaacatcatttttcagtgaaacgaagaaagttgtatttactatttgctattttttacaagtagaaaatttattaactgaattttatttaaattgttgtaataaattgaatttaaacacattacttataagaaactaatttcatacgaaagaaacc

SEQ ID NO: 15536 - DNA, 438 bp, Gossypium hirsutum
  Clone ID: uC-gsflnu33B074d05b1
atgcttcatactgccgtttctcttcatctttcgatcagccctacttctgggtatttctcgctttgaggttttaattggtagccatgaatgctcttgctggaactagccgcaatttccgcctggcctctcgcctacttggcttggattctaagcttgaaaagtctcttctgatcccatttagagagatcaaggtggagtgcacaattcccaaggacgatggaaccttggtgtcctacgttggattcagaatacagcatgataatgctcgtggtcccatgaaaggaggaatcagatatcatcctgaggttgaccctgatgaagtaaatgcacttgctcaactaatgacctggaagactgctgtagcagacattccatatggtggtgcaaaaggtggcatatgaagctctcctagggacttaagtaagagtgaattggaac

SEQ ID NO: 15537 - DNA, 181 bp, Gossypium hirsutum
  Clone ID: uC-gsflnu33B074d07b1
caagtgaatccattgccacaccgatttgttttgctgcatttcacaaatcattttagagaaggaaaaaggtcctggtcagagttaggcttaattacaaaattagccctcaaactatattactttgccactcaagtatctcaagctttctttttgtatcttatcaaaattatatttaaactat

SEQ ID NO: 15538 - DNA, 443 bp, Gossypium hirsutum
  Clone ID: uC-gsflnu33B074d08b1
tttttcagagtagaagcttcactaagcttactccctccctccttccctctctctgtttctgtcgcttccatgactgtcttgtttaaaatgcctgtcgttttgggtttctttgtgggtcttatgatgctgggtttggttagctctgctgagtttcatgagctttttcaacctggttgggcaaacgatcatttcatctatgaaggagagcttcttaagctcaaacttgataatttttctggtgctgggtttgcatcaaaaagcaggtttttgtttggaaaagtatccatgcagattaaacttgtagagggtgactctgttgggactgtcactgcttactatatgtcatcggagggtccataccccaatgagttcgactttcagttcctgggcattaccacaggtgaaccttcccttctccagacccaagtgtacgtgaatggtgt

SEQ ID NO: 15539 - DNA, 74 bp, Gossypium hirsutum
  Clone ID: uC-gsflnu33B074d09b1
aaaaatacatgcagaacaaccagcacaagaagaaaggattaataaaaaaaaaagataggggcggcctttttaag

SEQ ID NO: 15540 - DNA, 444 bp, Gossypium hirsutum
  Clone ID: uC-gsflnu33B074d12b1
cgcgtgggcttttttacagtagaacaatgatgggttcgagaatcaaaatctcagctctgggtgttactatgcttctgctgttgattgccccaacttccaacgctgccatttcgtgcagtgatgtgataaaggacctgaggccttgcgtgaactatcttacgaaggggagcggaaaaccaccgtccgcttgttgcgcgggagcctccgctctggcatccgccacctcgtctgctgccgacaataaggctgcttgtgaatgcatcaaatcagcgtttaagaatattaaacccaataaccagtaagtttaggctcttccttttaattgtggaatcactttgcccgttaccatttaaccaaatgttcattgttccaaggttggttgagagcttggaagctgaaactgtgagtgcttggatggtcatgaagtaattaaaaaacttcatt

SEQ ID NO: 15541 - DNA, 172 bp, Gossypium hirsutum
  Clone ID: uC-gsflnu33B074e01b1
ccaaaaaaaaaaaaaaaaaaaaaaaaaggaaaaaaaacaaaatcgaaacggaaaaaatgaaatctcaaatcacctcttagagactgtttctctttttattcaaacttttgaatcgattttgtatagactcgacccttccccttttacatcctttcattcagttttatagccg

SEQ ID NO: 15542 - DNA, 341 bp, Gossypium hirsutum
  Clone ID: uC-gsflnu33B074e03b1
gtccgcccacgcgtccgttttttttttagcataagccaggttgccttctcttgatgttggtcatgggcgtagtggatgtagggatggatgtaatgtatgtatgtagggacggcgaatcaagaccttgacaatcgggaccgagggcttattgtaggcagggaaacaccacaaggtcaaaaggcactcgtagtattgacagatgtgtatgcgcatcggggctctgtggaccggatcatatgcttcaacctctggcctgccgagctataacaacttgatggcaatgcctaattggctcagagaattttgtgcgttaatggtatgtaccaattgtgtgaggcaac

SEQ ID NO: 15543 - DNA, 457 bp, Gossypium hirsutum
  Clone ID: uC-gsflnu33B074e05b1
cgtccgggaagttctcttactgtttggtcgacaggtccgcttcttcaaaaccgtcctccatgattttcggtgatgcggccattccccgaaccgccgtctttactcctcttcttacaaaccctaagctcgacactttctactacgttgagctgcttgggattagcgtcggtgggacacgtgtccgagggatcacgccttctttattcaaaatggatccagctggtaacggaggggtcattattgactcaggcacgtctgtcacccgcttgacccgacccgcttacatcgcaatgagggatgcgttccgtatcagggcctcgaatctgaagcgggcgcctgacttctcattgttcgatacatgcttcgacctgtccggcaagactttcgttaaggtaccgactgttgttctacattttagaggggcggacgtgttattgccggcgaacaaatatttgat

SEQ ID NO: 15544 - DNA, 466 bp, Gossypium hirsutum
  Clone ID: uC-gsflnu33B074e06b1
cgtccggccctgacaaaacccactactttatttacttgttctcgtaccccttcatgatagatcttgttgtggttgtaccaaatagcccaataggcaatagatctaattttgcgagcttctgtattctggctaacaaattctgtttctaaccattttttccaaattggttctctgttgcatgttgaaattgacacccccaatcccctcaacacctgtcgtgtgaaagagcaatccatgaagaggtgttccacagtttcctcctcagctcgacaaaccgggcacaatgtgttagcagccagatggcgtatttttaaattgtacatagtgggtaggaagccattggcaattctccacataaagattcgaagtttacttggtaatttaagctctcataggtttgtaaagaaattcgaagcaatttcactatgtattctattacccccctctgtagtaagtcattgatagc

SEQ ID NO: 15545 - DNA, 447 bp, Gossypium hirsutum
  Clone ID: uC-gsflnu33B074e07b1
tgctgcgataccaggctgtgaatatcgtggcagctcggcttggtcgggctgaaccacctctcaggagagaagtaattgaatacatgtctgatgcaaatgctcatctttggagcatgaggcgcagcaaggcaaactttttgcgcctgacatcggttttctcaggattatttgaagttggaaaatggtttggtgaagtttgcaagtggaagaacccaatgacaacagtgctggtgcatttcctatttgtaatgctggtttgttttccagagctgattttatcaacagttttcctatacatgttcctgataggggtatggaagtatcgttatcggccaaggtaccctccccacatggacacaagccttttttgcgcagatgcagtttctcctgacgaactagatgaagaatttgagtccttttctgcattaaggagcttggatctagttc

SEQ ID NO: 15546 - DNA, 280 bp, Gossypium hirsutum
  Clone ID: uC-gsflnu33B074e08b1
actggaaaaccaaggaaggaggccccaaatgcccttaaattactcaaaagaagacccttttttttcttttttacattattatccctataaatttcctatttgaaattcaagtcattgaagcataaggttgcactgtaatactaactatatattttatgttgttagttgttactagtggtttatgtgttttgattttttttgtaccaaattgtcactccattaaaatgagagtggctaatctttgttctattttattaatgaagatggtgtcgtttaatta

SEQ ID NO: 15547 - DNA, 469 bp, Gossypium hirsutum
  unsure (1)..(469): unsure at all n locations
  Clone ID: uC-gsflnu33B074e09b1
agagagagacacagagccagagaaacagctttttatctgtttactcagcaaagtcttccggcttgcaaacccgtcttaacaccaggatgggttatagcaatatttttgtttatgggtgtcattttcattcctgttggcctgatcactctgcgtgcttctcattgtgttgttgaaattgtggaccgatatgatattgattgtgtacctgagccatctagaatggataaagtttcatatatccaagatgactcaattcccaagaattgttctcatttcatgaaggtgcacaagtacatgaaagctccaatttacatttactatcaactcgataattattatcagaaccaccgaaggtacgtcaaaagcagaagcgataagcaactcttggatggccagaagtatcatgacacangttcttgtcaacctgtggagtcgaataacaataggcctattgttccttgcggattga

SEQ ID NO: 15548 - DNA, 221 bp, Gossypium hirsutum
  Clone ID: uC-gsflnu33B074e10b1
aaagctcctgcgaagagtgtaaagccgaagagtgttaagtcaccggcgaagaaagccccgtcgaggaggggaaagaaatgagagaagagagggtggtcaacataggggtagttttgtaaattcgagtgaagcttagtggctgtatttgggtccatacccatgaaaatatgacatcggatcttatctgttcttgaacttttcttcgaggggatgtttttttt

SEQ ID NO: 15549 - DNA, 449 bp, Gossypium hirsutum
  Clone ID: uC-gsflnu33B074e11b1
cgcgtccgggaatccgtatggaatacatgttttcagatgctgttgaagttcaggcattggtgaggagcaaagggttattttcattttacgaggatgggcaccaagagtgttgccgggtcaggaaagtgaggcctttgaggagagcactcaaagggttacgtgcttggattaccggtcagaggaaagatcagtctccagggactagatcggaggttcctgttgttcaagtggatcctgtttttgaaggattggatggtgggattggtagctcggtgaagtggaacccagtcgccaatgttgatggtaaggacatttggaatttccttcgggcgatgaatgtgcctgtcaatactttgcattcccaaggatatgtgtctattggctgcgagccgtgcactaggccggttctaccgggacaacatgagagggaaggaaggtggtggtgggag

SEQ ID NO: 15550 - DNA, 424 bp, Gossypium hirsutum
  Clone ID: uC-gsflnu33B074e12b1
tttcatctacccagcaacaaggttcaggtggtgtttggcggtggatagccgggggcacatagaagttgcatatttttcataccatcattgctacggtatctccgaagcaatggctaggtaagttccaatcccactgatatcagagagtgcaatctactcgaatatcacttagattgtacatgcggtttacatttgtttcgttacttttcttaataagtgtttgtgagctttcgagtttgaccattaaaattttctcgaagctatagaatctgaagttgttaaaattgtactttccgttgtcggttgtatcagctcttcttttaattttcaagtctttttattccgtatcctgtaaaccagtatactcacgcatgttttcatatttgattgatcatattataccaaatcttgacattttcctctg

SEQ ID NO: 15551 - DNA, 466 bp, Gossypium hirsutum
  Clone ID: uC-gsflnu33B074f01b1
agatatcaactgtccctgttaaaacagctgaggcaattgtgaaaattttgacccacaacagcaaaggcatcgactttcagattctctccaaccctgaattccttgccgagggaactgcgattcaggaccttttcaatccggaccgtgttcttattggaggcagggaaacaccagaaggtcaaaaggcaatcgcagcattgagagatgtgtatgcgcattgggtccctgtggaccggatcatatgctccaacctctggtctgccgagctatcaaaacttgctgccaatgccttcttggcgcagagaatctctttggttaatgctatgtccgcattgtgtgaggcaaccggtgctgatgtgagccaagtgtctcatgctgttgggaaagacacaagaattggacccaaagtcttgaaatgcagtgtgggtttccggggatcgggttttcaaagggatatttgaacctg

SEQ ID NO: 15552 - DNA, 458 bp, Gossypium hirsutum
  Clone ID: uC-gsflnu33B074f02b1
tccccgtaagcaaaccacaaaggaaagcttggagagagacccaaaaacaatgtctaaggaagttagtgaagaaggacagggtcgtaaggactatgtggaccctccaccggcacctctgattgacatggctgaactcaagtcatggtctttttacagagccctcatagctgagttcatagccactctcctcttcctctatgtcactgttgctactgtaattggtcacaagaaacaacaagatgcatgtgatggtgttggtctcttgggtattgcatgggctttcggtggcatgatctttatccttgtttactgcactgccggtatctcaggtggacacattaaccctgcggtgacttttgggttgtttttggcccgtaaagtgtctttcattagggctgtggcttacatggtgtcacagtgcttgggtgctatatgtggagttgggttggttaaagctt

SEQ ID NO: 15553 - DNA, 461 bp, Gossypium hirsutum
  Clone ID: uC-gsflnu33B074f04b1
cgtccggaaataattaaatctgtagtggctggtacaaccccttcatattccttggaattgaaattgggtgattgcaagagggcggctgcaatcaggcgggaagcgttgcaaagattaacagggaagtcgttatctggattgcccttggatgggtttgattacgagtcgattctagggcagtgttgtgagatgccggttggctacgtgcaaattcccgttggaattgccgggcctttgttggttaatggaagagagtactcggttcctatggctaccacggaagggtgcttggtggctagcactaataggggctgtaaggctattcatttgtctggtggagctacaagtgttctattgaaagatggtatgactagagctccatgtgtaaggttcggtaatgcgaaaagggcagctgatttgaagttgtatttggaggaccctgataatttcgagacctttgt

SEQ ID NO: 15554 - DNA, 463 bp, Gossypium hirsutum
  Clone ID: uC-gsflnu33B074f06b1
cgtccgcccacgcgtccggttcaatgagccattggagtcttcaactgttgaaaagatgtttcttatgggtatgaacacttgtgaaggtgtggatattcttgatataagaccctgctccagtacacaatatagattagagcgtttccagaagcaggtccaaattatgaagaagtatcgggggactgcaaatgttcaacgtgcatggcttgcttcctctaaaaaagcattgcctaccatcatgaagcatgggcttgcagactgccgtctttcttcaatcccaggcctatatgccgctggtgttcatcttgctgcagcagaatttacgaatggcagtgcaaagtattgtgatgttgacgaaaatggagtacagtacatgatattatgttgcgtaataatgggaaagacggagcttcttttccctgaaagtggacaatgttttcctagcagtgaggatgttgatagt

SEQ ID NO: 15555 - DNA, 157 bp, Gossypium hirsutum
  Clone ID: uC-gsflnu33B074f07b1
ttctggggatagtctaagaatcttaaattttatagaaagccaataaagtgcttgctggacgaaatgtggtgattaattgaattgcaaggtcatacatgctgttaattttttaagagctgataaatgagtatgacatagtgctcataaatgttctaag

SEQ ID NO: 15556 - DNA, 93 bp, Gossypium hirsutum
  Clone ID: uC-gsflnu33B074f08b1
caaaaccttgcggaggtaccgttggatcccattttggtagtggtgggtgggggtgaaacatcgacagataggcttgaaggtaacgctacaagg

SEQ ID NO: 15557 - DNA, 465 bp, Gossypium hirsutum
  Clone ID: uC-gsflnu33B074f10b1
caaaaaattatagctttcgagcaatctagacacttattttctcatcaaatcgttttgacatatggctcgtaccaagcaaactgctagaaaatcaaccggtggtaaggctccgcgtaagcagctggccactaaagctgctcggaagtcagcaccggcgaccggaggagtgaagaagcctcaccgtttcaggccaggaactgtagctcttagggaaatcaggaagtaccagaagagcaccgaactcttgatccgaaagcttccgttccagaggcttgtgagagaaatcgctcaagattttaagactgatttgaggttccaaagcagtgccgttgctgctcttcaagaggctgctgaagcttaccttgtcggactgttcgaggatactaatctatgtgctattcatgctaagagggttaccattatgcctaaagatatccaacttgctaggaggattagaggagagag

SEQ ID NO: 15558 - DNA, 449 bp, Gossypium hirsutum
  Clone ID: uC-gsflnu33B074f11b1
tttgaacaacttacccttgatttctatcataagggcaatctttatggccttgaaaaatactgggcattccatcacttccgagatcagaaagaactgataaagaaacatcccgaactggataggttactgagggaggaataccggcgattggaagatttccgtaccaaagagaagaatactagtagcacaagagaggagcgccattaatgagtgacgtaattgatccctagtgttattgaaccccaattttgacaagcaactctgatgaccggatcagagagtaggaaggagttcaaggtctatatgaattatggtttggtttatgaatgcagagggaagatgagttgtgtaatgtatattggaaggggtcagataaattctggtgcggctgccgattctggaggctatccatttttgtgtttcctgatatttgtgtaggctttttttgc

SEQ ID NO: 15559 - DNA, 415 bp, Gossypium hirsutum
  Clone ID: uC-gsflnu33B074f12b1
cgcgtccggaccgcccatacctggcgcgaggattgagcacgctgtcgatctaacccatgcgcccatcgtcaggcctgaatcggacatcatttactattctacgggcacagggacgacatggctctgaccaagtaggggccagctacacagcggggagagggacttgaactactagcagattcatggctgtggactgaaccactacccgaatggctacacagccacctgtggtgggctgacgaactaaaacacgcatgatcaataacgcattatttggcaatggtgcctggagcagggctaacaacggcgggcactgatagtacatggggggggacacacgtgtagatccaaggccagcaccctgagatgattttggattatcacagagctgagtgcttacaggactagtgcgggg

SEQ ID NO: 15560 - DNA, 393 bp, Gossypium hirsutum
  Clone ID: uC-gsflnu33B074g01b1
tctcattacagactctttcaagaatttccttaaataaaagaagagaaagaagaagaagatgttgctggggaagaggccaaggccacctatgaaaagaaccacaagcatgacagagatcacttttgatctaaacaccaccgccaccaccaaggacgaacctccaccctctgattcacataacccttttaacaactaccccaaacaggcttcccctttcggtggcgcagcaccttctgtagctgttgctggcagaggcggtggacttgaatggttggatcaacggttgttggcgacggagtcacctagagttcatagaaggcattcagctgattttatggaaacactctatttcctaaggtcttgcgggctttgtagaccgtcgcttgttcctgg

SEQ ID NO: 15561 - DNA, 366 bp, Gossypium hirsutum
  Clone ID: uC-gsflnu33B074g03b1
acctggaggaattgagattgcggtgaagcgcattttatatgaaaatgatggaatgaaagagttcttggcagagatttcgagtctcggccggttaaaacaccggagcctcgtcgggttgaaaggttggtgcaagaaagaaaaagggtcattcatgttgatctatgattacatggaaaatggaagtttggataagagggtttattatgactgtgatgagaccaacatattgacttgtgaagaaagaattagaatcttgaaagatgttgcctcagcgttattgtatttacatgagggatgggaagctaaggtcttacatagggatattaaggccagcaacgtattgcttgataaggatatgaatggaag

SEQ ID NO: 15562 - DNA, 430 bp, Gossypium hirsutum
  Clone ID: uC-gsflnu33B074g05b1
ttctttcctcctagcccaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcaagcccttcgttgatgttttgaaggaaggtggtgttctccctggcatcaaagtcgacaagggtaccggtgagccttaacggaaccaatggcgaaacttttaccca

SEQ ID NO: 15563 - DNA, 455 bp, Gossypium hirsutum
  Clone ID: uC-gsflnu33B074g06b1
tttcttaaactatatttctaaaataaaaggggtgttttagaagtatcatatggaaatggttattttatttgtaggtcttttttttaatctatttatgtagtattagccttagaaaatatataattggatgttattcatgtttaaatccaataatttcttcagagaaaagacagcaacattagtcaactttgtttacctaatgtcttaatgatctacagatgattgcatatatgactctgatcattgtttgaaaatgtttatgtcatgttttatatgtacatagatattttctttcatcctttgaaattcattgtggaaatgcttaatgatactatttagttaatcattttttttcatttgaggtttatattacatttatgcctatatacatgtaacttctgtcccaataaaaccttgtttggtttttaatcacaagttctttcatgcattgattt

SEQ ID NO: 15564 - DNA, 436 bp, Gossypium hirsutum
  unsure (1)..(436): unsure at all n locations
  Clone ID: uC-gsflnu33B074g07b1
aacctcaagatccagtacaggaactattattggaagtttggtatcagtcctttcaagcaaaatgataatcaacagctagctgatgcccaagttgttgctaatcccattgtcgatgacattgaaaacccccctgcggataatgttcatgttgataataattttagttcgaattttaagaataatcaacattgtttgttcgttggatgtaagttcaaagccatggctttgactagattttgtcatctccatattctctccgattccaagcagaagctttataaggcttgcacttatgtcatcaaaagtgctcatgcgggacctataacatgtggaaagcccatactgagaaccgccattccttttctctgtaccgngcacttccaaaagactcagaaacatgttaacagggccttgaagaagcaagtcttaatgtttt

SEQ ID NO: 15565 - DNA, 225 bp, Gossypium hirsutum
  Clone ID: uC-gsflnu33B074g10b1
cgcgtccgcccacgcgttcgatcaaaggctcattttttaccccagagccccttctctccgccgaatttcccttttcccccgtaaaaaatgtctctggtggccaacgaagatttttagctcattttgcgtgtcctgaacaccaccgctgtatggaaagcagaagattattgtttgactctgaccctccatcatgggtatcaggcaggcgtttttgccaacgattgt

SEQ ID NO: 15566 - DNA, 443 bp, Gossypium hirsutum
  Clone ID: uC-gsflnu33B074g11b1
gtttcggataacttccctcaaatgtttgtccataattcgatggatgctgttagtgaagatcatgttatgtcactcgagaagttggaggttgagttagtcgagcttctgaaaacaaagagaggggatccggtttccatcgcatcgctgcctttgttgtattacgagaagtacggcaaagttctgcaggcagatggttatctcactgagagccagagacatggcaaagcaggttacagtttgacaaagcttcttgcgaggttgaaaaacacgatccgagtaattgacaggcctcacggacagcattccgtcattttggctgaagatgctcccaagtacatggaaaaccgaaatgatagaaacgatccaggtcccgatgtaagtggatcaagacagatatatcttacatttcctgctgagagcacttttaggggagaagatgtctc

SEQ ID NO: 15567 - DNA, 428 bp, Gossypium hirsutum
  Clone ID: uC-gsflnu33B074g12b1
cgcgtccggacattaggaaccagagactagggatgtttgagcataagcagtatcaggagctatacaaaaataacattagaggaaaccatacatactgggctgggcgacttggagagcctaagctgatgggccttatattgcaacaacatatccggtaccatgcgtacttaaatcgagaaacttggccgtcttgtaataacgcggcttaatgacaacccgtgaacgtggacctatttatagggagcttggaggaattccatgtctcaaggtggtcgaagactgaaacggtgattagtgtggaacatttcctaccagtggtccatttgaacgcataactgagcacacgttggaggaaaactttaatctcgaaggctgggaggtgtacgggcttggaagctgctacacatgctggtgccgtagaaaccgat

SEQ ID NO: 15568 - DNA, 478 bp, Gossypium hirsutum
  Clone ID: uC-gsflnu33B074h02b1
tggtacctaattgattaattaatgtcttaatatcgtaaattgaaaagttttaaaataaattttaaaatacgatccctttttatgaatgtcgagtttaaaagtgcttgaattggatcaaaacgattgctaaagatttcctcgtctcgagacatcagagaatcacatcccgtaagttaggacgcgataccttgaacttccgagcgcaagtttatctttaattttaattgaaatttcatgtgttcttaaaactcgaaaggatatttggctatttagaatcaacgagagaatcgaaatcccgtaagttagggcacaattcttcggtgttccaagacgcgaaacattgtcttattttcaagattttcttttggtttaaatttggatctaaaaattttagtgaagtatttaagaggtacgttcagaaacaaatcacgatgaataattaaaatgatgaaacaaaaatgtaccataaaaaggtcat

SEQ ID NO: 15569 - DNA, 451 bp, Gossypium hirsutum
  Clone ID: uC-gsflnu33B074h05b1
cgaaggcagcctcccattgataccacttggcagcagatttatttttgcttgaggactggttattatgatgaagcaagacaagttgccctgtcatcccgtgcttctcaccaatttgcaccactgcttgcagagtggattaatggtggaggcatggtgccagcacacgctgcagctgctgctgcagaagagtgcgaaaaaatgttcagaatgggtgatcgggttggtcgagcttcatatgacaagaaaaaactgttgctctatgctatcatatcggggtctcgtaggcaaattgaccgtcttctcagagatataccatcacttttcagtaccatagaggatttcctgtggttcatattgtctgcagcacaggattttcctggtggaacctcgtctatgagggttagtaccatacagtcttgacgatttgcaagcttacctaaccaatttgagc

SEQ ID NO: 15570 - DNA, 423 bp, Gossypium hirsutum
  Clone ID: uC-gsflnu33B074h06b1
tcactaattaatatgggttctttgatcaaagcgactgtttggtcaacctgttttgccgcattaatcattgcaatagcagctcaaatggacatgccgcccggcatggtaatgccaccaggctccgtcatgccctcggcgcccacgcccaatagaagcggccacgttgtatctccatctgtggtgcttggactccttgctttcatgttttcaatttttgttttcaaccagagagcctgatcagcctctctctacataaatgcttggtatttcgattttcatgctttttttttttttttaaatgtttttggtgtctccgtctgttgctacgctggtttgtaatacatttctctttcttaaattactatctatgatataaatcttctttctcctggtttgaggaagaatattagattaaatatttca

SEQ ID NO: 15571 - DNA, 481 bp, Gossypium hirsutum
  Clone ID: uC-gsflnu33B074h07b1
gcgtccggtccttcatttcccttcacctcaaagcactaacacttcctcttctaaacctgttttatcctatgcaccgcagacatccttaacctgcgctcatggggaaagaaatgacactgtcaattctataacaagcggtgacccagaaggagaaggagaggaagaggaagaagagttgtctttgatggctttggttgtgacccttttcaggaaatcattggctgcttgtaagagtatggaaagaagagagctttgtgctatggagatcggttggccaaccaatgtcagacatgtagcacatgttacttttgataggttcaatggcttcttgggtttgcctgttgagtttgagcctgaagtccccagaagagctcctagtgcaagtacaactgtttttggagttttcacagaatccatgcagttgtcgtatgacttcagagggaacatttgttccacaatacttttgctattgcaagacgtc

SEQ ID NO: 15572 - DNA, 426 bp, Gossypium hirsutum
  Clone ID: uC-gsflnu33B074h08b1
agagagagaggagaaaatggagaagcaaagcaaatcttatggtgttgttttacctacaatggatgaagatcatgaagaatttgttttcattgatgaagattatgatgttgatgatgatctttcccattgggaattcattgattcctctgttaccgattctgatgatgccgatgatgatgtctcgtttcatcgtggtgaattattgagaagaaacgtagagtcgtttatccctttaactttcccctttccccctataacggaggtgaaaaagtccatcccgattcctgctccgattcaagatactgatgatcgtgatccatcacttgatggatctgatgatcaagatgatgatgttgatgcatcatttcatcgcgacgaattatcgagaagaagaaacttaacgttcggtatgccctttcctttccc

SEQ ID NO: 15573 - DNA, 467 bp, Gossypium hirsutum
  Clone ID: uC-gsflnu33B074h10b1
cgcgtccgcaaaacaagagctttctttcgtctgcttaattggactcacatctctagaaaaatggcatctttcaattgctttgctttagcattcgtgatggctttgtcatttgcaagcactgatgttggggtagcagctcgtcaccttctgcagctgcctcaattgcctccaatgccaactttgcctacaaccacactccccccacttccatctatccctaatctcccacagccatccataccagcattgccaaggcctggggcgcttcctccacttcctatcatgccagggttgcccacattgccaagtgtaccaagggccacactgcctcctctgccaagcatgccctcaatcccaactgcaatcccctctattcctttcctttctccaccaccttctccttctactccttgaaataccctttggtttattgaaataccccctttggtttatctgctgcatactgg

SEQ ID NO: 15574 - DNA, 464 bp, Gossypium hirsutum
  Clone ID: uC-gsflnu33B074h11b1
actccggcaatggttccagttatagatttctcaaaccaaaacctgaaaccgggcagccctgaatgggatttagtgaaatcccaagttcgagaagcattgggggagtacggttgtttcgaggcattgtttgatccaatcctggagcttcgaaaggcagtgtttggggctttgcaagagacctttgacttgcctttacaaaccaagaaactgtgtgtttccgataagccctttcgtggctatttcaatccttcatctggaccgtttcaaagcttggcgatggaagatgctcagattgctgaaaacattgaacaatgcctcaccaacactttatggcctcaaggaaacataagtttcagtaaaactctggcgtctttcactcaactagcatccgagttacagaagaaaattttgaagatgattttggagagttttggacttgagaaatacatggatgagctcattga

SEQ ID NO: 15575 - DNA, 461 bp, Gossypium hirsutum
  Clone ID: uC-gsflnu33B074h12b1
tttgcaaaggatttgtgatggcatttggtttaatatgattgaggaattgattactgtatttgaagcagccgcatctgaccgtaatggaaatattactttccataagttggttggccggcttgacaacagtgccgtttctgctgttggtgcgaggttggcattcaagtccaatgaagaaatagcagttcaagtgagatccatccttctcgatgaagttatcccagagtcagagccagtgcttctgcttaaaattgatgtacagggatgggaataccatgtattgaagggagccaaaaagttgttatcgaggaaaaaaggtgaagccccttatctaatctacgaggaagatgaacgactgttgcaagcaagtaacactaccgccaaagagatacgggattttctaagtggtttgggttatactcattgcacccagcatggtacagatgcttattgcaccaaga

SEQ ID NO: 15576 - DNA, 541 bp, Gossypium hirsutum
  Clone ID: uC-gsflnu33B075a01b1
ttattaaaaatcacctactctctcactttgctctcttcttgttcctgtcctctttcaccaaactatcgccgacaacctctccaaaagaatggcatatgaagggattctgttggggatgggtaatcctctccttgacatttcgttagtcgtggacgaagagttcttgaaaaaatatgatatcaagttgaacaatgcaattttagctgaggagaaacaccttcccatgtatcaagaaatggcatccaagcccaatgtagagtatattgctggaggtgctactcaaaattcaatcaaagttgcacagtggatgcttcaaattcctggtgcaactggttacattggctgcattgggaaggacaagtttggggaggaaatgaagaagaactcaaaagctgctggtgttaaatgtcaatatctcgaggatgaaactgcaccaacaggaacttgtgctgtttgtgttgttggtgtgaaaagtcactcaatgcaaatctatcagctgctaactgctataagtctgagcatttgaagaagcctgagaatt

SEQ ID NO: 15577 - DNA, 473 bp, Gossypium hirsutum
  Clone ID: uC-gsflnu33B075a03b1
ctgtcgcgtggggtgccttagagatgtttgcaaccggatactctacgataaaagatttagtgcctttcattacccagtcactgatgaggacgcgccaaactaccgctccataatccagaatcctatggatgttgctactttattgcagcgtgttgactctggacaatatcttacctgttctgcttttgtgcaagatgttgatctgattgtaaccaacgcaaaggtttacaatggagatgattataatggtgcaagaattgttagtagagcttgtgaattacgggatgcagtacatgggatgctgtcacagatggaccctgcattggttgcttattgtgacaaaattgctgctcaagggggtccagctcatatgcctgatgatctagggctgccttctgcggtacctgttatgcagctaggaactttaacttgggcaagtgctcgactccggaatggccagccagaggctgatc

SEQ ID NO: 15578 - DNA, 241 bp, Gossypium hirsutum
  Clone ID: uC-gsflnu33B075a04b1
cctactcgtccgccggttcctcctcaccggcgacaaatctacttccctctcaccgcaccggagccgaatcatataaatagcaattcaacaagcggcggatggaactttcagtttcgtgaatcgggctccattcaacgtcatatccctcgagttcagacttcagaccgactcagtcttcttataaggcaaaaggggaagggaagagattgaggaattagagtgatagaagacgatgaggggc

SEQ ID NO: 15579 - DNA, 249 bp, Gossypium hirsutum
  Clone ID: uC-gsflnu33B075a06b1
tcgtcagctccgtccacccaaacccatcctagcccataaacacctacctcttcaaccgacctacagccactgggtagcgaaatcgccgctgaatgtcaactaactcaaaccacattggtcgcacccagataggagcagagtgcgatttatcgccccagcgttcccttggggaaaccgatgcctcctcagacgagccccttcctttggtaggcgaagactctgccgccttcgatttggggacccaaaaca

SEQ ID NO: 15580 - DNA, 339 bp, Gossypium hirsutum
  Clone ID: uC-gsflnu33B075a07b1
tcgtaccctttccattttccctttatttcctttgccgcccctagggtttaattacattccgcacatggcttctgcagatgtcgagtaccagtgctttgtcggaggtctcgcatggaccatcaacgaccgtgctctggaagaagccttcagtgcttacggcgagatcgtcgattcgaagatcattaacgatcgagagactggaagatccagaggctttggcttcgctactttccgtgatgagaaatcgatgagagatgctattgaaggaatgaacggccggagtctcgatggaaggaatataaccgtcaacgaagcacaatctcgccgaagcggcggcgg

SEQ ID NO: 15581 - DNA, 114 bp, Gossypium hirsutum
  Clone ID: uC-gsflnu33B075a11b1
tccacgcgtccggttaaggccaaaattcaagataaggttggtatccctccacaccagcaccggctgatatttgctggaaagcagctagaggatgggaggaccctagcagatttc

SEQ ID NO: 15582 - DNA, 558 bp, Gossypium hirsutum
  Clone ID: uC-gsflnu33B075b01b1
tctacgcgtccggatagaacaggtgttgttagtgccagtggaaaggaaacacgttcaagctccccttctttctcaaaagccggaccacccaaactagagctgcaaatgggtcgcaagtgggctgttgagaaccaaattggaagaaagaacttagttattgatgactgtgatgccaaacagtctgtgtatatttatggatgcaaagattctgttttgcagattcaggggaaagtcaacaatataaccattgacaaatgcactaagatgggagtggtatttaaggatgttgtggctgcttgtgaggtagtaaactgcaatggtgttgaggtgcaatgtcagggttctgctccaacaatttcagtggacaacacatctggctgtcagttgtacttaagcaaagactctttagggacatctataacatcagcaaagtcaagtgagatcaatgtgttggtgcctaccggacctgatggtgactggggggagcattcattgccgcaacagtatatccatgtatttaaggatggtcaatttgaaactaccccagtgtcgcactca

SEQ ID NO: 15583 - DNA, 406 bp, Gossypium hirsutum
  unsure (1)..(406): unsure at all n locations
  Clone ID: uC-gsflnu33B075b03b1
tctacgcgtccgggaggctatgagtttatcaagaaagcaattgaaaagcttggggcgagacacactcaacacattactgcctatggagaaggcaatgagcgtcgcctcactggtcgacacgagactgccgacatcaacactttcatatggggtgttgcaaaccgtggcgcatcgattcgtgttggtcgagacacagagaaagctggaaaaggttatttcgaagaccggaggccagcttcaaacatggatccatacgttatcacttccatgattgcagaaaccaccatcctgtggaaaccctgaggcatatatattccttggcttctgtttctctgtggtacaaaggaaagagctatgtttcgttttggtttgcttgctatatcnagccggatcggaccaaagaact

SEQ ID NO: 15584 - DNA, 420 bp, Gossypium hirsutum
  Clone ID: uC-gsflnu33B075b04b1
ggtccgagaaagtagttgtgcataaattgactcacaattttcgtgatgctacccacatagtacgtacaccattgaaactaccaattgaatcagggcacgtccttctgaaaatcatttatgctggggtaaacgcaagtgatgtgaactttagctcaggcaggtatttcctaggaaacaagaaagatctgagttcccttcttccatttgatgctggatttgaggctgtgggaataattgccgcagttggagattctgtaagtaatttggaagttggaactcctgctgcaatcatggtttatggaggttatgctgaattcattgacggccccgttaaagcacatacttcctattgtgagacctagtttcagaatgttgttgttatgcttacttcaggatatacagcattaatcgcattggaaa

SEQ ID NO: 15585 - DNA, 489 bp, Gossypium hirsutum
  Clone ID: uC-gsflnu33B075b06b1
atcgtaggaacaaagaaagcttgtgtcgtgggtggcagcggattcgttgcgtcattgctggtcaagttgttgctcgagaagggttacgccgttaacactacagtcagggaccctgacaaccagaagaagatctctcaccttgtaacactacaagagttgggagacttgaaaatctttcaggctgatttaactgatgaagggagctttgatgcccctattgctggttgtgaccttgtcttccatgttgcgacacccgttaactttgcttctgaagatccagagaatgacatgatcaaaccagcgacccaaggagtggtgaacgttttgaaagcttgtgccaaagcaaaaacagttaaacgtgacgtcttgacatcatctgccgcagctgtgtttatcaacacactgaatgggacagatctggtcatgacagagaaagactggaccgatttcgagttcttatcatcagcaaagccaccaacttgggggtac

SEQ ID NO: 15586 - DNA, 402 bp, Gossypium hirsutum
  Clone ID: uC-gsflnu33B075b07b1
tcacgcgtccgcttctgcatctggttaggccgtgccgatacacttcccgttgctgtcttggcaatgatcctcttctccattggagctcaagctgcgtgcggagccacttttgggatcatcccattcatttcacgacgatctttgggaatcatttcaggtctaacaggtgcaggtggaaacttcgggtccggactgacgcagctaatattcttctcaacctcaagattttccacagcggcaggtcttacttggatgggagtcatgatcgtggcttgcactcttcccgtgagcctggttcatttcccccagtggggtagcatgtttcttccgccttcaaaagatgaaaacaaattcaccgaagaacattactactcctcagagtggaacgaggacgaaaagaaa

SEQ ID NO: 15587 - DNA, 119 bp, Gossypium hirsutum
  Clone ID: uC-gsflnu33B075b08b1
tcgttgaatgctatatttcgttggggggttaaacccttggttgtggcgtctgtctccactccttggctcctctttacctgttttatttgaataatgagagctgatttggttcttttatt

SEQ ID NO: 15588 - DNA, 249 bp, Gossypium hirsutum
  Clone ID: uC-gsflnu33B075b09b1
tcgtacacacgcccgcacacgtgtacagctctagagggattgtgggcggttttgtcgacccaagattatgggcaccagaatgcgacgacatggcctttgtatagaggtatctacattcaattaactcgccgctctcctacaaagttgtggcggctaaaacactgcagttacccagcataattgctatgcaaatacacagacagttgcacagacggagtcatagccgataggtccgtaagctttgccact

SEQ ID NO: 15589 - DNA, 386 bp, Gossypium hirsutum
  Clone ID: uC-gsflnu33B075b10b1
gcgtgggctgaactaattgcaaatcctgaagcagtgaaaaaggtgaagcaagaaatagacgatgttgtcggttcggatgccgccgtcgatgagactcacttgcctaagttgcgctatctagatgctgcagtaaaggagaccttccgattgcacccaccgatgccactccttgtaccccgttgcccaggtgacttaagcaacgttggtggctatagcgtaccaaagggcaccagggtcttcttaaacatttggtgtattcagagggatccacagctttgggaaaatcctttagaattcaagcctgagaggttcttgactgatcatcaaaagctcgattatctaggaaacgattcccggtacatgccgtttggctccggaaggagaat

SEQ ID NO: 15590 - DNA, 374 bp, Gossypium hirsutum
  Clone ID: uC-gsflnu33B075b12b1
tcgtccacgcgtccgcttcatttcttcgtcaccagaagaagaaaaagaaaaaaaacagtttccttaaattttctaggaaatttagagaatggatgattacacgagagaaatgatggatttgaaaaccctagttacacgaacccttgagaagaaaggggttctagctaagatccgggctgaacttagagcaagtgtctttgaagcaatagaagaggaagatcgagtcattgaaaaagaagaaggtttacctcctgcattattgagaagttgcaatgatcatgctaaacgacttcatgcttctcctttgggaagacttttaaccgcactaatatgcgagtacttagactgggcgcaactaaatcacacactaaaag

SEQ ID NO: 15591 - DNA, 565 bp, Gossypium hirsutum
  unsure (1)..(565): unsure at all n locations
  Clone ID: uC-gsflnu33B075c02b1
ttttaaaggaaaaaagcatttgtaattgtaattgtttcgagatctctgtgtgtatagacagtctcaaatggcagtagctgcagcaccagatcacttgttccatttgaggaacaatttctacttgggttcctttcaggctgccatcaacaacagcgatcttcccaacctctcccccgacgacgccgtcgagcgcgactgcctcgtctaccgctcttacatcgctctcggcagctaccaactggtgatcaatgagatcgactccgccgctgcaactcctctccaagccgttaaactgctggccctctatctctccaaccctcatgataaggaatcaacaattgcgagcttgaaagaatggttagcagatccagcgattggaagcaatgccttattaaggttgattgctggaatcgttttcatgcatgaagaagattatattgaagctcttaaacacaccaatgctggtggcaccatggaacttcatgcattgaatgtgcanatcttcattaagatgcanccgtcagattatgcagagagacaactganggtcatgcagcagattgat

SEQ ID NO: 15592 - DNA, 149 bp, Gossypium hirsutum
  Clone ID: uC-gsflnu33B075c04b1
ataagggtatggctaccattcacaaagtacttcccactattgagatcattttcagtgtattcaatgtaacgtcttattataatgggggtgtgaagagcctcagcccaaatgcttgggaaaggaagttctggaacagcctacaatgctct

SEQ ID NO: 15593 - DNA, 419 bp, Gossypium hirsutum
  Clone ID: uC-gsflnu33B075c06b1
tgtactacggtacagcggacaacatgccgacggaagaaactatgggccctccattggggggccaacccagacgaggcggaatttccctacccgagagatcatccgcccccaaaccccattccaacattctcgccaggatcactccttaccccattgttacccgtggtaagcaagcggtctctgatgctgctttcgtctccaagaaactcctccgaagcaccggcaaagtcgcttggatcgccggaactaccttcttgatcttatttgtccctttgatcattgagatggaccgcgagcagcatttcaatgaactcgagctccagcaagcgagtttcctcggtgccccacccactgcacctgcacgctcttgagtaaccgagtcagtgtcatatcaggtcagaggagcttgttgattatca

SEQ ID NO: 15594 - DNA, 286 bp, Gossypium hirsutum
  Clone ID: uC-gsflnu33B075c09b1
ttgtttctttcttttttcccttctcaccaaactaaagcttggctgagaaaatgaagatcttcaactgggtgcaaaggaggttccatcataacgtcctcaaagatgggcttgcacgaaatgttaagaagactgattccattgcaattgactccaatacaaaagctttactggaacaagtggcactggttgacatgctggatggttggcgagatggcgctttaacaattggcaccttcggttttcgatcttgacaaatgcttggttgtagaacatagtgtctacctag

SEQ ID NO: 15595 - DNA, 184 bp, Gossypium hirsutum
  Clone ID: uC-gsflnu33B075c12b1
tcacgcgtccgccggctgatgttctgttttattcttgtatggaatgtagtaatgttttctttcatgtttgatgagagaccagttgctcatggctgtactcattaaaatgcttattctataaccttcttgtcactgaatgagcaatattcctgatgattccagctaagcttcaaacttccacttg

SEQ ID NO: 15596 - DNA, 178 bp, Gossypium hirsutum
  Clone ID: uC-gsflnu33B075d03b1
gtccctttgttttcgccggcgaaggctccggcatggcttttaacaagctcactgacaatggctcatcaacaccggcgggattagtcgcggcattagtggctcacgccttcgcgttgtttgtggcggttcccggcggtgctaacatctccggggggcacgtaaaccctgccgtcacatt

SEQ ID NO: 15597 - DNA, 376 bp, Gossypium hirsutum
  Clone ID: uC-gsflnu33B075d04b1
agtgaattctttccttcactttctcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcataataacaggcctttgtaatgattcattttcaaggatgaatgcctgcaaggtctatgactataattatg

SEQ ID NO: 15598 - DNA, 234 bp, Gossypium hirsutum
  Clone ID: uC-gsflnu33B075d05b1
gtaaattagaccagatttatcagaatttaagtgtggccttgctcatgtattcctgcaacacacgagtgcttctcttactatcaatgagaattatgactcggacgttcgagacgacaccgagacgttcctcaacaaaatagtccctgagggaagatctgtgccttggaagcatacacttgaaggccgtgttgacatgccagactttataaaatcatcaatgtttggttgcgccct

SEQ ID NO: 15599 - DNA, 234 bp, Gossypium hirsutum
  Clone ID: uC-gsflnu33B075d06b1
gtgagctataaggagataccaccatcaacattgtcatcaagaacaatatcaactgttatgtcatggatacagaagatagtaacttctatgtaattgtttcagttttaaggatgcatttcaaaccttgttaatataattatatatctatgtattgacggttaactgttaagcactatgctgaagtttatgcaagttgtgcttaactgcttttgctagtgttcgaattagaatgtg

SEQ ID NO: 15600 - DNA, 434 bp, Gossypium hirsutum
  Clone ID: uC-gsflnu33B075d10b1
ttaacaaagtgtggtagaaggagcactgaagggtatttccgagttctttgaactgacaaatcaggaggaaaggagagagtacttaaagaagaatcctatggataggataaggtggggttttagaaactatgcaggagaaaagcgagagtatctaaacgatagtggcggatgttaaaaatcattgccctagcaaaccggctagctttagaggtgccattgtgtagtactttaaacggatgcatgaggttgaacttggtttatctaatagcaatatcgaaattcttggtatactaagaagcctacattgtgaaggtatttaagctggaagaatgttttgacgccgtttccatgaattttatttctaccttcttttctatccaaatgtttcattttttttctgttccatactgtccttactttcttttgatttgtta

SEQ ID NO: 15601 - DNA, 499 bp, Gossypium hirsutum
  Clone ID: uC-gsflnu33B075d11b1
tctgatctatgtgacttctatcaccatatggaataaaggcatcattagccaaataattctttcgttccctatagcagtttttactgggagaaatatgtttgctgaaaggagtaaaaaaggcattagtgataataagatatatcattatcatttaaatcttggaggaagtgtttctaccagaaggctgactaggctaccttcaattcctaagaatgatgcaaagttcagggggtatgttggaattcacagttcgggattcagaaactttctgctaaaactggagctgctttgatctattgtggattctggttttgaacatccttccgaaggcaaagttttaaactcatgtctaatgttaacattcgtgaattccatgaattaagtcattttgtttttcttgcttttagtgacttataatggtgggcagtataataagtttggcgctttattattttgatttctatattatttttaatctaatttttattatttattttat

SEQ ID NO: 15602 - DNA, 408 bp, Gossypium hirsutum
  Clone ID: uC-gsflnu33B075d12b1
tcggatgattgacgcgtggagaaaccaccaataccctggtgcattttttcacaaatccagccgagggtaccataatcagagcacctaatgagcttatagatgatcaacattctcaacttttcaaagacatcgactttatggacttcctatcttttttctttaccgagcaagtaaagttcatcgtctcccctgaccagatttactcatttgcttctctcttactgccaatttccgatcaaaagcatggtagttaaaaatctcgactttgatctttaaattagtcgtgcggatcgtattcctatctcataatccgtgtgttaatatcgtatttgtatgttctaattatgcgcaactgcgtttaaggtatcatttgttgtcaatagattgcaccttgtcaatcatatttgt

SEQ ID NO: 15603 - DNA, 313 bp, Gossypium hirsutum
  Clone ID: uC-gsflnu33B075e03b1
ctttctttgttttcgccggcgaaggctccggcatggcttttaacaagctcactgacaatggctcatcaacaccggcgggattagtagcggcatcagtggctcacgccttcgcgttgtttgtggcggtttccgtcggtgctaacatctccggtgggcacgtaaaccctgccgtcacattcggtgcctttgatggtggccatattacattgctcaggagtatcttgtactggattgctcagttgctcggatccgttgttgcgtgcttgcttctcaagttttcaactggtggactgacaacatcagcatttagctt

SEQ ID NO: 15604 - DNA, 525 bp, Gossypium hirsutum
  Clone ID: uC-gsflnu33B075e05b1
tgttgcttctctagaggtctggtctactcaacactctctcctccctcttagcaaccaaagactcagatccgctcggatttctttgtcccagaactagaatggagacctttctattcacatcagagtccgtaaacgagggacaccctgacaagctttgcgaccaggtctctgatgctgttctcgatgcctgccttgcccaggaccctgacagcaaggttgcctgtgaaacatgcacgaagactaacatggtcatggtctttggagagattaccaccaaagccaacgtagactatgagaagattgttcgtgatacatgccgctccattggatttgtttctgatgatgttggtcttgatgctgacaattgcaaggtcttggttaacattgagcagcagagccctgatattgcccaaggtgtccacggacactttacaaagcgtccagaagagattggagccggtgaccagggtcatatgtttggttatgccactgatgaaaccccctgattcatgccttttagccatg

SEQ ID NO: 15605 - DNA, 346 bp, Gossypium hirsutum
  unsure (1)..(346): unsure at all n locations
  Clone ID: uC-gsflnu33B075e11b1
agcgacagtgcttngtgagcttaaaatccggcacgttgaactcactttccgacgaacaaaaagtagagttaatccaattccatataatcccaacttatctctcttcagctcagtttcaaaccattagtaaccctttaagaacccaagccggtgatagcggcgacgggaagttccctctcaacgttacctcgtcgggagacaccgtgaacattacgtcggggttgactaatactagagtttccggctcagattattccgacggtgaacttgacgactagcagacagattgatgttgttagcctttacagatattcgatcctagaccttcggcccctgttgcctgttc

SEQ ID NO: 15606 - DNA, 419 bp, Gossypium hirsutum
  Clone ID: uC-gsflnu33B075f01b1
cattatcctcgcatactaggtcatgaagctggagggattgtggagagtgtaggtgagggggtgactgatctaaagccaggtgatcatgttctccccatcttcacgggggaatgcaaggagtgtccccattgcttgtcagaagaaagtaacatgtgtgatctcctcagaatcaacactgataggggtgaaatgattaatgacggaaaatccaggtttttcattaatgggaagcctatctaccacttcctaggcacctttactttcagtgaatacactgttgtccatgtttgccaggttgccaagatcaatcctgaggctccgcttgataaagtttgtgttctaagctgcggaatgtccacagggtttggtgccactgtgaatgtagctaaacccaaaaagggtcaatccgttgcaatatt

SEQ ID NO: 15607 - DNA, 491 bp, Gossypium hirsutum
  Clone ID: uC-gsflnu33B075f03b1
tgttgaagttgacccgtttattttctttgtcgatattgtcaaggctatgcaagctgcggatcctatgaggttgcagaaccttacacagactctggatttccattatcaagctcttgcaaatggtgtagctcaacatgctgaacagaggagagcggagatcgaaaaggaacaaatggagaaggcatcagtcgctgccgctccaccatcatgagttcagtttcgaactcgatgttcatccataattttcattcattcagaaatggttattttatgaaaccaagatttgtttccacttgcagtccattcaagtcattcattggttcatacggtcttgaaggtgatcaaaaccccaaaaaggtcaaggttcaaatccatcgagattttttgtgtataaagtactcttcatccgcaaaacacggggttagggaactccgagtttgccagttttggctagtctggtgagtccggcccaactcatccatcaagttctg

SEQ ID NO: 15608 - DNA, 496 bp, Gossypium hirsutum
  unsure (1)..(496): unsure at all n locations
  Clone ID: uC-gsflnu33B075f07b1
ttcccctctccctgctttgctctgaaaagtccaagtttttctccaatggcgaccgtctctccaactcctctgttgaaagatgagctcgacatcgtgattcccacgattaggaacttggactttctggagatgtggagaccctttttccagccttaccatctcatcattgttcaagatggtgatcctaccaagaccatcaaggtccctgaaggcttcgattatgagctttacaataggaacgacatcaacaggattttgggtcctaaggcttcttgtatctctttcaaggattctgcttgtaggtgctttgggtacatggtttccaagaagaaatacatctataccattgatgatgactgctttgttgctaaagatccatctggcaaagacatcaatgcattggaacagcacatacagaacctactgagnccatccactccatttttctttacactctttatgacccataccgatcctgcgctgacctttgtcgtgc

SEQ ID NO: 15609 - DNA, 498 bp, Gossypium hirsutum
  Clone ID: uC-gsflnu33B075f08b1
ttttctagctaaagccttgctagtcaaagaaaaaatgatcgaagatcaggagaagcagaaatctcaatcagaagcagaattcagtgcactaatggatagattagatctcactgagaaagagaatgcatttctcaaatacaagtttcatgttctcgagaaggagcttgagatcagaaacaaagagatggaatatacccgtcgatcagaagatttagcacataaacaacatttgcaggatgtaaagaacattgctaagttggaagccgaatgccaaaagttacgtttacttctacaaaagaggctgccaggtctggctgccgtgatgaaaatgaagaatgaagtcgaaatgctgggaaaggacaagtcagagacgagaagaagaaagctgaacccaactagagatttgatcgtcagaggctccactgctgacatatctcctgaaaatccaatcaagagtatcaatctcttgttggagcaattacacaatgtggaagaaga

SEQ ID NO: 15610 - DNA, 340 bp, Gossypium hirsutum
  Clone ID: uC-gsflnu33B075f10b1
tgattcttttactagcgagagtgcttatggcagtactcattggaatgcctattttatgtcttcttatttctcaatgagcaatatcctgatttcaacaaacaaaaaaaaaaaataaaaaaaaaaaaaaaaaaaaaaaaaaaaaaaaaaaaaaaaaaaaaaaaaacaaaaaaaaacaaaaaaataaaaaaaaaacaaaaaaaaaaacaaaaaaaaaaaaacaaaaacacataaacaaaagtaatggggcccctgcttgacaatacacattattcatctcaatctacttccactacaactgttttattggttaatgcaaaaataaactactgccccccgtttt

SEQ ID NO: 15611 - DNA, 400 bp, Gossypium hirsutum
  Clone ID: uC-gsflnu33B075f12b1
tcgtgcgatgagattcaagaggcatcacaaatactgagttgtttggctgatatggtttactgcacggtctgtgcatgtatgcagacgcaacataaggttgaaatggacaaacgagatggcaagttttgtccacaaccaatggcagtcccccctgttcagcagatgtctcgcattgatcaaccaattcctcctgcagctggctatccaccagcagcatatggacagccttatccagctcaaggttacccgcctgctgcataccctcctcctcagtacccaccatctggttattctaggtaaatatttctctgggttacttgttggttgcaagcactagtttgggctactaaggcatggatagggctttgatttgtagcctgcaatacatagtgatatattt

SEQ ID NO: 15612 - DNA, 429 bp, Gossypium hirsutum
  unsure (1)..(429): unsure at all n locations
  Clone ID: uC-gsflnu33B075g01b1
tnattttgattctcatggaagctttgattgttgggtattttaggttttgtttatttttcttgttatgtctattgttggatgggaactgagagtaagaaagaaactgtgttaaagaagaacaaaaatggtggagaagttaagacaggacagtggttgttgttttcatgttgtaaactattacaactttgtacaatttggtcttgttttaaacaaggcagtttgagtttcaatcttagttgaatctcttttaacaacaacatccattgaaaatcttttaaagaaaaaaaaaagattgttgattttatcattaagttcatcattaaccatgaagagacttggcagctcagattcattgagtgctttgatgtcaatctgtccaacttcagattaacgttttccaagaaacaacaatgtttacagtccagagtt

SEQ ID NO: 15613 - DNA, 125 bp, Gossypium hirsutum
  Clone ID: uC-gsflnu33B075g02b1
gatggcacatggtggtggaaaaaggtgcacatatctgggatgtacaaagggtgctgaagggagtactcctttctgtaagggccatggagggggaaaaaggtgtgcatttcaaggtggtggtgttt

SEQ ID NO: 15614 - DNA, 363 bp, Gossypium hirsutum
  Clone ID: uC-gsflnu33B075g04b1
atagtcttgggccgggacattgcggatgctcattacaaagctcgtctatatgctggaatcagtgtcagtgggatgaatggagaagtcatgccaggacagtgggaattgcaagttgggccaacagatgggatctatgacggagatgagttatggcttgcgcgttacattctggagaggatcactgagattgctggaggggcgctctcatatgatcccaagcgcattcagggagactgctatggagccagggctcacaccaattacaggacaaagttcatgagatgtgatggacgctatgaggatatcaagaaagcagtcgtaaagcttggggcgaggcacacacaacacatcgttgcctatgga

SEQ ID NO: 15615 - DNA, 462 bp, Gossypium hirsutum
  Clone ID: uC-gsflnu33B075g05b1
gatagagaaggccggaatctgaaagacaagacacagagaaaaagagagagagagagagagatgtcgggaggaatagcgcgtggtcgactcgccgaggaacgtaaggcatggaggaagaaccatccccatggttttgttgcgaaaccagagacgttgcctgatggaacggtcaatttgatggtgtggcattgcacgatccctggtaaagcaggaactgattgggagggtggctacttcccgctcacgctccatttcagtgaagattatcccagcaagcctccaaagtgtaaatttccccagggctttttccacccaaatgtttatccatctggtactggttgcctttcaatcctaaatgaggatagtggttggagaccagccataactgtgaagcagattcttattggaaatcaagatcttttgatgcttcaaaccctgctgatcctgctaaaactgaaggtt

SEQ ID NO: 15616 - DNA, 425 bp, Gossypium hirsutum
  Clone ID: uC-gsflnu33B075g08b1
ctcacgcgtccgcaaatcccttggccttgacctcatcgcagccgacaacgggcgccttcattcctcaccaatgatttacagccccgtgattccttccccaccttcgatttcaacgaagtcaagagggatcaatggcggattcgaagggtaaggtctcgttttccttttttcttttgtttttaaatgcaaaaaattagaaaggaaaacgaaagaagcagttagagaaaaaaaacgcaatagatctagagactcaaaacggaaatcacctttctttgcttttttctatttgattgtttcgtatgcgtagtgtgtgtctaaaaaagatacaatggcattgttcttggctttatagccgaaacagagtaagaaaaatcaaaataaaaatacaaatttttttgtatttgctgccgtgtggtttttgtatt

SEQ ID NO: 15617 - DNA, 416 bp, Gossypium hirsutum
  Clone ID: uC-gsflnu33B075g09b1
tggacgcgtgggctacactgcatatgctaagttgattgatgagaataggtggtatcattttgatgatagtcatgtttctcccgtcaacgaatctgacatcaagacttcagccgcttatctgttgttctacaagagagtgaatgaatcaaagatggagataggggagtcatcatatagtcattccacctcttaatagtctagttgagagcattctgcaataccattgttttttggagctacttccatttgaggttatgccgtgctcacctgtgacagtacttggctgagcaaagctgacctgcggtcccacattttatggaagatagatgacactagcatgggaccaaattcactccggaacggtggcaagaattcaaggtaggggcaaattttagttccaaatttcattttgaaag

SEQ ID NO: 15618 - DNA, 241 bp, Gossypium hirsutum
  Clone ID: uC-gsflnu33B075g11b1
tccacgcgtccgcccacgcgtccgcaatattgtaaatttcttttgtgtgagaaaaaaaaaaaaaaaaaaaaaaaaaaaaaaaaaaaaaaataaattaaaaaaaaaaaaaaataaactaaaaaaaaaaaaaaaaaaaaaaaaaaaaaaaaagggtcgtcctttctaaaaaacccaatttaactaccccctccatccaaccaaaaatttttttttatgttcccccaaaattaattttcctccc

SEQ ID NO: 15619 - DNA, 522 bp, Gossypium hirsutum
  Clone ID: uC-gsflnu33B075h01b1
tgtgtgtaggggatggagaaaacctacaatatcaccgtggataatatcgagtgtgcttactttgaccaaatcgaaaaacttcacaacttcggatcttctaacaaggaaactgttgctcaactggtttggggtttcttcaactattgggcatacggtcatgattacgcaaattcagtaatatctgttcggacaggaagcataatcagtaagcaagaaaaggattggacgaggagaattggcaacgatcggcacttaatctgcatagaggatccattcgagacatctcacgatctgggcagagtggtggacaagtttagcataagggtattacgagaagagttcgaacgcgcagcggatatcatgcagtttgatccaaatccatgtgtgaaactgtttgaaccttatgttcatagttaagtaggttaaaaaacggtgtctaagtgtgggatatttttaagccctatttgtgcttcttttttgggtatggcgtcatactatatgtatttaaaggttttggttttt

SEQ ID NO: 15620 - DNA, 482 bp, Gossypium hirsutum
  Clone ID: uC-gsflnu33B075h04b1
ttcagactctggttccggaaccactacgtgcgactgcatctgctgaagagtttatgaagcaattacctgagtttgacaaagacttggctaaggagagacaggatgctgaggaatcaggggaagtcctaagatatgtcggtgtagtggatgccattaaccaaaagggagttgtggagctacgaagatacagcaaaagtcacccatttgctcaactctcaggatccgacaacatcatagctttcacaactaagaggtacaaggagcagccactgatagtccgtggtccaggtgctggtgcccaagtaacagccggtggaatattcagtgacattttgcggcttgcttcatacctcggggctccatcttaggcaacattaaactctccggttttgggcactctttggtctttcagactcgaatcgagtgttgtattagtgttcatactcttggtttacatatcttgaaaagctttaagtttttat

SEQ ID NO: 15621 - DNA, 316 bp, Gossypium hirsutum
  Clone ID: uC-gsflnu33B075h06b1
ggtacaggtttctcttgggctggttgatgccacccaaggttttcttgctcaaggctactcaaggtgaatctataagaaactattaccatgagatgcatgtgattcaagacatgcttgttcctctttacaaggttggggatgcccttgagtgggtacaccatgagatggagatctatcccatttggctctgcccgcaccgactgttcaagcttcctgtcaagacaatggtgtatcctgaaccaggctttgagcagcatcgcagacaaggcgacacaccatacgctcagatgttcaccgatgttggggtcgattatgc

SEQ ID NO: 15622 - DNA, 463 bp, Gossypium hirsutum
  Clone ID: uC-gsflnu33B075h08b1
tcttgttctgcaaaccagaatgcttcctcaatgtccattttcatggcttcaacgtctgctcttgcaggaaatgcccaaaaccagtcagggttctccttgattggctcatccgaattggaagggatcacccaaggacgtcccatgaagccaaggagcactgaggcgctgttgcagtccccaatagacatggacattaaacaaagagaggcacgccacgacgttttcatcaagtatggcaaagagggctactgcttcatgggaaccgataccaacttcatgggaggtttcgggcaatatcctatcgctgaaatggcaaggctagatgcagaacacttcactccaaggtttcctggtaatggtgcatcactcactcttggacttccccactgcgaaaacctatatttgcctgcgacttaccaaactctcttccaaaccaaaccctgcagatggggagaaggctcga

SEQ ID NO: 15623 - DNA, 183 bp, Gossypium hirsutum
  Clone ID: uC-gsflnu33B075h09b1
tgaaaatgagaagcacgaagaaactactactcagaagacaaaggaaaatgtggatggttgttgtcagggtgctaatgggtttacctgttgcatgactgctagttaggaagcatatgaaaaagagatatgtgaagagccaacagatgtgtgtggaaagattggccttgtttcaatccccaagct

SEQ ID NO: 15624 - DNA, 300 bp, Gossypium hirsutum
  Clone ID: uC-gsflnu33B075h10b1
tgagtggcggaaacatatttgaagatggtggaatgatcaagtcactgctctagtagagctttctgaataggaagattaatggagcagtaaatgaagtaattggtagcaataacttatcctccgcacatgtataagatatgcttgtctagaaataaatatgaactttattaaaagtagtagaaaagtggtagccatatagactgacacaaccattcttcattgtaaacttcaactgaatatcatttctttcttattagatgaataccaatggttaatatattaaaaaaagttattaacgtc

SEQ ID NO: 15625 - DNA, 559 bp, Gossypium hirsutum
  Clone ID: uC-gsflnu33B076a01b1
cgggccggaattttggtcaccacgcgtcgtctcgcgtccggaatgacttgggtgaagaagatgaggaagatctcgatgacgaggagatagtcacacatgcttagcaccgatataacgttaattgctattcatgccggatagccaaagggaggattagaagagtgtctaagggtggatcccgataaagtaagacgtcttagcatgagtgagcaacaacttgaaaatgctgcgattactcacggaaaagaaattgtcaggtttacacagcggaatattcttagggtatatccgaggggtacacgtgtcgactcttccaattacaacccattaatcggatggatgcatggagctcaaatggtcgcatttaatatgcagggttatggaagatctttatggttgatgcatggaatgttcaaagccaacgggggatgcggatacttgaaaaaacccgatttcctattgaatcctaacaaagtctttgatccaaatgtcaagttaccggttaaaaaaaatttgaaggtaactatgtatatgggcgaagggtggtattatgattttc

SEQ ID NO: 15626 - DNA, 536 bp, Gossypium hirsutum
  Clone ID: uC-gsflnu33B076a02b1
ttttgcatggatgctgctacaggcagtgttaataggaatctagataatccattgttagttgtgcctcttaaaccctctgttgcggagtttccattcgccaagaaggaagagcaaagtgatcgattgagtaatttggctggagctgggttaccaagctttgaagatgctattttaaataaactgacaaagactgccgaaaaacaacaaaaatgatgacaaaaaggtcttaggagcagattgcaaatgcatcagtggcattttatccacagatgttttgccaacatgtcctaaatttactagttcgggattgaattttagctttctgaagtataccttttaagaagagagatgaaccattcgggttaaagacataagttcttatgtatgtaaattctatattcgtttattaatgctcaatacttcaaactattttatctgtactttttgtaagtagaaaattcttcttacaatctatgcaataacatttgttttcttattgtaagaatatttttaacattgtaacttttaacattatt

SEQ ID NO: 15627 - DNA, 486 bp, Gossypium hirsutum
  Clone ID: uC-gsflnu33B076a03b1
ttttacaagcagctagggattgcgacgattgtggtgtcggataggtttacgggttggacaatgatgtcggggataatctgagctcagttgaactacctgctgcctggttcatatactctgttatgggaataggaattacgatatgtcgtattgctctcattggttgcatagctgctgaatctattaatggatgctgcctttgtttctatacacttctcaaaagtattctcgttctaatagaagctgctttggtagcatttattgcaattgaccgtagctgggagaaggatcttccgtgggacccaactggagaaattgatagcttccgatcctttgtcgaagacaacattgatatatgtaaatgggttggcatcagtgtggtcattattcaagcattagcaatgctagtggcaataattgtgcggactatggtttctgctagaagaagagacatcgatgatgaagatgaatatgattatgaaagca

SEQ ID NO: 15628 - DNA, 504 bp, Gossypium hirsutum
  Clone ID: uC-gsflnu33B076a04b1
ttctcttgcttagcgcttttgattaatactgtttttgtgtgcgtctttttgcttctctggctcatattttctcgagattttccttcttctttgtttgcttgaactatggcttcaaccttgctactggctctggtttttgtgattgatctgattgctttcgcccttgctgttgctgctgagcaaaggagaagtactgcctctgttggcaataatgggaaagaaagttattgtgtttatgatgaggatattgcaactggtttgggtgtgggttcattcctattccttctgcttagtcagatactaataatggtgacaagtcggtgcttatgctgtggaaaggccatgagaccaagtggatctagagcatgggcagttgttctgttcatcacttgttggttgttctttttcattgcggaggtatgcctgctggcagggtcagtgcggaatgcttatcacaccaagtacaagaatctcttatatgatcccccatcgtgtgcgacactg

SEQ ID NO: 15629 - DNA, 325 bp, Gossypium hirsutum
  Clone ID: uC-gsflnu33B076a05b1
gttgttttttttaggatgacaaatactacctggtagtgtatttacctgtctgcattatggcctcacctactctaggaaatggaggagtgggttgttccatggaagtttagggttacacaagctactgtatctgtgttgagtgactgatcagagagatgcttgaaatgagactgatagacaaggtggaccatgatcaagacagagatggcgataccgaaaaagaatgtggatgggttgctgaagacagagtcttgtaattggaaccaccgtgggtggatgcctaggccaatcgctacagcaggtactaattatggcgacacgtgca

SEQ ID NO: 15630 - DNA, 87 bp, Gossypium hirsutum
  Clone ID: uC-gsflnu33B076a06b1
ctataagtgctaaaatctagggattagcgggtggagattttaaaacattcactcacgttacacccgaaactaataatttagcctatt

SEQ ID NO: 15631 - DNA, 80 bp, Gossypium hirsutum
  Clone ID: uC-gsflnu33B076a08b1
actcagagagggaaggagacaatggaacagagggggaacttaaacacgaagacgccgatgcccccaggaaaacgaaaagc

SEQ ID NO: 15632 - DNA, 359 bp, Gossypium hirsutum
  Clone ID: uC-gsflnu33B076a09b1
tcactctcaagcttgccactccaacttttggtgatcttaaccacctcatatctgctaccatgagcggtgtgacatgctgtctgcggttccctggacaactaaactctgatctccgcaagctggccgttaaccttatccccttcccacgattacacttcttcatggttggatttgctcccttgacatccagaggatcacagcagtaccgggcactgactgtgcctgaactgactcagcagatgtgggatgctaaaaacatgatgtgtgctgctgacccacgccatggccgttacctaactgcctgtgccatgttccgtggtaagatgagcactaaggaggttgatgagcaaatgattaat

SEQ ID NO: 15633 - DNA, 457 bp, Gossypium hirsutum
  Clone ID: uC-gsflnu33B076a10b1
tctttttttagtggataacaaatactagtttctataagatttacctggctgaattatggcatctgcaagtctaggaaatggaggagtgggtagttccaggtctgttaatggtttcaaaagttcttctagttctgttgattggctcgggagagaaatgcttgaaatgagactgagagacaaggtggaccatgatgaagacagagatagtgaaccagaagtagttgatggagtgggtgctgaaacagggcatgtgataagaaccaccattggtggtcgaaatggtcaatcaaaacagaatgttagttatattgctgagcatgcagttggaactggttcttttggtgttgttttccaagcaaaatgtcgtgaaactggagaaattgttgccatcaagaaagttcttcaagataagcgctacaagaatagggagttgcagattatgcaaatgctggatcat

SEQ ID NO: 15634 - DNA, 377 bp, Gossypium hirsutum
  Clone ID: uC-gsflnu33B076a11b1
cgttgtttttcagtggatgacaaacaccagccggtggtggttttaccaggctgactcatggcatctgcaaccctaggaaatggaggagtgggtagtatcaggtctgttaatggttacaaaagttcctctagttctgttgattggctcgggagagaaatgcttgaaatgagactgagagacaaggtggaccatgatgaagacagagatagtgaaccagaagtagctgatggagtgggtgctgaaacagggcatgtgataagaaccaccattggcggtcgaaatggtcaatcaaaacagaatgttagtaatattgctgagcatgcagatggaactggatcttttggcgtagttttccaagcaaaatgtcgtgaaactgg

SEQ ID NO: 15635 - DNA, 511 bp, Gossypium hirsutum
  Clone ID: uC-gsflnu33B076b01b1
tactaaaacacaacggccgaccgtgtgtgtcgttgcggagacgttggacatctcatcagaccagatctcaactcttccttcgacgggtttatttgatcttccttggtgatgggctgttttcaataaagtggctactatttttccatggctgctccacctgcaagagctcgagccgattacgactatctcataaagctgcttttgatcggcgacagcggtgtgggtaagagttgccttcttttgcgtttgtcggatggctcatttactacaagttttatcacaaccattggaatcgactttaagattaggactatagagcttgatggaaaaagaatcaaactgcaaatttgggatactgctgggcaagagcggtttcggactattacaactgcttactaccgtggagccatgggcattatgctcgtctatgatgtgactgatgagtcatctttcaataacattagaaactggtttcgtaatattgaacagcatgccttggacaatgtcaaca

SEQ ID NO: 15636 - DNA, 183 bp, Gossypium hirsutum
  Clone ID: uC-gsflnu33B076b03b1
cctcgcgtccgccaaaacctcccaccgcgctatggtgggtgggacacaagaatgcgttgttctgcagtaggaactggcattccacaaacagaaccatgtttcatccatgttatagtttctactaagcccgtttggcatgtatgattgtgtatggcagtggtagcctaaataaagcaaacatag

SEQ ID NO: 15637 - DNA, 300 bp, Gossypium hirsutum
  Clone ID: uC-gsflnu33B076b04b1
gctaccacgcgtgcgcaaacgcgtacgcccaggcgtacgtttacgcgaacaaaggtgtaccgctctcttggcaatgccatggctagaggtgactataactagaaaaacaccgttttcttcaccagcacctaataccggctgaattgcacatgaaggggagaatgagtgctcaaacagaacgtgtaggacccaacctgacgggtgaagaataatgcggttatgactcgtgattcagacatgagaaggctcaactaagatgcggatataggctgctgattcgtggagatctaggcacagaag

SEQ ID NO: 15638 - DNA, 158 bp, Gossypium hirsutum
  Clone ID: uC-gsflnu33B076b06b1
tgttggttgaacaacgcataatagcgggttgttttttaataaaaccaaagaagcatcaaatgtcaccaatgtaaagagccaaccagaagtatgatctgatcagcggtgtatgatgaagcagctacgtatgcaccattcgcccaccctatgttatttgg

SEQ ID NO: 15639 - DNA, 251 bp, Gossypium hirsutum
  Clone ID: uC-gsflnu33B076b07b1
cctgccacgcgtccgctttctttctctaatatagtttttttcctgtagaaaaacacaagccaatatctttgcaaaaggaagatagtatatacgggacatgaagagttgtgcgtgtttttaccgcccagtgattgtggccaaatccatcgaccagaaagacatgagctttgtatcgacaaatcgagtggcgatcggtgctgggattctttatcatgttataacaaccgtgaggttcttgggctcatagggtt

SEQ ID NO: 15640 - DNA, 357 bp, Gossypium hirsutum
  Clone ID: uC-gsflnu33B076b09b1
taaaaaaaaaaaaaaaaaggcgtagcaatcatgatgttttctcccctctgctccctctcatcattaacccttagctttcatcatcgccactccatgttttgctatctaccaaccgcacaaaacccaccgccttacccaacccagctcccaacaccaagaaaaggaagaagaagaagaaaaaagacaaggaaaaagagaatttagatgaagaagatggattctctcaagaagaagaaacgaaaccctaccttctccatctgcatgccttcttcactgagttaaagggttctctcttttctttatcaatgaacaaaggcctcttccattttacttcatcattccttcttttctctcctt

SEQ ID NO: 15641 - DNA, 538 bp, Gossypium hirsutum
  Clone ID: uC-gsflnu33B076c01b1
tcttcgcgtgcgtccacgcgtacgaagagccacccttcttgttacttctacttcatcgacgcctaacaaccccggtctatctctgctatgatttggtatgaggtcacctataaacgctgttgatcatgaagctgtaatcagcaatcatggacgctggtgatcctagtttcaacaaagctagtaacccttatgttactgagcaagagttagaagataacgacaacgtttcatcagaaaccggcgctgagtctccttcttgtaccacgtttgaacagcatgaaactctctcctaaaagagggagatccatacagaaaagagttgtgtcagtgcctatcaaggatgtcgaagggtcccgctttaaaggtgagagtgctccaccatccgattcttgggcttggcgaaagtacgggcaacaacccatcaaaggctcttcttatcccagaggttattatcggtgtagtagctcgaagggatgcccggcaaggaaacatgtcgagaggagtcatgtggaccctaagatgttagtgatcacgtact

SEQ ID NO: 15642 - DNA, 156 bp, Gossypium hirsutum
  Clone ID: uC-gsflnu33B076c04b1
cactccgttctctactggaaagacaggatggatcttcagggaacggatacggcaccacgagcgctgaggaaagtggaatgattagtggattcacaacaggtacgaaagggactgcgaggaagaccaatccgacaagacaacgtgcagtaggagaac

SEQ ID NO: 15643 - DNA, 123 bp, Gossypium hirsutum
  Clone ID: uC-gsflnu33B076c08b1
gctgaaatatcagctgagtccaaggacacggtgcgtttattagaaagccccctaaaccagggacgcctgaatggttatcgggagcccactgctcagttaatatagagacttcatgaatggatt

SEQ ID NO: 15644 - DNA, 138 bp, Gossypium hirsutum
  Clone ID: uC-gsflnu33B076d02b1
gatacgcggcgggggcctcgggaagagttatctgttctgtttaacggcctgcccaccctggaaacggctcagccggaggtagggcccagcggacgtaagagcaccgcacgtcccgtggtgtacgctgcgcccccggcg

SEQ ID NO: 15645 - DNA, 150 bp, Gossypium hirsutum
  Clone ID: uC-gsflnu33B076d05b1
cacatgggcgcgtcaagactgaggagtagcctgttatgacattactagggcaactcgaggctttgaaaacgtttggacaattgggagagaccctatcctttgggacaaccccaatgaattttggcccgacaggttcatgggaatgagtat

SEQ ID NO: 15646 - DNA, 515 bp, Gossypium hirsutum
  Clone ID: uC-gsflnu33B076d06b1
ctctcgcgtccgcccacgcgtccgggagagcgtttttttttgtgtagcgattctcagttagtcttttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtggctctgaagctggtatctctaaagatggtcagactcgtgagcatgctttg

SEQ ID NO: 15647 - DNA, 290 bp, Gossypium hirsutum
  Clone ID: uC-gsflnu33B076d07b1
cgcctccttgatgaaagatctggtcggcggatattacgatgctggagatgctatcaagtttaactttcctgcatctttttcaatgactatgttgagctggagtgtcatcgaatacagtgctaaatacgaggctgccggcgagctcaatcatgttaaagagatcatcaaatggggtactgattatcttctgaagaccttcaacaatactgctgataccattgacaggattgcagcgcaggtagggataggagattcctctggaggagtatcaaccttaaatgatccttatt

SEQ ID NO: 15648 - DNA, 102 bp, Gossypium hirsutum
  Clone ID: uC-gsflnu33B076d08b1
acctcggacgcgtgggtggagacagaggcggtttaagcctgtttacgatctggttcagtttgaccactgagaagaaggaggtagggtccagtagaggtaaga

SEQ ID NO: 15649 - DNA, 262 bp, Gossypium hirsutum
  unsure (1)..(262): unsure at all n locations
  Clone ID: uC-gsflnu33B076d12b1
gctgnatcactccgttctttactggaaaaacatgatgaaattgctacaaaataattctgcaccatgagctctccgggaagtggaatgtttagtggatttacaaagttatgtaagggattggctgtgatattaatcggtggccacgttgtggttcaggttcttgctacttttgtgactgaccttgctcttattcccgccaggactattccttttggttggaacctcataactgctggttacattgaacaatcagtgcatggtg

SEQ ID NO: 15650 - DNA, 441 bp, Gossypium hirsutum
  Clone ID: uC-gsflnu33B076e01b1
ggtaagatgtgtatccatacatgcagacagtgttggagtgggttctacatgtgacggttacgacctgaccgaactacacgctgacggcggaggtgatcctgaccgccggaaaagggctctagctgatgcctatgctgactggggggatacactctacggagatgcatatgcgccggataccctaggatgcgacctgaaagaggatgacgctgttagacgatagggcggaccgaacgctgatccgagggtgaacttggccagatcgagactgaccctggatgctgaacagctaagagggcagaagcaagtgctattgatgattaccaactgaactgggtgggatgacgcaatgtaccactcaggagatgctgaggacactgcctatgactgcatagggcgaggcgcactatgagagagatgcgaggagctggaggcagacct

SEQ ID NO: 15651 - DNA, 453 bp, Gossypium hirsutum
  Clone ID: uC-gsflnu33B076e03b1
gatacttgacaaaaaagaaaggaaaggacaaaccaggatcatggagcgtaaaacaagagttgtattgcgggactatctttatggcgggataagaaagaaccacaagaggaagaaagcaaccttttgtgcatgtgctaaacccccaacgaaaggagattgagccaattacttatcagcggcacaaaatcagtgcagttttctggtactgagattttagttgcgttgtccataaatctgccttcctaagtttttgtttcacataattattttcttttagaggtcatcttcttctttagtttagacatcctgctgtatatttcaggcaccatctaatctaaagaagctgtaactttgtagcctaaaacttcccttctctgtacgtttaacttggcataaatatggatttcgttggaaaaatagataaatgacaagaaagtaaaaagagatctatat

SEQ ID NO: 15652 - DNA, 210 bp, Gossypium hirsutum
  Clone ID: uC-gsflnu33B076e04b1
aaaaaaaaaaaaactggatgctggtgttcatcggatgtctaatgtgatccatgcagcggatcctgatatatttagggagtgtaatactttgtcattaccatagaagtgccctacctttattatgccataaagcttcttcatgttccttctaaaagattagaaaaagacattaaagtattttttgctatataaatactagacttttaagct

SEQ ID NO: 15653 - DNA, 89 bp, Gossypium hirsutum
  Clone ID: uC-gsflnu33B076e07b1
gcctgaaattatgacattccaaaagaaattccagagcctgtttctaagaagcctgaagattgccatgatgaagaagatggcgattccat

SEQ ID NO: 15654 - DNA, 518 bp, Gossypium hirsutum
  Clone ID: uC-gsflnu33B076e08b1
tggaatatttacaaggctttggcaatgcctcaggaggctattgtctgttatcagcgagctgttcagactcggcctaactatccagtagctttggggaatctggctagtacatactatgagcgaggacagctggatttggcaatccaccattataagcaagctattgcctatgatcaaagatttgtggaagcttacaacaatttgggaaatgcattgaaagatgtgggtcgtgttgatgaggcaattcaatgctataatcaatgtctcacattgcaacccaaccatccgcaagcacttaccaacttagggaacatatatatggaatggaacatggttggtgctgctgcttcttactataaggctacattgactgtgacgacagggttgtctgctccattcaataaccttgctgtaatctataaacaacagggaaatcacatggaagctataacttgttacaatgaggttttacggattgatccattggcagctgatggacttgtacataggggtaacac

SEQ ID NO: 15655 - DNA, 249 bp, Gossypium hirsutum
  Clone ID: uC-gsflnu33B076e09b1
gctaaccagacctagggaaaagcttatcgaggatgagaaatattttcaaggcatccacaaacacacttacttgaaaggtccttacgataagatcacatctgtcgccattcctgccgctctagctgcaagttccttgtttttaatcggacgagggatctataacatgtctcatgggattggaaaaaaggattgagagctctcactctcggatagaagacatgcgttgctcattaagctgtccttctaagt

SEQ ID NO: 15656 - DNA, 465 bp, Gossypium hirsutum
  Clone ID: uC-gsflnu33B076e10b1
tgcccacgcgtccggcaagatgctggtgacatctatcatcatacacactattttagaggtcatagtcatactgatacacaaagcagccagatagagaatgatgaggtcattgctcgtacccttcaggaagaattctcgcatcttgctgtggcagaagcttccgaattttctcatgctggggaagagcagtcgcaagcatcctgtgaacctcatgattggcttactccttcaacaacagactactgttattcaggctatgaatatggccgggatgaatccgatgatttggtgccacatagttcatgctctagttctagccccagtgattcagaggatttttctggctctttggagctgactgagggttatttacttgatgatgaagtaggcatgaggttgaatcaaatggttcctattcctcatggtcctcgaatcaatgggaaaataccatcaatttgatgaagc

SEQ ID NO: 15657 - DNA, 487 bp, Gossypium hirsutum
  Clone ID: uC-gsflnu33B076e12b1
tactcaacccaccaccatcaccaccaccctgaccctcaccctcacccccatcctcatccacccactaagcccccaacccccactcctcctccagttcatccaccacccaaggcgccagtgcaaccaccaaccaagccaccagttcacccaccacccaagccaccagttcaacctccaactaagccaccaaccaaacctccaactcaacccccgactaagccaccaactcagcccccgactaagccaccaaccaagcctccaactcagcccccgacgaagccaccaacacacccaccatctcatcctccggccaagccacctaaatcgagccaggtggcagtgcagggcgttgtttattgcaagtcatgcaagtacgccggagtcgacacccttttgggagctaaaccaattcttagtgccaccgtaaggctgacatgcaaagacgctaaaaacgaattaacggtccagttcaagactgacaagaatg

SEQ ID NO: 15658 - DNA, 552 bp, Gossypium hirsutum
  Clone ID: uC-gsflnu33B076f01b1
cataactggcacatcaactggcttgtccccatgtgttgcggtgttgtgccgcattgtctgaaggtcggctcacctccgaatggagctcccgcggccataaaatccgctttgatgacctctgcttatacagtcgacaaccgtggcgaaaccatgctcgatgaatccaatgggaatacttccaccgtgttagattttggatccggtcacgttcacccctctaaagctatggatccaggactggtttacgatatcaccacaatggattacatagatttcttatgcaattccaattacacgatcaacaacatccgagtactcaccaggaagaatgccgattgcagcggcgcaaaacgagccggccatgttgggaacctgaattacccatcactctccgccgttttccaacagtatggcaggcgtaacatgtctacacatttcatcagacgagtcactaatgtcggtgaaccgaattcgatctataagttacaattcgaccaccgagcggcacggtggttaccgttgaacccgaacagcttgtatttagaagagttg

SEQ ID NO: 15659 - DNA, 244 bp, Gossypium hirsutum
  Clone ID: uC-gsflnu33B076f02b1
atcacgcgttcgggcaacaaggagggctgatggcaagtttaatgcccaaggaagagtattctcctaaggcttaatacacatttgacattggccaaaacgatcttggagaagggttcttctcaaacttgactgtacaagaagtcaatgctactatacctgatataaccaacacagtctcagcaaatattaagaatatatacaatttaggagcaagattcttatgggtccacaacaactggaccaa

SEQ ID NO: 15660 - DNA, 114 bp, Gossypium hirsutum
  Clone ID: uC-gsflnu33B076f03b1
accgggcccggaggcagagaccccaaccacgacacccggaccggctccgggaccagaagacggaaacccaacccaacgacaggccggggctggaccataacacaccaccctgaa

SEQ ID NO: 15661 - DNA, 447 bp, Gossypium hirsutum
  Clone ID: uC-gsflnu33B076f08b1
gctaccactcgtccgataatttgttctgcattgctgctgtgctcttccttgacatatgggcaaacggctagtccaccggctccggtggcaatgaccccaactccgacacctgcaccggctccggcaccagaatacgtaaacctaacctatttactctctgtggctggtccatttcacactttccttaactaccttgaatcaactaaagtgattgacaccttccaaagccaagccaacaacactgaacaaggcaatacaattttcgtaccgaaagacgattcgttcaagggttctaagaagccgtcattgtccaatctcagtgatgatcagcttaaaatgctcatcctttttcaagcctggcccaaaactatgcccctgccgacttcaattacctcagttcaaaaggccctatcactacccttgctggtggccaatcactttgaattt

SEQ ID NO: 15662 - DNA, 159 bp, Gossypium hirsutum
  Clone ID: uC-gsflnu33B076f10b1
gactcccacgcgtccgcccacgcgtccgcccacgcgtccttccacgcgtccgggaggagttccgctatgattcttctgtttcagctgaggttgggggtaggcaaacacccagtctccaattccctcgaaccaaggaagttatggcaaatgaggatcatg

SEQ ID NO: 15663 - DNA, 51 bp, Gossypium hirsutum
  Clone ID: uC-gsflnu33B076f11b1
aataaaaagtggggtagcatcaatattgatatgggtgattaggtgaaggat

SEQ ID NO: 15664 - DNA, 178 bp, Gossypium hirsutum
  Clone ID: uC-gsflnu33B076g04b1
agggcagtttgagaaatgggctcggtttgctaccacgatccatagggttgagtggggacactctctagcagaagagactgaagcagccactataccgtcatccatgggaagatgtactttacactaagtgagagaacattacgagcagtttgtgcaaattttctttgagcattgttgt

SEQ ID NO: 15665 - DNA, 91 bp, Gossypium hirsutum
  Clone ID: uC-gsflnu33B076g06b1
tcaggggcacctaaccatgaccatacactatttttgggctaggagagagacccaaaaccaatgtctaaggaagtgagtgaagaacgaccgg

SEQ ID NO: 15666 - DNA, 173 bp, Gossypium hirsutum
  Clone ID: uC-gsflnu33B076g07b1
tcggacgcgtgggcggacgcgtgggttttggctactcgtatacctgcattgctgcaggttcattgggatcaccagaggaaacccatggtttgggtggatgcctcatggcgtccgcaagcgcaaaaggttgcatgaaggcaatccacgaggaagtgacatacaaaaagtacaag

SEQ ID NO: 15667 - DNA, 213 bp, Gossypium hirsutum
  Clone ID: uC-gsflnu33B076g08b1
tgccagagttttaatgttggtttgaaccgctgggctgatcttaccaacgaggagtaccgagccatctacctgggaatcaagaaacccaaccggaaagtttccaaggccagtgaccgatactccgcgcttctcggcgaaaagttgcccgattccgttgattggagggaaaaaggggctgtcgctgaagtcatagatcaaggaagttgcggtcgt

SEQ ID NO: 15668 - DNA, 194 bp, Gossypium hirsutum
  Clone ID: uC-gsflnu33B076g11b1
acctggaatttggggcatgtaatcaagacaatacactttcagtgggtcagctctgagtaagctaactggtgtcttaggacgtgggggataaactgtcgggtacaaacgactgatatttccactaagccgaaatacatgggaagatgtgcttgacactaagtgagagatcataacgagcagtcagtgcaaatcta

SEQ ID NO: 15669 - DNA, 274 bp, Gossypium hirsutum
  Clone ID: uC-gsflnu33B076g12b1
gactaagattataagcacctccccataagcaaaccacaatggaaagcttggagagagacccaaaaacaatgtctaaggaagtgagtgaagaaggacagggtcgtaaggactatgtggacccttcaccggcacctctgattgatatggctgaactcaagtcatggtcttttcacagagccctcatagctgagttcatagccactctcctcttcctctatgtcactgttgcttccgtaattggtcacaagaaacatcaagatgtatgtgatggtgt

SEQ ID NO: 15670 - DNA, 134 bp, Gossypium hirsutum
  Clone ID: uC-gsflnu33B076h01b1
gctacatttaggagttccttagttgtgttgtaggagccataagatcaaaaaatggtgaagatcgcttttggtggcattggtgattctttgagtgttgggtctctcaaggcttatctggctgaattcattgctac

SEQ ID NO: 15671 - DNA, 226 bp, Gossypium hirsutum
  Clone ID: uC-gsflnu33B076h05b1
tagcaaggtgtggcgacaatgcggggttgaggggaatatgaacaatctgaaaggtcttgatcccaaacggataggtgagcttttgctgcccttcggaatagagacgattgatgaagcacagtagggcacttaatattacgaagacctaatatagtggatgctgaaatatctgacgcaacagatagtgtagtactatgctaccctagagacgtacttaagtaccaaa

SEQ ID NO: 15672 - DNA, 323 bp, Gossypium hirsutum
  Clone ID: uC-gsflnu33B076h08b1
tcggaagagtgcaaagcctacaacccacaacatctacaacaagaagagatggcagcttccgcggtggctatggacggattggctgcatccgctctccgctccgttctccagagagtccaccagaccgccgagcggtgtggtcgtgcaattcccaggccctgagatgcaccctgttaccaacgataacctcatcatcaacgtctataacaactaaacgaatcttttctcctctcctggaatggagtccaacaaaggaggaactcgtatgaagaccgcttgtttggcacatcctgccctattccacccggaatgaacttcacata

SEQ ID NO: 15673 - DNA, 327 bp, Gossypium hirsutum
  Clone ID: uC-gsflnu33B076h10b1
tagcgagttgttgcgtcaatgcggggttgattttaagaagaacaatcagaagggtattgatgtgaaacggttcggtgagcttctgctgccctccggaatagagacgattgatgaagcgcatcagggcatcttcatattacgaagacctaatagagtggatgctgaaacatcttatgcaacagatagtgtgcaccacgctaccctagagtcgttaatatgtaccaaaatggatggcctgactgaatgacctatcaaacatctgctgattatgtggccagtcccgcatggaggtgtggacatgacgacaaaactgtttgatgcagacag

SEQ ID NO: 15674 - DNA, 292 bp, Gossypium hirsutum
  Clone ID: uC-gsflnu33B077a03b1
aacaccaatgattctcattctgtgcagattatcctgccacaaaagcagttgggtcgtaaatcggatatgtatgtcttctgttgttcatattctcacaatgttgctccaaagggcaaattcattgcatttgtttcaacagaggccgagacagatcaccctgagagtgaactaaagcctggaattgaccttctaggtcccgttgatgagatattctttgatatctatgacagatatgaaccagtcaacgaaccttctcttgacaattgtttcatatcaacaagttatgatgcta

SEQ ID NO: 15675 - DNA, 79 bp, Gossypium hirsutum
  Clone ID: uC-gsflnu33B077a04b1
gaagaatctgctacaccaaagactagttactcgaattcgttaattttaagtcgaagaaaaatgggaggtggtagggaag

SEQ ID NO: 15676 - DNA, 293 bp, Gossypium hirsutum
  Clone ID: uC-gsflnu33B077a05b1
tggaaggtaatggtggtggtagcagtggtggtgctaatgggcggtactatttggggatgttcttgggtggggcttaccaggaatccctcggtggagttcacaacctctttggtggcccaagtgttgttagcgtgtcgcagagtgatggtccatatagctttgcggttacgcgggcggcgcctggtccgtcatgtggggatgtcctccgagtgatgcagcacgagcccgagctaatgtttgagaccctcaagcaccgtgcggaagaattttgtggacaggaccatggcaatgaa

SEQ ID NO: 15677 - DNA, 294 bp, Gossypium hirsutum
  Clone ID: uC-gsflnu33B077a10b1
cccaacaactaaataaataagaccaaatacctaaacccaaagcctaaaacaacaacctacaggcccaaactaaaacaccagcctagcccagaaatttaacactttctgaggaaccctagggttccccctttgcaccgcttcgctcacccacgtgacgtctgacaactttcaaccaccctgtggccccttcccatcacttccaaagacctgcaaatagaagaaaaggaaacagagcagagcaaggcagctggcaacagtagtgaaaacaatagtaaaatagggacttgttaatcg

SEQ ID NO: 15678 - DNA, 288 bp, Gossypium hirsutum
  Clone ID: uC-gsflnu33B077b01b1
agcagcctcatttctccaagatggctagagggttgaagaaacatttgaagaggctcaatgcccccaggcattggatgcttgacaagcttggtggtgcttttgcacccaagccatcgtctggtccccacaagtccagggaatgcttgccattgatccttattttgcgaaaccgattgaagtatgctctcacctatagagaagtcattgctattctcatgcagaggcatgttatggttgatgggaaggttaggacggataagacctatccagctggtttcatggatgttg

SEQ ID NO: 15679 - DNA, 107 bp, Gossypium hirsutum
  Clone ID: uC-gsflnu33B077b02b1
attcgcagggaattagcgagatcctgcaattttcctgcgttttctctcttcaatcttctccggctatctgatctatccgtcatcatgacaacatcaaggcgttttgc

SEQ ID NO: 15680 - DNA, 65 bp, Gossypium hirsutum
  Clone ID: uC-gsflnu33B077b05b1
agttaacccctatggctcgtaccaagcaaacagtaaggaaatcaaccggtggtaaagttccaagt

SEQ ID NO: 15681 - DNA, 154 bp, Gossypium hirsutum
  Clone ID: uC-gsflnu33B077b07b1
taatcaatggctttaccgaaccaacagactgttgattatccgagctttaagctcgctatcgtcgcgcgatggaggcactggaaagaccacatttgtgaagaggcatctgactggagagtttgaaaagaaatatgagccaacgatcggtgcggag

SEQ ID NO: 15682 - DNA, 290 bp, Gossypium hirsutum
  Clone ID: uC-gsflnu33B077b08b1
ttactttagaagtggagagctcggatacgattgataacgtgaaagcgaagattcaggacaaagaaggaattccaccagatcagcaaaggttgatttttgctgggaaacaactggaagacggaaggactttggctgattacaatattcaaaaggagtccactcttcaccttgttcttcgtcttcgtggtgggttctaagccttaaggtctcccttaatgtgggttttctggttttacgtgaaggactgtgccctgtaatggccttttaaataatttctagtctttgttcac

SEQ ID NO: 15683 - DNA, 190 bp, Gossypium hirsutum
  Clone ID: uC-gsflnu33B077b09b1
tttttatgttatgtttttttttctcttagggacataatctttgttagatttaggtttttagaacccagtgatcagtatatatcataggatttgtgtagctgtatattgtagtataatcatgaaacagtattatgagtggtttgtactataatcatgacatatcgctctcttttactagtacccttttgct

SEQ ID NO: 15684 - DNA, 289 bp, Gossypium hirsutum
  Clone ID: uC-gsflnu33B077c01b1
aatggtggaaggcgcttgcaagaaatctgtatgtatcgttgatgaatccacgttggtcaagtatttgggaggcagcggtttggctatgcccgtcgaagttgatcctttttgttggaaattcactgccaaaaaactccaaaacttgcttcgagattctggctgcgttgccaagctgaggaatgatcgtaaagggcagcctttcgtaaccgataatgggaattacattgtggatttgtatttgaagaaagatattggggatttgcaggtggcaagcgatgctatttcgagg

SEQ ID NO: 15685 - DNA, 293 bp, Gossypium hirsutum
  Clone ID: uC-gsflnu33B077c03b1
tgtcagagtagaagcttgactaagcttactccctccctccttgcctctttctggaactgccgcgttccatgactgtgcttgtttaaaatgcctgtcgctgagggtgactaagtgggcctcatgatgctggggacggttagctgtgctgagggtcatagacgctttttcaacctgttggggcaaacgaacattgcatctatgaaagagagctgtgtatgctcagacttggtaaattttctggagctgggacagcgtcatactgcaggtacacggacggataagtatgcatgcaa

SEQ ID NO: 15686 - DNA, 122 bp, Gossypium hirsutum
  Clone ID: uC-gsflnu33B077d01b1
tgatgggtatccccagattgatcaggtctgtacactattcgattttgtctactgttgtgaaaacatatatcaactgacataagaggataaagttatgctgttaatgcatgtgaatgggactt

SEQ ID NO: 15687 - DNA, 193 bp, Gossypium hirsutum
  Clone ID: uC-gsflnu33B077d03b1
cactttgggttttttcagtcttcttcgccatctcctgaccagctacaaaataaccagtggctttcaggaaatcaaagagcatggagttggaaatttgagattaaagcaatggaagaaaggagttgccataagtcaaaagaataaagatcttaaacagaattttattttatttttttataatgggtagggtagg

SEQ ID NO: 15688 - DNA, 91 bp, Gossypium hirsutum
  Clone ID: uC-gsflnu33B077d08b1
ccagaactcctagaaagcactggtggtctgtttgataccagacaatacgtaaatgaaactgctattgttagaggtgtgaagctagttgctg

SEQ ID NO: 15689 - DNA, 295 bp, Gossypium hirsutum
  Clone ID: uC-gsflnu33B077d12b1
ttctgattaaaaagcaaaaaaaaaaaaaaaaaaacaaaacaaaaccaaacttcaaacaaaagggaattttcttgtcataattttctgaggaattcatcgatggcaaccaaagtgtatattgtatactattccatgtatggacatgtggaaaaactagcagaggagataaagaaaggggcggcatctgttgaaggtgttgaagcgaaactatggcaggtccctgagactctgtcagatgagattcttggaaagatgagtgcaccaccaaaaagtgatgtaccgatcattacaccac

SEQ ID NO: 15690 - DNA, 236 bp, Gossypium hirsutum
  Clone ID: uC-gsflnu33B077e03b1
tccctttcgccaggaatgggtggtggccattaataaataatcaattccacagcttctgatcagcctctttgcatgccaacaatgtgtttcaagttttatgatttgcttggtgtagtttcatataaatatttgctttgatgcaatgcagtcatggcttagtcccatgcctctccttatgtatttttaaggtttccatatatagggaagtttgcagggatattttttctatattctta

SEQ ID NO: 15691 - DNA, 294 bp, Gossypium hirsutum
  Clone ID: uC-gsflnu33B077e05b1
tgtaaagtctaaaattcaagacaaggaaggcatcccaccagaccagcagcgtctcatcttcgccggcaaacagctcgaagatggccgtaccctggccgattataatatccagaaggaatccaccctccacctcgtcctccgtcttcgcgggggaatgcagatcttcgtgaaaaccttgaccggcaagaccatcaccttggaggtggagagttcggacaccatcgacaatgtaaaggcgaagattcaggacaaggaagggatcccgccagaccaacaacgtttgatctttgcagg

SEQ ID NO: 15692 - DNA, 140 bp, Gossypium hirsutum
  Clone ID: uC-gsflnu33B077e11b1
caatctctcgtcccacgtagcaaccaaagactcagatccgctaggatggcgggggcctagaactagaatggaaacgctcatcattcacatcagattctgacaaccagggacactcggacaagcaggttcacctgcacact

SEQ ID NO: 15693 - DNA, 295 bp, Gossypium hirsutum
  Clone ID: uC-gsflnu33B077f01b1
caaaggccttagcaaagaagggatttgaggtgatgacctccgatgatgcaggacggtttgtgtgcaattatgtttactatcactcccttcgctttgccgaacagaatgggatcaaatctctctttgtccatgtccctctcttcttgaccatagatgaggagacccaaatgaaatttgccgcttccttgttggtggtactcgcttctctatgtcagtaacatactgcatccactcatctttatgtccagaaattgatatggttgtacggttgtatgtgagtggtggatggaaggat

SEQ ID NO: 15694 - DNA, 120 bp, Gossypium hirsutum
  Clone ID: uC-gsflnu33B077f06b1
gacatcaatgcattggaacagcacatacagaacctactgagtccatccactccatttctctttaacactctgtatgacccataccgatccggtgctgactttgtatgtggctaccctatt

SEQ ID NO: 15695 - DNA, 118 bp, Gossypium hirsutum
  Clone ID: uC-gsflnu33B077f10b1
tatatatacacacacaactccacttccccatcacaaaaaatatattcttcacttcacatcttttgggcaatcaattttgtaagcaagtatggctaaggacgttgaggttggtggtgag

SEQ ID NO: 15696 - DNA, 296 bp, Gossypium hirsutum
  Clone ID: uC-gsflnu33B077g02b1
tctctgctgaggacaagactactggccagaagaacaagattacgatcacaaacgacaagggtcggttgtctaaggaagaaatcgagaagatggttcaagaagcggagaagtacaagtccgaggatgaggagcacaagaagaaggttgaagccaagaacgcattggagaattatgcctacaacatgaggaacactgtcaaggatgagaagattggttcaaagcttgacccggccgacaagaagaagattgaagatgccattgatggagcaatccaatggttggatggcaaccagcta

SEQ ID NO: 15697 - DNA, 289 bp, Gossypium hirsutum
  Clone ID: uC-gsflnu33B077g08b1
ttattgaagttgttttgggaagcaaaatctgcataactagcgaatggagatgtaaaacatatgctggcagcatatgaagcagcctatgcatggaaggagtaagtacatgcactcactgttataaactaaaagtgagatggaaaggaacaaacatattgtaagaatacagagtccaagattaggaacactggttagaacaaaaggtgtgtacagattcataaccattccactctttttttttattgtatctagaattgtattaattgtttgattgcttgatggattcatc

SEQ ID NO: 15698 - DNA, 172 bp, Gossypium hirsutum
  Clone ID: uC-gsflnu33B077g09b1
tttcattaaagccgatcagagatctcctccgcctctaatttctcctccatttgtcttttgcatttacggttctttaattttctgtaacaaatggaaccttcatcttcatctcctggttcaatgaaagttacgccgctcgatctgatgtccgtgataatcaaagccaaaatgg

SEQ ID NO: 15699 - DNA, 116 bp, Gossypium hirsutum
  Clone ID: uC-gsflnu33B077g11b1
taccctaatttgttcttatcaaccatggctgctactttagtgttagcactgctcattcttgccatcactgcaggccactcaagtggtgcgacgggcaaatggtgagcttgcaaaga

SEQ ID NO: 15700 - DNA, 208 bp, Gossypium hirsutum
  Clone ID: uC-gsflnu33B077g12b1
gatgccatcaaagcaggtctggatttggattgtgggccttttttggcgcaatacactgaaaatgcagtaacaagaggattgttaaaggaggctgatgttaacagtgccttggcaaacacgctcacagtccaaatgagactcggcatgtttgacggtgaaccgttctgctcaaccattcgggtacttggggctcaaaagatgagtgctt

SEQ ID NO: 15701 - DNA, 298 bp, Gossypium hirsutum
  Clone ID: uC-gsflnu33B077h02b1
acagcagttgagagtgccattggccatgttatcaccttttgccccttgctttcccctcgaatatatatatttttgcttgaaccgtgctttgctagcgcttctgctctatagtgagcatagatgaaaaggattttcaagtatttaaggatgttctatgttttttatttacttaaagcttgcccaaagtagttttagtgacattgcagattgcataagcggaaatggaagtcatgactgttttgaatattatattaaatgatttgatgcaagttttagtaacttaattatcaatatggat

SEQ ID NO: 15702 - DNA, 60 bp, Gossypium hirsutum
  Clone ID: uC-gsflnu33B077h04b1
actagagccaatgtaacaagggtactcgagggaaatggcaccacctgaagatgatgaaga

SEQ ID NO: 15703 - DNA, 293 bp, Gossypium hirsutum
  Clone ID: uC-gsflnu33B077h06b1
tctttgtctctatttaaaaaaaaagagccaatttttttgaggtggtagtatacaaaaacaaaatgaagatctgttgcattggagctggctatgttggtgggcctacaatggctgtgatcgcgcttaaatgtccggatattgaagtggctgtcgctgatatctctgtacctaggatcgctgcctggaacagtgaccagctccctatctatgagcctggtcttgatggtgttgtgaaggagtgtcgtggcagaaaccttttcttcagcactgatgtatagaaacatgtgcgtgag

SEQ ID NO: 15704 - DNA, 379 bp, Gossypium hirsutum
  Clone ID: uC-gsflnu33B078a01b1
gccgtgaactgccaaaaaaacaataatgtccattccaacgaaaggccatgcacaatcttttcacacccatagccaagatctaacgtggaacattcacacagcattggttacagcgcatagtgctttgaagagtcagaggaaagcgggaattgggacggggctgtctatgaggatcattatcaaggggccactactactactactgcagccagcagtgatgctagaatggctgctcttgcatcattgcgtgccactacatcccatgcacttgaatgaggaagagacgtggttactatggcaccacagccaaaaatgagcactaccttaactagatcatggcatatgtaccagagagcatgcatagggttttgaaacatta

SEQ ID NO: 15705 - DNA, 420 bp, Gossypium hirsutum
  Clone ID: uC-gsflnu33B078a04b1
ctaagtgacaaaaacaagccaaacaggcaggagaacagtgacaacagcctacaatgccctgtacctaggagatgctgagaggctcctccaagtaatggaccaaagctttccgagttgggcttggcgcgaaaagactgtatcgaaacaagctggataaaatctgtgctctacatagctgggttcccaagtgaaacacctccagaagtactgctagaaggaaagtctttattcaagaattatttcaaagccaaatctgattttgtgcaacaacctattcttgaaaccgctcttgagaagctgtgggaaattttgttggaagaagagtctccgttgatgatatggaacccttaccgaggaatgatggcaaacatttccgatttctgaattcctttccctcacagaaaaggtaacttattcaaa

SEQ ID NO: 15706 - DNA, 492 bp, Gossypium hirsutum
  unsure (1)..(492): unsure at all n locations
  Clone ID: uC-gsflnu33B078a05b1
cttatgttcttactttcttccctctgaaaccctaaaccgccgccgtcgcccgtcaaacgccgacgaagatggctttagagggagtagttctccgcggcaccatgcgagcccacactgacatggtaacagccatcgccactcccatcgacaactacgatatgatcgtcactttctctcgcgacatgtccatcatcctttggcacttgaccaaagacgaaaagacctacggtgtcgctcgccgacgtctcaccggccactcacactttgttcaagacgatgtactctcttctgactcccagttcgctctctccggatcctgggacggtgagcttcgtctttgggatttgaacgccggaacctacgatcgacgttttgtcggccacaccaaagacgtgctctccngtgctgtttcaattgataatcgacagatcgtttcggcttctcgtgatcgaagcattaagctgtggaacactcttggtgagtgcaaataca

SEQ ID NO: 15707 - DNA, 403 bp, Gossypium hirsutum
  Clone ID: uC-gsflnu33B078a09b1
tcgttcgcgtgggatcacatatcaatgatttcgattatgaatacagtcgaagggtttttggggcaacatgggatagcattagtcgccctatgtcacgtcgctatgacacaagtgacccaatttcatatcccttttactgatatttattatgacagctacatgagggtaaaattcttacatgatgcacttaaaattggactgttgtagttattcaaacaagataggctgtagagttgttagtcagaaggggtaaagctagcattttttgtaagttatgtctttggtcccagcattgttcgtttatcatactacaatttcattgtgtggtgctatttcatattttcacaacctttcaaatattgtatttttgtatggttatgactgcatatttgctagtagattg

SEQ ID NO: 15708 - DNA, 392 bp, Gossypium hirsutum
  Clone ID: uC-gsflnu33B078a10b1
tcttttttcaggaggaaaaacttttgcctctgaaactatggctccgttctctttacgtagccgtcttcaggcttctgcgctaagcaagaggcgtctcaaatccaaagccaagcatggcaggaaagggatgaagaacatggcggaaagcttcaaaagattgaaatctgaaatggatgaaataagcgaggaacaaaagaatatcagggaagggcaaaggcaagttaaagaaaaattcggaatcatcgaatccgagcgcgaggaattgaagagggaaactaggctcataatccagcaaagtgcgagaactcaggttaaacttgctcttatgttccgcatactgaaagcaagggaacgccgcgagttgaataccgctgccactctcactgaaatgc

SEQ ID NO: 15709 - DNA, 431 bp, Gossypium hirsutum
  Clone ID: uC-gsflnu33B078a11b1
tttctacgcgtccggacctcaagaatgaatttgagcgtgttaatggagctcaaattgaaacggctgccaggccttacgcctttataaaatttgacacattcatacagaagacataaaagttgtgccaggacacccatactcaacggaatattgcaaagttgaatgacgaactctatgaagttcaccaaataatgactcgcaatgtacaagaagttctcggtgttggtgaaaagttggaccaggtcagccaaatgtccagtcgtttgacatcagaatctcgcatatatgctgacaaggcaagagatttaaatagacaggctttgattcgaaagtgtgctcctggcgacattgtgttggcagtgagttccttctcttctgggtgaaagcagagatatggtgattcaactgtgatccatagtgataagaactca

SEQ ID NO: 15710 - DNA, 525 bp, Gossypium hirsutum
  Clone ID: uC-gsflnu33B078b01b1
atttataccctcgaaaaatcctacccatccaatcaccaccggaaaccatggccactccttccccacgcgaagaaaatgtctacatggccaaactcgccgagcaagccgagcgctacgaggagatggtcaagttcatggagaacgtcgtatccgccgtccccgctcccgacgaactctccgtcgaggaacgcaaccttctctctgtcgcctacaagaacgtcatcggcgcccgccgtgcttcctggaggatcgtctcctccatcgagcagaaggaggaaggccgtggcaacgccgaccacgtcgccgtcatccgtgactacagggccaagatcgaggccgagttgtccgagatttgcgctggaattttgaagctccttgacgagaaccttgttccggctgctggaaacggagatttcaaggtgttttatctgaaaatgaaaggagattaccataggtactcggctgagttcaagactggcgatgacaggaaatctgctgtcgagaataccctcactgcctataaat

SEQ ID NO: 15711 - DNA, 427 bp, Gossypium hirsutum
  unsure (1)..(427): unsure at all n locations
  Clone ID: uC-gsflnu33B078b04b1
cttactcgtccgaggctttgaaggtggacttgttgaaccacccagaatacttagaagacaacgcaaccttggctttccagacagcaatgtggaggtggatgacgccgatgaagaaacaccaaccctcagcccatgacgttttcgttggcaactggaaaccaaccaagaacgacaccttggccaagagggttccaggttttggaaccaccatgaatgttctttatggtgaccaagtttgtggtcaaggtgatagtgattccatgaacaatatgatctctcattacctttattaccttgaccttttgggagttggccgagaagaagctggtcctcatgatatgctcacctgtgaagaacaagaacccttcactgtttctccctcatctgcaacatcatcatgaaaaagganacanactctagtatatgc

SEQ ID NO: 15712 - DNA, 549 bp, Gossypium hirsutum
  Clone ID: uC-gsflnu33B078b08b1
ttttatccgattctaattcggtaagacattttcaggaaaattagaagccaacaccgattttttgcttccccttccccttcccccatctttgacacctgatcttctgcttgccgtcagccaacactgattctcaacaccagacaccggcgttcatcaaagcttttacccattttcgcctttcgttgtcaaaatctgcactggcattcatcttcttctctcgaagattcgatcatagtgcttattgttactttaaaatttatttactgaaagcatttgtggattgcaacggatgggtgcactttgtgaatataagatattgtgtctagttaaaagctgatctttgtgcatttgaatcaagtgcttaccatactcttcattccatgaagcttatggtaatgattgagctaaaagtcgctcgagccactttaaatccccaggctgtttaccttatggtggcaactcatttaattcctatgatggtcataatcgaaacatggaagcttatagaactgagggatgggatactgagaagacgggatctgatttgca

SEQ ID NO: 15713 - DNA, 545 bp, Gossypium hirsutum
  unsure (1)..(545): unsure at all n locations
  Clone ID: uC-gsflnu33B078b09b1
tttgttatgtctacccctgttgttgaccggaacgatcccgtcactggtcacataatttccacaactattggtggcaaaaatggagaacctaaacagaccattagttatatggcagagcgtgtagttgggacaggatcattcgggattgttttccaggcaaaatgtttggaaacgggagaaactgtggctataaagaaggttttacaagacaggagatataagaatcgtgaactgcaattgatgcgtgtgttggatcacccgaatgtgatttccttgaagcattgtttcttttccacgacaacgaaaaatgagcttttccttaacttggttatggaatatgtaccagagagcatgtatagggttttgaaacattacagcagtgctaatcaaagaatgccacttatatatgtgaaattatacacatatcagatattcagggggcttgcatacctccatagtgttgttggagtttgccatagggatctgaagcctcaaaatcttttggttgatcctctgactcaccaggctaagatntgtgattttgg

SEQ ID NO: 15714 - DNA, 452 bp, Gossypium hirsutum
  Clone ID: uC-gsflnu33B078b10b1
tcctacgcgtccgaaaatctttccagtttcaattttctcacaacaaaactgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttgagggtgcgatgcccgtgtggagacaactgcaaatgcaacccttgcacttgcgggaagtgaacaacaaagagaagcagagtggcctttgtcattttaactaaataaattctattactttagtatgtatcagcaaatcttcatgaggatttggatcttaattatgtgtaatgtggcttttctgctatgtcagaatgtattatgatatttaagaaagtttgttttc

SEQ ID NO: 15715 - DNA, 542 bp, Gossypium hirsutum
  Clone ID: uC-gsflnu33B078b11b1
tagttaatcccttaaagtctggtgaaagcacaaccatagaagtattgtacctgttgacacactcccaagaaccttttccggctgagatagcccaatcagaatctcaattagtatattatcgtgatagtgcattgatattgtcaccatatcatattaagcaacaagcgacttttattaagacaccaagtactaaagtggaatcattcacaagggtggaacccagtaatcgtgcaggcactgaaataaagtatgggccatatgaggatcatcctccatactctttttctccaattcttatacattttgagaacaatagcccatttgctgttgttgaggagcttgttcgtgaagttgagatatctcattggggcaaccttcaggtcacagagcagtacacattggttcatgccggtgcccggcacaaaggtgtattttcaagggttgattaccaatccaggccaactttgaatggtgcatcctcattgaggtaccttttggcaagactaccttctaaggttcattctgtctactacccggatgaa

SEQ ID NO: 15716 - DNA, 543 bp, Gossypium hirsutum
  Clone ID: uC-gsflnu33B078c01b1
cttactcgtccgcccacgcgtccgcaaatcaaaatcgacgaggaatcggggaagattgttgatgcttgctttaaaacattcggttgtggatcggcgattgcgtcttcttctgttgctactgaatgggtgaaggggaaaagcatggacgaggttcttaccattaaaaacacggagattgcgaaacatctatcacttccaccggttaagctgcattgcagtatgcttgcagaagatgctataaaggcggccgtaaaagacatggaacttaaacgtgccaagttgaagggcaattcaagtgctgatgctgctaatgcacccatcgagaaggctgctgatgcctgatgtctgtttatatgcccgattgtaaaaaaagtctgaacggtttgcttacagagagcatgtaaggtaagactaaaataaaaccagggggggacattctgaggacacatgtaatgttacttgtttggaaggtatgttcttgatcaatggaaaattatgtaagtgaataaatcattggcccagtgcgtatactatcgtttgaat

SEQ ID NO: 15717 - DNA, 551 bp, Gossypium hirsutum
  Clone ID: uC-gsflnu33B078c03b1
atttattgctcttgaaggacttgaggctgaagttacggatatggattgggaaagtacattttacttgcgccatctccctgaatcaaacatggctgaaatcccagatctcagtgatgaatataggaaagtgatgaaggaatttgcagtgaaattggagaaactagcagaggagttgttggatttgttttgtgagaatattggattagagaaggggtatttgaaaaaggcgttttatggggcaaaaggtccaacctttggcaccaaagttagcaactatccaccatgtccgaccccagacaaaatcaaggggctcagagcccatactgatgcaggtggcatcatcttgctgttccaagaccccgtcgtcggcggccttcagcttcttaaagacggcgagtgggtcgatgttccaccgctccgccactccatcgtcatcaaacctcgtgatcagctcgaggtgatcaccaatggcaagtacaagagtgtggagcaccgagtcatagcccaaacccgatggaactcggatgtctttagctttattctacaacccc

SEQ ID NO: 15718 - DNA, 535 bp, Gossypium hirsutum
  Clone ID: uC-gsflnu33B078c07b1
tctttaagcagcctgcgaagatttcagcaatgtgattagttcttcaacagttggcactgtgtacaaagggacactgtctagtgggattgaaatatccgtggcctacttccctgtgaaatttgccaaagattggtcaaagaatttagaagcacagttcagaaacaagattgaaacattatcaaaggtgaaccataaaaatttcgtcaacctagttggatattgcgaggaagacgagccttttacgaggatgatggtttttgaatatgctccgaatggaacactctttgagcatttacacattaaagaatccgagcacttagactggacgaccaggttaagaattatggtgggcatggcttcctgcctagagcatatgcaccagctgaaccctcccataccgcataccaacttgtcgtcagctgctgtcaatctaaccgaagactacgcggccaaagtctatgatccgttctcctggaacgagataactgcagctgagagtgaaactgatagaaaaaccattcagatacaccatcat

SEQ ID NO: 15719 - DNA, 188 bp, Gossypium hirsutum
  Clone ID: uC-gsflnu33B078c09b1
tctttatcttctaatttttttttattgtaatatttgcaatgttttatacagctgcatggttgaatcgtttatgcctggaaattctagaaccgaaattttcaacttgaactttttattggatgtagtttgcagacccatcatgttgttgttaaagaaaattatgagctacttgaaagagttaatttttt

SEQ ID NO: 15720 - DNA, 389 bp, Gossypium hirsutum
  Clone ID: uC-gsflnu33B078c10b1
ttagacgggcggttgctttgctgctaaaggatatcgctgcgaggcgagttaagaccttacatggatcacaacactgccgcatgagctgctctaagacttacctggaactggccgaggttcactgctgtagctctacgtgcatgccatggccacgcacctccgatgaccacacatgcctactggcacaagcaccaaccattggcacactgtacagccagcgacttgaccaaaagatgcactgacactgggcaagagcgctgacttgtcatgatgaacacgcggacatactgtaccgagatggaccatgagctgctctctaataacaggaatgactgagctgaacgctcgtgtcagccttaggactgctattaaagctaatgtgctggggg

SEQ ID NO: 15721 - DNA, 471 bp, Gossypium hirsutum
  Clone ID: uC-gsflnu33B078d01b1
gcctccaaaaaacactataaccctatagccatgaaattcaagcgtatgaatggtggccgaaacaaacatcgacggggacaagtcatgtccatgcgctgatgtaactgcggtaaacgctgccgtactgatatgtcaatcaagaggcttcttgcgaggaacatcgtggagcaagctgctgtcagggatgtccaggaagcctgacaatattacacacgcactgtggccaagctgtatgtgaagatgcaatactgtgtttcatgtgcgatccattcccactgtgcgagggaccgatcacccactgacaggaggaaacgtgacccgcctcagcgcttcattagacgcagggatgatatgccaaagcccggtcagcctggtcaggctactagaactggtgctgcggctcctgctcgtgcataaggcttttgaagtttaagatgaatttggatttcgtgttttgctttgagatatggt

SEQ ID NO: 15722 - DNA, 495 bp, Gossypium hirsutum
  Clone ID: uC-gsflnu33B078d02b1
tgtggtttgagagaaaactgatgctgctggctctggaaaacctcaagtttatctatctgctgttctacaggtcacgatcattcagtgtcagatgaagatggcatagccatcattaagcatgcagtcgaaagaggagtcactcacatcgatacagccgacctctatggacccaaaactaacgaaattctggtcggaaaggcattgaagcatctgccacgagagaaggtacagttggctacaaaattcggtgttgaaagcatgggtccagatggtccggttatcaatggcactcctgaatttgttcgttcttcacttgaggctagccttcaacgcctcgatgtggattatattgatctttactatataatcagagttgaccgcaagactcctatagaagatattatggaagaactgaagaagttggtggatgagggaaaaataaagtacaattgtatatctgaagctagccccgaaactataaggagggcacacgct

SEQ ID NO: 15723 - DNA, 542 bp, Gossypium hirsutum
  Clone ID: uC-gsflnu33B078d03b1
ggttatctaagcaatatatgacatctgcaggcgttctttggacattgaacgacccacttatacgaatcttaaccgccttgtctctcaggttatctcatctcttaccgcatctttgaggtttgatggagccctgaatgtggatgtgactgagttccagactaacctggtcccatatcccaggatccactttatgctttcttcttatgcccctgtcatttcagctgagaaggcttaccatgagcagctatcgtgggctgtgattacgaacactccttgcgcaccgctgttaatgctggccggaccggatgctgctctctgatttgggctttggttgatctcgatgctgccgatggccttttcactccatattaaagctaatcgtgtgggggttaacctaaacgttactgtttcattgactttgctcctcaattcctgcgaaaagctaaagcctgctgtgtactaaagtgcttaaacttattttcactggggctcagcaatgtttgggtttttcttttacgcgttcttttcttttctgggctttg

SEQ ID NO: 15724 - DNA, 552 bp, Gossypium hirsutum
  Clone ID: uC-gsflnu33B078d04b1
gttgtctatgaagccgatatagatcccgttaaaatgatcttgcctgatgaagaaggtgaaccggagaagctcactacggtaggtgacggtgcagcgagtcaacaagtggagcagcattacatccgttcaatcgaatcaacggttgtgattagacaactcccttccgaagggctttcattccagctttggccagctgctactaccctcgtcacgctcctcgataactacctccgtcaccctagcaaaagccctctaacagccaccctatcaactgaccggaaactaaaaatcttagagctcggctccggtaccggtctcgttggaatcgcagcggccgtcacgctgggagctaacgtgacggtaacagacttgccacacgtcatccccaatttgaaattcaacgcggatgcaaacgctgacgtggtgactaaaagaggtgggaccgttgacgtggcaccgttgagatggggagaagatgatgacttggaggtaatcgggcgggaatttgatctcgttttgggttctgatgtggtttaccatgatcatctattt

SEQ ID NO: 15725 - DNA, 547 bp, Gossypium hirsutum
  Clone ID: uC-gsflnu33B078d07b1
tcttacgcgtccgaaaaaaggcattcttccaaaatcaaacgatttcgatctctgatctgggatttgtgaccatgagcgatggagaagacgctgtacggcgccgaaatgccattgcggagtaccgaaagaaactccttcaacacaaggagtacgagtccagggttcgcgcaggtagggagaatctgagagctgctaagaaggagtttaacaaaactgaagacgatttgaagtctcttcagagtgttggacagatcattggagaagttctcaggcctcttgacaatgagcgcctgattgttaaagcaagcagtggccctcgctatgtggttggttgccgcagcaaagttgacaaggagaaactgacttctggaactagagtggtccttgacatgacaacgcttacaatcatgcgggctcttccacgtgaagttgatccagttgtttacaacatgctacatgaagatcctggtaacgttagctattctgctgttggtggtttatctgatcaaattcgagaacttagggaatcaattgagctccctctatg

SEQ ID NO: 15726 - DNA, 300 bp, Gossypium hirsutum
  Clone ID: uC-gsflnu33B078e02b1
gcgcattgataagcgagattaggttgattattatgcctggggttctcttgagttgtccatgtactgcaaaaccgtgaaggaaacactgaacactccggatgctttgttaatctaataacatggattagcgatggattgcgtattatggcaacaatggtagaaaaagattattacatttaaaagtaaaaatgtcatctttactgctagttttttcttgatatgacctcaaatggattattaccgtgcttcaaaaacactaataaaaaaaaaaaaaaaaaaaaaaggcacggagctggggac

SEQ ID NO: 15727 - DNA, 516 bp, Gossypium hirsutum
  unsure (1)..(516): unsure at all n locations
  Clone ID: uC-gsflnu33B078e03b1
gcgttctatttgcaacatgtaccggatagccgacttggatatatcgacagacaatatacagggtcaaataccagcacagttaggcaaaatgaaggtgctcgcaacgttggacttaggcagcaacatgctcaccgttaaattacctgcggacggtgtgggcagtaccggtttgggtatcttaaacttgagtcgaaactcccttgaaggcaacattccggacgttttcgggccgaaatcgtacttaatggcacttgatttatcggtcaataacttgaaaggtccggtccccggatctttatcgtcggcgaagttcgtctgacatttagatcttagccataaccatctttgcggtacgattccggtgggaacgccgttcgatcaccttgaagcttcatcatttgatagccatgattgagtttgcggcaatccactcaagacttgctaataatatttgctcaatgaaattaataattgtgcatggnggattaaattgtaatagaatgttttattttgggt

SEQ ID NO: 15728 - DNA, 470 bp, Gossypium hirsutum
  Clone ID: uC-gsflnu33B078e05b1
gcttctttggttggatgcatgatgccctttatgcttggaatctgcttcctttgcccttccatggactgtctttggcataaatatcattattgcccaacctgcaacgagaagattgctgattttgagaaatcagatccttgtctggtggtggatttgccccaatggatgcagaagagttttgctttgcctgcatgataaccaagtctactaaaacccatttgcttctgatttgctacaaaccattgtctatacaagcaactgtgttttgaataaaagctttccactcgactctgttgccagtcgcaacagcctgttgtgtatttttttggatacatacaatctatccatagctgaatttaatgttataagtcaatttgatcttagctccattagaaaaagcttcatgacattattgacgaatagccccttcggtttgaactatacaataataaacatatgtaatattcttc

SEQ ID NO: 15729 - DNA, 114 bp, Gossypium hirsutum
  Clone ID: uC-gsflnu33B078e06b1
gttctttatcgcgagcggccgtgcttttttattttattttattttattatttaatattcaagggttttgagaacattaatgttaatagctattattgtacgagatttttttttg

SEQ ID NO: 15730 - DNA, 392 bp, Gossypium hirsutum
  Clone ID: uC-gsflnu33B078e07b1
tttcctttccattttccctttatttcctttgccgcccctagggtttaattacattccgcacatggcttctgcagatgtcgagtaccagtgctttgtcggaggtctcgcatggaccatcaacgaccgtgctctcgaagaagccttcagtgcttacggcgagatcgtcgattcgaagatcattaacgatcgtgagactggaagatccagaggctttggcttcgttactttccgtgatgagaaatcgatgagagatgctattgaaggaatgaacggtcggagtctcgatggaaggaatataaccgtcaacgaagcacaatctcgccgaagcggcggcggaggtggtggttgaggatttggaggaaaaggttgggtacaaccgtggtggaagcggt

SEQ ID NO: 15731 - DNA, 507 bp, Gossypium hirsutum
  unsure (1)..(507): unsure at all n locations
  Clone ID: uC-gsflnu33B078e08b1
atttccctagggttttgttggttctcttactctgttgcaggcaaaatctagagttttcaatcgacaatggtgggagttttcgaagtaggcgctgttccgtttaaccctgacggctggggtccacccgattccgccgccgccgcatcgatcaccactactctccctctccatgttcccttcgctcctttctcccgctccgacaagctcggccgaatcgccgacttcacccgctcttttccttcctcaaacgctaatccgtccaaccgcccttcgtcgaggcacggggctgggaaccctgcggactcgccctttgatttctccctcgacgtcgacgctttccccttggctaaccccgaagacgattcctcattccgtttagtcgatgccaagcctccgccgcggcctaagttcggtcctaagtggcgtttcaatcaaaacagacctcaactccctcaaaggcgagacgaagaagttgaggcccgcanacgggaagccgagaagaacgtg

SEQ ID NO: 15732 - DNA, 530 bp, Gossypium hirsutum
  unsure (1)..(530): unsure at all n locations
  Clone ID: uC-gsflnu33B078e09b1
tcggtttgatcatgccttaacattacctctatttatttggggacagaccattgtgattagcaaaatgcgaataatgaccaaggaaggactaaagtggactgacaggagagtcagctttatgaacgaaattttagctgctatggacacagtgaagtatggttgaatttagaaagcatttcccttggattttcaatatatttttttccatttgatattgcttattggtcctatgcttggaaaattttcagattttatgcatgggagaagagctttcagacaagagttcacagtatacgaaatgatgagctgtcttggcttcggagagctcagctactatctgctgtatgatatttgaaattctagtccattttttctttgcatgtgtctttgccatatgaaatgccaaaatagagtatgaagttgccagttgccatgtaaaatcaacgagtgtacttccttttgcaccgganaatgtaacaccaaccataaaatntacaagtatgccttcacaacttgatttgagggaaaat

SEQ ID NO: 15733 - DNA, 410 bp, Gossypium hirsutum
  Clone ID: uC-gsflnu33B078e10b1
gatccactcatcatacaatgcactaagatttgtttctggggttacaaccacatttacccccaaagcaggtcttaaaataatacagttgtacatggaaggctaccgacaagactggaagctttcttttgaggaagacactgttaagagaggtggctggcagcaaggtggaattttagtagcaggtcctggaaaaaccaacattttatacattcacaaggacaaagaagcaggggatgatccagatattgaagacattttgaaagcttgttgctcataagaaatggggcctataatctcagtgaaatttcgtgtttataatctatcatagtgtatatttgggaattttcagtaaactcttctgttcttttccgattatgtgtgatacaacagaaatagaaaggagttttatc

SEQ ID NO: 15734 - DNA, 500 bp, Gossypium hirsutum
  Clone ID: uC-gsflnu33B078e11b1
tcctacgcgtccgtttaggtggtcctgcagagcgaggaagctcccctgaaagcttcagttgaacatgcctaagcaaattcatgagatcaaggacttccttctcactgctagaaggaaagacgctcgctctgtaaaaatcaagaaaagcagagatgttgtcaagttcaaggtccgctgctccaagtacttgtacacccttcgcgtgtctgatgctgagaaggctgacaagttgaagcacgctcatcttcctccaggtgtgagcgtccaagacctgtgaaattaaaactgcccttagcttgtactaggcaatgaaaactagattttgacttctagtttattgcttgcatttcgaatcgatttgcaacgatcaaaagtttttataatggatttttatttggtgatgatttatggacgattgtaatgttattaaaaccctatatttatgttagcatgcgtgttctacatcttagttgggcacatattggataatcaaacatatg

SEQ ID NO: 15735 - DNA, 268 bp, Gossypium hirsutum
  Clone ID: uC-gsflnu33B078f01b1
cttcgcttccgaatagagtgcctacccgtctttcatttctagtggggaaaacaagatagattaaaatctatgatctgtttcctggtatcggaaaatttatacttgcacacattggtaatgtaatttggagtttatgttgtgccctttgtgatttatctgatattttcagcattcctgataatcaaaggctcattttttgctaccgagcttaatcctatttgcccaacaacaataatcaaataaagcgttactaatgatttcgtgaacc

SEQ ID NO: 15736 - DNA, 547 bp, Gossypium hirsutum
  Clone ID: uC-gsflnu33B078f02b1
ttattttctggaaggcccatcatgcctggtcgcaccgaggtggagcaattacacaagatattcaaactatgcggctctccttcagatgaatattggaaaaagtcaaagttgccacatgcaaccatatttaagcctcaacaatcatataaacgatgtatagctgaaacttttaaggactttccaccatcatcgttgcctctgattgatactcttcttgcaattgatcctgttgagcgcctgacagctacagccgcattaaatagtgaattcttcacgaccaagccttatgcttgtgatccttccagccttccaaaataccctccttgcaaggagatggatgctaagctacgagatgaagaagctagaagattgcgagctactggaagacctaatgctggagtgaagaaagctcgtccacgtgatcgacctgcgcgggcaattcctgcttcagaagcaaatgctgagctttaagccaaccttgatagacgacggttaataacacatgcaaatgccaaatgcaagagtgagaaatttccaccttcacacc

SEQ ID NO: 15737 - DNA, 546 bp, Gossypium hirsutum
  Clone ID: uC-gsflnu33B078f05b1
gatgttttgttcaggagacagacacatctagttctgaagatgtggttagtgccagagagtctctctgtagtgagggaaggagcccagatgctgagttctcagatgaaccatcgagtatattgttagcaggagatggtagttcaagaagaataacaaatgctgatgtgtcagcactgaacagtgagtcatcagactctgactcttctgaagaccctgaagttattcaggggtcccccactttggacggcagggaggataatgatcttgatgtggcttcagaaaggaatgttcctccctcaagcactgaagggatatcaaagctacgtgcaactgaaaatttttcaacctggcagcgaatcatccgtctagatgctgttcgtgccaatgctgaatggatgccatactctacttctcaggctttggtatcagatgggagggcacgccgttcagctgaggctgttgggttaaaggattatgatcacctggatccctgcagaattttccatgctgcacgtttggttgctatccttgagcttatgcacttta

SEQ ID NO: 15738 - DNA, 546 bp, Gossypium hirsutum
  Clone ID: uC-gsflnu33B078f06b1
cctactcgtccgggatttttgttttaggatctcaggcagtgccagtttccttttaaccgattttatttatcaaattgtaattaaaagaaactttgaaaatatatgcggctcccaattgagcgattaacaatttcatttcattaaatagaaaaaaggaagtgattatttaattttgatttgaaattgaacattcaagtctgaccgttgatttcatcggttgttttctccgtgatcgtcgtgatggaagtccggccaaatcaagcggtggacaattcatcaacctcacctcaacagcatcggcgccgtgcagctgccgctgcatctaaacaaccagtttccgctaccaacgccgttgataccacttccgttactcaaaggctccaaaaggaactaatggctctcatgatgagcagtggagatctcggagtgtccgcatttcctgaaggtgaaagcatttttacatggattgggacgatcaagggtggagagggaactatgtacgagggtttatcgtacaaactttccttgcgtttcccgttggactac

SEQ ID NO: 15739 - DNA, 409 bp, Gossypium hirsutum
  Clone ID: uC-gsflnu33B078f08b1
acggttgagtattggaaggcccatcaagcctggccggtctgggttggagcaattacacaagacattcaaactatgcggatctccttcagatgaatattggataaagtcaaagttgtcacatgcaaccatgatttaagcctcaacaatcatataggcgatgtgttgcgtgaagcttttaaggactatccaccatcattgttgcctctgattgatactctacttgcaattgatcctgtagagcgcctgacaggtacagtcgcattaaatagtgacatttttacgaccaagccttatgcttgagatcctgtcagccttacaaaatacccttcttgcaaggagatggattctaaactactagatgaagaagctagaagattgcgagctactggaagacctaatgctggaatga

SEQ ID NO: 15740 - DNA, 348 bp, Gossypium hirsutum
  unsure (1)..(348): unsure at all n locations
  Clone ID: uC-gsflnu33B078f09b1
ttgtgtacgcgtgggtttgaaaagaagagaaaaaatgcataatccaccaccaccagacccccaccatcctcaccatgcccaccacccacatccggaaccccatgctgcgcctccaggtccgccacatgctgatcatcctcctccaggccatgctcctcctcctggaccaggcccccatgcgccaccgccaggaccaggtggtccaggtcatcatcccgagccacacaagcctcgtccatgatccttataccgtgtatccaatattatgtacgcttaggctccgtaccgtacttgtataactctatcacctacttggcgttaggctntatgtaatagattatgaaaacc

SEQ ID NO: 15741 - DNA, 546 bp, Gossypium hirsutum
  Clone ID: uC-gsflnu33B078f10b1
tgttacgcgtccgaccggcggtaagctccagagcatgaaggaattggcagcttttcttggacatgtcggcagcaagacttcatgtggttatggagtggcaactgggggaccattggcttggggtctatgctacaacaaagaaatgagtcccagcaaattgtattgtgatgattactacaaatacacctacccttgcactcctggagtttcttaccatggccgtggtgccttgcctatctattggaactacaactatggagaaacaggagacgcattgaaggtggacttattgaaccaccctgaatacatagaaaacaatgcaaccttagctttccaggcagcaatctggagatggatgacaccggtgaagaaacaccaaccgtcggcccacgatgtgtttgtcggcaactggaaaccgaccaagaacgacacgttggccaagcgggtcctggggttcggagctaccatgaatgtgctctatggagatcaagtttgcgggcaaggtgatgttgacgccatgaacaacatcatctcacattaccttta

SEQ ID NO: 15742 - DNA, 338 bp, Gossypium hirsutum
  Clone ID: uC-gsflnu33B078g01b1
cgttcgctatgggaagatttgcatgcttggagatgctcaacatgtttaagaggctgagaggattgctccggattatatggatgtagaagcattgaagaagctaaacaagaacaagaagtgggtcaagaagcgatggaagaaatatcatgcatttttggcctctgaatctgtcatcaaacagatcccccgtctcttgggtcctggtctaaacaaagcatgggaatctaacgcccttgttactcaccaggaatctatgtagtacaaagtgaatgaatcaaaggcactggtgaagttccaattgaagaaagttctttgcatgggcggccccgttgggaatg

SEQ ID NO: 15743 - DNA, 560 bp, Gossypium hirsutum
  Clone ID: uC-gsflnu33B078g02b1
ttttcctttaaaaaaaaaattaaaaaaaaaaccaaatccaaattccccccctttaagtacccctctgccgtctccctcactctcaccacaacccccactcttgctctctcttctcttcccttcttctctacagattttcagtaactttataagagttttaattatagtgttgaagttgttggaggaagggcaaaaatggcagtggcgagtgcagtagcatgcattttgctgtttatctcctccacaatgtggatgggtgaagctagaattccaggagtttattctggtggcgcatggcaaaacgcccatgctaccttctatggtggttctgatgcttcgggcaccatgggaggagcttgtgggtatggaaacttgtacagccaaggatatggagttaacacggcggcattgagcactgcgttgttcaacaatgggttcagctgcggtgcttgctttgagatcaagtgtgctagtgaaccacagtggtgccattcaaggagcccatccatattcatcactgcaaccaacttttgcccaccaaactacgcttttcaagcgac

SEQ ID NO: 15744 - DNA, 550 bp, Gossypium hirsutum
  Clone ID: uC-gsflnu33B078g03b1
cttacgcttccgcccacgcgtccgcccacgcgtccgcattgattgattatggtcatatcgagcaatggattgatttcgcagccatggaaattgatgctaatattgcaaaatggttgtatccaagacttggttacggtgtttaccttcctccagctgaggaagctgctattgctgcattgaagagagcccttggcgctttgaacactcatcttgcttccaacacatttcttgttggacattttgtcacccttgctgacattatcatgacatgtaacctctacttgggtttctcccagatcatgactaagagttttacctcggagttccctcatgttgagaggtacttttggaccttggttaatcaaccaaaaatcaagaagattcttggtgaagtgaagcaggcagtctctctaccacctgttccttcaaagaagcctgctgcccagccaaaagaaactaaaccaaaggctgaaccaaagaaagaagccaaaaaggaggttgagaaactggcagcaaaggcagaggcagctgatgaggaggcaccaaagcc

SEQ ID NO: 15745 - DNA, 167 bp, Gossypium hirsutum
  Clone ID: uC-gsflnu33B078g04b1
gttttggttacccttttggggacagtgttttgttatttggcttgctaaaaagaccttaaattttgtattcattttgtcaagtgaactgagacagctttagaaaactttggtattatgacagtaatccattttgttgagcattttattaaattgagaagtttcttgcg

SEQ ID NO: 15746 - DNA, 383 bp, Gossypium hirsutum
  Clone ID: uC-gsflnu33B078g05b1
ctgatgcttgggaaaaaaaaaaaaaaaaaaaaaaaaaaaattttttaaaaaattattgaaaattctttcaaaaaggtcaaaactttctaacgcctccatgctagccttcccattcttgggggcggcccttttaggggatccagctttccttccccgttcttccgacgttttatttttttttttgggccccctaaattcatttccttgcccggctttttccaacttggggcctgggaaacccctggggttccccaacttattggctttgcacaacatcccctttttcccagttggcttattaccaaaaaggccccccccgttcgcctttcccaacatttttccaccctgattggcgaatgggcccccccctgtatcgccccttt

SEQ ID NO: 15747 - DNA, 549 bp, Gossypium hirsutum
  Clone ID: uC-gsflnu33B078g06b1
ccttatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgcttgaaagtgcgcttaatggaaagaaattctttggtggagaaaccattggaatggtagatattgttgctagctctgttgggtatttcattagggtcactcaagaaattatggggcaaaatctgctgtcagctgacaaatttccccaattattccaatggtctgaagatttcgcaaattgcagcattgttaaggaaagtttgcctccaagagacaaactacttccctttgtcaaaggtctcattgccaaatatcagcaagataatgctaaggcctaagccctcccaatgaacgtctttcacaatgattgtcgcatgcattttgccatttttgtatttgctgcttttgtgtgtaatgacctacttgcttttatgttcgagtgaaaaaataaatta

SEQ ID NO: 15748 - DNA, 538 bp, Gossypium hirsutum
  Clone ID: uC-gsflnu33B078g07b1
gttcactgagcagaggttaaataaggaatggaaggtgaggaattcgcagtgggttgcttcctttcaattaagacaactttgggcgacgaatttgaaggtcaaattatcagtttcgaccgcctctccaacatcctcgtacttcaggagggtttggaatcaggacccagaaggaacattcggctgctgaaggctaatcacattaaagagttctctttattgcgccaagatgaagatcctcttgatgttaagaaatgttttttagaccttactagccttcaagcaagagaagattctgctattaggcaagctgaggctgattcagagaggtttggtgttggagttaccagtgaggcacagactctttttgatgctttgtctaaaacgctacctgttcgctgggacaagactgtcattgttgtaatgaatgaggtgcgtgtgagcagtccatatctccccgagtctgttagtggaggaactcctgcagccaatgaacgagtgagaaaagtgctggagtttgaaaggagaggatgcaaactcg

SEQ ID NO: 15749 - DNA, 557 bp, Gossypium hirsutum
  Clone ID: uC-gsflnu33B078g08b1
ttgattttcttcaattccaatcgactgggcgtattgtgtcgatttttttgagtaatatacctggaaatacccgttgattccttattaacgccgtttcgaacacaactggtacattccaaaataatcgttactcggacatctttactcttggccatgaacctcctttgagtttttaattcacccaacttttctattttccgatcaaaagcgaagaagaaaggaatgaaaaaaaaaagaaataaaagttgctaactcaaaaccaaatcttgaaagattttgttgcaatcaatatagtaaatcaatatagatttatagtaatagtaaataataagaataagaataagtaatacaacgatttcgaactctatttagaatcaaaccaccgtacggtattttctttaagtatcttgtaggatactgttgttccagccacatttctcttttcgctctactagtaatttaattggagcttgaacccgagtttcggtgaggttgaatccacttttttcgttctaccttccttatttattttatctaaatcttatctaattctaaaa

SEQ ID NO: 15750 - DNA, 511 bp, Gossypium hirsutum
  Clone ID: uC-gsflnu33B078g09b1
gtttaaacttgaggggaagaatcttgctatcccttgcttttctctcgcaaaaaattctcaaacttgtttttaacgttcgctgaatactatcgctcatttcttccctcagaaccctaatcgataactgaagccatttaatcatgtttgggcgtgttccaaaaaaatctgataacactaagttttacgaagtacttggggttcccaaaagtgcaagtcaggatgaattaaagaaggcttataagaaagctgcaattaagaatcatccggataaaggtggagaccccgagaagtttaaggaactggctcatgcttatgaagtacttagtgacccagagaagagagaaatatatgatcaatatggtgaagatgctcttaaagagggaatgggaggaggcggttcttctcacaacccatttgacatatttgagtcatttttcggtgggggagccttcggagggcggtgtagctcgagaggaagaagcaaaagcgaggtgaagagtagtgcatgctc

SEQ ID NO: 15751 - DNA, 546 bp, Gossypium hirsutum
  Clone ID: uC-gsflnu33B078g10b1
tcatcttcaaaaccctaacggggaaaaccataacccttgaggtcgagtcttctgacaccatcgacaatgtcaaagccaagatccaagacaaggaaggcatccctcccgatcaacaacgccttatcttcgccgggaagcagcttgaagacggccgcaccttagccgactacaatatccagaaggaatccactcttcacctcgtcctccgcctccgaggtggtgccaagaagaggaagaagaagacctacaccaagcccaagaagatcaagcacaagaagaagaaggtcaagctcgccgtgctccagttttacaaggtggacgagtcgggtaaggttcagaggctgagaaaagagtgtcccaatgccgagtgtggtgctggaaccttcatggctaaccattttgataggcattattgcggtaagtgtgggctcacttatgtttaccagaaggctggtggggattgagtgggataagatggatttttagtggttttcaaataatcgtattggcatgctcttatttatgatcgtttagtatgtataaatt

SEQ ID NO: 15752 - DNA, 386 bp, Gossypium hirsutum
  Clone ID: uC-gsflnu33B078g12b1
ttcttcgcgtccggctgaaataactgacaagcttggcctccattcccttcgacagcgtcactggtatatccagagtacatgtgcaacatctggtgaggggctttatgagggcctagattggctttccaacaacatagctaacaaggcctgaagctattaagaagatttttgctatgtgggaagttctggaagcaggggggagcattatctcgtcttattattattatttttcaatcattctcctttccccctcatttttcatctgagacagtcggattgttgttatgcctttatttgcattttgtgatgatcattaatttagttgggaacttatggctaaattgtaactaaaaaactggctggttggatatataattcctttggat

SEQ ID NO: 15753 - DNA, 549 bp, Gossypium hirsutum
  Clone ID: uC-gsflnu33B078h04b1
cattattagggccaatgtaccaggctgggaccttgagtgggaacccattggcgatgacagccgggatacagacccttaagcggttgaaagagccaggaacatacgaatacttggataagatcaccggacaacttgttcaaggcattttagatgctggaaaaaagacaggacacgcaatctgtggggggtatatcaatgggatgtttggatttttcttcacagaaggacctgtttacaactttgacgatgcaaagaagagtgatacggcaaaatttgccaggttttataggggaatgctggaggaaggtgtatacttggcaccttcacagttcgaagctggatttacaagcttggcacatactcaggaagacatccaaaagaccattgcagcagctgagaaagttcttagcaagatttaaggtactttgtccaatcctgttctcactttcctattgaatgattagccatttagctagggaatcaatggttcttttggtgtcagcttttcagattaaagatttgtggtcattgcctcttactttagagtct

SEQ ID NO: 15754 - DNA, 109 bp, Gossypium hirsutum
  Clone ID: uC-gsflnu33B078h05b1
tctttttttccggaaatttttgcagagatcaaaatagagaaaagaaaaaggaatattttgggaaaagaaaacgtcagattaatttcaacaacaccagaaaactaacatg

SEQ ID NO: 15755 - DNA, 536 bp, Gossypium hirsutum
  unsure (1)..(536): unsure at all n locations
  Clone ID: uC-gsflnu33B078h06b1
gctatggtatgccgtcacaaattacaggacctggatctttgttcttctctatggctactccatgggagttgaattgtcaactgataatgtcattgctgaatacttttacgacaggtttaatctcaaactacacacagcagggataattgccgccacctttggcatggcaaaccttgttgctcgtccctttggtggttacgcttcagacaaagcagcccaattatttggcatgagaggcaggctttgggtcctatggagcttacaaactttaggaggtgtcttctgtatctggctaggccgtgccaattctcttcccattgctgtcctggcaatgatcctcttctccatcggagctcaagccgcatgcggcgccacgttcggcatcatccccttcatttcacgacgatccttgngaatcatttcgggtctaaccggtgccggtgggaacttcgggttcggattgacacaattaattttcttctcaacatcgagattttcgaccgcatctggtctttcatggatgggagccatgatag

SEQ ID NO: 15756 - DNA, 493 bp, Gossypium hirsutum
  unsure (1)..(493): unsure at all n locations
  Clone ID: uC-gsflnu33B078h07b1
tttaatgtctgtgctcggttatcgtattgggaagtcaaaaatcaagcatggcatgaaatacatccaaatcccgggattaccacacgatgctgttcgagtattcattcgttttttatatacttcatgctatgaaggggcagagctggaaaagtatgcactccatctataggagttgtcgcattgatgctcagtcacgctactgaaacgagtttgcatttgttatctcgagcaagactttcttaccactgaaaatgtgattgatacccttttgttagctcggaaatgtgatgcaccaaggctcgtcctcatttgtgttcgtttggtcgtaaagaatttcaaatccgtatcttcaaccgaaggatggaaattaatgaaacgtatttatccagatattgagcaagaacttgtcgagtctgttgttgaagcggattctaaaagcangagaggcaaaggaaaatcgaagagaaaaggtctatacgcaattatatgaagc

SEQ ID NO: 15757 - DNA, 524 bp, Gossypium hirsutum
  Clone ID: uC-gsflnu33B078h08b1
tttcttacgcgtccggcctattgacgagaaaggcgaactcaaaaccgaccacttcttgcccattcacagagaagcaccagcctttgtcgaacaagctactgaacaacagatccttgtcactggtattaaggttgttgatctccttgcaccatatcaaagaggagggaagattggactttttggtggtgctggtgtagggaagacagtgcttattatggaacttatcaacaatgttgctaaagctcacggtggtttctcagtgtttgccggtgttggagaacgtactagagagggtaatgacttgtatagggaaatgattgagagtggtgttattaagctaggtgaaaagcaggctgatagtaagtgcgctcttgtttatggtcaaatgaatgagccccctggtgctcgtgctcgtgttggccttactggtctgactgttgctgaacatttccgtgatgcagaagggcaggatgtgcttctcttcattgacaacattttccgttttactcaagcaaactctgagt

SEQ ID NO: 15758 - DNA, 293 bp, Gossypium hirsutum
  Clone ID: uC-gsflnu33B078h09b1
ttgatttagggagagttcattgggggttcagatataattctcaacatgcaccagaatggagaactgaaagaaaagctcaaggatattgtaggcagtccgaagctcggataattcactgttgaatctcaagattgtagtaggtttttgctttatttgaaagtatttttgtttgccccttttcttctctggaagatgataaagataaaaaggttccatatgttactaatgtatgatgaccttgacttgttaaaaactttcaaaaaataatcttatttgttctactttatttattt

SEQ ID NO: 15759 - DNA, 441 bp, Gossypium hirsutum
  Clone ID: uC-gsflnu33B078h11b1
tctctttcgcgtccgcccacgcgtccgaccacgcgtccgtccacgcgtccggccaaataattattcaatgtctgaagcaaggtcctatcttgtcctttcccgatgtagcaatgacttaacaggtggatctcatggcggttcttctgatggatggtccatgcgcacattttcagagcttgaggcctcttctcaaagagaaaggtggtcttttgacagcgaacacttaggttctggttatggcaagataagtggatgtagcagcagattctcatactctccttccatagatgcacgaacttgtggtgcttgctccaagcttttagctgagagatcctcatggagtagcaatgagatttcagtggtttctgtgcttgtctgtggacatgtttatcatgctgaatgcttggagctgatgacaccggaggctgacggatttgaccc

SEQ ID NO: 15760 - DNA, 406 bp, Gossypium hirsutum
  Clone ID: uC-gsflnu33B079a02b1
ataacacggccggaacacggggagataaaccggcagagttcaggcagacactacaccggaggctgcagaggagaggagtacagacacggagcagtctacgatgagctaaaggacagggcgaagagaaggggaggcccgcaacggaggaaactgccgggaggagaggtcatgggggttcgaaatgaaagctaagaaaggagagtccgacattatagatacataactaggggacagggaactaaagaagaaggggagagagacggatggaattgacagccaaagcaaagagcaggaagcaaagacaggaccctcaatcgctgaagttgatgcatggaggaaacgtattggaaacaacgaggatgcacgataaacatacgatgatgaggatgaggaaaactgggaagga

SEQ ID NO: 15761 - DNA, 435 bp, Gossypium hirsutum
  Clone ID: uC-gsflnu33B079a03b1
ttccaatattttgggctaaccgtccaaagagttacttatctaggactattggttgggatcagtacccacaggggcgatggggtgattctcgaaaggcatcgcatggtgcactatccgactatcagttcatgaggccccgtgcacgtgacaagaaacttcaggaagaatgggctactccttggaaaagcattgatgacattcaagagaaatttacaaaccattgtctgggttagttgagaaggagcccttggtccgagttggatggtcttcagccagagacaaagatcatacatgagccacttggaaagatcaattcgaagggcttgcttaccatcaatagcccaccagccgtcaatggggagcgctctgattctccatctgccggttggggtggcccacgatggtacgtttaccaaaaggcttaccttgagtttt

SEQ ID NO: 15762 - DNA, 379 bp, Gossypium hirsutum
  Clone ID: uC-gsflnu33B079a07b1
gtcatccctcgagagacgggcgcgtacagggggcaagtttaaatgcgcgtgcctgcggcttctttgatccttgatagcgtcacttaaagtcattttacgggtcgtcgcattacagctgaatgactgggaaagaccttgcagcttacgaactgaatcgatttgcagcacattcgcctttggtcagttggccgatgtaacgaatagggctcttaccggatctgctcacacgaacatgaagggcagttctgtatgggaaggtgggacagagccctgtatgcggcgcatataaatctagaggctgatggtggtgacggcgcatcgtgacacggtagcacttgccatgtgtccttagcgccctgctcctttagatatttttcct

SEQ ID NO: 15763 - DNA, 450 bp, Gossypium hirsutum
  Clone ID: uC-gsflnu33B079a11b1
tcaagtctccctgtgagaaaatggcatcctaccaaatcttagctttcgcagctttgttcttgatcttgttacccgtagccgtcaatggagatttaggtgacttatctcctgctctatctcctttctatgataggttgtgtgatgatgttgattgtggaaagggaacatgcaaagcggacataagctaccctttgaactacatctgtgagtgtgatgctggttggaaaagaactcaagacgacagtgatgatgatgatgatcataagtttctgccatgcgttattcccaactgcactcttgactactcttgtcaaccagctcctcctccagtacctcagcgagaagttcctcgcaattcatctttatttgatccttgctattgggcatactgtggagatagaacctgcaacaaaactgcaacatacaagtacgtatgcgaatgcagatctg

SEQ ID NO: 15764 - DNA, 432 bp, Gossypium hirsutum
  Clone ID: uC-gsflnu33B079b02b1
ctcacgcgtccgatgacctcgtagagttgaatcacctctcaaaactactgtataatcaatatgctgaactgattttgctgcagaacaaagattgttgcatatatctttgatcagcacagtagcctgcaaaatgttaaatctttagtcggtcaagagaaaagtaaagagaaatttgatttggttgaaataaattttcactaaaaatatttccatggtaatgcaaaatgagatctagggataaaataacttgacatttgacgaaaaattctttaccttctcagagcttagtgctctagagttagtcaaaatatagaagcatataggttttttcctaaactgttcaacaagtgattctatactcctgcagatggcaaacataagtgaagtaaggaattccttctagatggcaaaactgttatataatacagctga

SEQ ID NO: 15765 - DNA, 338 bp, Gossypium hirsutum
  Clone ID: uC-gsflnu33B079b03b1
atcacgcgtccggacagtgagcacaaacgcggcacgattggccgcggtggctgatcgctcttactggagaggtcaatctgctggtcaagatccggagcctaaccacaccggcatgtggtaacaaacgccacaccggggctccgatcgggatagcatcccaccaccgactatgggcgttagagccaaagacggttgcagcataccacaagaccaggatgacctcacatgctacatgccgggcgcgcactacaatgctgacaggaacaacaggattacaccgtccagatcgaccgctattattctgagacatggagagggatgccaaagcgcatctagat

SEQ ID NO: 15766 - DNA, 410 bp, Gossypium hirsutum
  Clone ID: uC-gsflnu33B079b05b1
atcgactcaactgacactgactctccgatcgcacctcctttctcaaacccttccttaaattaaaagaaaagaatcacattaaaaaaaaaaaaaagcctgctgaaaaccactaaaagaatggcaactccagacgaaagtcctgcagctaagagatggcttcctctcgaagctaaccccgatgtcatgaaccagtttctttggggtctgggtcttccagagagtgaggcagagtgctgcgatgtttatggcttggatgatgaactcctatcaatggttccacagcctgttcttgctgtgctttttctttatccaataacttctcagactgaagaagagagattgcagcaagataatgagaaaagagatgttagcagtaaggtttatttcatgaaacaaactgtgggaaatgc

SEQ ID NO: 15767 - DNA, 467 bp, Gossypium hirsutum
  Clone ID: uC-gsflnu33B079b07b1
ctcacgcgtccggtcaatatgtacgtagtgttgtgggatctgttcaaagggttgccatggctattgctccatcccgtattagccctggcttgggaccaaaaagcctccctggttctcctgaggctcttactttggcgcgttggatttgccgaagctacaggattcataccggtggagaactcctacgagctgattcacaatccggtgatactttgctggagcaactgtggaaccattcagatgcgataatgtgttgttcattgaaaacaaatgcgtctccagttttcacctttgcaaaccaggctgggcttgatatgctagaaactacattggtagcccttcaagacataatgctggacaagattctcgatgaagccggccgaaagagcctatgcaccgagttctcaaagatcatgcaacaggggtttgcacatctaccagcagggatatgcgtatcgagtatggga

SEQ ID NO: 15768 - DNA, 497 bp, Gossypium hirsutum
  Clone ID: uC-gsflnu33B079b08b1
ttcatttctccatatcgtagggagagacctcaatcaccgttccgtggagggggctttcttggcatgcctaaagaagctgagaaatacaaagctaatatgatggttaagtataccagaagcaataacaactcgcaggaattagtaccgtatcagagcagcagacaaggctcaggtcctctaagccctgcagttgagaaaactttgtatgtagatactgtgaatgaaatggcaagttcaaattccaattcctcggatacgaaagtccaaatggattccataggaaaacattcaaatacctcagaagtgaacaaagtgttggaagaacctgctaccatggaatctccccttcaagatacaaaaggccttagtctcttggatggaaaagccatattggaatacgaaaccgcagggtcagtcaaatccagtcgatcttctttcttcaacaaacctgatctagaggtcaagcagaaatgatagattgcttcacacagaatgga

SEQ ID NO: 15769 - DNA, 535 bp, Gossypium hirsutum
  Clone ID: uC-gsflnu33B079b09b1
tggcacttaagatccttgataaagacaaggttctcaagcacaaaatggctgaacagattaagcaggaaatagcaacaatgaagctgataaagcacccaaatgtcatccgtttacatgaggcattagtgataataagatatattattatcacttaaatcttagaggaagtgtttttgccagaaggctgactaggctaccttcaattcctaagaatgaagcaaagttcagtttattaagagagtaagatggcatccactttcacagccatgtcattagttggctcattcgttgcatctaatgttttggtcatggataagaagctttcatcttcttccaacagattgtcatctttagcatccatttcttcatcttcatttcttattagacgaaatggtgttcttaaaagatctcatttgcccaagatttctacagcaaaagagctacatttcaataaggatgggtcaaccataaagaaattacaagttagtctgtgtttcaaatgctaaaaagtgccctaactggtaagtattcaact

SEQ ID NO: 15770 - DNA, 350 bp, Gossypium hirsutum
  Clone ID: uC-gsflnu33B079b10b1
tcacgcgtccgcactaaatggccaccaaagctgagaaataggcagccggaccgaaaccggcggtggagaaaaagaccaccgatgcaccaaaagccccggaggaaaagaaaccgaaggccggcaagaagccaccagaacaaggcggagccaccgttgacacgaagaagaagaaggccaccaagagcgtggagacgcacaagatctacatgacaagggtgctcaaacaagcccaccctgatacgagcatctcaagcaacgctaaggggataatgaacatggtcagtaacgatatcgacgagaaactggctcacgaagctcccgaggaccgcgaggcacaacaggaagcccac

SEQ ID NO: 15771 - DNA, 452 bp, Gossypium hirsutum
  unsure (1)..(452): unsure at all n locations
  Clone ID: uC-gsflnu33B079b11b1
ttttccaatacaaagcttcatattatcttttttagtttttacaaaagaaaacgaaaaaaatagaagaaatacaatcgttttctttttgaagtcgggttttagtttttggggagaaaaaaatgttgggagtatttagcagtgcgatagtgtctccgccggacgagctggtggcggccggttgccgaactccatcacctaagataacggcggatgctctggtgaaacggttccttgagacgaactcctccggcgtgtccatgcagatcggagaccatgtccaattcgcttattctcaccataaagagtctcctttacggcccagatcatttgctgtgaaagatgaaatcttctgcttgtttgagggagcccttgataacttgnggagtttaaagcagcaatatggtctggcaaagtcggcaaatgaagtgattttggtcattgaagcttacaag

SEQ ID NO: 15772 - DNA, 524 bp, Gossypium hirsutum
  Clone ID: uC-gsflnu33B079c03b1
gtgagtcaacgggctagaaaacccgtaagaaatcgccgaagccagtccttagaagttccaccatagaacgccttgcaaccgcacggaatacttcaaaggtctcttcggctgaattgaaatcgagccagccgaaaaagccaacattgaaggaaatcagttcttcaacaactcagaaggctgctcctgctaaggataagaaatcaagcacaaacaaagccaaagcttcagatataaaaagtggtacaaataaagaacttccaagtggcgataatgcacaaggaaaaagggagtccaatgaggtcacagtagcattgccaatggaaccagcaccatccaaagcaactcaacctactgacattgttgatgatttcaaggacattcaagaattgcagactaccccaatcgaaaagaccgaaggaaatgcaactttgaaaccaaacccgtcgggggaggaccaaagctcaaatgccaaaatggttaccgttaataagccaatgcaattagatcatgtaaaaggtgatgaa

SEQ ID NO: 15773 - DNA, 388 bp, Gossypium hirsutum
  unsure (1)..(388): unsure at all n locations
  Clone ID: uC-gsflnu33B079c05b1
atcacgcgtccgggattttggcttggagaaatcggtacttgaagtgagttttcgggatttcgacttttatggcaatcggctatggaggttttgtggaggatgctgccattttcatggcacttgcagcagctgttgacctcagcattgaggcatgcaagcctttccgaagaaagataaggatagggtcccgccattctttatgaaaaaaaaaaaaagaattaaggtgatgtatttccatgaacaaagaatggctctatatttgtgttgatttgtgtaacatttggcactgtgtatagatcttgtggttgataaattcctagacataaccaannnaaaaaaaaaaaaaaaaaaaaaaaaaaaaaaaaaaaaaaaaaaaanggggcggccg

SEQ ID NO: 15774 - DNA, 473 bp, Gossypium hirsutum
  Clone ID: uC-gsflnu33B079c06b1
atggttttagactctcttctagaagtagtggatatgttgtggatgataatgataacagacctggtgatggtcgccgtgcatcttgcaaaagaaaagctcttgaaggaaacgttgggcagtcctcttcgagtggaagttctagctacttccattgtgcagaaagtagcgctgggcatggtgtttctgctagttctagtgtaggaaacggcatgaatatatctgcctcctcaggacaggcacaccctagacttggtttagaggtgggaggatcaggttctgatgccaaccctggaccaatcgttttaccagctgcaaagggctcccacaggaacttccggctaagaataagtccatcaagcatacaggaacctattgctcctccggtattttctacaggtgatatgaccaggcggttctgttatttcgtcttcacagcaatcgtcaaggctttcaactgatcattctttggacat

SEQ ID NO: 15775 - DNA, 392 bp, Gossypium hirsutum
  Clone ID: uC-gsflnu33B079c07b1
atactcaccgccagagagctcagacttcgatcatcaattttagggcttttttcctattatctcataatcagattcttgattatccaaaattctaatcttcagatcaggtcttagttttctatttgttgggctctttcgaccagctaagtttcatgtctgatcttgacatccagattcctactgcctttgatccgtttgctgatgcaaatgctgaagactctggtgccggtgccaaggagtatgtgcatattcgtattcagcagcggaatggtaggaaaagcctgaccactgtccaggggttgaaaaaaaaagaattcagctataacaaaattcttaaggacctcaagaaagagttttgttgcatggcactgtggtccaagaccctgaattag

SEQ ID NO: 15776 - DNA, 542 bp, Gossypium hirsutum
  Clone ID: uC-gsflnu33B079c09b1
ttctgtcacaaactccaccacctcaaccacctcaaactcctccaaccacagctccagctcaaccgccagcagtgccaccaccatcaccaccaccagtatctcctgcaccagcaccagcccagaaaccaccagctcctgctccagtaaagctgcccccagcacctgcacccattattttgccaccggctcctgcaccagctcccaccaagcacaagagaaggcacaggcacaggcacaggagacaccaccgtgcaccagcaccagcaccaacagttccaagccccccagcaccacctgcagtgccaactacagatgacacgacaccagcaccatcacctagtctcgatttgaatggaggagattcattgttggtggcaggaacaaagctttggtgggcaaggacaggattgactattgccattttgatcgctattacaggctatagtttctaggaactcataagataaggggtgaatgtgatttactttacaattgcttgtcataccttttttctttttggtttgatttctctgtcacataac

SEQ ID NO: 15777 - DNA, 345 bp, Gossypium hirsutum
  unsure (1)..(345): unsure at all n locations
  Clone ID: uC-gsflnu33B079c10b1
tccacgcgtccggaaaaaaaaatttaagagcctctcctctctgctggggtctccaatgcccttgacgccgactgatgagccacctcagtggttcaccgcaccaccactatggctggtggccgacgacaagcgacgacggggaggtgagtttccttcctctcttttcttattttttttattattttgaatgcaaaagaaaagaaaaaaagggaaaatgaaatacactgaaatagtaaataaataaaaacaagcagaaactcaagcaaaaagagtaaaaagaaacatcatctgaaactgttttgctcttgatgtatctcgtttataaaancgttggtttattgagat

SEQ ID NO: 15778 - DNA, 445 bp, Gossypium hirsutum
  Clone ID: uC-gsflnu33B079d01b1
atacgcgtccgcccacgcgtccgcccacgcgtgcggtttgtgggggttttgattaacaatgctgggatttcatatccttatgccaggtacttccacgaggttgatgaggagctgttggtgaatttgattaaggttaatgttgaaggtaccacaaaggtaactcaagctgttttgcctgggatggtgaagagaaagaaaggcgcaattgtgaacattgggtctggtgctgccattgtcatcccttctgatccactttatgctgtttatgctgctactaaggcgtatattgatcaattctctaggtgcctttatgttgaatacaagaacagtgggattgatgttcagtgtcaggttccattgtctgtggcaacaaaaatggcatcaatcaaaagatcatctttctttgttccatcaacagacggatatgctcgtgcagcaatgcggc

SEQ ID NO: 15779 - DNA, 196 bp, Gossypium hirsutum
  Clone ID: uC-gsflnu33B079d05b1
ctcatcgcgtccgatcatggttgggagcatctgtcctaggccttggtgagtggtttatcaagcggatgccatttgttcgtcatatctacaatgcctccaagcagatcagttccgctatatcaccagatcagaacacacaggcattcaaggaagtagccatcataaggcatcctcgaattggttaatattctagctt

SEQ ID NO: 15780 - DNA, 201 bp, Gossypium hirsutum
  Clone ID: uC-gsflnu33B079d06b1
ttatatttaggaagtacaagcaaggttatacgtgaggtttaggtggtttgactgcagtttctggttctgtgactttgtataactaagcagatgttttacttgtttgcatgtggttgaaaatttgtgttggtactgaatgttttcattacagggtgtagacatttgtgtaagagcagtgatgagatgtgtccaatattttac

SEQ ID NO: 15781 - DNA, 547 bp, Gossypium hirsutum
  Clone ID: uC-gsflnu33B079d08b1
atcacgcgtccgcccacgcgtccggccatcttttctgattacgtactggcaacatctgtggtcgtcaattctacagtgcttcatgcaaatgagcctgagaaacacgttttccatatagtgaccgataaactgaattttgctgcaatgagaatgtggtttatcttgaatgctcctgaaaaggctacagttcaggttgagaacattgatgattttaagtggttgaattcctcttactgttccgttctacgtcagctcgaatctgccagagttaaagaatattatttcaagaatcatccatcctctctctctgttgggtctgacaatctcaagtacaggaatccaaaatacttgtcgatgctgaatcaccttcgattctatcttcctgaagtgtacccaaaactccacaagatcctatttttggatgatgatattgtagttcagaaggatttgacacctctttgggatgttgatctgaatggaatggtgaatggtgcagtggagacctgtaaagggagctttcatagattcgacaagtttctcaatttca

SEQ ID NO: 15782 - DNA, 322 bp, Gossypium hirsutum
  Clone ID: uC-gsflnu33B079d09b1
gtgctttgggtcgtgggtgactgaatattgaggatacattgctactctgggcatcgtgtgatgagggatacaacgtgatatgaaagagtgtacgggactaccttggcaagaaaagtgttattgagatgttgtcatattggtctgatgagacagatgacaatgaggtcattgatatattatcctctatgatcgagaattgtgctggtgcggctgaaggtgttgttcatgatctcgcacggactaggttgtccaattcacttattggggctgcggtattgatgctgcagacataccgacagggagcggctacctcgcttattga

SEQ ID NO: 15783 - DNA, 458 bp, Gossypium hirsutum
  Clone ID: uC-gsflnu33B079d10b1
ttctgaatggagggtcagatgaagatgcattggtatcaggtgctcgccagtttaaaaccttgagtggttatgaagctgctgatgagcggaacagttgggattccttcaagcatttagttgccggcgaagaattgcgatatgatgcctcagtaaaaatgaaagctgctgatgaagcttctcagagtgtcactttgatggtatctgtggaagatactggcattgggatccctttgattgcccaggacagggttttcatgccctttatgcaggcggatagctcaacctctagaaattatggtgggactggcataggcctgagcattactaagtgtttggttgagctaatgggtggtcacataagcttcatcagcagaccacaagttggaagcacattctcattcaccacagtctttgggaggtgtaaaagagcttcatttagtgatacaaaaaaacccaat

SEQ ID NO: 15784 - DNA, 428 bp, Gossypium hirsutum
  Clone ID: uC-gsflnu33B079d11b1
tgcagatattgtcaaggttagtgatgtcgagctcgagttcctcaccggtagcaacaaagtcgacgacgaaactgccatgaaactttggcgacctaactttacactgctcttggtcacccttggtgaaaagggtagccgatactacaccaagaatttccgtggggcagtcgatgctttccatgtcaataccgtggacacaactggcgccggtgactcctttgttggtgcattgctatgcaagattgttgaaaacccaaccattcttgaggatgaagcaaaattaagggaagtgttgaaatttgcaaatgcatgtggagccatcacgacgaccaaaaagggagcaatccctgcactaccaaccgaggccgatgcccttgccttaatcaatggagcttagattttaagcaacttgaataatttgcacattg

SEQ ID NO: 15785 - DNA, 271 bp, Gossypium hirsutum
  Clone ID: uC-gsflnu33B079d12b1
ttttaatgcacatggcacacgctgttataacgaagaaacttgactctttgttgaaagaggggctggtgatgaggcaaagataactacgcgcctaagctagttgctactgtcttgagggctctcgttgtcatctgcagagaggtagacatcaggatatggcactcatactgacatggaggttatcattatgatgacatacattctggacctggaagtgttagggcttaccaatatacatatgagagcacaacgaggtgtatccagacacaat

SEQ ID NO: 15786 - DNA, 88 bp, Gossypium hirsutum
  Clone ID: uC-gsflnu33B079e01b1
ttacgcgtccggctctcttgtgttaatttgttgcatgttaaactagtcctttaatgctttggatataaatttcagatggttaagcatg

SEQ ID NO: 15787 - DNA, 51 bp, Gossypium hirsutum
  Clone ID: uC-gsflnu33B079e05b1
ttcacgccagcggccacacaggggagccaggggccagagtaagaaagggaa

SEQ ID NO: 15788 - DNA, 463 bp, Gossypium hirsutum
  Clone ID: uC-gsflnu33B079e09b1
atcacgcgtccgcaagctccctaagctaaaatatggggatgcatagtttaccctatctaattgtgttgtttttgaatttaggagcattgctcacttcactaggctgccctgaatgttaccgccacccatctccgccgccgaaatgtcctccgccagactatccgcctaaacatcatcatcctcccattgtaaagccaccctatcaccctaaaccaccaaaacatcatcctccaaagccacctaagcctccggtggtaaacccaccatatcaccctaaaccaccgaagccaccggtggtgaagccaccgtatcaccctaaaccacctccggcacaacaaacatgccccatagacactctcaagctaggtgcatgtgtggacgtgttgggtggcttagtacacatcggcataggtagcagcgccaaagacacttgctgccctgtactacaagggctgttggattt

SEQ ID NO: 15789 - DNA, 368 bp, Gossypium hirsutum
  Clone ID: uC-gsflnu33B079e12b1
tccacactaagccatatgtgcgctcaaggggccggttgtttgagagggccagaggacgaaggaacagcaaggggtttagggtttaagatgacttcagtgtttgttctgaggcttgtttttcatttattactgcaaacaaaattttgctatgcattaggtttctctggcatttgtttacttcatgttggattttgtttacttatggagtagttttctggttgacattgactattaaaaaaaaaaaaaaaaaaaaaaaaaaaaaaaaaaaaaaaaaaaaaaaaaaaaaaaaaaaaaaaaaaaaaaaaaaaaaaaaatacagccaaatttaatataaaaaatactaaatcaaaggggcgccctttttaaag

SEQ ID NO: 15790 - DNA, 399 bp, Gossypium hirsutum
  Clone ID: uC-gsflnu33B079f01b1
atcacgcgtccggtgatgggcagatcaactacgaggagttcgtcaaagtcatgatggccaagtaaaggacctctccaactataaccaggatttaaaattggggtttaaaaaaaaaggaagaaaggaacagggcagataagtttgctaagatatctattaatgaataggacatctatgtttttatgttacaagcttttgttggatggttctttgcttcatgtttgcattatttggtggaccgaaccttagtattatgcttgtttgctctgcttttttgttcagtagtgctgggttgttaacgtcaatatttttatgctttgtgctttctttcgaacaaactggaagattcgatgttatttttgctttttctgattgactaattttttaggaaaaataaag

SEQ ID NO: 15791 - DNA, 446 bp, Gossypium hirsutum
  Clone ID: uC-gsflnu33B079f02b1
ctaatctttctctaccttttccacaccccccccccccaatatggcgatttcggcgctccaaaaactcacctcccaaatccaccgtctcccatatctctcctcccaaatcctcacccgatcctccgccaccttaacctcctccccctcctcttccaaaaaagttgctgatcggctcgtcaagctcttcgccatcgaccctgaaggccagaagcgtgaggttgtcggcctcgctggccagaccttacttcgtgccttgactaacagcggcctgatcgaccccgactctcaccgcctcgaggagatcgacgcttgctccgccgaatgcgaggtcaacattgcccaagagtggctcgagaagcttccgccgcgtacctatgatgaggagtatgtgttggtgaggaattcgaggggtcgcattttgaacatgcattccaggcttggatgtc

SEQ ID NO: 15792 - DNA, 313 bp, Gossypium hirsutum
  Clone ID: uC-gsflnu33B079f03b1
ataattttttttgagaaaaaatggtgagggcaatggcattgagtggaacgtaccagtgggaagtttatgaggaggtacaggttgcctgagaatgctatgatggatcagatcaaggattgcatggaaaatggtgtgcatactgacactgtttccaaacgggacgggaaacagcccggagataaggctatcggcagtcatggctatacgaatgaacgttggattctaagcagtgtgttttaacacctgcagatcagagctcagttcctactatgctcaatctatactatacgcgtgttttcctatgtgtgtgtta

SEQ ID NO: 15793 - DNA, 492 bp, Gossypium hirsutum
  Clone ID: uC-gsflnu33B079f05b1
ctcacgcgtccgcggacgcgtgggcaacaaaaaaaatctttccagtttctattttctaaaaacaaaactgaaaatgtcttgctgcggaggaaactgtggctgcagctctggttgcaagtgtggcaatggctgtggaggatgcaagatgttccctgacataatagagaagactacaactgagactattgttcttggtgtgacaactcagaaaatgcactttgagggatctgagatgggagttggggttgagaatggatgcaagtgtggagacaactgcacttgcaacccttgcaattgtaaataagagggggggaaaatgaacaacatagagaagcagagaggcctttgtctttttaactaaataaattctattactttagtatgtatcagcaaatcttcatgaggatttggttctttattatgtgtaatgtgggcttttctgctatgtcagaatgtattatgatatttaagaaagttgttttcaattggaag

SEQ ID NO: 15794 - DNA, 201 bp, Gossypium hirsutum
  Clone ID: uC-gsflnu33B079f08b1
tccacgcgtccgcgttttctgtactcgtggatttctactatggaatgttagttttggatttcaatgctcgcacttttattgtcaatttctttgtgatttatgtgtcgattttggaatcataaacattgtgtttagctgaaaaaaaaaaaaacaaaaaaaaaaaaaaaaaaaaaaaaaagactaataaaaataaaaccgggc

SEQ ID NO: 15795 - DNA, 449 bp, Gossypium hirsutum
  Clone ID: uC-gsflnu33B079f09b1
ttgaaagcacaaccatagaagtattgtacctgttgacacactcccaagaaccttttccggctgagatagcccaatcagaatctcaattagtatattatcgtgatagtgcattgatattgtcaccatatcatattaagcaacaagcgacttttattaagacaccaagtactaaagtggaatcattcacaagggtggaacccagtaatcgtgcaggcactgaaataaagtatgggccatatgaggatcatcctccatactctttttctccaattcttatacattttgagaacaatagcccatttgctgttgttgaggagcttgttcgtgaagttgagatatctcattggggcaaccttcaggtcacagagcagtacacattggttcatgccggtgcccggcacaaaggtgtattttcaagggttgattaccaatccaggccaactttgaat

SEQ ID NO: 15796 - DNA, 469 bp, Gossypium hirsutum
  Clone ID: uC-gsflnu33B079f10b1
tgaggtactatgactatactcatccaaatggaactgtttatgaaatatggcggcaagtatcgcaaaagctacctctgatcaaacttatgattaatagagacaagcggcttgttaaaagggagttgagtgaacccaattgctcatgtctttgttctaaccagacaggaatcatcgactccttaggataaacataaacttttgctgaccctttgaagttcatttcatatgtcaaatgtctgtccaagttggaagattcgctggtggagcgtgcaggcaggcttttgaggaataatttattatgttattacacccatttcccttcgcctttaggatgtttgtcttcagctggcagagctattgaaatttgcctttgcatgaagactttcttgcatacattgctgtggagtatatttggaatttagttatagctttatttgcatttgatttgacatgttagaaatacagtacg

SEQ ID NO: 15797 - DNA, 525 bp, Gossypium hirsutum
  unsure (1)..(525): unsure at all n locations
  Clone ID: uC-gsflnu33B079f12b1
tccacgcgtccgcccacgcgtccgaaaataaagtccatgtattttctctatgttttttcaggtcatatgggaaacaaggcaggaagaagaagaagaagaagaacaagaagattcaattttcaagcagggaaaccttcggcctcggaagaagcagcagagttgctggaaagaagctgcggcagcaccaccgcaggcgccggcttaagcggatggaaaccgaactggcaaagatgaaagcggagatgagggactcggctgagtccctaatggcaggtaaagtagaagctgatcaggctaaggctaaacttcaagtgctgaagttgaagcttttggcagtgaaggaaattgaagcttttctcatgggttttctttgacttattggagtttaggaccttcatgtcctaaactccttgctaggtcacaagcaacgcctncttgacttattggagggctacaatcgattagtataatggactcgagacttaaatatgctttttctatttattagagtggtcttgggtagtt

SEQ ID NO: 15798 - DNA, 361 bp, Gossypium hirsutum
  Clone ID: uC-gsflnu33B079g02b1
ctgatgttctacaagcaggctaagaaaaccaatcaatgttgtaccatactgtaaacttgcaagagaaagcaacaatgttgtgatatgggattcgtttatgttggcctctaaagttgatgatgattgatgactgaaaacttgtgtttataatatggtttttcaagattgtttgctggtgagaattcctgatctttcccctttctgggcaatttgttgtttggatgaaaagtggaagggtaaacaactggtctcaccattggcggtgtattagatatttttttcttttctttgtactcgacttgacaaatagatcttatttcttgtttctgtggattagtatataatataatataataatttg

SEQ ID NO: 15799 - DNA, 420 bp, Gossypium hirsutum
  Clone ID: uC-gsflnu33B079g06b1
ttacgcgtccggttttattttcattaaacttgcttaatgagagaagggtgacataaatcaatcagtttcttatttgctgctggggggactgacaggtttcagtaactacaagcgatggcagtggcaaatttccctgcacttcagtttaaaacttgcgatatttttcgttccactccaaaatgtttcaaattgctccccttacaaaagacaaatctttttgttaagacattagtagttgaagcaaaggcaaataccagaacagaaagcgctaaaattaggaacagaagaatgctaaagaagtttaatggcaccccaagaagaccaagactgtcggtattctgttcagagaagcagttgtatgctatgttggtcgatgacaaaaacaagaagtgtttattttatggaagcactttgcagaaa

SEQ ID NO: 15800 - DNA, 290 bp, Gossypium hirsutum
  Clone ID: uC-gsflnu33B079g07b1
tgagctcccagcagctgctgtcaacaggcgaagaatgttggaccaaactggcgacgcctgcgcgccggcatgcatggcaagacagggaagaggactgggatcaggccgcaaactgctgttaatagaggaaaagcgctgcagccttgatgatagtcctgttgggaaccagtgtgcagagtgcactcagcctcgcgcacgaaggctgaaaacatggtgaccagatgggccgtttgctggattgtgagctctgcgttcgctagtacatctagctgatggaataaccgggaaat

SEQ ID NO: 15801 - DNA, 360 bp, Gossypium hirsutum
  Clone ID: uC-gsflnu33B079g09b1
tttggttgaaaaatattgggtctccaccagaatcagagcgtaaacgagctgaacttgatgcattagcccgacggttacaaggtattactaaatcagtgtcgaggtatccaactttcaggcgacactttgaggaatttgttaacaaactatccgaggatctctcaaaggacagtggcagcagcaacagcagcagatctagtaataggtctcatcaatcgaagaacaccgttctgcggttttttagcagcagatctttcaagcggagttcaagccaaaacatgtctgatcaagaatcacaatcagttcttgccagagatgcagaaatcgaatgatgtaggaataggatgtcgatcaagaatc

SEQ ID NO: 15802 - DNA, 429 bp, Gossypium hirsutum
  Clone ID: uC-gsflnu33B079g11b1
gtcatctgtgaataagtgaattgacatccaagcgttcctttccatttccgtatagttcaaaaacacttgagtaccttcgatcatattttagtgtcaaaaatggccgaggagcataccagtaaggcccctgagttggagagcaacgttagcggtgaaggagcagtggagagcatggaccgagggttgttcgatttcatggggaagaaagaagaggagaagcctcaagaggaggtgatcgtaaccgagtttgaaaaggttactatcgaagagacaaaggcagaggaagaaggtgaggagaagaagaagcatggtctcctggagaagcttcaccgatcagatagcagcagctccagctcttcaagcgactaggaagaaggtgaaggagaagagatgaagaagacgaaatagaaggagaagaggggctgaaag

SEQ ID NO: 15803 - DNA, 249 bp, Gossypium hirsutum
  Clone ID: uC-gsflnu33B079h01b1
ttcacgcggccgaccacgcgttcggtgatgggggagatatagagccacaacaggggcagaacttggttcagactctaaccggcaagacgatcactctggaggtcgagtgctccgacgcgatcgacagcgtgaggaccaagattcaagatacggaaggcatccctgcagaccagcaggacctgatctagaccggaaaacagctggaggacggccagacacttggccgataacaacatgcaagaggagtaa

SEQ ID NO: 15804 - DNA, 336 bp, Gossypium hirsutum
  unsure (1)..(336): unsure at all n locations
  Clone ID: uC-gsflnu33B079h02b1
gtcacgcgtccggtcgaccgaaaaccctaattttcggaggtaaggaggaaaagaagaaatggcggtgccgcttctaagtaagaaaatcgtgaagaagagggtcaagaagttcaagagaccccagagcgaccgcaaaatctccgttaagacaaactggcgtagaccaaagggtattgattctcgtgtcagaagaaagttcaagggatgtactttgatgcccaatattggctatggttcagacaagaagacccgacactatcttccaaatggctttaagaaatttgtcgtgcacaatgtcngagagcttgaactgttaatgatgcacaacaggacata

SEQ ID NO: 15805 - DNA, 453 bp, Gossypium hirsutum
  Clone ID: uC-gsflnu33B079h03b1
gtaggccaggctcaacttcccccacctcaagcaccaaggagctcatatttctggagaatttggtgactacaagcccctccattctgcagttgatgcaaagctccaagccatctgccagagcttacagaaacaagaattcaggaaaggcctgttctgttcacgattcaaagcccaaggttgagtttgattaccctgtgaagcgtgaggagtttgatcagtctccaagatttgctagtcctaaagttgagatgaactccctgtcatcatcatcatcctcatccccatccccggatttatccgatgagtcattggcaggatcttcttcaccagaatctgatatcactttcttcgatttctctgattcaaagagggatgacaacgaaattttcggtttggaaaagtacccttcagtggaaattgattgggaagccatcagggaactatctgaggctt

SEQ ID NO: 15806 - DNA, 432 bp, Gossypium hirsutum
  Clone ID: uC-gsflnu33B079h04b1
gtttctttgatttgtttctaaggatttaatctctaaaccttcttcccatttcttcattacattgttcaagaacaaacaaaaaaaaaaagaagcagaaaaacatggccaaagttctgttgttcattgctctatgtgtgcttccagctttggttagtgctacacgcattctgaataaccaattggtggttgaaggctatgtgtactgtgatacttgccgtgctggttttgaaacccctaagactagaaggctagctgatgccatggttaagctggtatgctccgacaggaagaccggcggagttgttttcgagaaggagggatataccgacaaaaccggaaaataccagattcgtgtatccgaggatcacttggatcagatctgtgatcagttcttgtgaagagcccccagcttggatgtgccacaatgtcccc

SEQ ID NO: 15807 - DNA, 514 bp, Gossypium hirsutum
  Clone ID: uC-gsflnu33B079h05b1
ttcacgcgtccggaagatttttggatctgttgaccaacatcatttccctactggatttgggtctggcataaatgcaactttccatcgaattcttgaacttcaggtcccaagtgaattcatgttaacatctgaatctagcgttgagataaattcaatcaggaccgtcaatgaagcacacagcttagattgcaatctaaatcagttccgctgcagagttgttgctgttcatgtcctggttctagagaagagcaaccggaaatgtgataacataaaatcaaatacttacaccagacctcatagtgttgacattccacttgcttgctttatattggatgatgggtcatcttcttggtgttgctgggctaatgctgaaagagcggcaacattgctgaggctgcagaacactgccaggacctctaccatgtatcatcttcaaagaattgtagaggagcatgacaggattactgtgaaaagcgctagatcaacttctgatccctttgatcaagatttcact

SEQ ID NO: 15808 - DNA, 471 bp, Gossypium hirsutum
  Clone ID: uC-gsflnu33B079h06b1
ctcacgcgtccggcagcagtggcttgacgttcccctttgttcccttcttccagaagccaaaagtttgagttaagaacaatggcttttgctgcaatgaagccgacaaaacctggtttggaggagtcccaggagcagattcacaagatcaggatcactctctcctccaagaatgtgaaaaaccttgagaaagtttgtgctgatttggttcgtggtgccaaggataagagactgagggttaaggggccagtgagaatgcccaccaaggttcttcacatcacaacaaggaagtctccctgtggtgaaggaacaaacacatgggatagatttgagctccgtgttcacaagcgagttattgatcttttcagctcccctgatgtggtcaagcagatcacatctatcaccattgaacctggtgttgaggcgggggttactattgcagattcttaaatatgccttacttatatgcttttt

SEQ ID NO: 15809 - DNA, 418 bp, Gossypium hirsutum
  Clone ID: uC-gsflnu33B079h07b1
cttacgcgtccgtccacgcgtacggtgatgtgggagacatagtgttacaacaaggcttgaacttggttcaagatatgtcaagcaagacatacaacacgtttagtggctttccggtggtagacagatggagaagctgggagaattttaaaacattaaatagcacagatgcagtggaggaccctgaaaagattaaattactggtgacagtcgaggatacacgtgtgggaattcatttgggtgatcaagatcggattttcactccttttgtgcaagctgacagttcaacttcacgacattatggtgggactggtataggattgagcatcagcgaacatctggtggaactcatgcatggggagatagggtttgtcagtgaacctgacattggcaggactttctcatttactggatcttttgc

SEQ ID NO: 15810 - DNA, 423 bp, Gossypium hirsutum
  Clone ID: uC-gsflnu33B079h10b1
ttgggtcgatatggatggtgataacctcgggcgatacgcacgcacgcctcttcccagatgactcgaaagattgctggtattttgtatttgaatgttgtattcatatatgaacatttgaataagtcagttggaaatggttttatctggtataaaataaagaccagaaaatgaaacacacaaaattaaaaaagaaatataaatcaaatccgctgcaaagttgaagctgttcatgtactggttctagagaagagcaaccggaaatgtgataacatgggggcccattcttaaagcacacctcatagtgttgacattccacttgcttgctttatattgtatgatgggtcatcttcttggtgttgctgggctaatgctgaaagagcggtgacataagctgaggctgcacaacactgacaggacctgtac

SEQ ID NO: 15811 - DNA, 455 bp, Gossypium hirsutum
  unsure (1)..(455): unsure at all n locations
  Clone ID: uC-gsflnu33B080a01b1
gcaggccccgcccccccacacccgggacgtcccacccccccgaatanatcacataaccccccccccccccacagaggggccgagaaacaacactacggccccaaaccccaaggacacccacgacatgacgaccggagcgcagcccgccggacggacagcgaaggagccacccgcagacagcacacctcgcactgcggagaacccccgagccctccgcactggcgagaaaggcgccggccgcagcggaaagcccccccactacaaaagccccaccgccccaacgcgggacccccaacacaacgagccaaggaggcgaccccaccgccggaaacggcaccggaggcgaaaccaccccccggacaaaggccgcggccaggaacagcaacaagaagcacaccggcccccgaacccacccaagggcaacgccggaccgggaaccaccgaaccccaacccc

SEQ ID NO: 15812 - DNA, 184 bp, Gossypium hirsutum
  Clone ID: uC-gsflnu33B080a03b1
acctttttatttctttcataaacactcaaatgcccaaggttcttattcaatggtgtttctcatgtcgagaatttcggtaacacaattcccacagcgagatacccacaaacatcttcttaatccagcatactaccattctatatgggatgccgcctaccagtatgcgttttcgctcactccttta

SEQ ID NO: 15813 - DNA, 209 bp, Gossypium hirsutum
  Clone ID: uC-gsflnu33B080a06b1
cccgccccgagccaccgcgaaaagggggcggcccaaaaggcgaagacccaactcacccccgacccaaggaacaaggcaccaccgaccgacccacagccggggccaacacggccacagacagaccggaggacacacgggcaccccaagccccaaaagccaagccaaaacaacaccccacgagtgaccggcctcaagagccacaagccccg

SEQ ID NO: 15814 - DNA, 293 bp, Gossypium hirsutum
  Clone ID: uC-gsflnu33B080a11b1
cggcacaaaacgggggggaacaaagaaccagaacggggaaagccccccccagccacaaccacggccagcggacacaacgagcaaaaacccacaagcaacccgcaaaaaccaggccacggcgctgcccccaacacacacggaaaccaaaacgggacgccgcgacaaagagggaccgaacgaaccaacaaaaaaccaccccgccgcccaaaaaacaaaaaaaccaaacgcaaacaccaaaaacaaacagaccaacccacacgaaccaaacacaacaccaccggggggggccgcac

SEQ ID NO: 15815 - DNA, 374 bp, Gossypium hirsutum
  Clone ID: uC-gsflnu33B080b08b1
ctacttaatttttcccaccaacaaacctagccaggggaaagttatctaaagacacgccgatacaacacacaaacgaagcgcgcgccaatagcatgatgatatcaatgagcatgacatgccgaaaggagagaccttgcctagcgaaagcaccagaaactcagcgtcatgcatggcgacataggaaggacgattacgaatttagggaccagactcgatggattgcagtccctgtggtctagacctactgggaaaccctaaacagataaggagaggaaccggcacacagacatggatgcaacattcgagatctaaagcaaattagatggcttgtgcaatcaacatgcgaaactttgcccacagagagagcatgctgg

SEQ ID NO: 15816 - DNA, 475 bp, Gossypium hirsutum
  Clone ID: uC-gsflnu33B080b09b1
cgcatcaatcttttccgcccacgcgtacgcccacgcggcctttgtaccatgatttagacagagatagcgaaccagaagtagttgatggagtgggtgctgaaacagggcatgtgataagaaccaccattggtggtcgaaatggtcaatcaaaacagaatgttagttatattgctgagcatgcagttggaactggttcttttggtgttgttttccaagcaaaatgtcgtgaaactggagaaattgttgccatcaagaaggttcttcaagataagcgctacaagaatagggagttgcagattatgcaaatgctggatcatcctaatattgtgtcccttaagcattattttttctcaaaaacagacaaggacgaactctacctcaatcttggtcttgattatgtaccagaaactgttcatcgtaccgccagaagctacagcaggatgaacacacgaatgcctttaatatttgttaaact

SEQ ID NO: 15817 - DNA, 462 bp, Gossypium hirsutum
  Clone ID: uC-gsflnu33B080c04b1
gatcgatttttctaatggctacccaggcagaacgtacaggttctacacaggggaaaccatttatacattgggagatgggctaagctactccaaaatcacccacgaattagccaaagcacctcgattagtatcaatcccattggaggaagaccatgtttgccgctcatctgaatgtaaatcagttgaagccgtcgaacaaagttgtaaaaacctagcattcgacattcatgtgagagttcaaaacagagggaaatacggcggaagccacacggtgttcttgttttcgagtcccccatcagtgcacaactcgccccataagcatttgttgggattcgagaaagtttcattaacagggaaatcagagacattggtgaggtttaaggtggatgtttgcaaggatttgagtgtggttgatgaacttggaagccgaaaagtagcattgggacaaccattgctgcatgt

SEQ ID NO: 15818 - DNA, 382 bp, Gossypium hirsutum
  Clone ID: uC-gsflnu33B080c05b1
cccctttaatatctttttctacccacccactgagagacgggaagtcttatgtgttatgaaccttttcacgcctgagactcatgtctcccgacgctagcgaaatcctccgctctgggtttatgataaattcttcacttagacgaaggactcatcttgctcaatctttctctgttgtttctctttactggctctatgtttcctcataaataaattgtcctattttaccatatatacatatatatatataataagtagctatttagcttacaatttagtctctctttttttcttttttaatggctccctctagtggaaactccatgcacaaatcaggatccgaagaggatttgcacaaccaaaggaaacggtaaaggatggaatc

SEQ ID NO: 15819 - DNA, 492 bp, Gossypium hirsutum
  Clone ID: uC-gsflnu33B080c07b1
caggcacccccccggaacccccgggacgacccacccgttcgtcacgcccccggagacggacaaaaacaggggcggtgtggaaaccagagcaccacacccacccgacgaaagacccagacgcacacccgagtcggagcacgagcccgccaggagggagacaacgcgacccgcaacggagaccgacagcgggggccacccaggcaagcggcgcgaccagaacccaggggccgaggaccaagccggacccgacgacgacccagacggcaaggtggcgagcgcaacaagcgcgaagaccaacatggtgacgggcccggggggaaaaaccacgaaaacaaaggaagccaatgaggggactgagcgcgcacaggccgcccaccggaggcgacacagaagaagcgggccacgacgccgacaaccgcaaggcccgggccaaaaaagagcagcagagcccggcaaccgcccagggagcccatggccaccagaccaagcgcc

SEQ ID NO: 15820 - DNA, 491 bp, Gossypium hirsutum
  Clone ID: uC-gsflnu33B080c09b1
tgaaacatttggtcgcaaatcaaaaaccagatggatcctttaacacaatctttgtctttggtccgaaaaatagaccaaacaaagtaccgaaattgaacccaaaaaaaaaaggcgtaaatatcactgggaaaaaagctttaacgaaaaatcatggcgtgatatgatcgagcaattactgttttctcccccgatggtcatttattccaaggggagtacgctcttgaagccgtccgtaaaggtaacgctgccgccggagttcgcggcactgatatcgtcgccctcggtgtcgagaagaaatccgccgtcaagctccaagattccagaagtgttagaaagattgtgactctggatgaacacattgctctggctcgcgcgggtttaaaagccgatgctcgagtcttgacaatagggctcgaaccgaatgtcaaagtcataggcttacagttgaggatcccgaactgtcgaaatattacacgatacattgccggttt

SEQ ID NO: 15821 - DNA, 386 bp, Gossypium hirsutum
  Clone ID: uC-gsflnu33B080c10b1
cgccccgccattaccgggtggacccacccccccttcattattttctccacggtcactctgcgcggaacgaaatcttatgcgaaacgaaatcaatcaagacagaaaccaaacgccctcaggtgcttcagaaatcactcacttttgggccgaagaagcatactggaggtagaccacaggccccgcttgccaggtcctactctcatgagtatatgcaccggttctacctttaatccgactttgtttgagcaagacccccatctttacggaccgactgctaaccagtgggtagtccggggacagcataaatgggtcttagttggtttgggatcgatatgaggctgggagcctgcaaacacagctgaggctgccttgaggaactgcccacc

SEQ ID NO: 15822 - DNA, 204 bp, Gossypium hirsutum
  Clone ID: uC-gsflnu33B080d01b1
gcaccccccgcaaggaggatacttactagcactagcagtccatcacagattccccatcttgaagaatggctagcgctaaaatcgtgttctcaatgtactctttctgctgaaagaggaaaggactcataccgcccgtagatttggaaatgcggagcgggataatgtttcaagcttaagaaaacttgcaattttcctgttatctag

SEQ ID NO: 15823 - DNA, 487 bp, Gossypium hirsutum
  Clone ID: uC-gsflnu33B080d03b1
ccctgatacataatggatcgacggaagggcaccctgagaacattgagctagacatggccaaggtggttcactactgtgctgctggctccaaaccctggaggtataccggcaaagaagacaacatggacagggaagacattaagacgctggtggctaaatggtgggagatttacgatgatgagtcgcttgactacaacaatgtcgtggcttctggccaagcagcagaagctgatgaggataagcaaagcggcctgcaactgcttttggcagctttgtcaaaggccggcggctttgttcaccgtattaacgccccttccgctgcttaatttggtgacgatacagattagtaatacaatacaatccacctaagctaaagcagtggaagaatgaatgaaaatgggttccttttcttgcttgaagtatgtatttgatctgcccttccatttttgaaatggacagatgttttatcatcaggaacataaggact

SEQ ID NO: 15824 - DNA, 404 bp, Gossypium hirsutum
  unsure (1)..(404): unsure at all n locations
  Clone ID: uC-gsflnu33B080d04b1
gataaagtttttctgtctctggaagcctacattgggctctatgctaaatagggtataccttgcttttcaattgtaatagaagtgcaaaaaccttgtgcagaccctggaatttctgattcttcaccaaagtcctagatgacatagactttgcctccaatcttgaggtggaaaagagtgccaattgcagcgccaatgaaactaaagatgtttctgatagagcttcaactcaattctcttgcaatgtgtatagtcataggcaggttcaactagttagtcctgttctcatatgtattatttattttagttttgattctaaatttttatttttactttaatttttacgacgacttgagttctaacttttggattctntcttgcttctgacttctatttttattatcttt

SEQ ID NO: 15825 - DNA, 492 bp, Gossypium hirsutum
  unsure (1)..(492): unsure at all n locations
  Clone ID: uC-gsflnu33B080d06b1
ttagngcttatttaattctacctttcctcgtgaatggcattttcagacacgtggataaatgaatataatgaagcggcgcgaattgctgatgatatcaatggcatgatatctgaaaggatttccttgcctgcgtcgggaccagaaactcagcgtcatgcatccgccataagaaggaagattacgattttagggaccagacttgatggattgcagtcccttttgtctagacctactgggaaacccttaacagataaggagatgaatcgccgcaaagacatggttgcaaattttgagatctaaagcaaatcagatggcttctgcattcaacatgtcaaactttgccaacagagagagcttgctggggccagaaactaagcaagatgccatgagtagaacaggtggcttggtaattctgggcctgctggccttcaacgacaaataatgaaagagcaagatgagggtcttgagaagttggaagagacagtaatgagt

SEQ ID NO: 15826 - DNA, 433 bp, Gossypium hirsutum
  Clone ID: uC-gsflnu33B080d08b1
taattaattggcgacggcgagtgttcgatctggtctccttcgagcagcccttcgcggcggctctcgtcctactgctcctcccacgcgtggctgcgcttcctcttctcatcacgatgatgcttatgaaaccgcaaaatgggaaaagataacatatttaggtgttgctacctgcactgttttagcgatttataacctatcaaaaggtcatccccaccatgaagagcctcctgcatacccatatttgcacattcgcaacaaggagttcccatggggtccggatggtctgtttgagagaaaggagcatcactagggatggccggatggatgcatatctttccgagttcggcgcatttttatcatttctctgagaaatcaatcagatcattctgtggatcttttgtaattttagcactcgattccccggttatggact

SEQ ID NO: 15827 - DNA, 461 bp, Gossypium hirsutum
  unsure (1)..(461): unsure at all n locations
  Clone ID: uC-gsflnu33B080d09b1
gcctcantgatttaataagctaagctagcttcgaggtaggtgtctttgagagattccatataagctaaaacatatatacaaacttgagctagctggttgaggagggtcttttttttttttctttgtcgagagtttttaagatttaagcatggaaggtcaaaggtttgttgtcaatggagggatcaaaacgcccattggttacaggttccgtcctacagatgaagagcttgtggttcattacttgaagagaaaggctttgaaccttcctttacctgcttctgtcattcctgagtttgatgtttttcagactgatccttggagtctaccaggtgatgtgaaagaaaaaaggtatttctttagcaacagatatggtaatgagagtaacaacaagaaacgtaagagagtagtagctggttctggtactggaagccaattggtaagagaaacaattttagcttttg

SEQ ID NO: 15828 - DNA, 381 bp, Gossypium hirsutum
  Clone ID: uC-gsflnu33B080d12b1
aggcgaaaacaacggggggcggtttttgagtgtgctctacgaaggttgtggcggaagcccgccaccacatgttttgggctgttggcttcgatcgtggccaaggagctgttctacggtcagaaagtggtggttgtgagatgcgaggagatctttatgtcgggaggactcgttcgacagaagatgaagtacttgagattcctccgtatacggatgaactccaagccttctcatggctccatccattttcgagctcccgccaagatcttttggcgcactgttcgcggaattgtacctcataagactaagcgtggagcatgctgcccttgctcgtttgaagcttatgagggaattccttccccatatgataagattaagaggatg

SEQ ID NO: 15829 - DNA, 443 bp, Gossypium hirsutum
  Clone ID: uC-gsflnu33B080e01b1
catgtataactattctcccactattttcccaagccacaccataagccaatttgcctgaagaggatatcaaggctctaacaaagcgaacacaagatggaggcactgaagttgtggaagcaaaggctggaaagggatcagcaacattatcaatggcctatgctggtgcaattttcgctgatgcttgccttaagggactgaatggcgttcctgacgtcgaggaatgttcatttgtacagacaactgtcactgaacttcccttctttgcttctaaggtaaggcttggaaagaatggagtggaggaagttatggggttgggtcctctttctgactatgagcaggcaggtttggagagccttaaaccagaacttaaagcatctatagagaagggaatcaagtttgccaaccagaatcaagcttatattggttgagatattcttccatta

SEQ ID NO: 15830 - DNA, 51 bp, Gossypium hirsutum
  Clone ID: uC-gsflnu33B080e02b1
tactggacgcttagccatcgcgacagcccacagccccatctattagagcac

SEQ ID NO: 15831 - DNA, 329 bp, Gossypium hirsutum
  Clone ID: uC-gsflnu33B080e04b1
tactacttttttgcccacgcgtccggagaaagaggaaagaaagaaactgattaaacagatgatggaacgagatattgaaactagaaatggtgaatcccttgacaaagcagcttgtttaggaacagaggacgttgatttaggggcagagcaatcgagtcgttcgcgtaagaagagaaagaggaaagaaaattcttttgtggagtcatcgggattgaaggaagaaccgaacttcgtaatgaatgattccgtgtcaggtagagattcaaatgtacagactccggggaataatgtttcggagagtcccttgaaaggacaatcggctgattcag

SEQ ID NO: 15832 - DNA, 459 bp, Gossypium hirsutum
  Clone ID: uC-gsflnu33B080e05b1
ccctagttgattttttttaagaaaacatttccttagagcatattttaaaagttactatcatgccgtgcgtcaatcctgaaattgagttcccagccattgagtttcgtttatcggatttgaagcgaggaactgaaggatggaaccgtttgtgcaagagggctcaagaggcttgtgagactttctgttgtttcgaggtggtctatgaaaaggtatcgactaaactccgagaggatgcctttgggttgatgaaagaaatggttgtgctcccattggagacgaaacagaagaataattgtcccatgccttaccttggttgggttggaccatgcaagccggtttctgcgccgcatgaaggctttggagctggagatgccttcaactatgactctgataaaagtttcgctcacttatgtggcctaatggtcacccacacttttctgacactattcataccctatg

SEQ ID NO: 15833 - DNA, 487 bp, Gossypium hirsutum
  Clone ID: uC-gsflnu33B080e10b1
tattttttgtctgactcggctcactttcgggtttgtcttccactctttattctcagtgccggatcagccgagaattccgcgggcgaatccctcacttgtctcataatgctctaaaatgccactttcttcgccatttaagttcttaaatgccgaagtcgaagaaaattgaagggcagagactagtgatgaaggaaagaattttaggtgacaatgaaagtgatgccgccgggggcaaagagattagaaatcttgatcacgtgctttcccaatttgtatacgagggcgatcatggtgaggaaacgggcttgaaggaacctgagattgcgcgcataaggattggaaagaggaagattggagatgtgccagtgcgaaaggttctaccatattttcaaggcaactgccaaagacagctcatgtcaattacgcaagttgtgtacaaaggttgcagtaatgaaaagctttttgaggaaggggaaaactttacaaa

SEQ ID NO: 15834 - DNA, 494 bp, Gossypium hirsutum
  Clone ID: uC-gsflnu33B080e12b1
ccctcctaattttttctgcatggccctccccatgaaaaaactcattcatcccaatggtgttctcttcacgggagctgtaacccgtcctccaaacctttcaattgtaacagaatatctccatagaggtagcttgtataggataatccaccgaccaaacaatcatttggatgagcggaggcgttcgaggatggctctcgatactgctcggggaatgaattacttgcacaattgcactccaatgatagtacaccgggatttgaagcccccgaatcttttagtagacagaaattgggttgtaaaggtctgcgattctggttcatcacggatgaagcacagcacatatctatcatcaatgtcaactgcaggaacggctgagtggacggctccggaagtactacgaaatgaaccttccgatgagaagtgtgatgtttatagcctttgagttatcttatgggagctctctaccctgcaacacccatggaaagggaatgacc

SEQ ID NO: 15835 - DNA, 177 bp, Gossypium hirsutum
  Clone ID: uC-gsflnu33B080f04b1
actcagtttttcttcaccccataataactaggaaagaatagagtgcatgatcccgcgaattactcctgaataaatttttaaaatcatattatagaaccatagcatttcgtgacgtataacttaataaattcaagttcaagatgcataaacttcacttctttacaataacaatgccct

SEQ ID NO: 15836 - DNA, 396 bp, Gossypium hirsutum
  Clone ID: uC-gsflnu33B080f08b1
actgctcactcttccgatttcgccccagaaattatagtatagcagagacaatgagaggaacattggtgttgacttggattctgatcatctgcctctcccaagtagccgtgcagagccaatactactcgaagacccgacactatgatcgcaagccagctaaggaaaccaatcttcatttctttatgcatgaacatacgggtgttacagcagtcgtggtagcccaagctaacatcacaagcaatagttcatcagtgccatttgcctccctggttgccgttaatgatcccctcaggactggtcctgagcctgactcgaaggtgattggaaatgttcaggggatcgcgctcctggctggaatgaatgcatcgagcacacaatacatagatttttggattc

SEQ ID NO: 15837 - DNA, 451 bp, Gossypium hirsutum
  Clone ID: uC-gsflnu33B080f12b1
ctactgcctttccctcatggaatcccatctcgagagacaaattgtagacgtgctccacaaatctcccaaagagatgacctctactctccctaaaaagagttgttggggccttcccgaagaccaacaccaatatcaaagtttttggttcagcccgccttttctacacggagcattgtcggctcaacaacaattccaagctcagccaactgccatcatccttcgtagctccccaagaacaggcacagcctggttaaaatccctcactttcgccactattacaagaacttcatacaatgattccaccacccctctactttccaagatgcctcatgatgttgtgcctcacatggagtctgatcatgccccgatttcctataatcgccatcttggaaatccccttttagccactcatcttcctaattctttctacccagatctataaatgactctg

SEQ ID NO: 15838 - DNA, 449 bp, Gossypium hirsutum
  unsure (1)..(449): unsure at all n locations
  Clone ID: uC-gsflnu33B080g05b1
ntttgttcatttgcagcgacgagatggctagcatgaactttatggcggatattgtgcttagctctgaagataaaaagcttccgatccaccatatccctggtccagagggtgtccgtggtcgtaattcagacaatacattgatcaaagaaaaacttggttgggcccctacaatgaggttgaaggatgggctgagaattacatatttctggatcaaggaacagattgagaaagagaaggctcaaggcattgatctatctgtttatggatcatctaaggtggtaggaacccaagcaccggtccagctcgggtcacttcgtgctgctgacggtaaagaatgaagtaaacttgctctggaaccaagctttatttatgatatagctatgctaatggcattgaatccaaaaagtatcaaccaatatcagttcaagattatttattttgtcgattta

SEQ ID NO: 15839 - DNA, 485 bp, Gossypium hirsutum
  Clone ID: uC-gsflnu33B080g07b1
cccacgcgaccgcaaggggggggtctttgacaatctttatgaacaagtaaatggcaccaaaagctgagaagaagccagctgagaagaagccagcggaggagaagaagacggtagctgagaaagcccccgctgagaagaagccaaaggcaggcaaaaagcttcccaaggaaggcggagctgcggccggagacaagaagaagaagagggtcaagaagagtactgagacctacaagatctacatcttcaaggtcttgaagcaagttcaccctgatatcggtatctcaagcaaggctatgggaatcatgaacagcttcatcaatgatatctttgaaaagcttgcccaagaatcgtctaggctcgcaaggtacaacaagaagcctaccatcacttccagggaaatccagaccgctgttaggcttgaacttcccggtgagcttgccaaacacgccgtttttgaagggacccaggccgttaccaagtttaca

SEQ ID NO: 15840 - DNA, 484 bp, Gossypium hirsutum
  Clone ID: uC-gsflnu33B080g08b1
gaccggatgtgttcctgttggagatgtgttaatgccttgcttggcggaccacgcactgagatgaaaaccggtcggcaagatagcaagagaagttaccttccagaggtagaaaataccatcctcaaccacaatgattcaatggagttggtgctttcacgctttcaatgcattgacattgacacccaaggagtagcagctctactaggagctcactccgtaggtcgagttcattgtgtaaacttagtacacagactctaccccacagttgatccgacattggaacctgactatgccgagtaccttaaagggaggtgtccgacacccgtccctgatccggaggcggttgtgttctcgagaaacgaccgggaaacgtcgatgattcttgacaatatgtactacaagaacttgttgaagcacatggggttgttggtgatcgtccagcaactgacctctgatcccactacttcccctttgtggagaaaat

SEQ ID NO: 15841 - DNA, 455 bp, Gossypium hirsutum
  Clone ID: uC-gsflnu33B080g09b1
gactattatatttcccaggagcaaaggctagtgcaagtgtattggactttgttcctccattgcacgccactgcagagcaacctgctatctttgatggaacaatcaggttgtatcaggcttatccctgcccttacgcacagcgcgcgtggatcgccaggaattgaaaggattcgcatgacaagagcaagctggttcctttgaaccttcaaaccagacctgcttggcaccaggaaaaagtctaccctggaaacaaggagccgtccttggaacataatggcaaagtcagatggggagagggttgctttgattaaatatgttgatagcaactgcgaagggccggctcttctacctgatgaagctgacaaaaaggagcaccttaagacgttgttatcacacaaggacgaatatccagggatggcgtatgctacatctaaaggagactcaacaaaggatgc

SEQ ID NO: 15842 - DNA, 300 bp, Gossypium hirsutum
  unsure (1)..(300): unsure at all n locations
  Clone ID: uC-gsflnu33B080h04b1
aatgcngcttatcgtgctccattggagcacatgacccgttttttccccattcttggttaagcctctagctgggatgaacacttttttggagttatttgtgccatgttttcgttgacattgcgaccattctctttgtttttttgtcttggatatatatatataactgagaacaagctattttaggatagacttgtcaagctaccccaaagattagctttgaatcggttcctttttatatctattttttcacttatcagaatttcagaatatatttatttactgcgcgttcttctttaaaaa

SEQ ID NO: 15843 - DNA, 321 bp, Gossypium hirsutum
  Clone ID: uC-gsflnu33B080h05b1
cctacgttttttttccataaccaacatcaaagtcgaattttttaataggtttactactgcctaccctatcacggagtagaatattgaagtcaggttcaatgagaaaggatggaccaccatggaatccaacacctacattgggtactattacaatggttacaatgaggccttgttcactgaataagggtggagaactaaggtaaaccagaatagtatcagctattacaatggtgacattgaggtcatgtttactgaaaaaggatggagtgctgaggtacaccaaatcgacttccacttttacaggggtgacaattgagttcc

SEQ ID NO: 15844 - DNA, 379 bp, Gossypium hirsutum
  unsure (1)..(379): unsure at all n locations
  Clone ID: uC-gsflnu33B080h09b1
tacacgcgtttttcaccccaanctctactgtgggatttttgaaaaacttatcaaaactttgaaaannnctcacaatctttagaacttttcaagccccgatctgcaaatctgactgttgaatcatcatggaacttcaaccatggcttctccccaccaccttcaacatcttggccgttcgaatttctgagacgatgcttgaatctcaagtactcaaaaacccgaaattgatcttagtttctgtttgcttctcatcattttatttttgtttggttctgtgttctggacttatggttttgcttgtgatgttaattattctcgacttttcctctcgcgaaatggttcagggtcaataataaaaataatagcagtttacaccccc

SEQ ID NO: 15845 - DNA, 238 bp, Gossypium hirsutum
  Clone ID: uC-gsflnu33B080h10b1
tgcctatttttcgggacaagcgcggcaaaggggggattttgaggggaattctctgtgatgcccacaaggtggctgaagtttgggggggtgatggacaggctaaagggggagtcgtaacgacggggtaaccacccaaagggccaacctggaagaccgagactacggatatccacagcactgccatggacgcgcttgggcattgggaggtcactaagaccacgaggacaggggcctcaca

SEQ ID NO: 15846 - DNA, 435 bp, Gossypium hirsutum
  unsure (1)..(435): unsure at all n locations
  Clone ID: uC-gsflnu33B081a03b1
tgcatatctctctctttgtctgtcggataattccaatggagggtcttattccttttgtttatagagcaataatccaatacaaaaatggaagacggggccatcatgttttagcaacatggttcaatgactcaccttcagcttcttacatgagactcccaactggtgattctggtcggtttcaaacatctgatacacaacaactgtttcaatcagattgtgtcaatttttcaacctcttcacctgtttcttcttctaccaccaccacttcctcttcacctctctatcgtcgtttcatcacctctcgccgtgtcgtttcataatcattacattgaatgcagtgacatgtctgaaggaagctgaagggtgtgccacttaccatacatacgggagnnttctttttcttttttcttttaatcaaatgggtgagggagaata

SEQ ID NO: 15847 - DNA, 422 bp, Gossypium hirsutum
  Clone ID: uC-gsflnu33B081a04b1
cctacgcgtccggttcgtggggcacaggggactggtggtggcaatgatggtagtagtagtggtcttgccgataatgcgcagaggtctgccggggataatcgaacggtggagaggagtttcaggatatcgcttccttggccatttagggctcgtgggtcgggttcaggatcaggcgataatgcggagaccaggcaagaagatctggattgagaactattgaaatacaacaaaaagtatcaggatttcttgtataagacatgatgatagaacagcttgtttcaaagttgggatatgcagagttatatgtaaacatgaagaactaagattagtttggtaaccttttaaggaagtgctagttttggtattttaatattacatgcccatctgattttatttttttatatatataacagatttgcttg

SEQ ID NO: 15848 - DNA, 498 bp, Gossypium hirsutum
  Clone ID: uC-gsflnu33B081a05b1
cttacgcgttcggtttcaataagattaagattgaaatagaagaatccaaattggacaaaggaaaagaagatgcatcagatgaggataaaaaatctagttctaagttttctgctcaagtaaacaccaataagaaattaacacaatcagctgagagtgaatcacctactgctgtttctaaccagaattcttccatcaaaagctcttgctaccatgctgatgatgtgacagccagatttcaagaactaaaacagcggcttaacaattctagttctgttcatactagagagcttgatgaactttcgagctccaagctttgtccggatttgggatggtgttgacctattggcaactgaagtaaaggacaactctactctaggcctgtcatcttaagactccattgtacaagggatagcctgccagacagaagatggtgaagcctctgtaatggctaggtttcaaattctgaaaaatcgcgactttgacaatttggatccaaat

SEQ ID NO: 15849 - DNA, 334 bp, Gossypium hirsutum
  Clone ID: uC-gsflnu33B081a06b1
ctgcgcgtagccggtacgggattggagtttcgggctaggcgtacgcgtacgcgttcgtaaaacactaggcatatcgatacaaatacagatacacacagagataatgaagagaagagtttgaagaataagtagagaaaaatagaaattatatttgtgaaagtacctttgttagatgtaaaactgtttttttcacaggctttgctgtgattgtttttcttttcttttctttcttttttactgtttggcttatacataaataatacctgaaactaagtgataaacatcgacttattttgtgatgttacttaatataagtttgagattttgttgtatt

SEQ ID NO: 15850 - DNA, 564 bp, Gossypium hirsutum
  Clone ID: uC-gsflnu33B081a07b1
cctacgtttccgaaaaaattccttttaaaaatttcccgacctactctaacctctcttaaaacacctccgtcgccgccagacaagcctctcgccaccacttccgacagtccgttttttggattttttgatttctgggtgaagtgcggaaagagttgctttcctaaagggtacagaaatcttaacacaaaggtgccagaactacctacaacatgtcaggcaggaaggaaacagtgttggatttggctaagtttgttgacaaaggtgttcaggtcaaactcaccggtggtagacaagtcacagggaccctaaaaggatacgaccagctactgaatcttgtcctggatgaagctgtagagtttcttcgagaccaggatgatccgttgaagactactgatcagactaggcgtcttggcttgatagtttgtaggggcacagcagtcatgctggtgtcacctaccgatggcacagatgagattgccaatcctttcatccagccagatggagcctgatctgatccgttttcaaaatatgggcattcctttgctctactacttatatattctc

SEQ ID NO: 15851 - DNA, 559 bp, Gossypium hirsutum
  Clone ID: uC-gsflnu33B081a08b1
atttattatgcagatagataggttgaactccctttttctccccttagaaccaaactttcaccgaccttcactttctgcctaccatgacggccaaggattgcggcaaccatggaaaaggccggcggcagcgcatccgaaggctcttcggttgccttctagtcttcctccttatcgttctcatcacaatccttatcatatgggcaatcctccgccccgcaaaaccccgcttcatcctccaagacaccaccgtctatgctttcaacgcctccactcccaatttcctcacttctaatttccaagtcaccgtatccacgcgaaaccccaatgacagaatcgggatttactacgacaggctcgtcatctacgccacctacaggaaccaacaaaccacccttaggacagctctccctccaacataccagggtcataatgagatcaatgtttggtcccctttcatctacgggaacatggtccctatagctcccgatttctccgtcgctttgagtccgaacaagcttgccggacgatcttcatgtgatcaagatgatggacggtgaga

SEQ ID NO: 15852 - DNA, 89 bp, Gossypium hirsutum
  Clone ID: uC-gsflnu33B081a09b1
gtttatttctcggaatgccccccctctttgtgtctttattttcaatggatgatgatgtgtaaataaaaaatcccacttgctgtttcaac

SEQ ID NO: 15853 - DNA, 97 bp, Gossypium hirsutum
  Clone ID: uC-gsflnu33B081a10b1
cttaggcgttcgttcaaacatacattcttgttgttggattatcttcattccaaacgtataaacaactcatcaaggtgcatttgaatcattaactgtg

SEQ ID NO: 15854 - DNA, 285 bp, Gossypium hirsutum
  Clone ID: uC-gsflnu33B081a11b1
tcgaatgaattcagcatctttatctgttttttgccgccggagtgagaaaaagggagatcggaaatgtcatcggagccgccaccttttcaggaagcacctcgctgcgacgtctgcaaatgcagcttcaacactttcaggcgccggcaccattgccgatgttgtggaaggacattatgccatgaacattcatctgatcaaatgcctttacctcaatttggcatactttcgtctgttcgagtttgtgcagattgttccaataactcttcaggatctgcaaaagctgac

SEQ ID NO: 15855 - DNA, 368 bp, Gossypium hirsutum
  unsure (1)..(368): unsure at all n locations
  Clone ID: uC-gsflnu33B081a12b1
cctacgcgttcgtaaaacactaggcatatcgatacaaatacagatacacacagagataatgaagagaagagtttgaagaataagtagagaaaaatanaaattatatttgcgaaagtacctttgttagagtgaaaactgactgtctcacaggcattggtggcgagggtattaaatgcgattctgacatatgcactgccagggtatgccgtagatgattatggcattttggagagacaagattgacttatagcgttaaggtacctaatctagggtggctgatctggttgggaatatttataatgtattatatattttaaacagtaagtatgggatgccaatgaatggatggtgaattgtatgtagaaaaa

SEQ ID NO: 15856 - DNA, 531 bp, Gossypium hirsutum
  unsure (1)..(531): unsure at all n locations
  Clone ID: uC-gsflnu33B081b02b1
ttggttcgtctaaacgaaactgcattggatagtaagctaaaagctgcttctcacggaaagcgattgaggacagatgatgaagtgggagtcggatctgtgcaagatatagacacgagtgaccgatttttaagagcaaataagaagtccaagagcacaactagccccctcaggtattcaccgtcagaagatggcgggtcagtattcaaagctgatgatgacaaccagaaccaacaaaacaatcaagaggattatacgaagttcactgtacaaaaacttaaacaggaactcacgaaacacaattttggcgcagagctgcttgcgctgaggaatccgaacaagaaagaaatccttgctctgtatgaaaaatgtgtactgcagaaatcatgatagttttggttttcagttgataatatgactntgtatatggaggtacacctgtaatctacttttagtttgatagagtcgagttgatgagccgagccgagctgagctaggtaaaattctaagctctctttctttataattgattaa

SEQ ID NO: 15857 - DNA, 514 bp, Gossypium hirsutum
  Clone ID: uC-gsflnu33B081b04b1
gtgccttatcgcccgatcccttcaggagcaatatctgagaatgaggttattagccaaatctggttgctactcttagggggccttggcatatctggtttactagacgtgtgggcagggcatgacttccctattgtattctaccttgctttgggaggatccttgctatcatacatatactctgctcctcctttaaagttgaaacaaaatggctggataggaaattttgctcttggagcaagctatatcagtttgccctggtgggccggtcaagcattgtttgggacacttacaccagacatagttgttctcacactcttgtacagcatagctgggttgggtatcgccattgttaatgactctaaaagtatcgaaggagacaaagctctaggattgcagacactttctgtagcctttggtgctgaaacagctaaatggatttgtgttggtgctattgacataactcaattatctatagctgggtatcttctatgggctggtgagccgtaatatgcac

SEQ ID NO: 15858 - DNA, 527 bp, Gossypium hirsutum
  Clone ID: uC-gsflnu33B081b05b1
cttacgcgtccgcccacgcgtccgcccacgcgtccgaaaccccatattatataccatcagaaaatgctagatccagcctccgatatgcttccgccgccgtcttcccccaccatctcttccgtttcctcttctgatctcgacactgagtcgacaggttcatttttccatgatagaagcactacattgggtactctaatgggtgtgagttttccggccattactttccgagcaccgtcacggcacaaccaccgcgagacgcaacccgcgagccccggttcttccacggcgaaacccaagaagaggagggcgttgacggcggctttcgggtcggagcgttcaggtagacggcggaggaagtggtggcagatttgccgggatggggattcaaagccggcttctctgggtgagtttctggagggtgagcggaggttcagtgacggagcgttttacggtgcgacggcggaactggaggagtgatggggacgggtcacgatgagaatcacgaggcgaggaatggacggtcgttg

SEQ ID NO: 15859 - DNA, 396 bp, Gossypium hirsutum
  Clone ID: uC-gsflnu33B081b06b1
attacatttattaggacgatgcagcgagttgttgttggcatcgccaagtggatcatagatcatggcttcgactttccttctcaaaatcgtggatttgttcctttcttcttcttcttttttgctttattctcctaatcaattataattggttctccccccccccctttttttaattccactttatttattttgtcggtgcactatattgaggtgtaccattcagccggaaaacaggggagggaagaaatgtcggactctgtatttctattgtaaaatgaactttgagtaccatttaacaacccgtaatagaaaattgctttatttgtaaaataaccttgcttcccccaccacagctattgttggagcacatgctggtatccgacaaaccaggggcgg

SEQ ID NO: 15860 - DNA, 483 bp, Gossypium hirsutum
  Clone ID: uC-gsflnu33B081b10b1
tcggtgtgtattgtatgatttgttgcaaaaagaggtcatagctttgaggaaagctggtcacgagaaagatctaagccttaaggataaggatgaggcaattgagatgcttgccaagaaggtggaaacattgacaaaggcaatggaagttgaggctaaaaagatgcgacgtgaagtagccactatggagaaagaggttgctgccatgcgtgtcgagaaagaacatgagaatcgggccaagcggtttggtaactccaaggggtctgctgctcagctgcttaccggaagaaacgtatctcgaagtgggttaacacgcagcactcaatgacaacaagattctaattggagctgccgcaaggacttgcataggtctcttctgtctgttctatttattatatattacctctttggtgattgattataaagatgataagtttttgtgttgatgaactcatgttcactgaaattagcgaagagaagagaaga

SEQ ID NO: 15861 - DNA, 490 bp, Gossypium hirsutum
  Clone ID: uC-gsflnu33B081b11b1
tcggattgtttaagtcataaagctttgttgtcattgttttcagctttatacaaaaaaggttcctttggatcctagtgttgactagcaagttgtagctgcattttccaatggatatgctggagctgatgtggaagctcctaatatgccagcataattaagagataaataattgttaaagaaaagatttaattttatcgaacaacataattaagttcagtacttaaatttattaatatactacacaactttctaatataaattcagtactttcaatttatcaaacagcaccttgtctcctaatagacctatgtgagtacagaaagccttatggtagcaataaacagcttcgttgtcagacatgggtaaaatctcagagatagcggatgcttgcacaaagaacttggtacttgcctgcagagttgagattttattttagtatgtatgatatgttaacattttgccttttggcctcactacttcattctcatgc

SEQ ID NO: 15862 - DNA, 235 bp, Gossypium hirsutum
  Clone ID: uC-gsflnu33B081c01b1
tgcttataccacaatgtgagttaacaagataatgaaaaattttactaaaaaaaacatgttgtaataatgtgtttaaactgagcattaaaagaactcttgaatttagagatttgatggaggctggtttttgctgcctcttccttttaattttgctcaaagtgggggaattttgaagttctattgattgtatgacaataaatcatttatgaagtaactgaaaactaggggattaact

SEQ ID NO: 15863 - DNA, 427 bp, Gossypium hirsutum
  Clone ID: uC-gsflnu33B081c03b1
cctacgcgtccgcccacgcgtccgcccacgcgtccgcttcttcttagcctcagaaatggcgaagtcaaagaaccacactgcccacaaccaatcttacaaggctcacaagaatggcatcaagaaacccaagaggcaccgccacacttccaccaaagggatggatcccaagttcttgaggaaccagaggtatgcaaggaagcacaacaagaagagcggtgagtctgccactgaagaagagtaaatttttaatggcaaaagatctagctttgattagtgttttctaattgttgtttttcccccgatggaattgagtgttcgtttactataatcaccttagttgaaatgttattttgggattgttgaatctcattttcaaaagagatttgaagctgtgagcttattaatattaagaacatgttttgagctt

SEQ ID NO: 15864 - DNA, 53 bp, Gossypium hirsutum
  Clone ID: uC-gsflnu33B081c04b1
tttcttttttttttttttttttttttttttttttttttttttctagaccgcga

SEQ ID NO: 15865 - DNA, 540 bp, Gossypium hirsutum
  Clone ID: uC-gsflnu33B081c05b1
ttttcttcttcttcaaacaagcaaaaaaacaagaggaaaaaaatgggtggagaaagaaaggtctacactttggctgaggtttctcaacacaaccatgctaaagactgttggcttgtcattgagggcaaggtatttgatgtgactaaattcttggaggaccaccctggtggtgatgatgtcttgctgtcttccacagggaaggatgcaactgatgattttgaagatgttggtcatagtagcagtgctcgagcaatgatggatgagttttatgtgggtgacatcgatacatcgaccatcccctctaagaggaagtacactcctccaaagcagcctcactacgaacaagacaagacctcagaatttgtcataaagcttctccaattccttgttcccctgctaatcttgggattggccttcggtgtccgctcctataccaaaacaccagcttcatcttaagcattgagactccccaagagataatttgaacaatcttcacaataagattatgctagtttaaatttgtttggaatttcacatact

SEQ ID NO: 15866 - DNA, 278 bp, Gossypium hirsutum
  Clone ID: uC-gsflnu33B081c06b1
gatcccttttgcacttaaggaacataataacatttccttaatttccattgtttatgtgaatttgaagcatagttgttcttccacaagcgaaaaagataaagtactatgtaaccatcccatcccatcccatccccctccccccccccctatctcagattctctgcatcaaagtaacttgagtctttatatatatcaccttttgattgtcaaatattaattactaaaatgtatcttatattagcatagggggggcacattctagaggattcaaatttagg

SEQ ID NO: 15867 - DNA, 514 bp, Gossypium hirsutum
  Clone ID: uC-gsflnu33B081c07b1
cttacgcgtgggtgaagcacctggcacgtttaccaatgttctggatgctcttaaacaagtcaggatgtctttacaacagaaaatccatacattgccactaatagagggtgcatctggaggaaaagctattgaaccttctgttcatggaagacaaattggggagagagtagagattcctgttggatgctctggactcttcagggttccaactgacttttcagcagaggcctctaaagtgaactttcggggttcaggtttgcagttaagtttggcaaactatttccccgaagcagtagttgcaccttcttctagcaaccatcttcttaccacttcttatatgaacactcagtcaagtagttctagtaactatcagccagttagtagtgatcggttttacagtaacccttacaggatgttagatcaagttattctgcagtcccaactgcatctggttacataaatgatgatcaacatttcacaggtcgatatgcagagacagggtcaagatccactc

SEQ ID NO: 15868 - DNA, 193 bp, Gossypium hirsutum
  Clone ID: uC-gsflnu33B081c11b1
tcggttgcaccaatacctggtctacccattcttccaggttcattcctctaaaatgaagtcttatccttgcaactttggatactttatttggtgtttgtatgaagagatattttatgttgatcaaattttgattgatgcactgtgacatttttatatcgttccgaatgttatattagataatacaacttgtttt

SEQ ID NO: 15869 - DNA, 484 bp, Gossypium hirsutum
  Clone ID: uC-gsflnu33B081d02b1
gcctgcacggaccgggacggactggccggaccgacccacgcgtatcatatgatggctgaacgttctttttgcagcaaaattttgagaaaagaaaggcaacgggcttttttctcttcaacttccttactatttgatgaaactcaattacagttcaaagaaagtgttaggcaatttgcacaagaaaatattgcgcctcatgcttccaaaatcgaccaatctaattctttccccaaggaggttaatttatggaagctcatgggggattttaatcttcatgggataactgccccagaggaatatggaggacttggtcttggttacttgtatcactgcatagcaatggaagaaataagccgtgcttcgtgggtcgactgggctttcctatggcgctcattctaatctgtgcatcaatcagttggtgaggaatggaaaccctgcccagaaagagaaatactcaccaaagctcatcaatggagagcatgta

SEQ ID NO: 15870 - DNA, 480 bp, Gossypium hirsutum
  unsure (1)..(480): unsure at all n locations
  Clone ID: uC-gsflnu33B081d03b1
tcggtaaaatcttatctagcatcgatgaggatcaggaaaagacaggttccgctacctttctcttccatttcaccagtacccctttcatcagatcccaactttaaccgccctccggtagcggtggtgcaactcccgctacggcagcaacaaccatccactccttgctgctttgatcctcactacccttctcaatctgatcatccgatcggccaaccactaccaacccaaccccgtgatggaacaacacatggagaacaactcacgaagaacaaacaagactacttggttttgaagactggaggagaagaagaagtggagaacaataatgataccaggtaagaactgaagggctaaaaaagtttaaattaaaaacaaaaaccaaatttcttctgttatttcataaaatcttgtattaaaaggtgaaaaaggaagaagggtcttgatcttaactttntaaaccacactaannnatgaaatata

SEQ ID NO: 15871 - DNA, 239 bp, Gossypium hirsutum
  Clone ID: uC-gsflnu33B081d04b1
gtctctctatgcacttctcttctgcctgtggcacccggtgtgcgattctgtggacccgtgattgcaactttaaatttgttgggtacagacattggccgcatattggttttgaagccaacctagactggctcttttttttttcctaaaaaaaagtcaaaactactttgatttgtattattattttctgcttaagtcggctcttaaaataccttgtatctaattaaattcctattttctat

SEQ ID NO: 15872 - DNA, 562 bp, Gossypium hirsutum
  unsure (1)..(562): unsure at all n locations
  Clone ID: uC-gsflnu33B081d05b1
cttcatcagaaatcaaaaggagtaaacctcagattccaaatcggaaaaagaaaaatggtgaagggacgccaaggggagcgagtcagactctatgtaagaagaaccatcttgggttacaagaggtcgaagtcaaaccagtatcctaacacttcattaatccaaattgagggagttaacaccaaagaggaagtagcttggtatgccggcaagcgtatggcttatatttacaaggctaaggtgaagaagaatggttcgcattatcgctgcatttggggcaaggtaactagaccgcatggtaacagtggtgtcgttcgtgctaagttcaagtctaaccttccccctaaatctatgggagatagagtcagagtcttcatgtaccccagcaacatttgagttgtctagatgcctgacggcattcgatcgatgactcaagtgactgtgcctttcaccaggttttacanactttgtcgaaatgttttggtttcagtcattttggttctttactaccatagaaactctgcttttgtcaaaatgtctcttctatctcggatttttgcgtgtt

SEQ ID NO: 15873 - DNA, 541 bp, Gossypium hirsutum
  Clone ID: uC-gsflnu33B081d07b1
tttattacgcgttcgaagaaacagagcaattgaaagagacctaaggcttgacagccgagcactcttacatggttggagccatgacttccaatgctggtgctcttccttgccgcagaggcaagcaatgctagtattatccatcttttccccaatcaattaaattggctgaaaatcagcctttttacaatctgtttgattttccccctctttccatgattcttaaaaaaaaaaattaaagcactgcctaccccaatcaaatatccatttatactatatatcccctgtcttgttttccaccccatctacctgcttcatcacatattttgacgacgtgtacaaatttacacattgtcattatatttggcttgtcctgccagctcactcatcctgtttgtcaatttgttttattttctcaacctcggcctgcttcagcttcaactcaagtaacccaaaccaaaaggaaatatatgtgttaggagcaagttgcggagcgttgtcccctttttccccaccttatgagtattttactgggtcatttgtc

SEQ ID NO: 15874 - DNA, 548 bp, Gossypium hirsutum
  Clone ID: uC-gsflnu33B081d08b1
attctacttccattcaatacaaaaaaaggcctgtgacaagtttgatccatccttttatcctcgattcaagaaatggtgcgatgactatttttacattaagcatcgaggtgaaagacgagggctcgggggaatattttttgatgatctaaatgactatgatcaagagatgcttctttcatttgccactgaatgtgcgaattctgtggttcctgcatacataccaatcatagagaaaaggaaggatacaccattcaatgagagccaaaaagcatggcaacagttgcgaaggggccgctatgtagaattcaacttggtctatgatcgaggtactacattcggactgaaaactggaggtcgaattgaaagtattcttgtttctcttcctttatctgcacgatgggaatatgatcataaaccagaagagggaagtgaagagtggaaactgttagatgcttgcatcaatcctaaggaatggatctgatacttctggtcgagtttctttcaatcctttcgaaaattcccattggttcctttattttaagatgctc

SEQ ID NO: 15875 - DNA, 84 bp, Gossypium hirsutum
  Clone ID: uC-gsflnu33B081d10b1
acactacttagattcgaattattaagatctgtttaaaaggggtgttaaaaaacctcgtatctaataaagtatctattgtctatc

SEQ ID NO: 15876 - DNA, 418 bp, Gossypium hirsutum
  Clone ID: uC-gsflnu33B081d11b1
tcgcttcaagctggaaaagccaaggcttagcacttcttcaagtagagtgttatttaatgttgcatttttataaacgccactaaaagttatgacctatagttagcaccgtttgtgagaaaagtgcagttaaaggtcagtctttagcggggtttgaggaatgcgccgctaaaggtcatggtctttagcggcgctttacccacaaacgtcgctaaaggtcatgatctttagcggcgtttatttctggaaacgccgttaaagttagcgacgctttcattagcggagttttttgcggcacttctaaagcgcggttaaaggcctaaaaagccgccgctaaaagcctattttggtgtagtgaattttccttttaaaaataagaaaagcgctttgatatggacttagtggaaggatcaaacatgct

SEQ ID NO: 15877 - DNA, 448 bp, Gossypium hirsutum
  Clone ID: uC-gsflnu33B081d12b1
tcgcctacgcgtccgcccacgcgtccgaacgctctacaatgtccaacaagctagaaggcaaggtagccataatcaccggcggagcaagcggcatcggagaagccaccgtccatcatttcgccgtccatggtgcccgtatgatcgtgatcgctgatatccaagatgaattaggccaaaaagtagtcgaagccatcggttcaaataagtgttcatacatgcaccgtgatgttaccgatgaagaacaagtaaaaaatttagtccaatcgacggttcaaaactacgggagcctcgacatcatgtttagtaacgctgggacagttagcaactcaattcaaaccgtccttgaactagacttcgcagcgtttgaccgccttttcaccgtcaatgtccgcggcatggctgcttgtgtgaaacacgccgcacgagccatggtgggaactgacgtgag

SEQ ID NO: 15878 - DNA, 438 bp, Gossypium hirsutum
  unsure (1)..(438): unsure at all n locations
  Clone ID: uC-gsflnu33B081e01b1
ttgctcacgcgtccgatttgtagctgctgttgtttctcccccgccgcctccatcccgaagccgtccccaccctccgacgacaatggtggccgccaagaagaccaagaagacccatgagagcattaacaacagattagctctcgttatgaagagtggtaaatacactttgggttacaaaactgttcttaaatctctcagaaactccaaaggtaagttgattataattgccaacaactgccctcctcttaggaagtcagagattgaatattatgccatgttgtgcaaggttggagttcaccactataatggagacaatgtcgacttaggcactgcctgcggcanatatttcagagtgtgctgcctcagcattatcgacccgggtgactctgatataattaagagcatgcccggagatcactgagcaacagctgacgacac

SEQ ID NO: 15879 - DNA, 455 bp, Gossypium hirsutum
  unsure (1)..(455): unsure at all n locations
  Clone ID: uC-gsflnu33B081e02b1
tcgcccacgcgtccgaaaccatcacagagtctcctgctaagaatcttggtcttaataactcagtctttggtaaagttaaaagcattagtttatcatcttatctcaagggtacacttcatgctactgctcccactgcttcaccagctccatctccagagccatctatttccccacatccttcttttaggcctactcatcctccagcatcatcacccaagagtcatcatccccaaccttgccgtaagtgtaaagctgcttctccatctggtaatagtcccctgcattcaccaggtcctgaaagtggtccctacccttcttttcctcctctgatttctcctgcaccctctactatagctcctcccccctgtccatactctcgccctgccactccaagatctcattctaacctaactnctcatcatncacattccacgtcacagctgtccccagatcta

SEQ ID NO: 15880 - DNA, 450 bp, Gossypium hirsutum
  unsure (1)..(450): unsure at all n locations
  Clone ID: uC-gsflnu33B081e04b1
cttacgcgtccgcccacgcgtccgcccacgcgtccgggcagatcccttgtccagtacaaccaattatggctttggccgatatgtttgagtgttgatggaataagtaaagctgtcttccttgttggagctaatgtgagtccgtccttttgttggagtcagtttgtgctgttaattagatttatgtaagggtgtcctaatgttatgtggagtctgctgaattgggatttttggttttgtagaaaccctttggtgtgtttccgttttctgtactcgtggatttctactatggaatgttagttttggatttcnaaacaaaaaaattaaaaaaaaaataaaaaaaaaaaaaaaaaaaaaaattattaaaatattaaaaaaaaaacttatatttaaaaaaataaaaatttatttgataaacttataaaaaaaaaaaaggggggggcctttttaagg

SEQ ID NO: 15881 - DNA, 569 bp, Gossypium hirsutum
  unsure (1)..(569): unsure at all n locations
  Clone ID: uC-gsflnu33B081e05b1
gtctcagtaaaaacaaactgtataaaaccatgtctgatctcgaagtttcgagctgcggttatgacaaggtactcgtggatgcagaatgtacgcatgatggatcggttaaacatatccaaaagttcgaaaattggggatggacaactcttcaacgccgtgtattggatgccgtgagaacagatagtttaactctacttcagttaaaacttctaaggaacggttttagactgctgaaagtcggggggttgctggtttacagcacttgcagtttgacagttgctcaaaacgaagacatagtagagcagttcttgaaggaaaacgcttctgcagaactacaggaaataaacgaagcagaagagtggccccgtaaaagtgggaggataccaaagacattacgatttgatcccttgacatcacagactagtggacttttcgtagctaagttcacaaaactcgccacttaattaagatttacattctggggtgcagagaatcgtctcttcgttgctgcacttcaaccttcgatctcggctnggtgtctgttcactactttggtaacactggttttt

SEQ ID NO: 15882 - DNA, 377 bp, Gossypium hirsutum
  Clone ID: uC-gsflnu33B081e07b1
tttacgtgttcgtggacgcctgggtgtgtcatatggaaagaatgatgacctggccgagcggacatattacatggatggaggaactgaggatgagattgagaaggcagatatcattgcctgggaatgcgcagcctaatcaaatccacataccttaatttctgccgagtggtttcgaaaataatgtaggtggtgttggcaatgccagcaacagacctgttcatttattttggggggcttgccttatagttaatgatgtgatctacgagtgcaaaagagcacttgggacacgctttgtcttttgtataaataacgcatatagaaagcggatgtgtacatctgttttttgtacgaaaacgctggctgctaaagccttattt

SEQ ID NO: 15883 - DNA, 476 bp, Gossypium hirsutum
  unsure (1)..(476): unsure at all n locations
  Clone ID: uC-gsflnu33B081e09b1
cgatatggggaagatcaagatcggaatcaacggatttggaaggatcgggcgtttggttgccagagttgctctccaaagtgaagatgttgagctcgttgctgttaacgatcctttcatcaccaccgattacatgacctacatgtttaagtatgacagggttcacggtcaatggaagcaccatgagcttaaggtgaaggactcaaaaacccttctctttggtgaaaagcctgtcactgttttcggcatcagaaaccctgaagaaatcccttggggtgagactggagctgattatgtcgttgagtctactggtgttttcactgacaaggacaaagctgctgcccatttgaagggtggtgcaaagaaggtaatcatctctgctcccagtaaggatgctcccatgtttggtgtgggtgtcaatgagaaggaatacangcctgaccttcacattgtatccaatgctagctgcactaccaact

SEQ ID NO: 15884 - DNA, 533 bp, Gossypium hirsutum
  Clone ID: uC-gsflnu33B081e10b1
tcggatatttcatgtacatttctttatttttctcagatttttctcactctctgcctcctttttctctccaatgttagttgaatcgatccaggaggaaaaaccattcttatcagggatggtggatggaagcaccaatttgccagtcaacctttcttgctttgagctgattaaaccaagcttggatgagaccaaccagcattgttctcttgatgtcttgcctattctactagaggaaacttcattttcagcaagagaaaaatgcagcttaaacacttcacaaggccaggatgtctatagcatttctgtcttgcctgaggaaggaaacatgaatccaaaatgcacaccacagttaacttttttgagcctcttagaagttccttttttatcaaaaaaccagatgtgcttggatgagcaattgagttgccagaactgcatcgatttgaaagtggatagtgaagatgcttattcatcgtgcattctggatataaacattgagaaagagactcccgacctactgaaatctaatgatgaaa

SEQ ID NO: 15885 - DNA, 408 bp, Gossypium hirsutum
  Clone ID: uC-gsflnu33B081e12b1
tcgctttctctttgtctctaaatccaaaatccaactaaaaaagatcataaatttatccatccatcaaaactacccaagcttttttctttttcttttttttttctgtatttgctttattgttttgtgtttcaacgtcttcaagcgcttcaagatttatcaaatgtgtaacagttggagatggagctgttggcaagacttgcatgcttatttgctatacaagtaacaagttcccgacagattacataccaacagtttttgataacttcagtgccaacgttgtagttgaaggcacaactgtgaacttaggtctttgggacacggctggacaagaggattacaacagactaaggccattgagctacaaaggtgcaaatgtctttgtcctagctttctcattagttagtcgag

SEQ ID NO: 15886 - DNA, 331 bp, Gossypium hirsutum
  Clone ID: uC-gsflnu33B081f01b1
ttggatgtatgctgtccaaggagacgggtgacatctactctacaactgagcctcagacggtattcaactctaggattgctttctgcctcaatatgcataacgatgctgtgcgtgcacttcggttcccaccaaactcccacaaggtgaaagaacgtgctgagaagaggagagaaagacaacaacaggagcaagagcttgcaacgcacattgcagaggacgatgacgacgaattttagagattgacattcgaaaagttactttatccaccatatgatggtttgatcaaagtgtgcattttcctttttaaagtgccctagtagtactagaaacg

SEQ ID NO: 15887 - DNA, 365 bp, Gossypium hirsutum
  Clone ID: uC-gsflnu33B081f03b1
cgttgctcacgcgtccgcccacgcgtacggtcttgtgacactatcgacaatgtcaaagccaagatccaagacaaggaaggcatccctcccgatcaacaacgccttatcttcgccgggaagcagcttgaagacggccgcaccttagccgactacaatatccagaaggaatccactcttcacctcgtcctccgcctgcgaggtggtgccaagaagaggaagaagaagacctacaccaagcccaagaagatcaagcacaagaagaagaaggtcaagctcgccgtgctccagttttacaagggggacgagtcgggtaaggctcaaaggctgagaaaagagtgttccaatgccgagtgtggtgctggaac

SEQ ID NO: 15888 - DNA, 541 bp, Gossypium hirsutum
  Clone ID: uC-gsflnu33B081f04b1
attgccttttggaaggatcctgaaggtcgcgtaatctccaacactacccgagatgccgccgtctcacagctcaaagccctccgtgacgacatcgcttctggcaacgctaagttcggtgaggttgcctctcgccactccgattgcagttccgctaaacgcggcggggatctcggtccttttggtcgaggccagatgcaaaagccatttgaggatgcaacatatagccttaagattggtgagataagtgacatcgtggatactgatagcggagttcacatcattatgagaacaggttgattattggtgataatacctggatatgttggcaattagttcggtgtgttggataactgtattcaagaatgttctgaaattaatgtcgatactgcctatggtcaatttgagtgatattttacacttggcaatgacattttaaatgcttggtataagttgtttggcgagggcatttaatttccgaaccattttggttgtgatttgagattatttgcttgtttataataaaagggtttgggttatattt

SEQ ID NO: 15889 - DNA, 507 bp, Gossypium hirsutum
  Clone ID: uC-gsflnu33B081f08b1
cctacgtttccgattccaacaaggaaaacttccgatcccatctccggcgacatgtttccggccgttttgactcaggtggccaccggcttaagcgttttagctggtgccgtcttagtcaaatccgtcatggatcaaaaacccatggccggtccgtttcaaagatgcccgacttgtaacggcacgggtcgcatcacgtgcatttgcactcgttggtccgatggagatatcggttgtcggacttgcgccgggtccggtcgaatggcgtgtagcagttgtggtgggtctggtaccggtagaccgattccggttcagatttctgtacgtcaaccaacgaatcggaactcttaatttaccgggtttggactctttaaactcttatatatttttataaatatattttttgaaatttaattaatgtaatataatagtgagagtaaaattaatagttgctgaattgtaatctttacaacgaaactggtttagattcttatagcttaattgttggtt

SEQ ID NO: 15890 - DNA, 521 bp, Gossypium hirsutum
  Clone ID: uC-gsflnu33B081f09b1
ctacgcgtccgcccacgcgtccgcaaattagtttgggggtttttttggaggctctgcttctaggccttgcctgtccaaaaacataataaaagaatccatttcaatcgcaacagagacggggatgttgcagctgttcttcacaattgctttctctgcagcgccgttgactctatatgtcccgcctgtgaggagcttgaatcacttcgtagagaccatggaggatctggtaagggagtcgcgggtgtatacccacaggctttacccacgtgcacgcttcgtctggtctaggctcttggattgcatgctttgcaacttgagtttagattagagtaggctgcgttgtgttgagccatctcctaaccctactttaattattagatctctttcaatgtacatatggaattttggtttcttttgcctctctggtcatgtgacaaaggctcttggtatagccaggaataaaagtcaaaagcattcttttggtggttccatatatgtttctttggggtggatatatatct

SEQ ID NO: 15891 - DNA, 469 bp, Gossypium hirsutum
  unsure (1)..(469): unsure at all n locations
  Clone ID: uC-gsflnu33B081f10b1
tcggttcaggttgttgacttcggaagttatatcgagaacggctttcggtagtaattacttggaagggaagaagattttcgacatgttgacgaaattggcgatactagttagtcgaaattatttcaaaactccgattcctggcatcagcaagatatggaaaactgcggatgaaatagaatcggagaaacttgccaatggaattcatgattgtgtgatggaaatggctaagagaagggaaaagaaagtagagacaggagaatctgacggttttggcaatgattttctaggattacttataaatgcttatcgcgatttcgacgagaaaaatcgattttccatcgaggatctagtggatgagtgcanaacattctactttgccggtcacgaaacaaccaactccttgcttgcgtggacgatcctttgtttagcaattcatactaaatggcaagaaaaacacgcaagaggtgtt

SEQ ID NO: 15892 - DNA, 490 bp, Gossypium hirsutum
  Clone ID: uC-gsflnu33B081f11b1
tcggtttggcgtcggtggtgctcctccagttcacagcggaagctatcctcccgcaggaggctatgcgagcccgttcgcatctctgttgccgtcggcatttccaccggggacagatcctaacgtcgttgcctgctttcaaatggctgatcaagatggaagtgggtttattgatgataaagagttgcaaagggcgctttcttcgtataaccaaagcttcagtttgagaactgttcgtttgctcatgtatctcttcactaatactaacaccagaaagatcggtccgaaggagttcacttcagtgttctatagtcttcagaattggagggccatctttgagagattcgatagggacaggagtggcaaaatagatgccaatgaactgagagaagcacttttgagtctcggattttcagtctctcctggtggcttggatttgcttgtctcaaagtttgatacaactgggagcaaaaacaaggccattgaatatgac

SEQ ID NO: 15893 - DNA, 252 bp, Gossypium hirsutum
  Clone ID: uC-gsflnu33B081g02b1
tcgccttcgcgtccgtccacgcgtgcccccacgtgtgagaaagctggatattatgtttactagtttcgccaaaagaaaaccgaatatatcgccgtaagacgacattactatctttgaaggcctaccgctgtcttaggggcgaaaaacagggtgggggcctaaagctgaggtaacgggtctgagcttcacgagcatttgtattacaactgtcgaacgtgcatgaactatgatagacagaggatgctccggtga

SEQ ID NO: 15894 - DNA, 325 bp, Gossypium hirsutum
  Clone ID: uC-gsflnu33B081g03b1
tcgtttacgcgtccgcttacatctctgggaataagctgaccaaggatgacataaaagtttatgccgctgttctgaagaaccctggtgattctttccccaatgttagccagtggtataattctgtttcttctcaacttgccgccagcttccctggtaaagctgttggcgttgggtttggtggcaaagctgctccagctgagtctgctaaagctgaggctgctgatgatgaggacgacttggatctatttggtgatgagaccgaggaggataagaaggctgcagaagagagggaagctgcaaagaagtcagctacgaagaaagaaag

SEQ ID NO: 15895 - DNA, 236 bp, Gossypium hirsutum
  Clone ID: uC-gsflnu33B081g04b1
ttttcctttaaatgaagaagccggctgaccgagccttggggacttgagtaattaggctcaggtcttcaacaatgagggaacaacctgtggagactattgtgggcccgctaggtacttgaatataagaaaagttggtggacactccttttacttgtataactttcctggaggtcattgatgttttagggttatggacgccatgggtaataattggcctttctggagggcgctggttt

SEQ ID NO: 15896 - DNA, 573 bp, Gossypium hirsutum
  unsure (1)..(573): unsure at all n locations
  Clone ID: uC-gsflnu33B081g05b1
ttttcgttaccgcccacgcagaccgacatcagcgacggggcactgagaagaatgcacgcagattcggcagaggacagcgttcatcaacagacaagagaacacgaagctgaattggaggcaaagcatatggaaatggaggctttggtctatgaactcaagggtgaaaacaacaccaagttgtcaacagaccgcgaaaaccttcttggatttgttacgagcctaggtgattggatcagcgagttctccggtgaagacgctaagctgatggggattttggggaggatgntgcagtcttttgacaattgcatttcagacatgaaaggtaatgatgaactttatgacactctcaaggaaaacaagaagagtcttatttcttctccagcagctagaaaacctgattctcttgttgaagaaagatcaccttttagagagctcaactagaaattattgatttcattttccttttcggcttctgtatatggataaattcgtgcatgtattatctgccagtaacagtttaccacttaagattcattggttcattnttaaataacangatagcatgtntctaat

SEQ ID NO: 15897 - DNA, 527 bp, Gossypium hirsutum
  Clone ID: uC-gsflnu33B081g07b1
atttaacatggccaaagttctgttgttcattgcactatgtgtgcttccagctttggttagtgctacacgcattctgaataatcaattggtggtagaaggctatgtgtactgtgatacttgccgtgctggttttgaaacccctaagactagaagcctagctgatgccatggttaggttggtatgctccgacaggaagagcggccaagttgtcttcaaaaaggagggatacaccgacaaaaccggaaaataccagattcgtgtatccgaggatcacttggatcagatctgtgatgcagttcttgtgaagagctcccagcttggttgtgccacaatgtcccccggtcgtgaacgtgcccgtgttatcttgaccaacttcaatggcatttcatccaccacccgttatgccaatgccatgggcttcatggttgacgagccttgagcaagctgtgctgagatgatgaagatgtatcaagaggatgaggaggatgtctagtgtgttggtttggatttatttgcatatgaaaaat

SEQ ID NO: 15898 - DNA, 539 bp, Gossypium hirsutum
  Clone ID: uC-gsflnu33B081g08b1
cttacgcttccggttctagatcgcgagccgccgccatttacttgggctggattatcttcacgggctgttgcgagtaccatgaggatgatgagtctgacgaagaatttagccctaaaaaaataggtggaattgctatatcaatggtaatgaaatatgcagacaatattgtgaaggtctattctacttcagtggcaatgcttctcactgccgttgtttcagtgtttctgttcggcttcaatcttacccttgctttcttcctcggtgctactcaggtgaccgagattccgtttaacaattttctttattgctggaacaagtcttaaccaagatcaagatcaaagtacttcacaaagttatatatgcaggcattgcaatgagaggtgatgatgatttggcattatattctcaccaggatgaattttggtttagaaattggaatactatgtgtgtctttgcgtgtgtgttgtttttatgtataaattacatattgaatcaatgttatgtataaatttaatttcattatatttatattatttttg

SEQ ID NO: 15899 - DNA, 466 bp, Gossypium hirsutum
  Clone ID: uC-gsflnu33B081g09b1
catattgtgacacaaaaacaaccacaactatttataaagcccatgtgccaacctccagattcttttaagagcataataaaaatttttataaaagccgaagcttgaacccaagacttcccagacatccctaaacacacctagctcacttaaccgacaaagcaaacatgaaatttgtgtcaaagcatgaaaaattacagaccttacatttttgaggcgtcacataatatatgaagaaattcgataaaaatcgattttctgacctaggggtaaaatggtcattttgcaaaagtctaggagaaaaatggtcatttcgcccaatttttaaagtgttgagtgcctaggttaataaaatgattaaatttgtgaattttcattattatagattaagaattacaaaatccaggcctagaccgtggaaaagtaaagcaagtagactaagctgaactagtcgtctacattttgcaat

SEQ ID NO: 15900 - DNA, 223 bp, Gossypium hirsutum
  Clone ID: uC-gsflnu33B081g10b1
ttgtttaaatagagcaagagcacacagctagagaactagaagaggcagtctttaacaattaggtcggaaattcatgatagacactatatacacattattgtgttggatatttacttgctagcctgagctgaaacttgaaactacatttacatttatactcaagatagtggtcattgatgtttttgacttataaaaaaaaaagtaacaagactaagaaatagag

SEQ ID NO: 15901 - DNA, 301 bp, Gossypium hirsutum
  Clone ID: uC-gsflnu33B081g12b1
cgcgtgcgccttcgcgtggcgcctgaaggacgcgtaatctgacgacactacccgagatgccgccgtctcacagctcaaagccctccgggacgacatcgcttgggaccgctcggtacggtgagggtgactagagtcacttggggggccggtcctttaggccgccgggggtgatctcgcccctgtggggcggggtcagttgcatgaggcggcccgaggatgcaacaccgcggcttgtgactgtatagcactgaggcggggaatccacggggggccccgggcacatcctttggagaacaggccc

SEQ ID NO: 15902 - DNA, 95 bp, Gossypium hirsutum
  Clone ID: uC-gsflnu33B081h01b1
gttttataagcgtctgaatcacattttcgaagagggttcgattccagcagacagactgttggtcgactgccgagaacgcttctaggtggcaactt

SEQ ID NO: 15903 - DNA, 388 bp, Gossypium hirsutum
  Clone ID: uC-gsflnu33B081h02b1
tcgcctacgcgtccgatttgaaaggcttataaccaaggtacatacattttgtattttttaatttcagatctaacctttttacttatttttgtaattttattattgggtccaaattatttttcaaattgatttaagcattcaactgatgtatagagttattattggcccaacattgttacttgactatacttaaatgcatgtgacctggggacgggaaatgttctaagaagaatggatttggctgagacagttgttaggaatcgtaagcaatggcgcctaaaggaaggtggtctactgtgactgtgaggtatcgctggtgtcattgtgaatccgaagggagaaatgaaaggttctgccattactggtccaattggaaggagtgtgctga

SEQ ID NO: 15904 - DNA, 499 bp, Gossypium hirsutum
  Clone ID: uC-gsflnu33B081h04b1
ccggaccggacagtgccggctccgacccatcgcgtctagctacgcgtccgaccacgcgtgcgcccacgcgtgcggttccattacccttccgtgacgcagattctgatggctgaaaaagattgctaaaagtcagggaagaagtccctaaccaagcttacatagaaggcaatccagggatcaacatttgttataacaatgtggaagatctgatctcccccaccatcaatcacatatccattccaatttgtagagtacttaaagtgcaagaacaagtaccagcatccaaatggcaacattctaacttggatttgctggtatctgaatcaatctgatgtcttcagccaatactcaaagggcattcttttttctccctgtaagtctctgttggatatgatgaagaatgtaagtttagaattccttttctttttgaagtcaaaatgtatatttgattgtctgtataatgatgggaactattgatcatcaggcacattaaaatttc

SEQ ID NO: 15905 - DNA, 337 bp, Gossypium hirsutum
  Clone ID: uC-gsflnu33B081h05b1
tcgttcacgcgtacgatggtgttgtatgaatgtctggcaaacggggatttacaccgttggttacatgagctcccaacgggggcgcccaacgtggaggattggagcaccgacacttgggatatgcacaacggaatcgggtcccatacatcttcgccggataaaacgaattggctgacccgccaccgcatcgcggttggagttgctcgtggggtggcatacctgcatcacgtatgttcgaggcatggccacctggaggcttccaatattcttttgtctgacaacctggaaccttggatatcctgattcgggataagaaacattgggtgtagaaaagaaa

SEQ ID NO: 15906 - DNA, 461 bp, Gossypium hirsutum
  Clone ID: uC-gsflnu33B081h08b1
ctgcacggtaccggtctcggaagttctccgggctcgagcccaccgcgtttcgcttataatgtcgaaacgagggcgtggaggatcagctggaaacaagttcaggatgtcgctgggtttaccagtggctgccaccgtaaactgtgcagataacaccggtgctaagaacctttatatcatttccgtgaagggaatcaagggccgcctcaaccgattgccatcggcttgtgttggagacatggtgatggctactgtcaagaaaggaaagcctgatctaaggaagaaggtcttgcctgccgtcattgtgaggcaacgtaagccttggcgccgaaaggacggtgtttacatgtactttgaagataatgctggtgtcattgtgaatccgaagggagaaatgaaaggttctgccattactggtccaattgggaaggagtgtgctgatctgtggccaagaattgcaagtg

SEQ ID NO: 15907 - DNA, 494 bp, Gossypium hirsutum
  Clone ID: uC-gsflnu33B081h09b1
cgtatgttctactacataatgagttgcccatttgctgaatccatagtgaagaacactgttaatagagctttgcaagatgacccaacgttggcagcagctttggttaggatgcatttccatgattgcttcgttgagggatgtgatggctccattctgattgactcgaccaaggacaacacagcagaaaaagactcacctggaaacttaagcttgcgaggctatgaagttattgatgatgcaaaggagcagctggaagatcagtgccctggcattgtctcctgtgctgatattgttgcaatggctgccagagatgccattttctggtcagagggacctgtgtatgatataccaaaaggaagaaaagatggaaggaggtccaagatagaagacaccataaacctgccattccccaccttcaacacctcagagctcatcagcgccttcggcaagcgaggtttcagtgctcaagaatggttgcttatctggggcacata

SEQ ID NO: 15908 - DNA, 565 bp, Gossypium hirsutum
  Clone ID: uC-gsflnu33B081h10b1
cttacgtttccggcttattatcaatgttttatctctaatttcaaaagtaataaagatgcccagatcctccattgatgctctgcaaatttccctacttcaagctaaggtattctagtatttggcctgtagttgattttaattgatttttcggaggaaggaagcagcattctgtttggttaatggggggtagtagttccaaggagggaagttggaggcagggttcttcctatcattcaaatccaccttcatgggattctcatcaggggtatcctcagacatcatatggtcaagaaaaccatagttttccgcctcaatatagctatgcagagccgcagtattatccgtattcacaaccagagccacagcagcattatccacccctgcaaccagagccacagtatcatccatctccacaagaccgtgtcggcgacaaaaagaagctacaaaggaagtattcgaaaattgcagacaattacaactgcttagatcaggtaacggaagcgcttgctattgctggtcttgaatcttctaatctaaatgttgtatcgatttcacaaagagcaac

SEQ ID NO: 15909 - DNA, 553 bp, Gossypium hirsutum
  Clone ID: uC-gsflnu33B081h11b1
gttatcttgaggggaagaatcttgctatcccttgcttttctctcgcaaaaaattctcaaacttgtttttaacgttcgctgaatactatcgctcatttcttccctcagaaccctaatcgataactgaagccatttaatcatgtttgggcgtgttccaaaaaaatctgataacactaagttttacgaagtacttggggttcccaaaagtgcaagtcaggatgaattaaagaaggcttataagaaagctgcaattaagaatcatccggataaaggtggagaccccgagaagtttaaggaactggctcatgcttatgaagtacttagtgacccagagaagagagaaatatatgatcaatatggtgaagatgctcttaaagagggaatgggagggggcggttcttctcacaacccatttgacatatttgagtcatttttcggtgggggagccttcggaggcggtggtagctcgagaggaaagaggcagaagcgaggtgaagatgtagtgcatgctctaaagtttctctggagaattgacaatgggacgacaaaaagct

SEQ ID NO: 15910 - DNA, 553 bp, Gossypium hirsutum
  unsure (1)..(553): unsure at all n locations
  Clone ID: uC-gsflnu33B082a01b1
cctacgcgtccggaatgacttgggtgaagaagatgaggaagatctcgatgacgatggagataagtcacaacatgctttagcaccggaatataaacgtttaattgctattcatgccggaaagccaaagggaggattagaagagtgtctaagggtggatcccgataaagtaagacgtcttagcatgagtgagcaacaacttgaaaatgctgcgattactcacggaaaagaaattgtcaggtttacacagcggaatattcttagggtatatccgaggggtacacgtgtcgactcttccaattacaacccattaatcggatggatgcatggagctcaaatggtcgcatttaatatgcagggtttatggaagatctttatggnttgatgcatggaaatgttcaaagccaacggnggatgcggatacttgaaaaaacccgatttcctattgaatcctaacaaagtctttgatccaaatgtcaagttaccggttaaaaaaattttgaggtaactatgtatatgnggcgagggtgtattatgatttcatcacactcatttt

SEQ ID NO: 15911 - DNA, 362 bp, Gossypium hirsutum
  Clone ID: uC-gsflnu33B082a04b1
tttgttgtattagcgcgagggataaaaactgcaggagcgtgcgactatttcctactctggctcatatccactcgagattttccttcctcttcggtagcttgaactatggctacaaccttgctactggctctggcttatgagaatgatctgattgcttacgaccttgctgatgctgctcagcaaaggagaagtactgcctctgttggcaataatgggaaagaaagttattgggtttatgatgaggatattgcagctggtttgcgtgacggtacattcctattccttctgcttagtcagatactaataacggtgacaagacggagcttatgctgtggaaaggccatgagaccaagtggatctag

SEQ ID NO: 15912 - DNA, 262 bp, Gossypium hirsutum
  Clone ID: uC-gsflnu33B082a06b1
tcgattttttttttttgtgtttttgcttcctggtgtgcagatctaaaaaaagcacatatgtaatccgaccaagatcatcaaattcaaaaggaccatctgtgtcaccttcatctcaaaaacccaaaacctggtaatctgcatcttctggaagaactcatggatttgcagaaagatccacccacttcttgcagtgctggtccagtaactgaagacatgttttattggcaagcaacaatcatgggaccctcagatagcccttatc

SEQ ID NO: 15913 - DNA, 441 bp, Gossypium hirsutum
  Clone ID: uC-gsflnu33B082a08b1
ttatatgagggaaggatataatggatcagaatgtggacccacttatgaagataaagatggtgattggatgttggtcggagatgtaccatgggagatgttcaccaattcttgcaaaaagctgaagatcatgaaaggatcagaagcaagaggcttgggttgtgtttgaaaaaaaatagcccttcagcttagggtatacaaagaagaaattacgatcccatttttttttcttctttgttgattaagcaacaaagaagattaatcttaggatgttgtccaaggcataacccaaaaaatatatattttcatgtatagttttggcatgtttctaatttccttgtggaatttgtacaaaggaaaacatattaagttcataacatgggtttcctttttttctttgtcatgtatattataaatcaaatccttcttttgcctttggtcttt

SEQ ID NO: 15914 - DNA, 516 bp, Gossypium hirsutum
  unsure (1)..(516): unsure at all n locations
  Clone ID: uC-gsflnu33B082a09b1
tttttcttaacgacgactcgaattctaaaagggaaaaaaacctacaacatgaagcccctcttctccgtcccattcttaaccttcctcttcttccatttctactcagtcccgaccctcagttcctacgtatacgacactagcgccaccaccaccaacgtcatcaactctacagatttcattcgtacaagctgctacgccaccttgtatcccgatatttgctatacttccctttatggctatgccaacgccatccaacaagacccagctcgtctagctcgtgccgccattagtgtcagcctctctaaagctcgtaacatggcagtctacgtctctaacctctcccgggaagccgattacggcgccgacccaagagccagcgcagccttgcacgactgtttctcgacatgggtgatgcagtggatgaatccgtgggtcgctgaagcaaatgcaacgggtagtggctccaggttcggagtctttcaggttccaaatggggaatgtncagacatggatgag

SEQ ID NO: 15915 - DNA, 385 bp, Gossypium hirsutum
  Clone ID: uC-gsflnu33B082a12b1
gtttcaagtgctaaaatctagggatttgcgggtggagaagacgagagcccatctctctgcttcaaagctcctgtccaggtagaattctcttcttcccttgcgttgcgttctttgctgatcaatcgccacggctacacagcggattctgtgagaccaccatgttcctccacttcgcatacacaccatttcagcccttttttcgcactacttggatacgagttctatatattacaactcattttcaacccaagcctacgaaaatatcctatatagcagagattctctccctgaaaatccccatatctatgatttctcagacatatgctcggccaccaataacttccggtcgaactggttttcatcttcttcggctttcgtcttcatg

SEQ ID NO: 15916 - DNA, 509 bp, Gossypium hirsutum
  unsure (1)..(509): unsure at all n locations
  Clone ID: uC-gsflnu33B082b01b1
attaataattcaacggccgaccgtttgtgtcgttgcggagacgtttcacatctcatttcaccagatctcaactcttccttcgccgggtttatttgttcttccttgttttttggctgttttcaataaatttcttctatttttccatggctgctccacctgcaagagctcgagccgattacgactatctcataaagctccttttgatcggcgacagcggtgtgggtaagagttgccttcttttgcgtttttcggatggctcatttactacaagttttatcacaaccattggaatcgactttaagattaggactatagagcttgatggaaaaagaatcaaactgcaaatttgggatactgctgggcaagagcggtttcggactattacaactgcttactaccgtggagccatggngcatttgctcgtctatgatgtgactgatgagtcatctttcaataacattagaaactggnattcgtatattgaacagcatgcttcggacaatgtcaac

SEQ ID NO: 15917 - DNA, 306 bp, Gossypium hirsutum
  Clone ID: uC-gsflnu33B082b03b1
cctactcgtccgccaaaacctcccaccgcgctatggtgggtgggacacaagaatgcgttgttctgcagtaggaactggcattccacaaacagaaccatgtttcatccatgttatagtttctactaagcccgtttggcatgtatgattgtgtatggcagtggtagcctaaataaagcaaacatagtttgcggtggtgtaagtttatcattaaccttggacttgttgatttgatgatgtattatgattggatgatgtaaaataccaaataatgtttgtgtattttgagctgtcaagtatatttctttt

SEQ ID NO: 15918 - DNA, 497 bp, Gossypium hirsutum
  Clone ID: uC-gsflnu33B082b04b1
cctactcgtccggaacaaacaaaaaaaaaaagaagcaaaaaaacatggccaaagttctgttgttcattgctctatgtgtgcttccagctttggttagtgctacacgcattctgaataaccaattggtggttgaaggctatgtgtactgtgatacttgccgtgctggttttgaaacccctaagactagaaggctagctgatgccatggttaagctggtatgctccgacaggaagacctgcggagttgttttcgagaaggagggatataccgacaaaaccggaaaataccagatttcgtgtatccgaggatcacttggatcagatctgtgatgcagttcttgtgaagagcccccagcttggatgtgccacaatgtcccccggtcgtgaacgtgcccgtgttatcttgaccaactccaatggcatttcatccaccacccgttatgccaatagcatgggcttcatggttgacaaggctgaagttggctgtgctgagatgat

SEQ ID NO: 15919 - DNA, 468 bp, Gossypium hirsutum
  Clone ID: uC-gsflnu33B082b06b1
ggtagatcttcgttcaaccacgcctaataaccggtcggatttttctcagacgtgaaaaaaatggggctgtctttcaccaagctattcagccggctatttgccaaaaaggagatgcgcatactgatggttgggcttgatgctgctggtaaaaccaccattctttacaagctgaagttgggagagattgtcactactattcccaccatcggtttcaatgttgagaccgttgaatacaagaacatcagcttcactgtttgggatgttggcggccaggacaagatccgaccattgtggagacactatttccaaaacacgcaaggacttattttcgtggttgatagcaatggatcgtgaccgtgtggttgaagctagagatgagttgccaggatgttgaatgaggatgagttgagggatgctgtgctgctagtatttgcaaacaagcaagatctttcaaatgctatgaatgct

SEQ ID NO: 15920 - DNA, 546 bp, Gossypium hirsutum
  unsure (1)..(546): unsure at all n locations
  Clone ID: uC-gsflnu33B082b08b1
tttaaccccagcacacagagtttgtggttggttagtggcaaccacaagacaacaatattaaattttgggttcagtttgatcagctattctgtgctgcccttcttcttcttcttcttcttcaaacaagcaaaaaaacaagaggaaaaaaatgggtggagaaagaaaggtctacactttggctgaggtttctcaacacaaccatgctaaagactgttggcttgtcattgagggcaaggtatttgatgtgactaaattcttggaggaccaccctggtggtgatgatgtcttgctgtcttccacagggaaggatgcaactgatgattttgaagatgttggtcatagtagcagtgctcgagcaatgatggatgagttttatgtgggtgacatcgatacatcgaccatcccctctaagaggaagtacactcctccaaagcagcctcactacgaacaagacaagacctcagaatttgtcatanagcttctccaattccttgttcccctgctaatcttgggattggccttcgtgtccgctcctataccaaaaca

SEQ ID NO: 15921 - DNA, 495 bp, Gossypium hirsutum
  Clone ID: uC-gsflnu33B082b10b1
tcgcctacgcgtccgcccacgcgtccgcccacgcgtccgcccacgcgtccgaagaaatcacattattctcccaaaaccatggcaagaggttcctctcactcgcaaaacaccgcttcctccaccaccacccgtcccggcgtcatggctcctcgaggttccgctgcagcgacggccggaatgcgtcgtcgcagggttaccggaggcgctgctgccacctccgcattgaccaccgtcggctccggaacgagcaacatgctccggttctacacagactatgctccgggcttgaagatctcccctaccgttgttcttgtcatgagtttttgcttcattgccttcgtcgttgctctccacgcttttggcaagatctatcgcgccaaagctggagccggagctggaccgtgaatcatgaccagaacccggtcttcgttttttttcggatctatgaggtgttcttgaatcgtaactgaataatattcgatttggtttaacttt

SEQ ID NO: 15922 - DNA, 420 bp, Gossypium hirsutum
  Clone ID: uC-gsflnu33B082b12b1
ttggtttgacgcttgcagattcgattcttgcgggctgttaattaataaaaccaaagaagcatcaaatgtcaccaatgtaaagagccaaccagaagtatgatctgatcagcggtgtatgatgtagcagctgcgtatgcaccatccgcccaccctatgttattcggattaggatgtaagtttcaaatataaatgttcgaagttatttcatgtatctggaagtttttaccttggtattcatatcaatatttgtggtgtgtaagaccaatcaagctctattttcttttgttttgctcttgcaagttgtaatcaacttaagtgcttatgatgatgcatagcttccgtatgaaataattgtgtatatagctcttaataggcttttcccccgcctcatgagagtgattattaaggggcttttattta

SEQ ID NO: 15923 - DNA, 556 bp, Gossypium hirsutum
  unsure (1)..(556): unsure at all n locations
  Clone ID: uC-gsflnu33B082c01b1
cttacgcgtccgcccacgcgtccgaagagccacgcttcttgtttcttcttcttcttcttcgcctaacaacccctttctctctcttctttgatttggttgtttctcacctttaaacgctgttgatcatcaagctctaatcagtaatcatggacgctggtgatcctagtttcaacaaagctagtaacccttatgttactgagcaagagttagaagataacgacaacgtttcatcagaaaccggcgctgagtctcctccttctaccactttcaacagcatcaaactctctcctaaaaaagggagatccatacagaaaagagttgtgtcagtgcctatcaaggatgttgaaggttcccgctntaaaggtgagagtgctccaccatccgattcttgggcttggcgaaagtacggccaaaaacccatcaaaggctctccttatcccagaggttattatcggtgtagtagctcgaagggatgcccggcaaggaaacaagtcgagaggagtcatgtggaccctaaaatgtagtgatcacgtactcctgcgaacacaatcacccc

SEQ ID NO: 15924 - DNA, 518 bp, Gossypium hirsutum
  Clone ID: uC-gsflnu33B082c04b1
ttccttttctcctttttctttttctcagacaagatgggttctcagggatcggttatggctatgcttttgctgatgatgttcactttatcatcagcttccgacatgtccattatatcctacgatgaagcccatcccgacaagtcaacgtctagttggagaacagacgacgaagttatggccatgtacgaggagtggcttgtaaagcatggaaaaacatacaacggtttgggtgagaaagagaggaggctccagatttttaaggataaccttaggttcatcgatgaacataacgccgatgagagtcacagttttaaggttggtttgaacgcgcttgctgatcttaccaacgaggagtaccgagccatctacttgggaatcaagaaacccaaccggaaagtttccaaggccagtgaccgatacgccccgcttctcggcaaaagttgcccgatccgttgattggagggaaaaagggctgtcgctgagtcaagatcaggagtttgcgagttgctggctttctc

SEQ ID NO: 15925 - DNA, 302 bp, Gossypium hirsutum
  Clone ID: uC-gsflnu33B082c05b1
aatcttaattcttaccaggtgtttgtgggattgtcttaattgattgaataacctggcgttttatgcttgcttgtatgctatagagtgtatacgaacaaattgattgtctcaaacttctatgtgcatggcatgacatgacaaattgattgaatatatcaaacagtttgttttgtcaaaaaaaagaaatataaaaaaaagaaacataaaaaaaagaaagccacctaaaaactgaagaaaacatagaacaataaaagcaatggggtggttgtaagcaccctaggactaaaaaaaaaagcgggggg

SEQ ID NO: 15926 - DNA, 451 bp, Gossypium hirsutum
  Clone ID: uC-gsflnu33B082c10b1
ttgttcactccgatcttcactggaaaaacataatcaaactgctacaaaataattctgcaccatgagctctccgggaagtggaatgtttagtggatttacaaagttatgtaagggattggctgtgatattaatcggtggccacgttgtggttcagcttcttcctacttctgttacttaccttgctcttattcccgccaggactattccttttggttggaacctcataactgctggttacattgaacaatcagtgcatggggtggttgttagcacccttggtcttcttttcatggggaagttgcttgagcctatatggggttctaaggagttcttgaagttcatcttcatagttaactttctgacgtctgattgtgttttcattactgctattgctatatactacctaacaatgcacgagaagtacctttacatgcctctttccggcttccat

SEQ ID NO: 15927 - DNA, 363 bp, Gossypium hirsutum
  Clone ID: uC-gsflnu33B082c12b1
tgttacccgagggccgacccgtatgcgagacgacggccgcgaaacacgacatgccactgcataacacctactacagcaacatactggactacgaaggggtgtggcagaggcgtgctatcatcagacacgcagggcgacaatatggaccagacgcttatgtcaagaagacatgccaagagtccaagactatgtctgtagcgaggcatcaggggccagaactctcctgtgtgcgaacaagactttaactggaacaaaggtttagagcggaacacaatgctatctgctaaacaggctctaataaaaagcctgaatacagagagagctagctgtggctatataaactgtagacctactgagtttgta

SEQ ID NO: 15928 - DNA, 173 bp, Gossypium hirsutum
  Clone ID: uC-gsflnu33B082d05b1
tttggtagacatatgtggttttgagtatatttgcccaatgtgttgggaaaatttttgggcttcattgcgccgattttaagaaaaccggatcgaatgttgaaatgatttgcactatgaggtctttttatgattgttcgaaatttttaatgcccaaagcttggattattttcgtc

SEQ ID NO: 15929 - DNA, 507 bp, Gossypium hirsutum
  Clone ID: uC-gsflnu33B082d06b1
cccacgcgtccgcccacgcgtccgggagagcctttttttttgtgtagcgattctcagttagtcttttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaaccgtggtatcaccattgatattgcccttgggaagtttgagaccaccaaatactattgcaccgttattgatgcacctggacaccgtgactttatcaagaacatgataaccggtacctcacaggctgactgtgctgttctcattattgactcaacactggtggttttgagctggtatctctaaagatggtcagactcgtgagca

SEQ ID NO: 15930 - DNA, 448 bp, Gossypium hirsutum
  Clone ID: uC-gsflnu33B082d07b1
tgttttgatgaaagatctggtcggcggatatgacgatgctggagatgctatcaagtttaactttcctgcatctttttcaatgactatgttgagctggagtgtcatcgaatacagtgctaaatacgaggctgccggcgagctcaatcatgttaaagagatcatcaaatggggtactgattatcttctgaagaccttcaacaatactgctgataccattgacaggattgcagcgcaggtagggataggagatacatctggaggagtttcagccccaaatgatcattattgctggatgcgccctgaggacattgattacccccgtcctgtatatgaatgtcatagttgctccgatcttgctgctgaaatggctgctgctttggcttcggcttccatcggtttcaaagacaacaaagcatactctcaaaggcttgtcatggtgccccgacac

SEQ ID NO: 15931 - DNA, 513 bp, Gossypium hirsutum
  unsure (1)..(513): unsure at all n locations
  Clone ID: uC-gsflnu33B082d10b1
accaacccaccaccatcaccaccaccctcaccctcaccctcacccccatcctcatccacccactaagcccccaacccccactcctcctccagttcatccaccacccaaggcgccagtgcaaccaccaaccaagccaccagttcacccaccacccaagccaccagttcaacctccaactaagccaccaaccaaacctccaactcaacccccgactaagccaccaactcagcccccgactaagccaccaaccaagcctccaactcagcccccgacgaagccaccaacacacccaccatctcatcctccggccaagccacctaaatcgagccaggtggcagtgcaggccgttgtttattgcaagtcatgcaagtacgccngagtcgacacccttttgggagctaaaccaattctagtgccaccgtaaggctgacatgcaaagacgctaaaacgaattaacgttcagttcagactgacaagatgggtatttcttctgcagcaccaataccattacaa

SEQ ID NO: 15932 - DNA, 344 bp, Gossypium hirsutum
  Clone ID: uC-gsflnu33B082d12b1
ttgtaaacatgtgtagtttcgagaatttaagcaatgtggaagtgaataaaagtggagatcaccgtgagggaactccagtggtgattgaaaacaagatgtatttccgaaaaggtaaggttggggattgggagaattatttgacacctgaaatggctgttcggttggactcgataacgttgcagaagctaaatggttcaggcttaactctatgattgaataataaagcagccatggggtacaaaaaaaaaaaaaataaaaaaagaaaaaaaaaagaaaataaaaaaaaaaaaaaaaaaaaaaaagaaacagaataaaagaagaaaatgaaaaagatttaaaaatcg

SEQ ID NO: 15933 - DNA, 472 bp, Gossypium hirsutum
  unsure (1)..(472): unsure at all n locations
  Clone ID: uC-gsflnu33B082e01b1
cttattttctctctacatacattaattcagtttgttaatggcttctcgtcttctcagttttggccccaccggaatccacgcttccgccgtttctgatcatgaccgccgganaagtacttcgtcgtcttcctatgctaactggtgggctccactttttcgagtttcatctgagccggattacataggatccgataagaaatcggaggtcacggagagaagagagggcggatcggaagcggatccgcggctaaatatggcgagatcgaagttttaccccggttgctttacggagaagaaggcgaagcagctccgattgatgattaccaactcgtcgtcgtttcatgacgttatgtaccactcggcgatagcttctcgactcgcctctgacttcaaaggtcgatccgatctatgagtgtcaggcaagtaactgaaagtcagacctaattaaacccaggttncggtaaattttttt

SEQ ID NO: 15934 - DNA, 412 bp, Gossypium hirsutum
  Clone ID: uC-gsflnu33B082e03b1
gatacttgacaaaaaagaaagtaaaggacaaaccaggatcatggagcgtaaaacaagagttgtattgcgggactatctttatggcgggataagaaagaaccacacgaggaagaaagcaaccttttgtgcatgtgctaaacccccaacgaaaggagattgagccaattacttatcagcggcacaaaatcagtgcagttttctggtactgagattttagttgcgttgtccataaatctgccttcctaagtttttgtttcacataattattttcttttagaggtcatcttcttctttagtttagacatcctgctgtatatttcaggcaccatctaatctaaagaagctgtaactttgtagcctaaaacttcccttctctgtacgtttaacttggcataaatatggatttcgttgg

SEQ ID NO: 15935 - DNA, 411 bp, Gossypium hirsutum
  Clone ID: uC-gsflnu33B082e04b1
tttattcgttcgagcaaatgaaggaaaggaagagccgggctaagaagatccgaggagtaaaaaagaccaaggccagtgaagcagcaaagaagaagtgagataaaaggatttgaaaaagaagaggtgaagttgatgctgtaacttagagccaatgttttccaacacgagtgtccaggtgttcttcaatctgttttgtttttgaaaaaaaaaaaaactggattttggtgttcatctgatgtttaatattatttatgcagcagattttgatatatttagtgagtgtaatactttgttatttccattgaagttcccttcctttattttgccatttagcttcttctttttccttctaaaatattagaaaaagacatttaattatttttttctatataaatactagacttttaagtt

SEQ ID NO: 15936 - DNA, 485 bp, Gossypium hirsutum
  unsure (1)..(485): unsure at all n locations
  Clone ID: uC-gsflnu33B082e05b1
gatggtgcgcctgctggtggcgccgcggactaattggcgcgaccgcacgcgtccgcttactcgtccggaacccccaaagaagcgaggtcgaaaatcgttgagtgcaaagaaggaaaacaaggaaacagaggctgttcccgaaaaatccgaaggtgagaaagaaaatgaaaaggaagatgcaccaaccactgaaaaggaaactgctgaagctgaaagagaaaaagatacttgcattgaaactcaggttcaggatggaggtaaaacagaagtggcagaccagactgggcatgctgacaccaagatggaggaagctggtacagatgttaaggtaccagaaactgcagaggctggcaaaaaagaagaggctgctggtaccgaagaaacaccaactgcatgggaggttcaagagaaacctgcagaagctagttgcatagatgggactcanactgncaaagaagaggaagcctctactgaaaaggtgccac

SEQ ID NO: 15937 - DNA, 535 bp, Gossypium hirsutum
  Clone ID: uC-gsflnu33B082e06b1
attgaagccctaaattttctcagcctttcttggtctttccctcgctttctcgggaaaaaaaatggcaaacgcggcttcaggaatggctgtgcatgatgattgcaagctgaagtttttagaactgaaggctaaaaggacttaccgcttcatagttttcaagattgaagaaaaacaaaagcaagttgttgtggaaaaggttggtgaacctactgatagctatgaggctttcactgctagccttccagccgatgagtgtcgatacgctgtgtatgactttgattttgtgaccgatgagaactgccagaagagcagaatttttttcattgcctggtctcctgatacatcaaaagtaagaagcaagatgatctatgcgagctcaaaggacaggttcaaaagggaattggatggcatccaggtagagttgcaagctaccgatccttccgagatggatctcgatgtcataaggagccgtgccaattgaaatgtatgtaccatttcttcattgaaatggaactttatactatgtggttcacat

SEQ ID NO: 15938 - DNA, 470 bp, Gossypium hirsutum
  Clone ID: uC-gsflnu33B082e07b1
ttttatgatgacattccaaaagaaattccagatcctgatgctaagaagcctgaagattgggatgatgaagaagatggtgaatggataccttcaactattcccaatcctgaatacaagggcccatggaatccaaagaaaatcaagaaccccaactacaagggcaagtggaaggcaccaatgattgacaaccctgatttcaaggatgatccggatctctatgttttccccagcttgaagtatgttggtattgagttgtggcaggtgaaatcgggaacaatgtttgataacatcttagtcgctgatgatgtagagtatgccaagaaactagctgaagaaacatggggcaagcagaaggatgctgagaaggcagcatttgaggaggaagagaagaagaaagaggaagaggaatcgaaggatgagccagttgattccgatgctgaggacgacgatgatgatactgatgatggtga

SEQ ID NO: 15939 - DNA, 552 bp, Gossypium hirsutum
  unsure (1)..(552): unsure at all n locations
  Clone ID: uC-gsflnu33B082e08b1
ggaatatttacaaggctttggcaatgcctcaggaggctattgtctgttatcagcgagctgttcagactcggcctaactatccagtagctttggggaatctggctagtacatactatgagcgaggacagctggatttggcaatccaccattataagcaagctattgcctatgatcaaagatttgtggaagcttacaacaatttgggaaatgcattgaaagatgtgggtcgtgttgatgaggcaattcaatgctataatcaatgtctcacattgcaacccaaccatccgcaagcacttaccaacttagggaacatatatatggaatggaacatggttggtgctgctgcttcttactataaggctacattgactgtgacgacggggttgtctgctccattcaataaccttgctgtaatctataaacaacagggaaatcacatggaagctataacttgttacaatgaggttttacggattgatccattggcagctgatggacttgtaaataggggtaacactttacaggagatnggtagagtgagtgaagcaattc

SEQ ID NO: 15940 - DNA, 519 bp, Gossypium hirsutum
  Clone ID: uC-gsflnu33B082e11b1
ttcacgcgtccggcaagatgctggtgacatctatcatcatacacactattttagaggtcatagtcatactgatacacaaagcagccagatagagaatgatgaggtcattgctcgtacccttcaggaagaattctcgcatcttgctgtggcagaagcttccgaattttctcatgctggggaagagcagtcgcaagcatcctgtgaacctcatgattggcttactccttcaacaacagactactgttattcaggctatgaatatggccgggatgaatccgatgatttggtgccacatagttcatgctctagttctagccccagtgattcagaggatttttctggctctttggagctgactgagggttatttacttgatgatgaagtaggcaagaggttgaatcaaatggttcctattcctcatgtccctcgaatcaatggcgaaataccatcaattgatgaagcaatgtctgatcatgagaggttgttaagcagattgcaggtatatggtttcatggagct

SEQ ID NO: 15941 - DNA, 500 bp, Gossypium hirsutum
  Clone ID: uC-gsflnu33B082f01b1
cttttgggcacatcaatggcttgtccccatgttggcgggttggccgcattgttgaaggcggctcaccccgaatggagccccgcggccataaaatccgctttgatgacctctgcttatacagtcgacaaccgtggcgaaaccatgctcgatgaatccaatgggaatacttccaccgtgttagattttggatccggtcacgttcacccctctaaagctatggatccaggactggtttacgatatcaccacaatggattacatagatttcttatgcaattccaattacacgatcaacaacatccgagtactcaccaggaagaatgccgattgcagcggcgcaaaacgagccggccatgttgggaacctgaattacccatcactcttccgccgttttcaacagtatggcaggcgtaacatgtctacacatttcatcagacgagtcactaatgtcggtgaactcgattcgatctttaaagtacaattcgaccaccgagcggcacg

SEQ ID NO: 15942 - DNA, 525 bp, Gossypium hirsutum
  unsure (1)..(525): unsure at all n locations
  Clone ID: uC-gsflnu33B082f02b1
ctttctcgtccgggaaacaaggagggttgttgggaagtttaatgcccaaggaagagtatttttctaaagctttatacacatttgacattggccaaaacgatcttggagaagggttcttttcaaacttgactgtacaagaagtcaatgcttctattcctgatataatcaacaagttctcagcaaatattaagaatatatacaatttaggagcaagattcttttgggttcacaacactggaccaatcggttgtttgccttatgttttggttgcatttgcctcaactgaaaaggaccctgctggttgtttaaagccttacaatgaagtggctcagtatttcaatctgaagctaaaggaatcaatagctcaacttagaaatgaattcccttcagctgcatttacatatgtagacatctattctgtgaagtattctctgtttgctgaaccccaaaaacatgggtttgaacttncacttgtgacatgttgtggctatggaggtgagtacaactacagtgctgcagttctat

SEQ ID NO: 15943 - DNA, 544 bp, Gossypium hirsutum
  Clone ID: uC-gsflnu33B082f03b1
gacaaagtagcgtatgcactttctcaaggcttggaggttattgcctgcattggggagactcttgaagagcgagaatctggctctaccatggctgttgttgctgcacaaaccaaagcaattgctggaaaagtaacaaattgggacaatgttgttttggcttatgaacctgtttgggccattggaacagggaaagttgcaacccctgctcaggctcaggaagttcattgcgagttgaggaaatggcttcatgagaatgttggcggtgacattgctgcatcaactagaattatatatggaggttccgtaaatggagcaaactgcaaggaattggccgcacaacccgatgttgatggctttttggttggtggagcttccctaaagcccgagtttgttgatatcatcaaggccgcgatggtgaaaaagaattagaagttgaaaagcaagaattaaaggtgaaacagaaacaaccttctgggaaactttaatttttgtagttgagatctttccttgaacctaatgtctgttgaaatttccgatgaataag

SEQ ID NO: 15944 - DNA, 339 bp, Gossypium hirsutum
  Clone ID: uC-gsflnu33B082f04b1
cttactcgtccgggcgggaacctataacaggacgcgataagcttagccaccgagccagtctcaaactacattttagggtggcttcacaagacagcaggcagctcagtgccaacacaaggagtatagggatggtgccggggcccatgatgactgctttcccaatctcaaaattggctccactgagcatggtcatattgctagactagcattaggacacctaactttactggggcattgagacttggaccatatgtgcaacccttgaggatcagatacacatttgtagattaagaaccctaagaggccctcaatatattacggcagttggattggaattag

SEQ ID NO: 15945 - DNA, 514 bp, Gossypium hirsutum
  Clone ID: uC-gsflnu33B082f05b1
ctgactcgtgggttgatgtcctggttcatggagagcctgagagaaatgatatggttgagtactttggtgagcaattatctggttttgctttcactgttaacggatgggttcaatcttatgggtctcgctgcgtcaagccaccaatcatctacggtgatgttagccgccccaaaccaatgaccgttttctggtcatctactgcccaaagtatgactaaacgcccaatgaagggaatgcttactggccctgtcaccattctcaactggtcctttgtcagaaatgatcaaccgagattcgaaacttgctaccagattgccttggccatcaaggatgaagtggaggatcttgagaaggctggtatcaatgttatccaaatcgatgaggctgctttgagagaaaggttgcctcttaggaagtccgagcatgccttctacaaaagtgggctgatcactccttcagaatcaccaactgtggtgttcaagacattacccagatccacacccacatgtgctac

SEQ ID NO: 15946 - DNA, 538 bp, Gossypium hirsutum
  unsure (1)..(538): unsure at all n locations
  Clone ID: uC-gsflnu33B082f06b1
gtaatttttatcctaatatttgcggcaacagcgggacctatagtgaaccaaaagtattcgggagccgaaacattgctcggaaacgccacatgcgcaggcctggctgtgatgataataattttatccaccggacacatatctggggctcatcttaacccttccctcaccattgcatttgctgcctgccgtcacttcccctggactcaggttccagcctacatagcagctcaagtttcggcctctatttgcgcttctttcgctctaaagggggtcttccatcccttcatgtctggtggcgttactgtcccctccgtcagccatggacaagctttcgcactcgagttcctcattacttttaatcttctcttcgtcgtcaccgccgttgccaccgacacccgtgccgtgggagagctggctggatagctgttggggcgactgtaatgctcaacattcttgttgctgggccaagtagtgggggttcaatgaatcctgtgaggacactggnngccgctgtagcagcagggaattatagggcatt

SEQ ID NO: 15947 - DNA, 529 bp, Gossypium hirsutum
  unsure (1)..(529): unsure at all n locations
  Clone ID: uC-gsflnu33B082f08b1
ttccacgcgtccgataatttgttctgcattggtcctgtgctcttccttgacatatgggcaaacggctagtccaccggctccggtggcaatgaccccaactccgacacctgcaccggctccggcaccagaatacgtaaacctaacctatttactctctgtggctggtccatttcacactttccttaactaccttgaatcaactaaagtgattgacaccttccaaagccaagccaacaacactgaacaaggcattacaattttcgtaccgaaagacgattcgttcaagggtcttaagaagccgtcattgtccaatctcagtgatgatcagcttaaatcgctcatccttttccatgccttgcccaaatactatgcccttgccgacttcaattacctcagtacaaaaggccctatcactacacttgctggtggccaatacactttgaatttcaccgatgactccggcaccgtgcacctcgattcaggatggagcanaacaaaagtatccagcgctgtacattcgaccgatccc

SEQ ID NO: 15948 - DNA, 438 bp, Gossypium hirsutum
  Clone ID: uC-gsflnu33B082f09b1
ttctacgcgtccgggggaggtgagtgcttgagctgcatatcttttacttgggctattattttcatatcaacatcgtgtttatttcatcaatgttattacttggagaaatgaagtattctttttcattctttttgcaggtccagacaatcaaacaaggatatttgttgaaacgttctagttcgaggggagattggaaaagaaggttctttgtacttgatagtcgaggaagtttatactattatagaaataagggtatcaaaccaatggtatgtgttaacattttattattatccttgattgatcatgtctagtaatataacttggagcattttgtcctttaactatgattatgggtgaaggggaggtatgcctgtacctagttagctttgatgctagctaatttatggttttgacacaattgatgatgcattgcagtgg

SEQ ID NO: 15949 - DNA, 517 bp, Gossypium hirsutum
  unsure (1)..(517): unsure at all n locations
  Clone ID: uC-gsflnu33B082f10b1
tttattataagcacctccccataagcaaaccagcaaaggaaagcttggagagagacccaaaaacaatgtctaaggaagtgagtgaagaaggacagggtcgtaaggactatgtggaccctccaccggcacctctgattgatatggctgaactcaagtcatggtctttttacagagccctcatagctgagttcatagccactctcctcttcctctatgtcactgttgctaccgtaattggtcacaagaaacaacaagatgcatgtgatggtgttggtctcttgggtattgcatgggctttcggtggcatgatctttatccttgtttactgcactgccggtatctcaggtggacacattaaccctgcggtgacttttgngttgtttttggcccgtaaagtatctctcatcagggctgtggcttacatggtgtcacagtgcttgggtgctatatgtggagttgggttggttaaagctttcatgaagcatccatacaactcccttggcgtggtgcaaacacg

SEQ ID NO: 15950 - DNA, 478 bp, Gossypium hirsutum
  Clone ID: uC-gsflnu33B082f12b1
tttatatagtggggtagcatcaatattgatatgggtgaagaggtgaaggtttttggagcatgggcaagcccttttagccgtaaggtagagctggctttgcggaagagaggtgttccatatgactacatagaagaagacttgaataacaggagctctttgcttttgcaatacaacatcggttcataagaaagtcccagttcttcttcacaacgggaaatcaattgcagagtcgattgttatacttgaatacattgaggaaacttggaaaacctatcccatcttgccacaagatcctaacgacaaagccatggctcgattctggatcaatttcattgatggcaagtgctcgtctgccattaggaaagttgcatttagccctgaggaggagagagagaaggcagtggaagaagcttgtgagtgtctgaaaacacttgcaagtgcactgaatggaaagaaattctttggtggggatacaatt

SEQ ID NO: 15951 - DNA, 401 bp, Gossypium hirsutum
  Clone ID: uC-gsflnu33B082g03b1
cctatcgcgtccgaagcaacagacaatggaaacggggggaagggaacttgaactgtggcagcgacaaaaagccacatctgaacaagttgccataaatgcaaagcagcggcagggctccggtggcgtatggggttggcttgcaggaagaactccacaaaatgctgatgatgcttgaaaacctaattaaatagtgcttgcagggaagtcatacccggtgcaatgttctattcacttgatcaagagctcaaaccatggatacagcctcttcttgcaaagccggggggaggttgcggacattaggaccttctgcaaatccttgttttagtaggaacctaacgcattgggcactctctttttgtcaaaattttgggtaaaatatacatatatttcctgttctactt

SEQ ID NO: 15952 - DNA, 513 bp, Gossypium hirsutum
  Clone ID: uC-gsflnu33B082g04b1
gctacttataactgctcaaaagtcttcttcaatggcagctcgagttcttgttttggcttcaattcttattttctcttgttttgcagagacatgctatggggtgatctctttctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagaatcgtcaagaaaccctacaccaacgtcaacgaaacccttgaatggaccatcgaacgagacgtgccgacggcgacgttctttatccgagcctacgctttggactccgacgaccacgaggtggcgtacggtcaaaacaccgacgccgagaagaaaaccaatcttgttg

SEQ ID NO: 15953 - DNA, 400 bp, Gossypium hirsutum
  Clone ID: uC-gsflnu33B082g05b1
acccacgcggccgtctatttttccgcccacgcgaccgagctggaaggggggcttatatgggagttatgctctacatgttcgggaattattgagaatcttacaactccttcagcagtgccattgctaagctacccatatctggagacgagaaatgtgccttcttcggcctcgctctcaatcaaatggggctggcttgtgcgcagcgctctgctataaaagaggctgtagagttgatagaccgaagctcatatcatgcctagagcgggagttgtgggccgatccaccctggtacactcagggaatacagtaatctcgcatgcacttacgacgcagttggcagggttggtgatgccattgaaatactggagtatgttgttcagacgagggaggaaaaactggg

SEQ ID NO: 15954 - DNA, 530 bp, Gossypium hirsutum
  Clone ID: uC-gsflnu33B082g06b1
gttaattacagggatccagagggtgatttggttacaatcaccaccactgatgaacttaggttggccgaatcatctactggtgttgccggtggatcacttaggttctatattgttgaaattaatcctgacagggaaccagcttatgaaggaatgaataaagaggaggtgatcaagagtgaggggaaattgagtatggtgatgatgataatggtaatgcaggctgtggtgtaggagctattaagggaacatgtgtggaggattgtgattgtccagtttgcgcgattgttcaagaactatgtcggatttgattctgattcatacttggatcttcatgaactcgggatgaaactgtattcggaagcaatgtaggagactgtgaccagtgaagatgcacaggaacttttcgaaattgctgcggataagttccaagagatggcagctctggcattgttcaattggggaaatgttcatatgtcaagggcaaggaagcatgtctatacagatgatggttcaaaggaatccaaattagc

SEQ ID NO: 15955 - DNA, 439 bp, Gossypium hirsutum
  Clone ID: uC-gsflnu33B082g08b1
ttttagagttttaatgttggtttgaaccgctggggtgatcttaccaacgaggagtaccgagccatctacctgggaatcaagaaacccaaccggaaagtttccaaggccagtgaccgatactccgcgcttctcggcgaaaagttgcccgattccgttgattggagggaaaaaggggctgacgctgaagtcaaagatcaaggaagttgcgggagttgctgggctttctcgactattgctgctgtggaagggataaaccagattgttacaggcgaactcctttcactatctcagcaggagttggtggattgtgatacatcttacaatgaaggttgcaatgggggtctcatggattatgcctttgaattcatcatcaaaaatggtggcattgacaccgaacaagattacccttacactggtcatgaccgtacatgtgacccat

SEQ ID NO: 15956 - DNA, 516 bp, Gossypium hirsutum
  unsure (1)..(516): unsure at all n locations
  Clone ID: uC-gsflnu33B082g09b1
ttccacgcgtccgcccacgcgtccgaggttgggcagcagtacaggtttggatgggaggacgaggctgctcgtgtagtggaggacgtgaggaaaaatcccgaggcagccaccaacggaatcgttttgaggaggagattgcagctgatgatgtacaacaacatgtacagaatcatgttcgacacaagattcgagagtgaggatgatcctttgtttgttaggctcaaggctttgaacggggagaggagccggttggctcagagttttgaatacaattacggggattttattcccatcttaaggcccttcctcagaggatacttgaagatctgtaaggaggttaaggacaggaggttgcagctcttcaaggaccatttcgtcgaagagaggaagaaacttggaagcacanaaagcatgaacaacgatggattgaaatgtgccatagatcatattttggatgctcaacagaaggtggaaatcaatgaggacaacgttctctacattgtcgagaatatcaat

SEQ ID NO: 15957 - DNA, 472 bp, Gossypium hirsutum
  Clone ID: uC-gsflnu33B082g11b1
ttattacgcgtccgcccacgcgtgcggttgagacgggctacataaatgggctctttgtgctagcacgatccattggtttgattgggcacactttcgatcagaagagactgaagcagccactataccgtcatccatgggaagatgttctttacactaagtgagagaacattacgagcagtaggtgcaaatctcctcgagcattgttgttactggagtccttttgtctgcatttttatggggtatggttgtttggttcttagattattgtttgtaaggcaaggctaaatggtggatcaccatcatttctaagttgtattcaaggtccacataggagaaaaaaaatctcaaaaatgctgcgtgattcgtttttagtttttttaccagtttcacggataaataagacatgtcttgcacattgtattggaatattttatgagaaatttcgaaattaggaatcatctattctcggatt

SEQ ID NO: 15958 - DNA, 489 bp, Gossypium hirsutum
  Clone ID: uC-gsflnu33B082h01b1
gttacaattaggagttccttagttgtgttgtaggagccaaagataaaaaaatggtgaagatagcttttggtagcattggtgattcttttagtgttgggtctctcaaggcttatttggctgaattcattgctactttgctttttgtgtttgctggtgttggatcagctattgcttatgggaagctaacgtcggatgcagcactagacccaccaggcttggtggccatagcggtagctcatgcacttgcgttgtttgttggggtagccattgcagccaacatctcaagtggtcatttgaacccagccgtcacctttggtttggccatcggaggaaacatcaccatcttgaccggccttttctactgggttgcccaatgccttggctcaattgttgcttgccttcttctccagtttgttaccaacggattgagtgtaccaacccacaacgttgcttcaggaatgaatgccgccggaggcgttgtaatggaga

SEQ ID NO: 15959 - DNA, 513 bp, Gossypium hirsutum
  unsure (1)..(513): unsure at all n locations
  Clone ID: uC-gsflnu33B082h02b1
tttcttttacggcgcagagccatgcccccactggaggtatcactataactgacggcggagatccctacaggttttacaggtggaatgtgtacgtacggtgacatttaccctctaggcggtcgacaaacgggtcttctcataaatgggcaattcccaggccctgatattcactctgttaccaacgataacctcatcatcaacgtctataacaactaaacgaatcttttctcctgtcctggaatggagtccaacaaaggaggaactcgtatgaagacggcgtgtttggcacaacctgccctatttcaccaggaaagaacttcacatacatgcttcaggtgaaggatcaaatagggagtttctattactacccatcacttggattccacaaggcagctggtggttttggagggatcaggatccttaatcgtccacgaatcccagtccccttccctgacccggncggagattacactgtgctcattggcgattggtacaagtccaatcacacggttt

SEQ ID NO: 15960 - DNA, 225 bp, Gossypium hirsutum
  Clone ID: uC-gsflnu33B082h03b1
ggtatctcaaaataacagcaaatgtgacttgtaggctgtaccagttttatggatagctgattagcagcaatagcagatattttcatttatctgtgttcaattaaaggagttccataaaggctggaacgattgtttgaagcattagcagattttaactccttggatgcatgttcatctgtaattttaacagatagctgattacgagcaagtaccagattttttttc

SEQ ID NO: 15961 - DNA, 528 bp, Gossypium hirsutum
  unsure (1)..(528): unsure at all n locations
  Clone ID: uC-gsflnu33B082h05b1
gttttgtctggcttggatgaatctggggctgatgtttactataactgtccaagtgggaattacttcgaataccaggcttttgccattggatcacggtcacaagctgcaaagacatacttggaacggaggtttgagaactttacaggctcctcgagggatgatctggtgaaagatgctattatggcaataagggagaccctgcaaggagaaactctgaaaagctcaatatgtacaattgctgtggtaggggctggagaaccgttccacgtattagatcagggaactgtacagcaaatcattgataccttcgagactgcagcggagcaagaagaccccgctaccgaacctgatgctgctacaggtcaggaggctgccgctgagcagggcactgctgctgatcacggtggttctacagatgaaggtgcagccccaatggatatttgaggatgcangaaccggngttccatccatgttcggcagttgaaaacattattgggttggatagttccttcttttattctcttacgc

SEQ ID NO: 15962 - DNA, 530 bp, Gossypium hirsutum
  unsure (1)..(530): unsure at all n locations
  Clone ID: uC-gsflnu33B082h06b1
tatgtgtgcgaatctgtgaaggttgttgacaggggtgacactttcaggcttcaggagcaaccccctttcgacaagaagcagtttgtcgtgttcatgaagaagttcatcaagaacttgacaccgaaactggatgcggaaaagcaagagtccttcaagaaaaacattgagggagcaaccaagtttttgctttcaaaattgaaggaccttcaatttttcatcggagagagcatgcacgatgatggatgtttggtatttgcttactacaaggatggtgctgttgacccgacatttttgtactttgcgtatgcattgaaggaggtcaagtgctgaggtttgaagcaaagaaaaaaaaagtggttgctgaagaatttagtcctttttattattgcttttgtctcttattttcagtactctgctaaagacataaattatttatgggttttgatgtttntgatttaattggttgttgttatattatggaatggtttctatttttatgggttgactaaacaagaatttaactctttgtt

SEQ ID NO: 15963 - DNA, 310 bp, Gossypium hirsutum
  Clone ID: uC-gsflnu33B082h07b1
cttatccggtggaggttgatgtgcaaggggttatgcatatatatattatagtccgagatcattcaatagagaatacattcgaattgcattgctgtaacattaggaaatgaagatggggattaatggagcataataacaaagagagaagaaaactacaatcataagtaggcttgttcctacgtaggcatccaagtttaaaaaactgtagtaatgtttcatggtctccaactgcaatttatgcgcttcacgtcatacaagaagagatatcacggcggttaactgcgtagaggatctgctgtttttatcttta

SEQ ID NO: 15964 - DNA, 402 bp, Gossypium hirsutum
  Clone ID: uC-gsflnu33B082h08b1
tctggaagagtgcaaagcctacaacccacaagatctacaacaagaagagatggcagcttccgcgggggctatggacggattggctgcatccgctctccgctccgttctccagagagtccaccagaccgccgagcggtgtggtcgtgaatcgcagcggatccatgtggtcgccgtcagtaaaaccaaacccgtctccgtcattcgccaagtgtacgacgctggtcatcgctgtttcggtgaaaactatgtccaggaaattgtcgaaaaagctcctcagcttccggatgacatagagtggcattttattgggaatttgcagagcaataaagtgaagcctttgattgctggtgtgccaaaacctgccattgtggaaactgtagatgatgagaaagatgcaatcat

SEQ ID NO: 15965 - DNA, 396 bp, Gossypium hirsutum
  unsure (1)..(396): unsure at all n locations
  Clone ID: uC-gsflnu33B082h09b1
ttccctacgcgtccgcccacgcgtccgctcttggcatgcttcattttcagggttagcattggggatggattttagttcaaataatggggtgaggaatgagaaaaggcgaggcctgatgggttgggctgggaaggctgcactttgtcaaacaaagaggaataggtcccggaaatctttggctcgaactcatgggttccgtcgaagaatgagaaccactagtggaagagctgtattgaaacgtcgccgtgctaagggtcggaaggtcctttgcaccaaatctaatccaaacagtgggaagcgctaaactatttcttttgtttccgtttgcagaattctgttaatctgatcctttcttctatgatgtctaaaggataatttangcaaaacttaatcaat

SEQ ID NO: 15966 - DNA, 434 bp, Gossypium hirsutum
  Clone ID: uC-gsflnu33B082h11b1
tattgagttgtggcgacaatgcggggttgaggggaagatgaacaatcaaaagggtgttgatcacaaacggttcggtgagcttttgatgtcctccggaattgtgttgattgatgatgcgcatcgaggcactttatcatagctggatatcattcctgatatttgcttaaacttttgacctgcaagagtttgcccgatactccaactggcttcttcaattggatcaaaatgtattttccgatggtatacgatatcaaacatatgatgaagttctgcaatggcctacatggaggtttaaacaagctggccgagctgttagaagtggaaagagttgatgtatgccatcaagctggttcggatagtttgctcacatcatgcacgtttaggaagttgagggataactttttcaaatcagtacagaaatatgcaggtgtact

SEQ ID NO: 15967 - DNA, 460 bp, Gossypium hirsutum
  Clone ID: uC-gsflnu33B082h12b1
atgagagaaaaagaatgaaaaagagctgaattctgaagggactgaaagcgctctaaactcagtttacaactcacctttcttccccactgtttgtttctttgttttttttttttttgtgtgtgtgtgtgtgttgggttggcgccaaaaaggaaaacacccagaaagaaagtttgggggggatctttggttcttgatcacatgatcaacggccattgaaatttaaaaaatgggttgcgtcagttcgaagcaggcggtgtcggtgacgcctgcgttagaccattccggcgctttacgtgacaatgccggtaccgttagctatggtagtaattcgtgtcggtctcggatcgggttctcggagctggagaagaagaccaccgtcggcggcggttagaagaagaaaaagaatcgtgatagtgcgggtgtgagtgatttccgcggtgttacgggagcatgttggaac

SEQ ID NO: 15968 - DNA, 226 bp, Gossypium hirsutum
  Clone ID: uC-gsflnu33B083a01b1
tttattttcaacttcctaagaattttcttcccctttttttatgttatgtttttttttctcttagggacataatctttgttagatttaggtttttagaacccagtgatcagtatatatcataggatttgtgtagctgtatattgtagtataatcatgaaacagtattatgagtggtttgtactataatcatgacatatcgctctcttttactagtacccttttgctg

SEQ ID NO: 15969 - DNA, 441 bp, Gossypium hirsutum
  Clone ID: uC-gsflnu33B083a02b1
tcgcttacgcgtccggaaaactatcagtcaggaagacaataattacaccattgtctgtcaggcatcctcacctagcccttctgattcttcaacaatgatacctcaactttctgcagcagcactttcaattgcacaattacaagcacggggatttgaagaacctgccaaacaaaatcaattatacaagaaacattatccgccaatgttgggagatgaagtttggcgtctagacagaattggtaaaaatggaattattcatgtaaggctggcctctgaaggcattaacacagtgcaagacttcttgagaatgtcggtcgtcagtcctggtgagcttagaaggattttaggccctagaatgtcagagagaatgtgggataatgcaatcaaacacgccaaacttgtgttatgggaaaccatattatgtttttcgaggctcaatta

SEQ ID NO: 15970 - DNA, 396 bp, Gossypium hirsutum
  Clone ID: uC-gsflnu33B083a03b1
cccacgcgtccgcccacgcgtccgggaaattaaatttctttaattttttctctttgtcgacctaagtctcttttatttgcttctttcaccatgaccaagcagcaggctaactggtctccttacgacaacaatggaggatcttgcgttgcgatcgctggagctgattactgtgttatcgccgccgatactcgaatgtcaaccggttacaatatactgacccgagagtactccaaaatctgtaaacttgcagataaatgtgtcatggcatcctcaggatttcaagctgacgtgagggctttacaaaagcaactggcagctaggcacttgatttatcagcatcagcacaacaagcaaatgagctgccctgcaatggctcaattgcttttcacacacttt

SEQ ID NO: 15971 - DNA, 475 bp, Gossypium hirsutum
  unsure (1)..(475): unsure at all n locations
  Clone ID: uC-gsflnu33B083a05b1
atagggaaagctggctcgccgggcgggtccggaccggcagggtcgacccgacccacgcgttcgcttacgcgtccgcccacgcgtccgcccacgcgggcggcccaacaactaaataaataagaccaaatacctaaacccaaagcctaaaacaacaacctacaggcccaaactaaaacaccagcctagcccagaaatttaacactttctgaggaaccctagggttccccctttgcaccgcttcgctcacccacgtgacgtctgacaactttcaaccaccctgtggccccttcccatcacttccaaagacctgcaaatagaagaaaaggaaacagagcagagcaaggcagcaggcaacagtagtgaaaacaatagtaaaatagggacttgtaaatcggctataaaaccgaaagaaaancaatgtaaaagggggatttttctttttgaaataaaaaacagaggaaatcggttcaagttt

SEQ ID NO: 15972 - DNA, 293 bp, Gossypium hirsutum
  Clone ID: uC-gsflnu33B083a06b1
tcgtttacgcgtgcgctggactacgctttggggagggcgaaaaccaatcctgacggaatattcagagtatacgagcatttgcatcatctagaaaagatggcggcggaacaaccaagatcggcaaccgatgacgtgaagatggatttgttcgaagatgatgactagtttgaagaatttgagagtgattaatagtgggaggataaggaagaaggaaaggtgtttacacagcaatgggaagatgactgggatgatgatgatgttactgacgatttctgtttacaactgttgaggga

SEQ ID NO: 15973 - DNA, 469 bp, Gossypium hirsutum
  unsure (1)..(469): unsure at all n locations
  Clone ID: uC-gsflnu33B083a09b1
ggaagatcggcaaggctgttatttcaattgctattatgagtcacccaaggccaaacaccaatgattctcattctgtgcagattatcctgccacaaaagcagttgcgtcgtaaatcggatatgtatgtcttctgttgttcatattctcacaatgttgctccaaagggcaaattcattgcatttgtttcaacagaggccgagacagatcaccctgagagtgaactaaagcctggaattgaccttctaggtcccgttgatgagatattctttgatatctatgacagatatgaaccagtcaacgaaccttctcttgacaattgtttcatatcaacangttatgatgctacaacacattttgaatcaactgtcagtgatgtacttaacatgtataccatgataactggaaaggttcttgacctcagggtggatttgagtgctgctagtgctgctgaagaataattaccctgaag

SEQ ID NO: 15974 - DNA, 345 bp, Gossypium hirsutum
  Clone ID: uC-gsflnu33B083a10b1
cttgcctctaaaaaatctcactcatataatttaaattggaagaatctgctacaccaaagactagttactcgaattcgttaattttaagtcgaagaaaaatgggaggtggtagggaaggcgaatcaagtgacaaagggctgttttctcatcttgctggctatgccgccggacattatcctccgcctggatcctaccctccacaaggatatcctcctcaaggatatcccccacaaggatacccaccggctggatatcctccaccagcgggatatcctccacatggcggataccactgcagggggtatccttctattggaggataccctcatccactaatggtggata

SEQ ID NO: 15975 - DNA, 420 bp, Gossypium hirsutum
  unsure (1)..(420): unsure at all n locations
  Clone ID: uC-gsflnu33B083b01b1
tcgtgctggttactccccaatccgctttaaggacaagcctttctggatcataaagaattcatggggagcaaactggggagaggacggatattacaaaatatgcagaggtcgcaatgtttgtggagtagactccatggtctcaagtgtggcggctttgcatacaaagtctcagtagcattgccctgtaaatgactgatataagtaacggtaatattagtatccgtcagtatgtcttatctctggatttatgccatctgctagaacgggtttattccaatcctggtttatgcagccacctttaaaaggctgcatttagtagctttagaatttgaatctcagcatatgaacctcttttttcttgggcaatgattntcattgtaccaaagaaagggggtgtatgcttagagatgatattactta

SEQ ID NO: 15976 - DNA, 401 bp, Gossypium hirsutum
  unsure (1)..(401): unsure at all n locations
  Clone ID: uC-gsflnu33B083b02b1
ctcgattctacttaacgcaaatagttcgagtttcgtaatcaatggctttaccgaaccaacagactgttgattatccgagctttaagctcgttatcgtcggcgatggaggcactggaaagaccacatttgtgaagaggcatctgactggagagtttgaaaagaaatatgagccaacgatcggtgtggaggttcaccctttggacttcttcactaactgtgggaaaatccgattctactgctgggatactgctggacaggaaaagttngggtggtcttcgagatggttactatatccatgggcaatgtgctataattatgtttggacgttactgcccgtttgacatacaagaatgttcctacctggcaccgtgatctttgcagggtgtgcgagaaatattcta

SEQ ID NO: 15977 - DNA, 378 bp, Gossypium hirsutum
  Clone ID: uC-gsflnu33B083b03b1
gtagatcttcgtcaagactttgaccggtaagacgattactttagaagtggagagctcggatacgattgataacgtgaaagcgaagattcaggacaaagaaggaattccaccagatcagcaaaggttgatttttgctgggaaacaactggaagacggaaggactttggctgattacaatattcaaaaggagtccactcttcaccttgttcttcgtcttcgtggtgggttctaagccttaaggtctcccttaatgtgggttttctggttttacgtgaaggactgtgccctgtaatggccttttaaataatttctagtctttgtttaccggttgcatctatgtatggtttctctttgaatggaatttgcatatttacctat

SEQ ID NO: 15978 - DNA, 398 bp, Gossypium hirsutum
  Clone ID: uC-gsflnu33B083b04b1
tcgtgtctattgaattctttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggcctataattatgtctctct

SEQ ID NO: 15979 - DNA, 360 bp, Gossypium hirsutum
  Clone ID: uC-gsflnu33B083b05b1
ggctggaaattttttgggaatcttatggatgctggaaagttgtcaatttgtggggaagaaagttttggtacgggttcagatcacattcgtgagaaggatggcatatgggctgttttagcatggctctcgattattgcatatcgaaacaaagacaagaaaccaggggagaaattggtatctatctctgatgttgtcaaagaacactgggcaacttatggaagaaatttcttttctagatatgattacgaagaatgtgaatctgaaggtgccaataaaatgatcgaataccttagaggtctaatctaaagagtaggcagggaaaagttggaaattatgtccttaatttgctgatgacttttc

SEQ ID NO: 15980 - DNA, 487 bp, Gossypium hirsutum
  Clone ID: uC-gsflnu33B083b07b1
ctcacgcgtccgcccacgcgtccgcagactttgagcaaagcagcctcatttctccaagatggctagagggttgaagaaacatttgaagaggctcaatgcccccaggcattggatgcttgacaagcttggtggtgcttttgcacccaagccatcgtctggtccccacaagtccagggaatgctcgccattgatccttattttgcgaaaccgattgaagtatgctctcacctatagagaagtcattgctattctcatgcagaggcatgttatggttgatgtgaaggttaggacggataagacctatccagctggtttatggatgttgagtccattcctaaaacaaatgaggacttccgtctactttatgacaccaaagggcgatttcgtctccatgccatcagtggcgatgaaaccaaattcaagctttgcaaggttacgatctgtccagtttggccagaaaggtattccatactttgatacatacgat

SEQ ID NO: 15981 - DNA, 412 bp, Gossypium hirsutum
  unsure (1)..(412): unsure at all n locations
  Clone ID: uC-gsflnu33B083b10b1
gttaaacataggaaagatgaaatcaaacttcaattatgtaagtagtggctccaacactggtatttgatttgcaacaacatgaatgtcaatttactttgaattctgggatttgttttttttttttaatgttcctccattaattctatgctttagagctcgattggatacatatgtaattatatcattttcaacttgtgaggcgttttaatgtacaatatattacatgttgnaaaaaaaaaaaaaaaaaaaaaaaaaaaaaaaaaaataaaaaacaagcacggggtgtacagatttaaaaaatgcaattatttttgaaaaaaaaaggtagcaaaattttagttttagggggggcgttattttataggatggatgcctgcaagcccgttattgcggtttaatcttttttgtgtat

SEQ ID NO: 15982 - DNA, 482 bp, Gossypium hirsutum
  Clone ID: uC-gsflnu33B083c01b1
cggacgcgtgggtccgcttctctagagggctggtctactcaacactttctcctccctcttagcaaccaaagactcagatccgctcggatttctttgtcccagaactagaatggagacctttctattcacatcagagtctgtaaacgagggacaccccgacaagctttgcgaccaggtctctgatgctgtgctcgatgcctgccttgcccaggaccctgacagcaaggttgcctgtgaaacatgcaccaagactaacatggtcatggtctttggagagattaccaccaaagccaacgtagactatgagaagattgttcgtgatacatgccgctccattggatttgtttctgatgatgttggtcttgatgctgacaattgcaaggtcttggttaacattgagcagcagagccctgatattgccaaggtgtccacggacactttacaagcgtccggagagattggagccgtgaccgggtcatatg

SEQ ID NO: 15983 - DNA, 228 bp, Gossypium hirsutum
  Clone ID: uC-gsflnu33B083c03b1
cccacgcgtccgcttgttagttaatcaggcgaggattctttcaaaatctccgctctctctctctctctctctctctcgctgtctctctgtcgctgtctctctgggtggcgcgctctggatggctgtggaagagggggggatggggggagggatccggctgggagaatggcggatctgggaagagggggaggtgtcggtgaaaaaagaaagccgggctaatgatgttgg

SEQ ID NO: 15984 - DNA, 465 bp, Gossypium hirsutum
  unsure (1)..(465): unsure at all n locations
  Clone ID: uC-gsflnu33B083c05b1
gctttatgtgcgttttcttttgcccttggccctgatgttgaacctgttacctttctggggaaaaccccgggtaaaatagttccggccaggggacccaatgactntggatgggatcctatctttcagcctgacggctatgaccaaacttatgcggagatgccgaaggaagagaagaacaagatttctcaccggtcaagggctcttgatatggtgaaatcccactttgccgaagcaggatacaatttcagcacctccaactaaagagtgagccatatctngtctttgttgttaccattgtatgggtagattcttagaactgttacaaacccttctcaaccatgttcactttctgatttctataaagggtatatcaggaacagtggaaacagtgaaggcaggttttcgcatggaaacttggagattacaatttatataatcatattcctaggcttaagttgggaaaaa

SEQ ID NO: 15985 - DNA, 340 bp, Gossypium hirsutum
  Clone ID: uC-gsflnu33B083c06b1
tcgcccacgcgtccggatatgttgtaattgcagcagaaagaactaagaaaatggggttccaagaaaggtggaaattgatcttatagcaaatggcatttttagttactaaagtcggactgtcatccttggtttaatctgcaaaattacattaccttgcatttgcattttcatgctttggaattttaactggttggatttatagctctaagctcagagaggatttttactacctaaccagaagtcaacattcaataaataaaaaggggctaaatgaccgagggaggacctgaaaaggctaaaggacagtagcttttagcttcatttttattcatttgtttgc

SEQ ID NO: 15986 - DNA, 506 bp, Gossypium hirsutum
  unsure (1)..(506): unsure at all n locations
  Clone ID: uC-gsflnu33B083c09b1
cccacgcgtccgcggacgcgtgggtgagtgtgtatttttcagagtagaagcttcactaagcttactccctccctccttccctctctctgtttctgtcgcttccatgactgtcttgtttaaaatgcctgtcgttttgggtttctttgtgggtcttatgatgctgggtttggttagctctgctgagtttcatgagctttttcaacctggttgggcaaacgatcatttcatctatgaaggagagcttcttaagctcaaacttgataatttttctggtgctgggtttgcatcaaaaagcaggtatttgtttggaaaagtatccatgcagattaaacttgtagagggtgactctgctgggactgtcactgcttactatatgtcatcggagggtccataccacaatgagttcgacttcgagttcctgggcaatacacaggtgaaccttaccttctccagaccaatgtgtacgtgaatggtgtagggaacagagagcanagaatgaacctttg

SEQ ID NO: 15987 - DNA, 358 bp, Gossypium hirsutum
  Clone ID: uC-gsflnu33B083c11b1
ttcgtttttcgtccggatattttggaactgcagcgggatgaactaacctgaaacgtgtgtcaagaaaggtggaaattgatcttatagcaaacggcatttttagttactaaagtcggactgctatccttggtttaatctgcaaaattacattaccttgcatttgcattgtcatgctttggaattttaactggttggatttatagctttaagctcagagaggatttttactacccaaccagaggtcaacattcaataaataaaaaggggctaaatgaccgagggaggacctgaaaaggctaaaggacagtagcttttagctgcatttttattcatttgctagcagctgacaggttttcca

SEQ ID NO: 15988 - DNA, 463 bp, Gossypium hirsutum
  Clone ID: uC-gsflnu33B083d02b1
gtattttgaatccttcatcgatacgacatggagtttccgtacatggaagctgttgttggttttatgatattaatgtacttatttgaaacttatctggacttacggcaacatgctgctctcaaattgccaactcttccaaaaacattgtaaggagtaatcagccaagagaaatttgaaaagtctcgagcctatagcctcgataagagccacttccattttgttcatgagtttgtgacgatcctgatagattctgcaattgtggtctttggtatattgccttggttttggaagaaatcaggaactttcttgcctttacttggtctaaatgaagagaatgaaatattgcacaccctttcatttttggctggtgttatgatatggtcacaaatcactgacctatccttttctctttattcaacttttggaatcgaggccccgcatgggtttcaatcaacaaacaata

SEQ ID NO: 15989 - DNA, 402 bp, Gossypium hirsutum
  Clone ID: uC-gsflnu33B083d03b1
aggaagagccgcccgccgggacgggccgggaaggaatggccggaccgacccacgcgtttgtttacacgtgccaccgattctacaaagggggggggaacaaggactttgtcagccctcttagccacctactgaccagatacaaaataaccagtggcttccaggaaaacaaagaagacggagctggaaaattgagaataaagcaacggaagaaaggagtcgccataaggcaaaagaataaagaacgcaaacaaaaatcgaatgtaatttcttaaaatgggcagggaaggagctggtcaagaatcaaaattagaactaggggtaacccagtactggcaaatgccaagggaaaaaaaatatggtcaaaggaggttttctaaaaaacaaagccaaaaaaaaggaaaa

SEQ ID NO: 15990 - DNA, 556 bp, Gossypium hirsutum
  unsure (1)..(556): unsure at all n locations
  Clone ID: uC-gsflnu33B083d04b1
cttacgcgtccgcccacgcgtccggttggagatgcgtacagtagttattatgaaatttgtgttactcaacatgatgtgttgagagaccttgctcttcatctcagcaatcaaggggatgtgaacgagcgaaagcggttgcttatgcctagaagagatactgaactccccagagaatgggaaagaaacacagaccggccattcaatgctcagatagtttcagttcatacaggagaaatgagggaaatggactggtttcgcatggaattcccaaaggctgaagtactcatcctgaatttttcctccaatgaatacttcttgcctcctttcatatacgacatgcccaagcttagggcacttattgtcataaattatggtacaaatgaggcaatatttgagaatttttcagtcttcaccaatctggcaaatttgcgaagcctatggcttgaaaaaacgtggngttcctcaattgaccaatccaactgttcacatgaaaaacttgcggaaactatctatggttcttttgcaggntaataacagctttaatccatcagtgata

SEQ ID NO: 15991 - DNA, 473 bp, Gossypium hirsutum
  Clone ID: uC-gsflnu33B083d05b1
tctcacgcgtccgaacagctgttcgtaattattggtcccttctgtcccccctaatattctcagatcatccaaagagacctggtgacgaggatccttctccaccttataacatgttcaggaatgtgctagacatgaatgctcgctatggtggttttaatgctgcattactggaagcagggaagtctgtctgggtcatgaacgtagtcccaacaactggacccaactaccttcccctggttcttgacaggggatatatcgctgtattccacaattggtgtgaagcatttccaacatatcccagaacttatgatatggtgcatgctgatggacttctatcccttgagactagtcaatatggcaggtgcactatgctctgatcttttaacggaaatagacaggttgcttcgtcagagggttgggtaataattcatgataaggctcctcttatcgaatcagctagagctctaactgtg

SEQ ID NO: 15992 - DNA, 176 bp, Gossypium hirsutum
  Clone ID: uC-gsflnu33B083d06b1
tcgcccacgcgtccgcccacgcgtccggttgtttgtaaaaagtctcctatgattttgttggttcaatttaatttctatatggtaaaaaagaaaaaaaaaaagaaataggcgtccgaatagaaaaatgaaaaaacaagggcagagactaaaaaggaacacaagctaacaaacacgga

SEQ ID NO: 15993 - DNA, 573 bp, Gossypium hirsutum
  Clone ID: uC-gsflnu33B083d08b1
gctggctcggcccgcctgacggaccgggactgtaatggctggatcgacccacgcgttctgttactgctgtcactctttctgaactttgtgtcacaccataactcctagaaagcactggtggtctgtttgataccagacaatacgtaaatgaaactgctattgttagaggtgtgaagctagttgctgaaagtcttgcgaggcatatctatggccatcagggaaaaaatatccaaatttttgcagatgagagcagtttggctgtcaatcctgcctatatacgatcttggctggatgttttatcacaaacacctcgagtagctccatttctttcaaaggatgacccttttgtcatggcattgaaaaaggagttagctggtcatgttgatgaagtgaatgtgcaacatgagactcttgaagggatttttactttctatgattcaactagcgctaggcttaacatatatcaggttggtagtgtaacctttgatttgctggtactctttggttgggatcttatttgatagtgctcttcagttttcttgtcattacaactaggggtcttgatgatctaat

SEQ ID NO: 15994 - DNA, 440 bp, Gossypium hirsutum
  unsure (1)..(440): unsure at all n locations
  Clone ID: uC-gsflnu33B083d10b1
acggttaaacgtatgcccggcgattgggaggtgtctctatgaccaagatgtccttgcggaagacacaattctttactggttccggagaggatcaaatccaaagggcaggcaaaccttcgtgaaggccctggagcccttcgtgaattggctggaggaagccgaagaagaggaataagcgcgtcgataataatagtgttatcaacaatcaagaagttatgataattaaccttgttatcttttccttgtctttattaagctatatgtttgccggattcttttaacatttggtgtgtgcctgctaaaatatttgctgcgctcgtatgctaagcttaatggattattaacttaaataaagaaatatggtgctttttgtaccatctctgttgtaaaaaaaaaaaaaanaanaanaaaaattaaanaaaaaaaaaaaaaaaggggcg

SEQ ID NO: 15995 - DNA, 409 bp, Gossypium hirsutum
  Clone ID: uC-gsflnu33B083d12b1
gttgagtttaagcatatcaataagcggaggaaaagaagcttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagggaaagatgaataaaaaaaaaaattttacttaagggataaataaaaaattttaaaaaaaagataaaaaaaggggcgg

SEQ ID NO: 15996 - DNA, 346 bp, Gossypium hirsutum
  Clone ID: uC-gsflnu33B083e02b1
gtggttttgtatttgctcccttagagggtgggacagtgatggtaaaaatgggaatggagcgtaacgaaaggtggtggagctggagggaatcctaacggggggaatccatatcaaggtggcggtggtcaaaaccgccggcaaaatggcggtgattgctccttcgaacctcgggatcctaatgaggtctctcgtggtggaaacggcggcaaaaagggagcatctatcatcgttgtcgagaagctcactaccccctttgacttcgctaatggagggaacatgaggtaacaacaaatggatgctgacccttacataggaatggtccccatggggagcttaccccaaatgg

SEQ ID NO: 15997 - DNA, 441 bp, Gossypium hirsutum
  Clone ID: uC-gsflnu33B083e03b1
tttctttattggcattgccgaacccacctaaacaagggtccctttcgccaggaatgggtggtggccattaataaataatcaattccacagcttctgatcagcctgtttgcatgccaacaatgtgtttcaagttttatgatttgcttggtgtagtttcatataaatatttgctttgatgcaatgcagtcatggcttagtcccatgcctctccttatgtatttttaaggtttccatatatagggaagtttgcagggaaatcctttttatttctctaagatttgtaatctaagcttataatttccaatatatcacaactttcgaaaatgaaaatttgaaaaagaaaaatggtgggaaaaccctcaagctttacaccaactaaccgagaaccaatttttaaaaaaacagtttttatagtaaaataaaagggggcggcccttttaa

SEQ ID NO: 15998 - DNA, 545 bp, Gossypium hirsutum
  unsure (1)..(545): unsure at all n locations
  Clone ID: uC-gsflnu33B083e05b1
catagtagaagcttcactaagcttactccctccctccttcccgctctcttttctgtcgcttccatggctgtcttgtttaaaatgcctgtcgttttgggtttctttgtgggtcttatgatgctgggtttggctagctcagctgagtttcatgagctttttcaacctggttgggcaaacgatcatttcatctatgaaggagagcttcttaagctcaaacttgataacttttctggtgctgggtttgcatcaaaaagcaggtatttgtttggaaaagtatccatgcagattaaacttgtagagggtgactctgctgggactgtcactgcttactatatgtcatcggagggtccataccacaatgagttcgacttcgagttcctgggcaataccacaggtgaaccttaccttctccagaccaatgtgtacgtgaatggtgtagggaacagagagcaaagaatgaacctttggtttgacctcaccaaggacttccactcttacactctnctttggaaccagcgcaagttgtatttctagtggatgagaca

SEQ ID NO: 15999 - DNA, 394 bp, Gossypium hirsutum
  Clone ID: uC-gsflnu33B083e06b1
gttgtgcggcgtggaaactgaggccggggctagtgatgaatctctcgtctcaggtggcaacaaaggtctcacagcctccagcacggggggggctcggaactacgccggggaccacattatggacaggagcattaacacatgcaggaacactcggacacgatgggtgacatgcacacaggggctgtgctataggccagaccagcccagaaccttgacaggatgcatgcctgccaaacatgcacaaacacatacaggtaaagggagtcggaagagacgactaccatagctaactcgatacacagaggaggacggcttgtgaagcatgcttggagagaaggatcagaaaaagaagacagctgactggacgctcacccatggaggacttgtaaacaga

SEQ ID NO: 16000 - DNA, 483 bp, Gossypium hirsutum
  unsure (1)..(483): unsure at all n locations
  Clone ID: uC-gsflnu33B083e07b1
ctcattatttcctttcttcgagttttctctgtttgcttccgtcacaactccaaaaccgtacacaaaatgggcaaggatctaagcgacgagcaagtctcatcaatgaaggaggctttcactctcttcgacaccgacggtgacggcaagatcgctccatcggagctagggatcctaatgaggtctctcggcggtaaccccacccaagcccaactcaaagctattatcgctgaagagaagctcacggcgccctttgacttccctcgctttttagatctcatgtccaagcatatgaaacctgagcccttcgataggcagctacgcgatgctttcaaggttctggataaggacaatactggctttgtcttccgtgcagatctgagacatatactgactagcatcggagagaagctggagccctcggagttcgatgagtggantcaggnagtgggatgtcgggccagatgggaagatccgttacgagga

SEQ ID NO: 16001 - DNA, 452 bp, Gossypium hirsutum
  unsure (1)..(452): unsure at all n locations
  Clone ID: uC-gsflnu33B083e08b1
tcggggaccgatgggtccgaaaacgctgtgtaatgcgtgtggtgtgaggtacaaatcgggtcggttggtacccgaataccgacccgcctcgagcccgacgtttgtgtcaacggagcattcgaattcgcataggaaggttttggagattaggaggcaaaaggatatgcaacgagggggacagggtacacggtttcttagtcaaacttcagttttccccatatccaacggtngtgatgttgctgatgattttttgatccatcatcatggtgggccacgattttagttgcatgatttagttagagtatcaaataaaattgggtaaaaaaaaaagaaaaaaagagaagagcttaacaaaaatcttatttgtagcccatttcttaaatcttgaatatttaaaaaaaatcattaaaaattaatttaagaattaaatttaaaaaaaaaaaaagggcggg

SEQ ID NO: 16002 - DNA, 469 bp, Gossypium hirsutum
  unsure (1)..(469): unsure at all n locations
  Clone ID: uC-gsflnu33B083e09b1
gcgtccacgcgtccgcatttgctcaaaatgcaccgtgcttccctacttctaagcctcctcactcttcttacactgctaacagcagctccgcttccggccattgggtatcgtccattgcctcacttaagacccaacagctccgatttaagattcggtgactccaagaaatacgagggttcctcggagttcgtccacttaagataccacatgggtccagtactcaccggtagcattaccgttcacacaatctggtacggccagtggcagaaatcccaaaagaagataatccgtgagttcatcggttcgttctccgccgtcaatgctaagcatcctccggttgccggatggtgggataccgtacggctttacaccgaccaaacgggagccaatatntcccgtacggggcgtttaggggaacagaaaacgaccgtttttactcctacgggaagtcactcactcgcttgtcgat

SEQ ID NO: 16003 - DNA, 456 bp, Gossypium hirsutum
  unsure (1)..(456): unsure at all n locations
  Clone ID: uC-gsflnu33B083e10b1
gtgcgttgatagtaaggggcaagtaagcaaacttagaaataagtcttctttttcttcaatttagaggaatttgtgggggtagaataaattaactgcggaggttcatgaaaacgatttggatgaaccttgggttaaattgaattgggtttttagttaatatatcgaaattgatggactcaacttttttaatgggtttagaccttgaactcatatttatttgttgctgtttttgtggttggtattggtttcatcctttaaatgcttggtttagggaagaactgatcaaccacacgttagtgatatgagcaagataatttagaataggttaaaacattagtgcgacatttcttaatgctatgagccagataggtttagaatgctaagaccatgttaaacagatccccatnctgttattctgcattttacatggaagttattacaagatcatgtactcta

SEQ ID NO: 16004 - DNA, 508 bp, Gossypium hirsutum
  Clone ID: uC-gsflnu33B083e11b1
cacccttgaagtcgagagctctgacaccatcgataatgtaaagtctaaaattcaagacaaggaaggcatcccaccagaccagcagcgtctcatcttcgccggcaaacagctcgaagatggccgtaccctggccgattataatatccagaaggaatccaccctccacctcgtcctccgtcttcgcgggggaatgcagatcttcgtgaaaaccttgaccggcaagaccatcaccttggaggtggagagttcggacaccatcgacaatgtaaaggcgaagattcaggacaaggaagggatcccgccagaccaacaacgtttgatctttgcagggaagcagcttgaggatgggaggaccttggctgattataacatccagaaggaatcgacccttaccttgttttgaggcttcgtggaggcatgcagattttcgttaagacattgactgggaaaacaatcacattggaggtggaaagttcggatacaattgacaatgtgaaggcaaagattc

SEQ ID NO: 16005 - DNA, 468 bp, Gossypium hirsutum
  Clone ID: uC-gsflnu33B083f02b1
cccacgcgtccgcccacgcgtccgctgttgacccaaagaagggtaacattgggatcattgcacccattgcaatcggtttcattgtgggtgccaacatcttggctggtggtgcctttgatggagcttccatgaaccctgcagtctcctttggaccagccgttgtcagctggacatgggacaaccactgggtctactggctcggtccctttgtcggctctgccattgcagccatcgtctatgaagtcttcttcatcgcccccgacacacatgagcagctgcccacttcagaattttaagatttctggtcttttcgatgagtttcatgtgatccattaacaagggttctatgcggggtgggatcactttggtttcatgattgtgggtgcttattggtccctgttggttggatctctcttctggtaattggtgattccattgaaacttgtttatcaatcatttcaaacaaaa

SEQ ID NO: 16006 - DNA, 433 bp, Gossypium hirsutum
  unsure (1)..(433): unsure at all n locations
  Clone ID: uC-gsflnu33B083f05b1
attaacattcactcaaaactctctcagttcatcccatatatatacacacacaactccacttccccatcacaaaaaatatattcttcacttcacatcttttgggcaatcaattttgtaagcaagtatggctaaggacgttgaggttggtggtgagttccaagccaaggactaccatgatcctccaccagctccattagtggacggggaggagttgacaaagtggtcattttatagggctgtaatagccgagtttattgccacgctcttatttttatacatcactgtgttgacagtgatcggatacaagagtcaggttgaccctgataagggcagtgacaatgcggtggtgttggcattcttggcattgcttgggcttttgggnggatgatctttatcctttgttactgcactggtggtatctctggaggacaca

SEQ ID NO: 16007 - DNA, 367 bp, Gossypium hirsutum
  Clone ID: uC-gsflnu33B083f06b1
gaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattat

SEQ ID NO: 16008 - DNA, 427 bp, Gossypium hirsutum
  unsure (1)..(427): unsure at all n locations
  Clone ID: uC-gsflnu33B083f10b1
cccacgcgtccggaaaataaaaaacctcagatacttggccgaggaagaaggcaaagcacagccaaaatgtcgtcgtttttgcaatcacttttggatccgaagaagagctggttagcttctctgcatatgaaagcccttaccacacgcctccgcaaatacggccttcgttacgacgatctgtacgatccttactatgacttggatatcaaggaggcgttgaatcggctgccccgtgagattgtcgatgctcgtaaccaacgccttaagcgtgcaatggatctctccatgaagcacgagtatctccccgaagatcttcagaaaatgcagacaccatttaggagctatcttcaagatatgcttgctcttgtgaagaaggagagagcagagcgagaagcattgggagcnttgcctctgtatcagcgaacca

SEQ ID NO: 16009 - DNA, 295 bp, Gossypium hirsutum
  Clone ID: uC-gsflnu33B083g01b1
ctatgaccttggcaagggcggccatgagctcagcaaaggcacaggaaatgctggcggcagagtagcttgcggtattattggtctgcaaggctaaaatctgagccaagatgcggatgaaggatgcaatgggctttgagaactctttatgtgaagtagaaagaacttggttataataataaaaaggttaaaagaatcctttgtttgcgtacttctgttgcgtgtcggttgtcgtttgtaactctaaggaagagtgtgctctgaatcttaaaataccttttgttgaaaaaccccttac

SEQ ID NO: 16010 - DNA, 324 bp, Gossypium hirsutum
  Clone ID: uC-gsflnu33B083g04b1
tcgctttacgcgtgggagggactgtacggcggtgacggggaggggacgcgtgggagagcaggtggcggcagaagctagggcaagagcggcggctagctagggttttttctctcttttttttttagggctgtttgggtttggaattttaggcctgttactttattttgtaatttggggtagggtaatatgggcttgtaaaaagaattgagttttggcatttattattttttgtgttttattaaaaaaagcacaaaaacaatagctgcaaataaaagatgaaaaaaaaggaacagttccgctaaaaaataatactaataaaaacgg

SEQ ID NO: 16011 - DNA, 393 bp, Gossypium hirsutum
  Clone ID: uC-gsflnu33B083g05b1
ctttgatttaccgaatgtcatcttggcggcaccagtatacaatgagatctcccatgttggtggtgacatgttccatgtcattccaaatgctaatgcggtaattatgaattgggtattgcatgattggggtgatgaagattgtataaacatattaaagaattgttggaaagcaattccaagagaaaatgggaaagtgataattgctgaaggtgctgtgaaagcacacgggagtggagtgttcgatgacatggggttcatattcgaccttctaatgattgcacactccagctgtggtaaggagagaaccgccgtggaatgtatgaaaatgtttgaagacggagggttttgtcgttgcagaattattgacattactgcattgccttccatcatcga

SEQ ID NO: 16012 - DNA, 521 bp, Gossypium hirsutum
  unsure (1)..(521): unsure at all n locations
  Clone ID: uC-gsflnu33B083g06b1
tcgctcaacctcagcttctagctttagtttctgccttagttaccctaatttgttcttatcaaccatggctgctactttagtgtttgcactgctcattcttgccatcactgcaggccactcaagtggtgcgacgggcaaatggtgtgcttgcaaagatggtgtgggtgatggaaacttgcagaagacattggactatgcttgtggaaacggtgctgactgtaaccctatccgttcaaatggaccttgttacaaccccaacactgttaaagcacattgcaattatgctgttaacagctatttccaaaaaaaaggccaaggtcaaggctcctgtgaatttgctggcacggcagccatcactacaactgaccctagctctgctggctggtcttacccctccagtgccagtggcggaggcacgaccttaacaccaacaacaccgggcacgacaacaactncatcatcatcaacaaccaccacgcccttcatcatgaccccaggcaccaacaccccaacaagcacta

SEQ ID NO: 16013 - DNA, 412 bp, Gossypium hirsutum
  Clone ID: uC-gsflnu33B083g08b1
tcggtttcatccattgacgaactcagaactcctccagtcgaggagttattgaagttgttttgggaagcaaaatctgcaaaactagcgaatggagatgtaaaacatatgctggcagcatatgaagcagcccaagccttgaaagactccagagttccactcactgctataaactaaaagtgagatggaaaggaacaaacatatttaagaaaacaaaggccgagtatagtatagtgttaagaacaaaaggtgtgtacagattcagaaccattccactcttttttttttttctttcttgtatttcattaattgattggttgcttgttggattcagcaaattatcacatttacatactaaatcagattttcttctcttcgagcataagcaatcctatcattgccaagatgtaccaag

SEQ ID NO: 16014 - DNA, 340 bp, Gossypium hirsutum
  Clone ID: uC-gsflnu33B083g09b1
ctcaacgacgccaaattttatttatttatttatttatttcattaaagccgatcagagatctcctccgcctctaatttctcctccatttgtcttttgcatttacggttctttaattttctgtaacaaatggaaccttcatcttcatcttctggttcaatgaaagtttcgccgctcgatctgatgtcggcgataatcaaagcgaaaatggacccttctaacgcctccgccgactcggctgccgagatggctaccatgcttctagagaacaaggagttcgttatgattttaactaccttcatcgcggtgctcgttggctgcgtcgtccgtttggtatggcgta

SEQ ID NO: 16015 - DNA, 445 bp, Gossypium hirsutum
  Clone ID: uC-gsflnu33B083g10b1
cgcgcatcgatgatttagttgcgaattccatgaacattttggaacctgcttcagttgatgctgatggaaatgctcgtgaagatgtgatgcatgcgaatgatccagttgatttgttcattttgcctggacttgcttttgacagatctggaagacggttaggccgtggtggaggatattatgatacattcttgaagaactacaaggagcttgccaaggaaaagaattggaggctcccactctttgttgcactgtcttattctgtgcagataatggatgaagaagtaataccagtcaccccaaatgatgtactggtggatgctttgtttcccccactggagtgattcccattacctcagctgccttagggagaatgaagccttaatgctgtgcttctctgagtcagatccaagtgcttttcttcataggattctctgaaattgcagtt

SEQ ID NO: 16016 - DNA, 411 bp, Gossypium hirsutum
  Clone ID: uC-gsflnu33B083g12b1
cttacgcgtccgcaatatcctctaattctaaagctaagagttttaagttaacgaagcatttgggtcgtttcgaagtaatggaaacttcaggaaaagtaaagaagggagccggaggaaggaaaggtggtggcccgaagaagaagcccgtttcaaggtctgtcaaagctggtctccagttccccgttggtaggatcggccgttacttgaagaaaggaaggtattcacagcgtgttggaaccggagccccggtttacttggctgctgttcttgagtacttggctgctgaggtcctggaattggctgggaacgctgcacgtgacaaccaagaaaacaaggatcatcccaaggcacgttctacttgccgtgaggaacgacgaagaattagggaagcttctcgccggcgtaacaatc

SEQ ID NO: 16017 - DNA, 277 bp, Gossypium hirsutum
  Clone ID: uC-gsflnu33B083h01b1
atttgatcaaataatgatgatatctcattattggcactacctctgagacaaaccatatgtcagatttattactactaattcctccctttgcaagtctagatttttgggtttttgaatggtaggtttcaacgaaagggatttttcactttattgaatatggatttcttttgttctgtaggttttgcacttcatcgaatatggattttgcaattctttattgagtctatagggtttgtgctttgtatatattgctgtagttgactacttttttgctact

SEQ ID NO: 16018 - DNA, 416 bp, Gossypium hirsutum
  Clone ID: uC-gsflnu33B083h02b1
ccggaccggacctgaattcccgacccaacccacccgtgtcgcttcgcctacaatcagaggactcaatttttttgtacagcagtcgagagtgccattggccatgttatcaccttttgccccttgctttccctcgatatatatattttgcttgaccgggctttctagcgcttctgctctatagtgagcatagatgaaaaggattttcaagtatttaaggatgttctatgttttttatttacttaaagcttgcccaaagtagttttagtgacattgcagattgcataagcggaaatggaagtcatgactgttttgaatattatattaaatgatttgatgcaagttttagtaacttaattatcaatatggatcacgctaggggttattgatagctcattaataagaaaagtatttccggg

SEQ ID NO: 16019 - DNA, 492 bp, Gossypium hirsutum
  Clone ID: uC-gsflnu33B083h05b1
tctttctgtagtttaagcggagagggtgtgcaggatgaatgggtcaccattgtttccaatatgatgcttaataataagtttttgttcttatcagctttgttttgcattgctgtagctggcgttttaggccaagctccttctactcctagtaatcctccgacatccacgccggcgccgccgactccacccgcttccacacctccacctactactcaaccacctccaacacccacaactacttctccgccaccagcttcctctcctcctcctacttcatcaccaccaccagtttccactcctcctccagcgactcccccgcccgttagctccccaccaccagcttctcctcccccggctactccacctcccgcaactcccccaccggcttctccacctccggctaccccaccacctgcttctccccctcctgctacttctcctgcagctaccccaccaccagctccgttggcttctcctactgccacggttcca

SEQ ID NO: 16020 - DNA, 382 bp, Gossypium hirsutum
  Clone ID: uC-gsflnu33B083h06b1
gttggatgcaaatcttagttaagacgcttacgggaaagacgatcactctggaggtctagagctctgacacgatcgacaacgagaaagccaaaatccaagacaaggaaggcatcccgccagaccagcaacgtgtcatcttcgtcggaaagcaactcgaggacgggcggactttagccgattacaatatccagagggaatcgactctttatctggacctgcgtcttcgaggtgggatgcagatcttcactaagactttgaccggatagacgattactttagaagtggagagctgggatactattgataacttgcaagcgcaagattaagacaaagaatgaattccaccagatcagcaaaggttgatttttgctgggaaacaact

SEQ ID NO: 16021 - DNA, 507 bp, Gossypium hirsutum
  Clone ID: uC-gsflnu33B083h08b1
tcgcctacgcgtccgcccacgcgtccggctcacgaaagtggtattcaccaggatggaatgctaaagcacaaaggtacatatgaaattatatcccctgaagatattggacttgagcggtccaatgaagctggcattgtgcttggaaaactcagtggacgtcatgctttgagcgaccggttgaaagagcttggttacgagcttgacgatgttcagcttgggaccatattctggcgcttcaaagaagtagctgaacaaaagaagcgagtcactgatgctgatctagtagcattggtttcagatgaagtttttcaaccagacgtggtttggaagcttctggatctacaggttacttgcggaactcttggtctttctactgcaacagttaaactcatcgatgctgatgggagagagcatgttgcctgctcagttggaactggacctgtagattcagcttattaagctgttgatctcattatcaagggatccgtttcactacttgagtactca

SEQ ID NO: 16022 - DNA, 371 bp, Gossypium hirsutum
  Clone ID: uC-gsflnu33B083h09b1
tcggtatatttgagaacttatgcacttgagcaaatggtccaagctgcaagctcctctgctggacttcggaccatcaagcgggttgagcaaaccttacagatcttggggttatttaaagccaaaggttccaacaaaggccgtttgtgctgagcatcttgaattaagaaaagaaattctaacgttgctaaatctccagaaacagttgcaatacaaggaggcagaaggttcatctttccgtgatggttcctatggtgatatgccaggcactgcaaagcggtcacaacgtgctgctgatcaggaccgtccatttgtccccgccaccattagttttggagtaattccaggtgatggggttgtcaagagggagcaaa

SEQ ID NO: 16023 - DNA, 328 bp, Gossypium hirsutum
  Clone ID: uC-gsflnu33B083h10b1
gttattataatagtaagagatggtgagtgaactgttgactagagccaatgtaataagggtactcgagggaaatggcaccacctgaagatgatgaagaagataatgcttaatatcaacccatgcaacatttaatctacttgtgttaatctgtatttttttaatttattttttcgtttttaaattatatgataatccctgggggttttgccttcctccccagttttatttcttatgttttgctagaaatgtaagaaaaatacatttaatatgtaatccttgcctgcgaccaaaaacattagcaggagaaaagaattataaaaaatattta

SEQ ID NO: 16024 - DNA, 504 bp, Gossypium hirsutum
  unsure (1)..(504): unsure at all n locations
  Clone ID: uC-gsflnu33B083h11b1
gatactttaaggcttcatcctattgcacctttactagttcctcgtgagtcaatggaggacatagttattgatggttgttacataccaaaaaagtcaagggtcttagtgaacgtttgggcaattgggagagatcctaatgtgtggtccagtaatgttgaagagttttttcctgaaaggttcattaatagcaatatagaacttcatggacatgattttgaactcatcccatttggttcaggccgtagagtatgcccagggaagaaactagggttaatcacagttaaacttattctagctcaattggtgcattgttttgattgggagcttcctagtggaatgtcgccaaatgaattggacatgactgagaactttggtacttcggtgccaaggaagactaatctttgtgccaagcctatttatcgtatgtagaaatgcaagtttcaagataatatttctattgtaatataacaagatgtatccgtataataaaattggngccttgtg

SEQ ID NO: 16025 - DNA, 433 bp, Gossypium hirsutum
  Clone ID: uC-gsflnu33B083h12b1
cctacgcgtccgcccacgcgtccgtttcctctgaatgctttgtctctatttaaaaaaaaagagcaatttttttgaggtggtagtatacaaaaacaaaatgaagatctgttgcattggagctggttatgttggtgggcctacaatggctgtgatcgcgcttaaatgtccggatattgaagtggctgtcgttgatatctctgtacctaggatcgctgcctggaacagtgaccagctccctatctatgagcctggtcttgatggtgttgtgaagggagtgtcgtggcagaaaccttttcttcagcactgatgtagagaaacatgtgcgtgaggctgatatagtctttgtttctgtcaacactcccaccaagactcgggggctcggagctggcaaagctgcagaccttacatattgggaaagtgctgcccgcatgat

SEQ ID NO: 16026 - DNA, 340 bp, Gossypium hirsutum
  Clone ID: uC-gsflnu33B084a01b1
aaaaaaaaaaaaaaaaaaaaaaaaggggggaataaaaaaaaaaaaaaagacaaaaaaaaaaaaaaaaaaaaaacaggggcggccgcccaaaaggaaccaagctaacaaacgcgggcaagcgaaccaaaagacccaaaaaagggcaaccaaaagcaaagccacgggccacgagcaaaaaaaggagggacgggaaaaaccccggcgcaacccaaactaaaaacgctaagaaaaaaaaaaccccaaaggcaagcgggggaaaaaagcaaaaaggcccgcacccaacgcactgaccaaacaaaagcaaacccggaaaggaaaaaggaaacccccccaaaacggc

SEQ ID NO: 16027 - DNA, 418 bp, Gossypium hirsutum
  Clone ID: uC-gsflnu33B084a03b1
tgattttgcagaaaaagcaatggggacaaaggaggtgagagtcgatgtcaagctgaacaaacacatctggagccgagggatccgaagtgttcctagaaggattagggtccgcattgctcgcaagagaaatgatgatgaagatgcaaaggaagagctctactctctagtaactgttgctgaaatcccagctgaaggattgaagggtttgggcactaaggtcattgacgatgatgatgagtaatttattgatgtttagttctatgaaaaacttgcatttattcaccaagaaatttacccagagttttggctagtgttatatttgtgacctgtgagacatcattctacgaatattttggttaattgttgtcaagactatttaagcttgttccttggcaattgaaatttccggcagattttt

SEQ ID NO: 16028 - DNA, 333 bp, Gossypium hirsutum
  Clone ID: uC-gsflnu33B084a06b1
ttttttcgtccgctttgttggctccatcaccatcgtcactttgctttacaaccttgacttcgtgtttgggtttaggagaaacaagcaaattgatgttggagactgtgaatcagggtgatcctactcgtacatgtaggctttaatgccctagcaaatgccatgcatgcggtactagattccttggtttgcttctctaattataagtatacgtgtgaagtgaagcaattcccgttgcttcactaataattaagtatgaaccccccccccccaatttgtaatgcaaatgatgaagtatatagctagtctctagctagcaactgagagcattcattc

SEQ ID NO: 16029 - DNA, 256 bp, Gossypium hirsutum
  Clone ID: uC-gsflnu33B084a07b1
tcgttcacgcgtccgcccacgcgtccgcatggcagaattttacagagagacaatgcgagcatcctgatattgtaaatcttcattctttacggtgatctttgttttgtaccataaataattccatttttcgggagatttgtaactagtgcagatgttagaatactagtttagattctaggtttacaaatattgctacagcttcagcttcatattttttattttttttctctgtttaataaaaatatattcttttctt

SEQ ID NO: 16030 - DNA, 357 bp, Gossypium hirsutum
  Clone ID: uC-gsflnu33B084a08b1
tcgtccactcacacgaattaacaagaaacacccggcttcataggccttgatcgactatagaactacatccagaacggtgcacttgtccgggtacgagtcatgaatagctgttattgctcattgtagagtttggtgtgtgtttttagttatgttgataatggtgtgttcttcagtttgattgatttcattcattcttggggttaggttaaactagtgtttcttccttgtatttgtgtgcttgggcatctagatttgtgtgtttatggcgcatttggtaatgaggtaggatttcatatgttatatatgagttaattttttgcaaaacacttctatttagcgtcatctaacttcaattta

SEQ ID NO: 16031 - DNA, 278 bp, Gossypium hirsutum
  Clone ID: uC-gsflnu33B084a09b1
tcgtaaaaaaaaaaaaaaaaaaaaaaaaaaagagggggaatttttaaacaaaaaaagctattaaatcacaaaaaaaaaagaacaaaaaaaacacgaccacataataagtagatccggccgggcgttctcggggttccatctcccccccctgtcccttgaatggcccctcctctttccacggggtccctaaacttaaaccccgcggggccgcgctttcccaacctgtggcccggcatacccccgcggttccccaccttaatttcctcgggccccccccc

SEQ ID NO: 16032 - DNA, 204 bp, Gossypium hirsutum
  Clone ID: uC-gsflnu33B084b02b1
atggcaaaatgccttttgtcgaaccctaaagctcagactttgaccccagaagaactgcagaaaactatgctgaaagcattagaaggtgtcagcaaattggagaaggttttgagcatttggcatgctggaaagatgttctatgtgttgtcaacttgaggacttacattggctggggtatataagagccgtactatagtgaaactt

SEQ ID NO: 16033 - DNA, 485 bp, Gossypium hirsutum
  unsure (1)..(485): unsure at all n locations
  Clone ID: uC-gsflnu33B084b04b1
ttcactcgtccgctttcattttctctacttgggcaggaaaacagcaatggcaagaatgaaacttatggcacttgctttagtaattttgatgacggggaattgctgcttggcaacaaatagaaaagttataaaagtagaagttgatgggctcaagcatgaacaaatcagtgtccatggccgtcagctgcttgatgatagtgggagtgacagagccagctatccatcgagcagtacaaacaaccatcattttaggcctaggcaggatttccccggtggtggtactggagatggaagcggttcaaataattagatcagtattgctacgcctatatggtcatgttatatggaataattatcgacaatgatactacgacgctgttacatgcttaattaggttttctctatatatgntgtgtgtgatctaattagcttctctttgtagctttgtactattgttctcttttgctattatacacgagatgtta

SEQ ID NO: 16034 - DNA, 554 bp, Gossypium hirsutum
  Clone ID: uC-gsflnu33B084b07b1
ttcacgcgtccgcgttttggtacggttcgtgcgtgtacactgatgccattttcacactatttagacctaaagccagtaattcggatcaccggcggccaagccttgattcttcgagacggagtatagatgtcggggccactcgatcgattcgctcggccttgctttgaggggttttatggtagtgatgagaggagagagaggaaatctgatttcgagaactcagaggatgaaaggcgcacaagaattggatccttgaaaaagaaagcaataagtgcatctgctagatttaagcattctcttaaaaagaagagtaatagaaggaaaagtgatggccgtgtcagctctgtatccattgaggatgttcgcaatgctgaagagctacgggctgttgatcaatttcgacaagcattaatcatggaagaactgcttccagaaaaacacgacgactatcacatgatgttgaggtttttggaagcaagaaagtttgatatcgataaagctaagcacatgtgggcagatatgctccaatggaggaatgagtttggtgctgacac

SEQ ID NO: 16035 - DNA, 534 bp, Gossypium hirsutum
  Clone ID: uC-gsflnu33B084b08b1
ttgttaaacgattgtcctcctaacctttatgctcggttggtatctaccgtagattctagagactttttgacccgactcaaatctcttaatgaatccgatattaaagttgagtttccattcaaggaagctgcaggagatgatatacattcagctgaagttctgattaacgttgaccaaaaagaaccaagttggtgggtatgggtaactgatgaaatggttccaagcaatgttgaagagtggagtggaattgacgatgagaattacattgttgttagcgaagagcatgttgtggatggtgttgctaactttatggcaaaatgccttttgtcgaaccctaaagctcagactttgaccccagaagaactgcagaaaactatgctgaaagcattagaaggtgtcagcaaattggagaaggttttgagcatttggcatgctggaaagatgttctatgtgttgtcaacttggggacttacattggctgggttatataagagccgtactatagtgaaacttggctgcatgggcattcacaca

SEQ ID NO: 16036 - DNA, 528 bp, Gossypium hirsutum
  unsure (1)..(528): unsure at all n locations
  Clone ID: uC-gsflnu33B084b10b1
tcggttaaagcaaaggggagggcctgttttcttcacaaccaccatgagctgcgagtcttcaataaccaagaggctggatggcaaggtggcactgataactggtggtgccagtggcttaggaaagtgcacagccacactatttgtcaaacatggagccaaggttctcattgctgatattcaagacgaattgggcgactctgtttgccaagagcttggaactgaaaacatcagctatgtccactgcgatataacgtgcgaatccgatgttgaaaatgccgtaaacttggctgtctccaagtacggaaagctcgatatcatgttcaacaatgccggcactcttggtgacaacgaagcaagagtgacacacgccagcacggaggacttcagagagtgttcgattcaatgtgtgngtggtttcttgggtgccaagtatgctgccagggtcatggttccggccaagaaaggttgcatactattcacttcaagtcttgcttaaaaatcagcttccgtagcccccatgcatacaag

SEQ ID NO: 16037 - DNA, 491 bp, Gossypium hirsutum
  unsure (1)..(491): unsure at all n locations
  Clone ID: uC-gsflnu33B084b12b1
tcttttcgcgtncgcccacgcgtccgattcggtccttcttcactcctctgttgcagaatcaaaatctctctttctcgtcaatatggcagnaaatggcgttgtttctgacaagagcttgatcgtcagcttcggtgagatgctgatcgattttgtccccactgtctccggtgtttctctagccgaagctcccggcttcctcaaagcccctggcggtgctccggctaacgtggccattgctgttgctagactcggaggcaaagcgtcatttgtcggaaaacttggagacgacgagtttggtcacatgctggccgatattctcaagcaaaacggtgtcttcggtgacgggagcttgtttgaccaaggcgctagaactgctcttgccttcaatacgttacgcgccgacggagagcgtgagttcatgttctaatagaatcctagcgcccatgtgctgttgaaacctgaagagttgaaccttgatcttatcagatctt

SEQ ID NO: 16038 - DNA, 276 bp, Gossypium hirsutum
  Clone ID: uC-gsflnu33B084c01b1
tattttaggaggaccaacacacagacgaacaaagggctgagtaaaaagaagctttgagcctttcagacaaggatggtgaaggctgcatcactacaaaagagcggggaacggtgacgagatccctaggacaaaatccaactgaagcagaaccgcacggaatgatcaaagagggcgatgctgatcaaaacgagcaccagagaacatagccgagaccactgaaatataaccgcacgcgaaaaagaaggaataccgaaactcgaggaggaacattaagga

SEQ ID NO: 16039 - DNA, 550 bp, Gossypium hirsutum
  unsure (1)..(550): unsure at all n locations
  Clone ID: uC-gsflnu33B084c04b1
ttgttttatagttctggtctgctcaacactcttccttctctctaaatctaatactcagatccgcgagtaatttttgtcacagctcattagaatggagacctttctattcacatctgaatcagtgaatgagggtcaccccgacaagctctgcgaccagatctctgatgctgtgctggatgcttgccttgcccaggaccccgacagcaaggttgcctgtgaaacatgcaccaagaccaacatggtcatggtctttggagagattaccaccaaagccaatgtagactatgagaagattgttcgtgacacatgccgctctatcggatttgtttctgatgatgtgggtcttgatgctgacaactgcaaggtcctggtcaatattgagcaacagagccctgatattgcccagggtgtccatggccacttcaccaagcgcccagaagaaattggagctggtgaccagngccatatgtttgggtatgccactgatgagaccccagaactcatgcnccttagccatgtncttgcaactaagcttggngctcgtctaact

SEQ ID NO: 16040 - DNA, 478 bp, Gossypium hirsutum
  Clone ID: uC-gsflnu33B084c06b1
ttaggacttgtcagttattccgggaatggatgagaatgctacatttcttgattcttccaatttactaaaatgtaaggtagatgaggtgatgagcattgaagagctaaatgaatgcattgcaattgaaacaaggaaggaatttcgcaaaaggctgcgtggaaaggatgccttagttagaagtagtaagagagcaaagcagatgatgacgaagacgaagaaacagcagaagattattatccaggatttacgttccaggatgataagtagaaagttttgcaacttcatcacttgtagtgtatagccattcaaggataataacttaatttttttggccaagagaaagcatttttattaagcttgaaaaactcaataccaagaacatttgaaaactgaatacccccattcggagaaaattttggggaagttaaaggttcttatggagattagaagaaagaatcagatttaaacttaataattc

SEQ ID NO: 16041 - DNA, 538 bp, Gossypium hirsutum
  Clone ID: uC-gsflnu33B084c07b1
tccacgcgtccgggcaatccctatccctttcctgtccttccattctaagtaatacattctatacaagtcgtcgaccgccgcaaactagctgaaacgaagatggagcttggcttggaaactatggcggcggcaatcggcgtatcggtgccggtacttcggttccttttgtgtttcgtggcgaccattccggtgagttttctgtggcgatttgttccgggtacactacctaaacacgtctactcagctttttcaggtgtcgtgctttcttatttgtcgtttgggatctcttccaatctgcttttcttggtgcccatgctcttgggttatgctgcaatgcttctttatcggcccaagtgcgggattatcacatttttcttgagtttcggttatttgattggctgccatgtatattacatgagtggggatgcatggaaggaaggaggcattgatgccactggagcattgatggtgttgacactgaaagtgatttcatctgcaataaattacaatgatgggttggtgaaagaggaagacttac

SEQ ID NO: 16042 - DNA, 454 bp, Gossypium hirsutum
  Clone ID: uC-gsflnu33B084c11b1
caggggaaagacacgacagaagacatttgccaatgttcttcaaaaagaccttaaattccccaaaagtatacaagtgagtctgcatgcaaagcagttaatgtaccgcttattgcatagagatccaaagaacagattaggtgcacgtgaaggggccaatgaaatcaagcgacatccattctttaaaggtgtaaattgggctctcgttcgctggatgactccacctgagcttgaagttcccatctctgcaactgaaactaggaaggaagaagataaagcaatggaccctcaattacaggatttacaaactaatattttctgagaagcttggaatgctttatcacttcaccattagaggcttcgggttttatagatgttgtgtgtttctctcatgctagcattatgttgcattcttctttttccttttttgggattaaaatgcaattttcctgttgat

SEQ ID NO: 16043 - DNA, 538 bp, Gossypium hirsutum
  Clone ID: uC-gsflnu33B084c12b1
tgtttcacgcgtccgaacaatgaccacttcggtgcttctatctattttattcagctttgtaatacttgcttcagctgccaactttaaccaagacatcgaagttacttggggtgatggcaggggcaagattctcgaaaacggaaaccttctcactctcaccctcgacaaattctccggctctggttttcaatccaagaaccagtatctgtttgggaagatcgatatgaacattaaactggtcccaggcaactctgctggcactggtaccacttattatcttcgttcggaagggtcgacatgggatgaaatcgacttcgagttcttggggaacctaagcggagacccatacatagttcacaccaatgtatatacacaaggcaaaggtgacaaagagcaacagttctacctatggttggatgacaccaaagacttccacacctactcccttctttggaaccctcaacggattatctccactagatgatgggactccgatcagggagttcaagaacttgaaatcgatgggcgttgcgttccc

SEQ ID NO: 16044 - DNA, 524 bp, Gossypium hirsutum
  Clone ID: uC-gsflnu33B084d01b1
tcgttcacgcgtccgattccaggtcttgcagttcaattgatgctaaaattaagatgtatggttctcttgactctattgaacctgtaaaagacattttagaaaaggaccaaaaaggctttgacacatctttagtggctgcaattgatcgaaccatgaagaaacatactgataatttgatgcacatgttagaaggtgttggtgaccgacttacacagctggagagtagaaccagtaaacttgagacttctgtggatgatttaaagatgtctgtaggaaacaatcatggaagcattgatgggaaaatgagacagctggagaacattttaaaagaggtgcaaacagaggtgcatgttgtaaaagaaaagcaggagagtgttgaagctcttttacagcatgcaaagctgcaggagacccaaatggaccagccatcggaaacttataacactgcacatataggttccatgcaacaagctgcatctgctccttttcaatctcattaacagcttccattggctggctttttt

SEQ ID NO: 16045 - DNA, 550 bp, Gossypium hirsutum
  Clone ID: uC-gsflnu33B084d05b1
gtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgcctgtgtcttgtgtaatagaagctttgtttgtggtgaaaataatgtataagccatttggttgggagcaaattgtccttttctccaaaggatttttgctgctcactcatggcgactaggtttatgggtttatctgctggtgttaaaatcttataaaaatatatatc

SEQ ID NO: 16046 - DNA, 567 bp, Gossypium hirsutum
  unsure (1)..(567): unsure at all n locations
  Clone ID: uC-gsflnu33B084d08b1
gaaggtcaagaagaagaaacagtggggcgttgaattggaaggaaaagaagggatttctggggtagctattgaggtataccagttaaccgatgagctggttgtggtggaaaccaaaagaacaggcagtgatgctcaatggtacaaggaactctggaacaacaagctgagacctgccctagtgggaaattagccgtacgtagtggtttggcttttgtggaaacgcagagatgaagtcttgttgatttcaatatgggtgcatttgctattgttgttattattgttatgaattgattgatgaatgatgtgaataaaagggaagaatacagacaatatatgcatcagcaatggaggaattttccttccaaggcagagcagaaggagaaggatgagtgaaacttactacttcatacagaagttagtataacaatcatagtagttattataattatgtaagttgctgtatgttagcagcattttggtggagtaatactaaagataanccggaactttgtttatttgggggttaacaaaatccccatccccacataaagtttaccattggatttc

SEQ ID NO: 16047 - DNA, 539 bp, Gossypium hirsutum
  unsure (1)..(539): unsure at all n locations
  Clone ID: uC-gsflnu33B084d10b1
gtttcggttcgtcttttcaaatctatggatgtctttgtggttgttcttgttgcatgctttgggaatgaaagaaactctggctctgcaagatttcaacagcaatggcctctcttttgcagtcaatctctattacattgattcttatcccaaaaagacacgctattcccttcatcgtattgcacggtaatgttcttatcccaatatcttttcttttcaattttaatgttcatatgcactcttccatggcttaaattcgttatttattgccctaaaacttgagataaatggggattagatgccagtttaacctgatacacatatttcttttatggacataatgcttaaggttcaactaagacgacataacttcatttctagtgaaattgtttaagcaattgtgcctttgtataaattgttaaaattctgttaaatgtacgggttaaacatggttcttcttatcagggaatttgtttgacatagggttatgctgataacgctntctgcataatatggtgactagtctagcagtctgtggaatc

SEQ ID NO: 16048 - DNA, 123 bp, Gossypium hirsutum
  Clone ID: uC-gsflnu33B084e01b1
cacgtgccaaaatgcaaaaatcatgaggaaattgttgaaacctttcagcgttattgcaccaactcgggaatgggttagtattcacaggctctaacctgtcaatggtctgtggctaagctttac

SEQ ID NO: 16049 - DNA, 494 bp, Gossypium hirsutum
  Clone ID: uC-gsflnu33B084e03b1
tttgttactctactccattggtggatattttcatgcaagcatgcaatgacatggtggactttcacattgccggattttttcaagcccttcattctgaagatagttatctccgaattcaggatgatacactctctcagcaaatgtcaactttggatattgctaccaaggaaaaccttgagaatcttgtgaaagtcggacaagaattgctaaaaaaacctgtttccagagtgaatttggagaatggtcaattcgaaccagctggcacggtaacaaatgaggacgctctcatcagattagcagaagttctttccatggagaagcggcttctagacatgagatcacctcttggaaactttgcgatgaaggagaataaaggatgcgctcagattaataacacaatgacctaatctagttagttttaacgtaagtggtcttcaatgcaaagtcacgtagaattgctagtagttaatgatgatgatctaagttgacggtag

SEQ ID NO: 16050 - DNA, 62 bp, Gossypium hirsutum
  Clone ID: uC-gsflnu33B084e04b1
ttataataaaaaaaaacaaaaaaaaaaaaaaagggggaaattagaaaaaaaaaggcgttcta

SEQ ID NO: 16051 - DNA, 515 bp, Gossypium hirsutum
  Clone ID: uC-gsflnu33B084e05b1
cgtccgatgaaattgtcaacaacaaaagtcctggagataccccaggaaatgttttgctggttaccattgagggtgtggaagctaatgatgtgaccattgagacaattcacttggtattttctgcatttggttttgtgcataaaattgctacttttgaaaaggctgcgggattccaggcattaatccaattcactgatgctgaaactgcatcttcagcaaggaatgccttggacggtagaagtattcccaggtacttgcttccaggccatgttacttcttgtcacctgcgaatttcgtattctgcacacactgatctgaatatcaagtttcagtctcatcggagcagggattataccaatccataccttcctgtcaatccaactgcgatggagggactcatgcagcctgtagttggtcctgatggaaaaaagcaagaacctcagagtaatgtgctacttgcttcaattgaaaatatgcagtatgctgtgacagttgatgttcttcactcggtattc

SEQ ID NO: 16052 - DNA, 544 bp, Gossypium hirsutum
  Clone ID: uC-gsflnu33B084e08b1
tcgtttgggttgaaaaactatgatccccaaaaagacaagcgtttcagtggttccgtgaagttgccacacattcctcgacctaaaatgaagatctgcatgcttggagatgcccagcatgttgaagaggcagagaagataggtttagattatatggatgttgaagcactgaagaagctaaacaagaacaagaagttggtcaaaaagcttgccaagaagtatcatgcttttttggcttctgaatctgttatcaagcagatccctcgtctcctgggtcctggtctcaacaaagccgggaaattcccaacccttgttactcaccaggaatcgctagagtccaaagtgaatgagaccaaggcgatggttaagttccagctgaagaaggttctttgcatgggagttgccgttgggaatgttgcgatggaggagaagcagatcttccaaatgtgcaaatgagcgtcaatttcctggtttcattgttgaagaaaaactggcaaaacgtgaggtgcctctacttgaagagtaccatgggcccataaacaggatc

SEQ ID NO: 16053 - DNA, 457 bp, Gossypium hirsutum
  Clone ID: uC-gsflnu33B084e09b1
cataaatcgaaaattagcaatttattcactctagactcaaataaatatcacttcttggccgaaactataattatatttatatataaatagaacacctaaaagagaaccatcaaatttacattcatatttaacacaggatgaaagataaatagagattgttgggggcaggttaacatccctcgaaactactcaaacaattcctcccatttgtagcctattcattctttccttgcctcttttcttctctattcttccccttttaaccatgaatgccattcatctgctcagtaaatcaatcaacactgcattttttggaaccgccggtcatctttccggaggaaccagtaagcgccacgtcgtcacaccaaaccctaagtatcctacgccgtcctctccaccccccgtatcgaaacgcaacgtcggcgaccacctttatattgaacttgagctcgccacg

SEQ ID NO: 16054 - DNA, 542 bp, Gossypium hirsutum
  Clone ID: uC-gsflnu33B084e10b1
gttttatgcctccatggattcagaacaagcggtgaaatcctgaagaaaatgatggcaaagtggcctcattccgtgctcaacaacttcgatttcgattttctcgacgctccctttcatgctagaggaaaatccgacgttgaatccctttatgatcctccttattatgaatggtatcaagtcaacgagatggagtgtgttcatttcgatgaatgtattgcatacatagaagattatatgattaaacatggtccctttgatggtctactgggtttttcccagggtggaatgctagcatctgtggtgcctccaatgcaaagagagggtgccgcttttactagtgtgccaaagataaagttcgtgatcataatatcaggttttgaacttcgagaattgaagtctgggcctcctaaattgcttgctaatgtttattcagttccaattgactgcccatctcttcatttgattgaaaaaccataagagcaacttttaggacttgcaaatcgttcgtcgctcttagaaaatgtcaatttcttaatcaggag

SEQ ID NO: 16055 - DNA, 549 bp, Gossypium hirsutum
  Clone ID: uC-gsflnu33B084e12b1
tcgtgtaacgggcttgtgacagtcgagggtgaaaaatgggtgaagcaacggacgttggggaattatgcttttcatggggaaagcttaaagaacatgacaccggcagtaattgccagcgttgaaacaatgctagaaatgtggagaggctatgtgggcaaagagattgaactgtttcaagaatttagattattaacttcagaagttatatcgagaacagcttttggtagcagctacttggaagggcagaagatttttgacatgttgagcaagttggcaataattttgcaccgaaatcttttcaagaccagaattacttggatcagcaagttatggaaacctgctgatattgttgagtcagaagaacttgcatatgaaatacagggttgtgtgatgaagatgattaagaaaagagaagacagagttgtgaatggagaagctgatagctttggcaatgattttctaggattacttgtaaatgcctatcatgatttggacgacaaaaacatgttttaattgggagatttggtagatgagtgcaaaacattttac

SEQ ID NO: 16056 - DNA, 278 bp, Gossypium hirsutum
  Clone ID: uC-gsflnu33B084f01b1
tcgttcacgcgtccggattttattaaatctgatgggattattggaagcaagaaaattgttgctcctgtacttttccagggcattggccattcactgaatcctgtcaatagcttggtgttaaaggttctctcagcttcttcatctgcctatttagcttatgccttatccaagctgtcaactccaccattattgacgggttctgcgatctccttggtttcagttgtccaggcaaggaacaatgcacgaattctgatttctgtgtcactaagtatgttcag

SEQ ID NO: 16057 - DNA, 186 bp, Gossypium hirsutum
  Clone ID: uC-gsflnu33B084f04b1
ccaaagtcaactgtctgatcttcatgcctctgtgtaaatattgaagtgtataagagacctcaacacactggttttattgttgagatatatctctgtcttattagatgaaattaaatgatgtatggaacaaaacaaagagttaacacataccaatagagtaaatgcttaactcaaattcaagaaacg

SEQ ID NO: 16058 - DNA, 539 bp, Gossypium hirsutum
  Clone ID: uC-gsflnu33B084f05b1
tttctttcgtccgaattcccatctcaagcactcttcctactttcaactcgccacggtgggatgcaacggaagaccctccaatcgcaccttggtttttagaggatttcaagagagcagcgacaagttccatatcaacaccgataacaggactcacaagggtctttaattcacttcccctctttccggattctttcaattctgaaatgggtacaatattatttgttaatttcgcagatagaagagctaaagcattgcccttttgctgagatatgttggtactttaccgattcatgggagcagtttcgaatcagtggaagagttgatgttattgatggatccaatcctgacaactttaaactccagcaaagggagaaatcttggtttgctagctctgttaaatcaaggctacaatacttgggacctaatcctggtctgccccgcataagtgagcaccaaagtgaggaggaagttcgattagatccttcaatcgcccccggttgctgctttttggatgctagttcttgatcctgatcaggttg

SEQ ID NO: 16059 - DNA, 421 bp, Gossypium hirsutum
  Clone ID: uC-gsflnu33B084f06b1
ttttttctgagcttagtgtcaacaacaatggcatttgtttagatggtagtgaaatagaagatgatattggcagcgagataggtggtcgatcccctgccagcatgcatgcccgatgatggtcagggtgtaaagaccatgaggtatggcaatacattaattgtttttaattctacgatatttgacatttggcatagaaccaattcccaggaagaaccaccaatcgaatcattattctaatatcaatgtaaagctagttagatttgcttactgttttgtaatttgcaatcattgtattattagggaaaccaaggtagatgctagacatatttcttctcctattccgatttctaacacggtgggttgttatgaaactagctttgaaatggttaaatcttgtcaattgaaaaccagggtagatgct

SEQ ID NO: 16060 - DNA, 557 bp, Gossypium hirsutum
  unsure (1)..(557): unsure at all n locations
  Clone ID: uC-gsflnu33B084f11b1
ttgtggtggtgcaaacaccgtggcttctggctacaacaagggaactgccttgggagctgagattattggaactttcgtacttgtctacactgttttctcagccaccgaccccaagagaagtgcccgtgactcccacgtccctgtattggctccccttccaatagggttcgcagtgttcatggttcacttggctaccatccccatcaccggtactggtattaaccctgcaaggagtttcggtgctgctgtaatctacaataacgacaaagcctgggatgaacactggattttctgggttggtccatttgttggagcacttgcagcagctatatatcatcagtacatccttagagcagcagctatcaaagctttgggatccttccgcagcaaccccaccaactaaaaaaaatcaacccaaatagctttgtctccacttcactctttttctattttcttcatttgtntcgttgtgtgtatgagaagattattatgaatgatgaatgatgatgaccctttcctttttataattttctctatttataaatatttaatccttc

SEQ ID NO: 16061 - DNA, 432 bp, Gossypium hirsutum
  unsure (1)..(432): unsure at all n locations
  Clone ID: uC-gsflnu33B084g01b1
ttcatgctttcggatttattttcattaaacgggggggaggtgagaagggtgacatatattaattagccnncgcatttgcagctggggggactgacaggtttcagtaacctccagcgatggccgtggcaacatttcctgcacttcatgtcaaaaattgggatatctttcgttccaattcaaaatggttcaaattgctcccccttacaaaagacaaatttttttgttaagacattagtagttgacagcaaaggcctataccagcacagaaagcgcttaaattgggaacagaagaatgctaaagaaggttaatggcaccccaagaagaccaagactgttagtattctggccagagaagcagttgtatgctatgttcggtcgatgacaaaaacaaggaagtcttttattttatggaagccgtttgcagaaaattat

SEQ ID NO: 16062 - DNA, 377 bp, Gossypium hirsutum
  Clone ID: uC-gsflnu33B084g07b1
ttgatttcttcgtaccaatggttcagcaaggccagcagggtcagcgtcctggtgggagaagggctggagctgttcagcaaaatcagcaaccagttccattaatgcagcatcagatgctaccccgagggcgggtctatcgctatccagtggggcgtggactacctgaagtttcgatgcctaatgttccaggaggcatgctttctgttcatatgatatgggcagcatgccaatgcgtgatgcaccactttctcaaccaattccaattggagctttggcctcagctcttgcaaatgctactccagaacaactaagaacgatgctgggggagaatctctatccactttgcgagcagctggaacccgattcatcagcccaaa

SEQ ID NO: 16063 - DNA, 351 bp, Gossypium hirsutum
  Clone ID: uC-gsflnu33B084g09b1
ttcgtcacgcgtccggccttgcacagcgatgccagaagtactatgaagctggtgcccgctttgctaaatggcgtgctgtccttaagattagtgctaatgaaccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgcttgaaggtactcttttgaagcctaacatggtgacccccggttctgactcccccg

SEQ ID NO: 16064 - DNA, 560 bp, Gossypium hirsutum
  Clone ID: uC-gsflnu33B084g10b1
tttgtttggagtcggaattacaaaactttgacatcctatggtatttttgtcccacatgtcacagcttcaaattcgcctcgaaacccgaggttcaaaaatgctgggaagttcttagcattatccaagttttaaccatggcaagcaatgctagctctcttcaaggtgtcttaatcagcattgagaatgctcctttccttttagagcaaggatttgtcataaccgatgcagtgctcgatgctttgaccaaagctggcttcggttacaagacagatcagaaagtcatgattcagtccagtcgtagctcggttctaatgaagttcaagagtcataccaactatgatctcgtttacaaggttgatgaagatattggtggcgctcaaagttcaacaattgttgacatttagagatttgctagcgctgtggtattaccaaggattccgtattttctgaacttcaaacttcatcactagtgcttcgattgttttcccaggtttaaagctgctaatctcttgttttgtcaaacctttagtaatggttacatttaagcctggacttttttc

SEQ ID NO: 16065 - DNA, 512 bp, Gossypium hirsutum
  Clone ID: uC-gsflnu33B084g12b1
tctttggagagcaggacaaggaatggagagaggaagggacacaaacaaaggggggctttaagcaaacactccaggaccaccaagcactctggagaaggaaaatctctttcctgcagggctataaccagatccctacatcgctaggtgcagggaaagggatgcagaccacctaacgcaacttcaaaggcattgacggaaaggaacaactaacccaaagaatcatcttcatcaaagatctggaaatgaagacccgagtccgcatataaggccatgaagctacaggcaggcgccagtagatgaacgaagatggcaactgaaaaccctcatagaaacagggagctagctctcaaaaggcagacctaaacagaaagcctacaagctaccacagagtatgatggcaaacaactaaactttacaaaaagcaaaagataggcacactgatgaaaaaaataaaacacgctagaaggaaggctaaactaaaaaaaggaagggacataccaaaaaagggaaag

SEQ ID NO: 16066 - DNA, 493 bp, Gossypium hirsutum
  unsure (1)..(493): unsure at all n locations
  Clone ID: uC-gsflnu33B084h06b1
nttcgtcttttgatttaatatttaatggccaggggcactatttttatttttaaaaaacccattcaattttacatgtttttcatacacgatcttcatcttcttcaccagtatcgtccttaaaactgatccaatccaaatccaaaaacaaaaaaacccaaagtaaagatatggagctacgaacactccagcatcatcttcttcaagggtttatgttattatctttgataagcaattgttacgcgagattcgtggtggaaaagaacagcttgacggtaacatcgccggagaagattaaaggaacccatgatagtgcgattgggaactttgggatacctcaatatggtggaagcatggctggtgttgtggtttaccctaaagaaaaccagaaagcttgtaaaagctttgatgactttgggatttcgtttaaatccaagcctggttctttttctacctttgttttggtcgatcgtggagattgcttctttgctttaaa

SEQ ID NO: 16067 - DNA, 517 bp, Gossypium hirsutum
  Clone ID: uC-gsflnu33B084h10b1
tcgtgagcctctagagtcactatcaccaccagggggtgtcttacaagttcataattttttccctcatacatctttcctttgaaagagcatgagtagatccatttgttgatcaaggaacgaaggtaaactagacctccctaaactttctctgctcaatttttatgtcttgaataaaggtccatatttccgatctatccatagggcctgatttagctttcttgatcacagttaaggagtcaccttcaataaccacttctctcaaacccatctccactcccaacttgacagcctgaaggcatgtaagggcttcagccacgaaaacagatagtacatactcatttaaaatcacccttgtacctattattctagatctgtcgtctttaataactaaccccgaatatgattttgcgatgtgagccttaaaagctacatcaaaattaatttttaagaaatgagcctttggcgatcttcacccttacaccccacttttgaaacagttaaaccttcctccatttat

SEQ ID NO: 16068 - DNA, 365 bp, Gossypium hirsutum
  unsure (1)..(365): unsure at all n locations
  Clone ID: uC-gsflnu33B084h11b1
tccacgcgtccgggcaaagaagagaagaggggggattttagtagnggtgatttttacaagaacgactcctcttctggcggtggagatgacaagggtaaagacaataaaggaagtggtggtggtgaaggaggagaagcaaatgtggccgctggaggaggaggagaagcggcggaaggtggggtggaagagactagagtggcggtggagctgtagaaaaatgaattctattattacccaccaaggtatgccactgagttctacgcttatcctccacagtccttcagtgatgagaacccctaatgcttgttctataatgtaatcaacaaaaaaatgttgggtcctttggtaatttccatgttcttctt

SEQ ID NO: 16069 - DNA, 393 bp, Gossypium hirsutum
  Clone ID: uC-gsflnu33B085a02b1
gcgctgtctcgcgcagaacatcgagtgctttaacgaggagtgttcagtctgtctctaccctggacctgcataggataggattacaagactcggatgacactactatagagctaatgaccgggcaaaggaccagtgtggcccgcaacggaagaaactgcctgtaggacagtgcattggcgtttgaactgcaagctatggaaggggagtccgccattattgctacatagctaggggacagggtactcaagatgaaggggagactcactcttggaatcgactgccaaatgaaagagcatgaggcatagccaggaccttcgcttgatgaagttgatgcatggagtgaacctattgctaacgacgtggatgcccagtgcacctacgttgatgaggatg

SEQ ID NO: 16070 - DNA, 505 bp, Gossypium hirsutum
  Clone ID: uC-gsflnu33B085a06b1
acgcgcgtcctctcgtccgaaacgccccatctccgatgatgaggttgcatggcttgcaaagttgcttatttggttatccagttggttgaatgaaagccttggcctaaaccgcccagaagataatgatgtgggttctaagtggttctatgtgaacatcccaggtgatgcagtaaacctgaacggatcaggtgagatcgtgaaaactctggtttgcttaattggttcttggcttttaatgatgggaacaacaacaacgagattaatgagaaaacacggtttaaggataaatcttagggtgttggcttccaagaaggtggtgatggtgctgctcatatttgttgtatttagtgtattgaagaaagcttgtggattgttccattgatagtgtaaataaatcaaacatacgaatagggaggaaatggttctcagtttttttggatttgatctcctaaaggaacagcaacgtgtgaagcaagaaagaaatttgcaaaaaaaaataaagggc

SEQ ID NO: 16071 - DNA, 503 bp, Gossypium hirsutum
  unsure (1)..(503): unsure at all n locations
  Clone ID: uC-gsflnu33B085a11b1
tttaagtctccctgtgagaaaatggcatcctaccaaatcttagctttcgcagctttgttcttgatcttgttacccgtagccgtcaatggagatttaggtgacttatctcctgctctatctcctttctatgataggttgtgtgatgatgttgattgtggaaagggaacatgcaaagcggacataagctaccctttgaactacatctgtgagtgtgatgctggttggaaaagaactcaagacgacagtgatgatgatgatgatcataagtttctgccatgcgttattcccaactgcactcttgactactcttgtcaaccagctcctcctccagtacctcagcgagaagttcctcgcaattcatctttatttgatccttgctattgngcatactgtggagaaggaacctgcaacagaactgcaacatacatgtacgtatgcgaatgcagatctgggttttccaatcttctcataggacatacttcccttgcacagtcaatgtaccc

SEQ ID NO: 16072 - DNA, 290 bp, Gossypium hirsutum
  Clone ID: uC-gsflnu33B085a12b1
tccacgcatacatgaaaaaaaaaaaaaaaaagaaaaaatacataaaaaaaaaaaacgctgacctagaacaagacacccagaaaccgtccatggagcctaaggtgacttatctcctgttttatctcctttctatgttcggcggtgggccgattttgactgtggtcagggtacactcctggcggtcataagcttccctttcgtccgcatctgtgagtgtgctcctgcgtggccacgcccttatgacgacagtgacgacgctgttgcccctacgcttctgccatgcgtttttc

SEQ ID NO: 16073 - DNA, 550 bp, Gossypium hirsutum
  Clone ID: uC-gsflnu33B085b01b1
ctctccgccgcctgcgtctctctcttcatctgtctgaacctaaaagtctttagcttttcgcttcgagagagaccatgttggtttgccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacattgagggagcaaccaaagttttgctttcaaaattgaaggaccttcaatttttcatcggagagagcatgcacgatgatggatgtttggtatttgcttactacaaggatggtgctgttgacccgacattcttgacttt

SEQ ID NO: 16074 - DNA, 187 bp, Gossypium hirsutum
  Clone ID: uC-gsflnu33B085b04b1
cctacgcgtccgcggacgcgtgggttcgtcgtgagattcatggctaacacgttctctgaggacgactatgttaaagccatcaaggaggaaattaagaaggttgctgaccttcaggaagagctcgacattgatgtccttgttcatggagagcctgagagaaacgatttggttgagtacttcggtgagc

SEQ ID NO: 16075 - DNA, 583 bp, Gossypium hirsutum
  unsure (1)..(583): unsure at all n locations
  Clone ID: uC-gsflnu33B085b05b1
acctactcaacttacactgactcttcgatctcacctccagtctcaaaccctttcttaaattaaaagaaaagaatcacattaaaaaaaaaaaaaagcctgctgaaaaccactaaaagaatggcaactccagacgaaagtcctgcagctaagagatggcttcctctcgaagctaaccccgatgtcatgaaccagtttctttggggtctgggtcttccagagagtgaggcagagtgctgcgatgtttatggcttggatgatgaactcctatcaatggttccacagcctgttcttgctgtgctttttctttatccaataacttctcagactgaagaagagagattgcagcaagataatgagaaaagagatgttagcagtaaggtttatttcatgaaacaaactgtgggaaatgcttgtggaacgattgggcttcttacagtgttggaaatattacttcagaaatcaagctacaagagggatcctttttagatagngtttttaaatctactgcaatcatggatccattggagcgtgctgcacttcttgagacagatggagagatggaagttgctcacactgtggcagc

SEQ ID NO: 16076 - DNA, 535 bp, Gossypium hirsutum
  Clone ID: uC-gsflnu33B085b06b1
gctaccttctctcaacccaaacacatatttcccaggaaaaagaaaaagcttgagccaaaagaaaatggccgatcagcttaccgacgatcagatctctgaattcaaggaggcctttagcctgttcgacaaggacggagatggttgcattactaccaaggagttgggaactgtgatgcgatcacttgggcagaaccccactgaggcagaactgcaagatatgattaatgaagtcgatgctgatggaaatgggaccattgattttcctgaattccttaacctgatggcaagaaaaatgaaggatacagactctgaggaggagcttaaagaggcattcagggtgtttgacaaggatcagaatgggttcatatctgcagccgagctgcgccatgtcatgacaaaccttggtgaaaagcttacagatgaggaagtcgacgagatgatccgcgagctgatgtgatggtgagggcagatctctacgagggttcgtcaagtcatgatgcccagaaaggacctcttcactttaccaggattaaaa

SEQ ID NO: 16077 - DNA, 539 bp, Gossypium hirsutum
  Clone ID: uC-gsflnu33B085b07b1
cccacgcgtccggtcaatatgtacgtagtgttgtgggatctgttcaaagggttgccatggctattgctccatcccgtattagccctggcttgggaccaaaaagcctccctggttctcctgaggctcttactttggcgcgttggatttgccgaagctacaggattcataccggtggagaactcctacgagctgattcacaatccggtgatactttgctggagcaactgtggaaccattcagatgcgataatgtgttgttcattgaaaacaaatgcgtctccagttttcacctttgcaaaccaggctgggcttgatatgctagaaactacattggtagcccttcaagacataatgctggacaagattctcgatgaagccggccgaaagagcctatgcaccgagttctcaaagatcatgcaacaggggtttgcacatctaccagcagggatatgcgtatcgagtatgggaaggccgttgtcctacgagcaggccattgtgtggaaggttgcgatgatgacaacgatgatgctgccaatcact

SEQ ID NO: 16078 - DNA, 513 bp, Gossypium hirsutum
  Clone ID: uC-gsflnu33B085b08b1
tctcatttctccatatcgtagggagagacctcaatcaccgttccgtggagggggctttcttggcatgcctaaagaagctgagaaatacaaagctaatatgatggttaagtataccagaagcaataacaactcgcaggaattagtaccgtatcagagcagcagacaaggctcaggtcctctaagccctgcagttgagaaaactttgtatgtagatactgcgaatgaaatggcaagttcaaattccaattcctcggatacgaaagtccaaatggattccataggaaaacattcaaatacctcagaagtgaacaaagtgttggaagaacctgctaccatggaatctccccttcaagatacaaaaggccttagtctcttggatggaaaagccatattggaatacgaaaccgcagggtcagtcaaatacagtcgatcttctttgtccaacaaacctgatctcagaggtcaagcagaaatgatagattgcttcaacagaatgaggacttgatcaagaat

SEQ ID NO: 16079 - DNA, 509 bp, Gossypium hirsutum
  Clone ID: uC-gsflnu33B085b09b1
tgtggcacttaagatccttgataaagacaaggttctcaagcacaaaatggctgaacagattaagcaggaaatagcaacaatgaagctgataaagcacccaaatgtcatccgtttacatgaggcattagtgataataagatatattattatcacttaaatcttagaggaagtgtttttgccagaaggctgactaggctaccttcaattcctaagaatgaagcaaagttcagtttattaagagagtaagatggcatccactttcacagccatgtcattagttggctcattcgttgcatctaatgttttggtcatggataagaagctttcatcttcttccaacagattgtcatctttagcatccatttcttcatcttcatttcttattagacgaaatggtgttcttaaaagatctcatttgcccaagatttctacagcataagagctacatttcaataaggatgggtcaaccataaagaaattacaagttagtctgtgtttcaaatgctaaa

SEQ ID NO: 16080 - DNA, 386 bp, Gossypium hirsutum
  Clone ID: uC-gsflnu33B085b10b1
atcacgcatccgtactaaatggtcaccaaagctgtgtaataggcagcctgaacgaatccggcggtggagaaaaagaccaccgatgccacaatatccttggatggaaagaaaccgaaggccgggatgaagctatcaatagaaggctgagccaccgttgacactatgtaaaagaatgccacgaagagtgtggagacttacaagatctacatgtcataggttcttaaacaagttcaccctgatatgaggatttcaagcaacgctatggggataatgaacaggttcattaacgatttctctgagaaacttgctcacgaagctccgaggctggcgaggtacattaagatgcccacgattacttcatgggaagatcaagaccgctgttaggc

SEQ ID NO: 16081 - DNA, 520 bp, Gossypium hirsutum
  unsure (1)..(520): unsure at all n locations
  Clone ID: uC-gsflnu33B085b11b1
tctttccaatacaaagcttcatattatcttttttagttccgacaaaagaaaacgaaaaaaatagaagaaatacaatcgttttctttttgaagtcgggttttagtttttggggagaaaaaaatgttgggagtatttagcagtgcgatagtgtctccgccggacgagctggtggcggccggttgccgaactccatcacctaagataacggcggatgctctggtgaaacggttccttgagacgaactcctccggcgtgtccatgcagatcggagaccatgtccaattcgcttattctcaccataaagagtctcctttacggcccagatcatttgctgtgaaagatgaaatcttctgcttgtttgagggagcccttgataacttgnggagtttaaagcagcaatatggtctggcaaagtcggcaaatgaagtgattttggtcattgaagcttacaaggcccttcgtgaccgagcaccttatccttcaaccatgtggttggccatctaattgggagctttgcttt

SEQ ID NO: 16082 - DNA, 399 bp, Gossypium hirsutum
  Clone ID: uC-gsflnu33B085b12b1
ttccacgcgtccgtgtgtttaaggtattatttgttgtaacttgaaagcacctcgccaatcatatttgtatgtgattttttttatatcactaggaatttaagatttcttaagccaaaaaaaaaataaaaaaaaaaaaaaaaaaaaaaaaaaaaaaaaaaaaaaaaaaaaaaaaaaacaaaaaaaaaaaaaaaaaaaacaaaaatacaaaaaaaaaaaaaaaaaacaaaagaggggggggccgttttaaaggacccaagttaccatccgctggcctgcaacaattaactccttttatagggacccctaaattaaacgcatggcccgggatttaacacatctgtgatggggaaaccccgggtgctccccactttaatcgcgtttaagacaacccccttttgg

SEQ ID NO: 16083 - DNA, 243 bp, Gossypium hirsutum
  Clone ID: uC-gsflnu33B085c02b1
gctctcggattgtacaagggtattgttcctctttggggccgacagattccatataccatgatgaaattagcttcttttgaagctatcgctgatatgatctacaagtatggtatccccactcccaaggagcattgcatttaaattgtgcaccttgatgttagttatggtggtggctatgacgctggtgtgacctgtaataccgtggcgtatcctgatgtaaaccgtgtgtacttaattcacctt

SEQ ID NO: 16084 - DNA, 566 bp, Gossypium hirsutum
  Clone ID: uC-gsflnu33B085c03b1
gttttgtcaacgggctagaaaacccgtaagaaatcgccgaagccagtccttagaagttccaccatagaacgccttgcaaccgcacggaatacttcaaaggtctcttcggctgaattgaaatcgagccagccgaaaaagccaacattgaaggaaatcagttcttcaacaactcagaaggctgctcctgctaaggataagaaatcaagcacaaacaaagccaaagcttcagatataaaaagtggtacaaataaagaacttccaagtggcgataatgcacaaggaaaaagggagtccaatgaggtcacagtagcattgccaatggaaccagcaccatccaaagcaactcaacctactgacattgttgatgatttcaaggacattcaagaattgcagactaccccaatcgaaaagaccgaaggaaatgcaactttgaaaccaaacccgtcgggggaagaccaaagctcaaatgccaaaatggttaccgtaaataagccaatgcaattagatcatgtcaaaggtgatgaagactttataatgcccactaaagttgttctgaagatacatag

SEQ ID NO: 16085 - DNA, 398 bp, Gossypium hirsutum
  unsure (1)..(398): unsure at all n locations
  Clone ID: uC-gsflnu33B085c04b1
gtgaattacgcttacaacatgagaaacacagtgaaagatgaaaagattggttcaaagctctcaccagatgataagaaaaagattgaagatgctattgaagaagctattcaatggttggatagtaaccagttggctgaagctgatgaatttgaagataaaatgaaggaattggagagtgtttgtaaccctatcattgctaaaatgtaccaaggtgctggtggtgatatggtggagattntgaatgatgatgctcctacatctggcggacgcggcgctggccctccatttgaagatggtgactgacacatggcgcacggctgtatttgaaactagagacgctggacatgctgcttacagcttgaactccctggataaatttgtacatcggagccctgact

SEQ ID NO: 16086 - DNA, 387 bp, Gossypium hirsutum
  unsure (1)..(387): unsure at all n locations
  Clone ID: uC-gsflnu33B085c05b1
ccctcgcgtccgggattttggcttggagaaatcggtacaagaagtgagttttcgggatttcgacttttatggcaatcggctatggaggttttgcggaggatgctgccattttcatggcacttgcagcagctgttgacctcagcattgaggcatgcaagcctttccgaagaaagataaggatagggtcccgccattctttatgaaaaaaaaaaaaagaattaaggtgatgtatttccatgaacaaagaatggctctatatttgtgttgatttgtgtaacatttggcactgtgtatagatcttgtggttgataaattcctagacataaccnatnatagtggaaagaagacttgaaaaaaagaaatgaatatgaaactaattgggcgtgc

SEQ ID NO: 16087 - DNA, 444 bp, Gossypium hirsutum
  Clone ID: uC-gsflnu33B085c07b1
tctctcagcgccagagagctcagacttcggggatcacttttagggttttttgcctattatcccataatcagattcttgattatccaaaattctaatcttcagatcagggcttagttttctatttgttgggctctttcgaccagctaagtttcatgtctgatcttgacatccagattcctactgcctttgatccgtttgctgatgcaaatgctgacgactctggtgccggtgccaaggagcatgtgcatatccgtattcagcatcggaatggtgggaaaagcctgaccactgtccaggggttgaaaaaaaaagaatctcagctataacaaaattcttaaggacctcaagaaagagtttcgctgcaatggcactgtggtccaagaccctgaattagggcaggttattcagcttcaaggcgatcaaaggaagactgtttccaccttc

SEQ ID NO: 16088 - DNA, 411 bp, Gossypium hirsutum
  unsure (1)..(411): unsure at all n locations
  Clone ID: uC-gsflnu33B085c10b1
cccacgcgtccggaaaaaaaaatttaagagcctctcctctctgctggggtctccaatgcccttgacgccgactgatgagccacctcagtggttcaccgcaccaccactatggctggtggccgacgacaagcgacgacggggaggtgagtttccttcctctcttttcttattttttttattattttgaatgcaaaagaaaagaaaaaaagggaaaatgaaatacactgaaatagtaaataaataaaaacaagcagaaactcaagcaaaaagagtaaaaagaaacatcatctgaaactgttttgctcttgatgtatctcgtttataaaacgttggttttattgagataaattcttaaacaataaggtnnaaaaaaaaaattaaaccaaaataaaaaaaaaaaaaaaaaggaca

SEQ ID NO: 16089 - DNA, 544 bp, Gossypium hirsutum
  Clone ID: uC-gsflnu33B085c11b1
cactccgcagcctcccccgttctttgaaatcctattttccctttatccgcactggggaaaagaatagagaaaaattgcaatagctttttttgatcgtcataaagaaaaagcgccggggcgtgacctgagatcatcaaaacctaaacacgatcctttgatttccgaaatatgtggagaaggctacttacttcacagttcaaatatctggcaacacttccatgccgatccgcctctaaaacggcgccgcttccattcaaatctcacatttctccttccccttctgcttccctcctcgttcgccatttctccgccgagtcagcggatactgctgtgaagatgagagttgaggatgtaatgcctatcgctacaggtcatgaacgagaggagcttgagtctgagcttagggaaagaaaatcttgaagatgtaaacacctgttggtccttttggcaaaaggaagctcctgctgtgtcaagtcctctatgacagagaatagtgatgcccaggagtgaagcgagatgacatgatgtgctgttttgctgagaa

SEQ ID NO: 16090 - DNA, 540 bp, Gossypium hirsutum
  Clone ID: uC-gsflnu33B085d01b1
tttacgcgtccgcccacgcgtccgcccacgcgtgcgggatgtgggggttttgattaacaatgttgggatttcatatccttatgccaggtacttccacgaggttgatgaggagctgttggtgaatttgattaaggttaatgttgaaggtaccacaaaggtaactcaagctgttttgcctgggatggtgaagagaaagaaaggcgcaattgtgaacattgggtctggtgctgccattgtcatcccttctgatccactttatgctgtttatgctgctactaaggcgtatattgatcaattctctaggtgcctttatgttgaatacaagaacagtgggattgatgttcagtgtcaggttccattgtatgtggcaacaaaaatggcatcaatcaaaagatcatctttctttgttccatcaacagacggatatgctcgtgcagcaatgcggtggataggctatgaacctcgttgcacgccctactggccccattccatcctctggggcttggcttattcactgccagagagtgtggttgatgcatg

SEQ ID NO: 16091 - DNA, 224 bp, Gossypium hirsutum
  Clone ID: uC-gsflnu33B085d02b1
ttttcgcgtccgctttaatttattcgagcatagatatgtggccttgcgcatgattgatgaagctctttctatctatagtgggcatgcatttgctatctggcggataatttgatgtactatgggcactattagcaatttaagcatctatttgttccatttgcagaacgagtctacaagagatagatctatatttggggccaacatatctgtgatgaaatgggaaa

SEQ ID NO: 16092 - DNA, 207 bp, Gossypium hirsutum
  Clone ID: uC-gsflnu33B085d06b1
gtcatatttaggaagtacaagcaaggttatacgtgaggagtaggtggtttgaatgcagtttttggttttgtgactttgtataactaagcagatgttttacttgttttcatgtggttgaaaatttgtgttggtactgaatgttttcattacagggtgtagacatttgtgtaagagcagtgatgagatgtgtccaatattttactgttt

SEQ ID NO: 16093 - DNA, 438 bp, Gossypium hirsutum
  Clone ID: uC-gsflnu33B085d08b1
tttccacgcgtccgcccacgcgtccggccatcttttctgataacgtactggcaacatctgtggtcgtcaattctacagtgcttcatgcaaatgagcctgagaaacacgttttccatatagtgaccgataaactgaattttgctgcaatgagaatgtggtttatcttgaatgctcctgaaaaggctacagttcaggttgagaacattgatgattttaagtggttgaattcctcttactgttccgttctacgtcagctcgaatctgccagagttaaagaatattatttcaagaatcatccatcctctctctctgttgggtctgacaatctcaagtacaggaatccaaaatacttgtcgatgctgaatcaccttcgattctatcttcctgaagtggacccaaaactccacaagatcctatttttggatgatgatattgtag

SEQ ID NO: 16094 - DNA, 431 bp, Gossypium hirsutum
  Clone ID: uC-gsflnu33B085d09b1
gtgctttggatagaggatgtctgaatattgaggatgcagggctactctgggcatagtgtaatgagggatacaacgctataggaaagagcgtaggggactacattggcaagtaaagtgttattgtgatgttgtaatatgggactgacgagacagttgacaatgagatcattgacatatcatcctatgtgatcgagaattgtgctggtgcggtctgaggtgttgttcatgatctcgcacggactaggttgtccaattcacttattggggctgcggtattgatgctgcagagtaaccgacagggggcggctacctcgcttaatgattatggtgctagtgacaaagctgtgccttcggagccactatcatgggaggagcctgaagagcttgctgatccgcatgttgtatacgcacaaagtaatcctgtttctgag

SEQ ID NO: 16095 - DNA, 489 bp, Gossypium hirsutum
  Clone ID: uC-gsflnu33B085d11b1
ggcagatattgtcaaggttagtgatgtcgagctcgagttcctcaccggtagcaacaaagtcgacgacgaaactgccatgaaactttggcgacctaactttacactgctcttggtcacccttggtgaaaagggtagccgatactacaccaagaatttccgtggggcagtcgatgctttccatgtcaataccgtggacacaactggcgccggtgactcctttgttggtgcattgctatgcaagattgttgaaaacccaaccattcttgaggatgaagcaaaattagggaagtgttgaaatttgcaaatgcatgtggagccatcacgacgaccaaaaagggagcaatccctgcactaccaaccgaggccgatgcccttgccttaatcaatggagcttagattttaagcaacttgaataatttgcacattgttttgccttccgtgattatcctttcattcagagagttctcaatttattcccctttgaatgcg

SEQ ID NO: 16096 - DNA, 389 bp, Gossypium hirsutum
  Clone ID: uC-gsflnu33B085e02b1
gcgctttatccctggctctaacacggatatggctgtcttagaattatggaaggatgtggaagcccaccagttcgattctgcatcttcaaaaatagcctgggaggcgttttacaagccatttttcggcatggctaccgactcctcggatgaggaggaaaatgaaggtaagcttgccaaagctcttgacgtgtacgaggctcgattgacacagtcaaaatacttggcaagtgactgctttaccttggccgacctgcatcacattcccaacattcaatgcttgatggctacacctgccaagaagctgattgattctcgtccgcatgtttgtgcttgggtgaaagagatcactgctaggcctgcttggtctaaggtcctcgctatgcaaaaac

SEQ ID NO: 16097 - DNA, 196 bp, Gossypium hirsutum
  Clone ID: uC-gsflnu33B085e04b1
ctctcacgcgtccgatttatattatgtaaactcactcctcctatatacctattttcccatgacaagaaaatgtcaaccttcatatgccttcctattctcttttctttctttctttttttttaattattaatattatgattactgtaatccattttgtgtagacccaacccaaataatatttgtttgtttgtttttc

SEQ ID NO: 16098 - DNA, 564 bp, Gossypium hirsutum
  Clone ID: uC-gsflnu33B085e06b1
gtcacttcagctgccacattggagtgggcattatcagagctcctaaggcatccaagggtaatgttaaaactccaacaagagttagaaagtattgtcgggaacaagagaatggtagaggaaaatgatttaccaaaattggagtacctagacatggttgtgaaagaaatttttaggcttcatcctgttgcacctttgctagttcctcgtgagtcagtggaagacataattattgatggctgttacataccaaaacaatcaagggtcttagtgaacatttgggcaatggggagagaccctaatacttggtccaataatgctgaagagttttttccagaaaggttcattgatagcaatatagaccttcatggacatgattttgaactcatcccatttggtgcaggccgtagattatgcccagggaagatattaggattaatcacagttaaacttattctagctcaattagtgcattgtttcaattgggagctacctagtggaatatcgccgaatgaactggacatgactgagaactttgtgtctccgtgccaaggaagatcaatctat

SEQ ID NO: 16099 - DNA, 267 bp, Gossypium hirsutum
  Clone ID: uC-gsflnu33B085e08b1
ttcccaggctttcgcacagccatgagcgccggtagagaacgcacgatcacttgttattttgacaccacacacaccggtaacaccgcgtcgtgcaccgccgcatcgggcccagcaaagatgccccagaccacactgctaagtcttggagcatatgcgcacgtgccgtctgttgatgacacaacggcctaagtgcatgtccagagacacttgctgccctgtactacaagggcgtgttggacatatacgctgccatatgtgtctgtacta

SEQ ID NO: 16100 - DNA, 578 bp, Gossypium hirsutum
  Clone ID: uC-gsflnu33B085e09b1
tttcacgcgtccgcaagctccctaagctaaaatatggggatgcatagtttaccctatctaattgtgttgtttttgaatttaggagcattgctcacttcactaggctgccctgaatgttaccgccacccatctccgccgccgaaatgtcctccgccagactatccgcctaaacatcatcatcctcccattgtaaagccaccctatcaccctaaaccaccaaaacatcatcctccaaagccacctaagcctccggtggtaaacccaccatatcaccctaaaccaccgaagccaccggtggtgaagccaccgtatcaccctaaaccaccttcggcacaacaaacatgccccatagacactctcaagctaggtgcatgtgtggacgtgttgggtggcttagtacacatcggcataggtagcagcgccaaagacacttgctgccctgtactacaagggctgttggatttagacgccgccatttgtctctgtactacgatcaaggccaaaactttgaatatcaatattataatccccatagctcttcaggtcctcatcgactgtggcaaaactccacctcaggg

SEQ ID NO: 16101 - DNA, 389 bp, Gossypium hirsutum
  Clone ID: uC-gsflnu33B085e10b1
gcgcgcgtgcgtgccccggcgcggtttccgggtgtagacacacgcgtgcgcacacgcgtgcgcatacgcattctcccactcgtacggtcactcttccggtctgatgcataagaaacaatgggagaccaaaggccatgtacagctatgctttaaggagggaacagagtgaaaccattctaggcttgatctccctgcaagttggatctgcatgaaggaagattatctacattggtgaccgtaaagggtggaacgagccatttcatcctttgtacctatggtctagctgatggctccattatcattgctgctttttcctttggtgtcgacaggaaaagtgggccagtgatgcccgtcgctatcttcgtaggtttgtgggtgttgacatgatt

SEQ ID NO: 16102 - DNA, 442 bp, Gossypium hirsutum
  Clone ID: uC-gsflnu33B085e11b1
ttcacatttttctcacttatttattctttcatttatttatttgtaaaaactcacacatgtttaggaagaagacgaagatgtgctggcaaacgtatgttgatgatcacctgttgtgtgatatcgaaggcaaccatctgtctgccgctgctatcatcggacaagacggcagcgtttgggctcagagctccaatttccctcagtttaagcaagaataaatcaatggcatcatgaatgacttttctgaacccggatcacttgccccaaccggattgtaccttggtggcactaaatacatggtgattcatggtgaaccaggagctgttattcgagggaagaaggtacctgcaggtgttactgttaaaaagaccaatcaggccttgatcatcggcatgtatgatgagccagatgactcccgaacagcgcacatggctgtggcaaggct

SEQ ID NO: 16103 - DNA, 378 bp, Gossypium hirsutum
  Clone ID: uC-gsflnu33B085e12b1
ttcacactaagccatatgtgcgctcaaggggccggaagtttgagagggccagaggacgaaggaacagcaaggggtttagggtttaagatgacttcagtgtttgttctgaggcttgtttttcatttattactgcaaacaaaattttgctatgcattaggtttctctggcatttgtttacttcatgttggattttgtttacttatggagtagttttctggttgacattgactattaaaatgaaaaaaaaagaataaattgaaaaaactcagatagaaaaaagatggaactaaaaacattaaaagacagaattacttgcatcttaaatttctaatgaaaatgataaaaatattgggggggcccttttagagaaccaaagtt

SEQ ID NO: 16104 - DNA, 401 bp, Gossypium hirsutum
  Clone ID: uC-gsflnu33B085f01b1
ctctcgcgtccggtgatgggcagatcaactacgaggagttcgtcaaagtcatgatggccaagtaaaggacctctccaactataaccaggatttaaaattggggtttaaaaaaaaaggaagaaaggaacagggcagataagtttgctaagatatctattaatgaataggacatctatgtttttatgttacaagcttttgctggatggttctttgtttcatgtttgcattatttggtggaccgaaccttagtattatgcttgtttgctctgcttttttgttcagtagtgctgggttgttaacgtcaatatttttatgctttgtgctttctttcgaacaaactggaagattcgatgttatttttgctttttctgattgactaattttttaggaaaaaaaaacaa

SEQ ID NO: 16105 - DNA, 416 bp, Gossypium hirsutum
  Clone ID: uC-gsflnu33B085f03b1
cgaaaaaatggtacatggcgatggcatctactgaaacgtagctgtgggcagcttatgtggcggttcaggttgcctgagaatgctgatacgtgtcagagcaaggctagcatgagacatatggttgcttgctgcaagtgttcccaaactggacgggaaacaccccggtgtcaaggctatcgacatttctggctaaacgattgaactgcggttcctaaaccgtgtgttttaacactggcagatctgagctcagtccccactatgcgcgatctatactatatgcgagtttacctatgtatgtataaacgttttaaagaacgttgggattagtaatggtcttggttttgcaggttggtcttttatgtatctggaatcaaaagtaacatctcaatttcatacaataataattaaaaacgggc

SEQ ID NO: 16106 - DNA, 390 bp, Gossypium hirsutum
  Clone ID: uC-gsflnu33B085f04b1
ttaccaggttcaactgtttatggtgggttgactggtgctggtgcggcgggtgggtctgttgtctaaagtggagggtcttgatatatataatgacataccaattatcatgttataccaactgaactgtattcatagactgattattatagcttgtctctcttttgtgcttattctagaaactttcaacaacagtctgcgacatactcattgccaatatttgcaattacaacattgactgcaaatataacacacttctacagtgaaccatgacaagaccgtgtgcgcaaacacttcttgctgtattctcaactgcctacatacagactatatatactgtatctctactattgcatgacctcacatcttatcatcagctttccaactttgata

SEQ ID NO: 16107 - DNA, 449 bp, Gossypium hirsutum
  Clone ID: uC-gsflnu33B085f07b1
ttctgtctctactcgaatgctttatgctcttgcaaagcaaccttttacccccaaaagatatttctctatagatcgtgtgttcagaaatgaatctgtggaccgaactcatcttgcagagttccatcagattgaaggcttggtatgtgacaaggggcttactcttggtgatttgattggtgtcctgaatgacttcttctcacgactaggaatgtccaagttgcgtttcaagcctgcttacaacccatatactgaacctagcatggagatattcagttaccatgaaggcttgaagaaatgggtggaaatcggaaattctggcatgttcagacctgaaatgttgcttccgatgggattccctgaggatgttcgtgttattgcttggggactttctctcgaaagaccaactatgatactctacggagtccgattacattccggatctatttcga

SEQ ID NO: 16108 - DNA, 146 bp, Gossypium hirsutum
  Clone ID: uC-gsflnu33B085f08b1
tcttccacgcgtccgcgttttctgtactcgtggatttctactatggaatgttagttttggatttcaatgcttgcacttttattgtgaatatctttgtgatatatgtgtcgactttggaatcatacacattgtgtttagctgaaaaa

SEQ ID NO: 16109 - DNA, 504 bp, Gossypium hirsutum
  Clone ID: uC-gsflnu33B085f10b1
tgaggtactatgactatactcatccaaatggaactgttaatgaaatatggcggcaagtatcgcaaaagctacctctgatcaaacttatgattaatagagacaagcggcttgttaaaagggagttgagtgaacccaattgctcatgtctttgttctaaccagacaggaatcatcgactccttaggataaacataaacttttgctgaccctttgaagttcatttcatatgtcaaatgtctgtccaagttggaagattcgctggtggagcgtgcaggcaggcttttgaggaataatttattatgttattacacccatttcccttcgcctttaggatgtttgtcttcagctggcagagctattgaaatttgcctttgcatgaagactttcttgcatacattgttgtggagtatatttggaattttagttatagttttatttgcaatttgatttgtacatgttagaaatacagtacgtctatatatacaacagcgatgcttaattcttt

SEQ ID NO: 16110 - DNA, 507 bp, Gossypium hirsutum
  unsure (1)..(507): unsure at all n locations
  Clone ID: uC-gsflnu33B085f12b1
tcttcacgcgtccgcccacgcgtccgaaaataaagtccatgtattttctctatgttttttcaggtcatacgggaaacaaggcaggaagaagaagacgaagaagaacaagaagattcaattttcaagcagggaaaccttcggcctcggaagaagcagcagagttgctggaaagaagctgcggcagcaccaccgcaggcgccggcttaagcggatggaaaccgaactggcaaagatgaaagcggagatgagggactcggctgagtccctaatggcaggtaaagtagaagctgatcaggctaaggctaaacttcaagtgctgaagttgaagcttttggcagtgaaggaaattgaagcttttctcatgggttttctttgacttttggagtnttaggaccttcatgtcctaaactccttgctaggtcacaagcaacgcctccttgacttattggagggctacaatcgataagtataatggactcgagactcaaatatgctgttcttatttat

SEQ ID NO: 16111 - DNA, 361 bp, Gossypium hirsutum
  unsure (1)..(361): unsure at all n locations
  Clone ID: uC-gsflnu33B085g02b1
ctgatgttctacaagcaggctaagaaaaccaatcaatgttgtaccatactgtaaacttgcaagagaaagcaacaatgttgtgatatgggattcgtttatgttggcctctaaagttgatgatgattgatgactgaaaactngtgtttataatatggtttttcaagattgtttgctggtgagaattcctgatctttcccctttctgggcaatttgttgtttggatgaaaagtggaagggtaaacaactggtctcaccattggcggagtattagatatttttttcttttctttgcactcgacttgacaaatagatcttatttcttgtttctgtggatagtaatataatataatataataatttg

SEQ ID NO: 16112 - DNA, 562 bp, Gossypium hirsutum
  unsure (1)..(562): unsure at all n locations
  Clone ID: uC-gsflnu33B085g06b1
cccacgcgtccggttttattttcattaaacttgcttaaggagagaagggtgacataaatcaatcagtttcttatttgctgctggggggactgacaggtttcagtaactacaagcgatggcagtggcaaatttccctgcacttcagtttaaaacttgcgatatttttcgttccactccaaaatgtttcaaattgctccccttacaaaagacaaatctttttgttaagacattagtagttgaagcaaaggcaaataccagaacagaaagcgctaaaattaggaacagaagaatgctaaagaagtttaatggcaccccaagaagaccaagactgtcggtattctgttcagagaagcagttgtatgctatgttggtcgatgacaaaacaagaagtgtttattttatggaagcactttgcagaaatctattcgtgacgatcccacttgcaccaccattgatgctgctnaacgtgttggtgaagagctcgtcaaggcttgtattgatcttaacataaacgaaatatcatattatgatcgcaatggatttgcacgcggtgagagaatgc

SEQ ID NO: 16113 - DNA, 358 bp, Gossypium hirsutum
  Clone ID: uC-gsflnu33B085g07b1
tttgctcccagcatttgctgtcaacaggtgaagagaataggccagaatccgagatgcctgcgcgccgtcatgctttgcaacacggataagagttctgggatcaagccggtaactgctatcactattgcaaaacgctggacactggtgatcgtcctgttgtttaccagtgtgcagtatacactctgccttgagcacgaaggctgaagtcatggttcccagatgggctgtttgctggactctgtgctttccgttagctagtacatctagctgatgaattaaccgtgaaatgtatgtattggaaggacaaatagacgtttacaacttcacttattctgtgattcaagggattgcttgagct

SEQ ID NO: 16114 - DNA, 337 bp, Gossypium hirsutum
  Clone ID: uC-gsflnu33B085g08b1
aaaatatttcatgatttataactattgtactgatttgaaacgtttccctcatggtgttccaccagagtgtaaacgcccaaggttgtaatatcaaacctctcctcctttccatgtaatatattctttttttcactactttcttactatgtattcaagttgcactcaacttgatgcttgtggatggatggaataagtggctattattattattcttttttttatgtatttttatttcgttccgaagcttcttaaatcatcttgaaaatagaggacgatcccctgcttctgataataaaattttcctcttttttagtaacgcgcagcgtgaccgcttcac

SEQ ID NO: 16115 - DNA, 533 bp, Gossypium hirsutum
  Clone ID: uC-gsflnu33B085g10b1
tctgatctgagagcaaggtacgttactctttctcctttttatgcttttttgaataataaaaaaaaaactaaagcaaaagaatggggaaaaatgaaaggaaacttgctccttactttcaatcactgtttttcgtattatttcaatggaagttacagaatctcttctcctttttttacaaaaatgaaatggctttatatatagcttgaaaaagaagaaaaaatagatcaaatatagttgctattttgctgttttttttcttcggactcttttagtccgttttgcaagcgaacgtggtggaaacggcacgcgtggaggccgaaacttgcggcgactggagactgctggggtgtttgagggcggcggctacttgctgctctagggttttctgcttttatttaagtattgggcaatttagtgattggctagggttaaatgtttgggctcgcttgctggtctgggccccggcatatttgggctagtacaccccatgcttaagttttcatatttaagctatatatacctgacattgatat

SEQ ID NO: 16116 - DNA, 252 bp, Gossypium hirsutum
  Clone ID: uC-gsflnu33B085h01b1
gtttgctctgtatattgaaattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaact

SEQ ID NO: 16117 - DNA, 494 bp, Gossypium hirsutum
  Clone ID: uC-gsflnu33B085h02b1
ccctctcgtccggtcgaccgaaaaccctaatgttgggaggttaggaggaaaagaagaactggcggtgccgcttctaagtaagaaaatcgtgaagaacagggtcaagatgttcaagagaccccacagcgacgcgaaaaatctcccgttaagacaaactgaggtagaccaaagggtatcgattctcgtggtcagaagaaagttcaagggatgtactctgatgcccaatattggctatggttcagacaagaagacccgacactatctttcaaatggctttaagaaatttgtcgagcacaatgtccgagagcttgaactgtaatgatgcacaacaggacatattgtgccgagattgcccatgatgtttcaacaaagaagagaaaggagattgtggaacgggcagcccagcttgatgttgtcgttatgaacaagcttgctaggctgcgcagcccagaagatgaatgagattaagcttggcctttatgtttatctttgag

SEQ ID NO: 16118 - DNA, 452 bp, Gossypium hirsutum
  Clone ID: uC-gsflnu33B085h03b1
gtttgttaggctcaacttcccccacctcaagcgcgagggagctcatatttctggagaatttggtgactacaagcccctccattctgcagttgatgcaaagctccaagccatctgccagagcctacagaaacatgaattcaggaaaggcctgttctgttcacgattcaaagcccaaggttgagtttgattaccctgtgaagcgtgaggagtttgatcagtctccaagatttgctagtcctaaagttgagatgaactccctgtcatcatcatcatcctcatccccatccccggatttatccgatgagtcattggcaggatcttcttcaccagaatctgatatcactttcttcgatttctctgattcaaagtgggatgacaacgaaattttcggtttggaaaagtacccttcagtggaaattgattgggaagccatcagggaactatctgagtct

SEQ ID NO: 16119 - DNA, 364 bp, Gossypium hirsutum
  Clone ID: uC-gsflnu33B085h07b1
tcttcacgcgtccgcccacgcgtccggtgatgtgggagacaaagtgttacaacaaggcttgaacttggttcaagatatgtcaagcaagacatacaacacgttaagtggctttccggtggtagacagatggagaagctgggagaattttaaaacattaaatagcaaagatgcagtggaggaccctgaaaagattaaattactggtgacagttgaggatacaggtgtgggaattcatttgggtgatcaagatcggattttcactccttttgtgcaagctgacagttcaacttcacgacattatggtgggactggaataggattgagcatcagcatacatctggtggaactcatgcatggggagata

SEQ ID NO: 16120 - DNA, 321 bp, Gossypium hirsutum
  Clone ID: uC-gsflnu33B085h09b1
gttgcctgcctggttgggattgtcctttgaaatttccagtcttcaatttataaagtactttcaggtcctatgaatgttcttaatcttttggtatgctctttcatttttcttcttctagctgggtgagtcatgtataccactatgtgtaaataccctttaaatggatttaggtaaggtggctgttgaaatcattgagtgcatgaccatagcaccctaagagcattggttggatatccaatcattactttgttttagatattcaacctcctacctcaatccagaaattgtaatgatgtattatcctacaccaacattgaaccc

SEQ ID NO: 16121 - DNA, 395 bp, Gossypium hirsutum
  Clone ID: uC-gsflnu33B085h10b1
tgtgggtcgatatggatggtgataacctcgggcgatacgcacgcacgcctcttcccagatgactcgaaagattgctggtattttgtatttgaatgttgtattcatatatgaacatttgaataagtcagttggaaatggttttatctggtaaaaaaaaaaaaaaaaaaaaaaaaaaaaaaaaaaaaaaaaaaaaaaaaaaaaaaaaaaataaaaaaaaaagaaaaaaaaaaaggaaaaacataaaataaaaagatatatataaaaaaaaatctgggggggcccttttagagtgaccgattttatgtcccgcggcaagggagacatatattttttttttggggcaccataattctttttcctgggcggctttataaaacgtgtgtagtgggaaaccc

SEQ ID NO: 16122 - DNA, 531 bp, Gossypium hirsutum
  Clone ID: uC-gsflnu33B085h11b1
tttcaagatgagaaggatcatgaccgtccctttcttcaccaacaaggtcgtgcaacagtacagacatggatgggaagccgaggttgccagtgtggttgaagacgtgaagaagaacccagaagcggccaccaatgggattgttttaaggaggagattgcagctcatgatgtacaataacatgtataggatcatgtttgataggaggtttgaaagtgaggatgatcctttgtttgttaagctcaaggctttgaatggagaaaggagtagattagcacaaagctttgagtacaactatggtgattttatccccattttgaggccattcttgagagggtatttgaagttatgcaaggaagtgaaggaaatgagattgcagcttttcagggaccatttccttgaggagaggaagaagcttgcgagcacaaaaagaactgacaacaatgctttgaaatgtgccattgatcacattcttgatgctcaacagaagggagaaatcaatgaagacaatgttctttacattgctgagaatat

SEQ ID NO: 16123 - DNA, 122 bp, Gossypium hirsutum
  Clone ID: uC-gsflnu33B085h12b1
ttatgtttgaatagatgattggcttctccaatagttcatgaagttgttgtttaggtcattcattcactctgtttacttgcttttctttaagaaaaatcatcctggttttgaagcttgttttc

SEQ ID NO: 16124 - DNA, 67 bp, Gossypium hirsutum
  Clone ID: uC-gsflnu33B088a04b1
actagacttgtggagtatgaggagggggatagcattcagagattgccttgtaatcatgaatttcata

SEQ ID NO: 16125 - DNA, 308 bp, Gossypium hirsutum
  Clone ID: uC-gsflnu33B088a05b1
gctcactcggctggaaaaacactggctgaaaaccttcttctgtttccatcaatgtagatgacgatgattccacatcagggtcatccccaatagcctgaaactgatacaaagcatgattgccaaactctgaagctgcaaatagaaaaccagttttcaacacacacattgaagacgtaactggaattgtatcaaaatacttaatcttcaattccgaaactccttcattttcaggtaggtgccctagggatgccctcaaattaggggtatgtgccaatgtgcttaacttagtcaatgtcaccgttggttca

SEQ ID NO: 16126 - DNA, 444 bp, Gossypium hirsutum
  Clone ID: uC-gsflnu33B088a07b1
ttgctccaattgcgtaataaatagccccgaagcccaaccccttcccccattgaatttgatattttgtgagtgttaaacattgtttgcctttcatttctttctctcttccttgttgcttcctcggcagcctctcggtttctgagtaatcgaagataaaaaaggatggggctgtcttttgctaagctgtttagtcgactgtttgccaagaaagagatgcgaattcttatggtgggtcttgatgctgctggtaagactaccattttgtacaagctcaagctcggtgagattgtcactaccattcccaccattggctttaatgtggagaccgtagaatataagaacattagcttcactgtttgggatgtgggtggtcaggacaagattcgacctttgtggaggcactatttccaaacactcaggggctaatctttgttgttgatagca

SEQ ID NO: 16127 - DNA, 123 bp, Gossypium hirsutum
  Clone ID: uC-gsflnu33B088a09b1
ttgtaaatttctgtatactaactcaacctaatcttatgtcgctgtattggttattccttgtcaatattttaactacttgtttgtatgcattgttaagattgtaattgaaatgcccttttgctc

SEQ ID NO: 16128 - DNA, 171 bp, Gossypium hirsutum
  Clone ID: uC-gsflnu33B088a10b1
ttatgctcccgaaaatggtttccccttggccactaactttgatttgctttctagctttctcggtctccattactcactccaaaactctcaagagagatgtaaaagccttaaatgagataaaagcatcacttggatggagagttgtatatgcatggatcggggacgaacctt

SEQ ID NO: 16129 - DNA, 276 bp, Gossypium hirsutum
  Clone ID: uC-gsflnu33B088a12b1
ttcgtataaaaaaaaaaaaaaaaaaaaaaaaaaaaaaaaaaataaaaaaaaaaaaaaaaaaaaaaaaaattataaaaaaataaaaaaaaaaaaaaaaaaataagggggggtgttatctgggttctcagggtttctttggcgggtttgtgcgtctggggtttttttttgggggtacttgattatctttgtcgggccctggttttataactttgggtctggtgaacctttggtttgttggccttttttggttttggcccccatttattttttttccgt

SEQ ID NO: 16130 - DNA, 474 bp, Gossypium hirsutum
  Clone ID: uC-gsflnu33B088b01b1
gtcatgctctgctcaactcgccaatgggggcttataagtacgtgtcggagctatggaggaagaagcagtcggatgtgatgaggtttttacagagggtgaggtgctgggaataccgccagcatccatcaattgttagggtcaaccatcctactcgccctgacaaggcacgccgcttgggttataaggccaaacaaggttatgtggtttaccgtgtccgtgttaggaggggtggtcgcaagaggcctgttcccaagggtatcgtgtatggtaagcccacaaaccagggtgtcacccaattgaagttccagcgcagcaaacggtctgttgctgaggagcgtgctggccgaaagttgggaggtctcagagttgttaactcgtactggatcaatgaggattctacttacaagtactttgaggttatcctggtggatgttgcacacaatgctatccgcaatgacccaagaataactggat

SEQ ID NO: 16131 - DNA, 310 bp, Gossypium hirsutum
  Clone ID: uC-gsflnu33B088b03b1
cccactcgtccggctttctcagctttttatatattcctacttattttctataaaaatcaaaatggcttctttccttactcaaagtgtcctcaaacttttccttgtcatctctttgtttcaaatctctttggccgttaggaagctgagtgaagtggtgcaagaccagcctcagctcttgacataccacaatggtccccttctttctggcaaaattactatcaatttgatttggtatggcaagtgcaagcctttcgagagggctattgtctctgattttgtcacctcccttttctccacgggtccatctcaa

SEQ ID NO: 16132 - DNA, 483 bp, Gossypium hirsutum
  Clone ID: uC-gsflnu33B088b07b1
tcgttggactttatacagaagcaatccaccaaaacaaaatctgaaaacttttatctcactgctgatgatcgtagatggttcgtcgccactgcctttgaagaggagaagattcactagcattgattccatggaggctgaatcggccaaggccaagctcgctgctgcaaaagagaaatttggacgggaaattcgtgtttttgaaactgctagtctgcttccaacacaagatggagtgcccaacactgaggagccagatgacttctatgatttcaccgcggaagattattatcgactaatggcaagtaaaaaagaagataagcacttgaaaacaagaaaaatccgagaagcagaagaggctgctcgaagatcaagaataacaaaggctgttgtaaggattcgctttccagataaccacacattagagcttacatttcatccatccgagacacttcagagcttggttgaccttatttctaaattgat

SEQ ID NO: 16133 - DNA, 486 bp, Gossypium hirsutum
  Clone ID: uC-gsflnu33B088b08b1
tcgtttcaatctatcttccaacttcttgactcatagagatgctagggccggcacttgcgaacgcctggacggagagctatactctcctagaactgattgcccagagaagttaccggaggcagcaccactgacgacaacagcagcaaacgaagacgctggtctctatgaatttcagagcgaggtagttcaactagccagtgcgcttaatggtgaccacttcttgagcggctttgccgaggagatgcacacaaagatgagcgtaaaaggagctcatgagtacgagaaaggcgcagtttcaaggtttataagagcaagcaaagaggccataaagttgggagccgatgaatctgccatatgtgatatgagatcatcgcttacaactcgatcttcttcgatccacaactagtttatctattacaggttttacaaatgtcttgtaatatgtactaaaactaactttttgtgaaagaattgtctctgaatcat

SEQ ID NO: 16134 - DNA, 219 bp, Gossypium hirsutum
  Clone ID: uC-gsflnu33B088b09b1
tctgatgctttgttcagaaggacccattaatgtcagatattctctcagtgattaatagtgaaacggtttccactcttactgaaagtgttcgcaaaccactctcctgtcatccttttgtttcaaatctctttggccgctaggaagctgagtgaagtggtgcaagaccagcctcagcttttgacatacccaaatggtccccttctttctgccaaattttcc

SEQ ID NO: 16135 - DNA, 274 bp, Gossypium hirsutum
  Clone ID: uC-gsflnu33B088b11b1
tgaaaaagggatttaaagtgctagtactcaatgaagttgacaagctttctagagaagctcagcattctctccgtagaacaatggagaagtacagtgcttcttgccggctaattttgtgctgtaatagttcttcaaaagtcactgaggcgattcgatctcgctgtctgaatatccgaataaatgcaccttcagcagaacagattgttaaggtgttggagttcattggaaagaaagaagggctgtaataatcatctgtctttgtagcccccattgc

SEQ ID NO: 16136 - DNA, 400 bp, Gossypium hirsutum
  Clone ID: uC-gsflnu33B088c02b1
ttactttcctggtgttaaggaatacttacaaaatggtgggttcaagaaaaatgtgccttttttgcaggaactagttgtcatggaaggagtagcccattttatcaaccaagaaaaacctcaggagattagcatgcacatttatgacttcattaagaaattctaggttcttgcccttctcttgttttcaactcttcccttgaagcttgtgacccaataataaggccagttttataccattgcaaggccatttgcttggctctatttaatgctttccctgttttatttgaactactggaattaatatttttgcagtgctttgtgtacggttatcagcttatggaactcaatgctgttctgatttatatataagaaatacagacatccaacaacgttcttcaaa

SEQ ID NO: 16137 - DNA, 89 bp, Gossypium hirsutum
  unsure (1)..(89): unsure at all n locations
  Clone ID: uC-gsflnu33B088c04b1
atanattgatatacatgttcctgagtcctactgatgagctgggtgaaaatcagctctttcctggccaaaagataactcagcaagtgctg

SEQ ID NO: 16138 - DNA, 339 bp, Gossypium hirsutum
  Clone ID: uC-gsflnu33B088c07b1
tcgtcacgcgtccgaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattaatgtctctgactgtgtcttgtgtattagaagctttg

SEQ ID NO: 16139 - DNA, 423 bp, Gossypium hirsutum
  Clone ID: uC-gsflnu33B088c08b1
tcgtctgagcacggcaacagcagagcatcgagccatatcaaaacatcccttactcagccacttttgccaccttcaacggaaaatgtttgacccctaaagaaaattcctaaactttcaaccattctgctttgctgcaaaaaatgaaagaaacaaatggggaaaaaaccaagcactaccctatatcagaaagtttgtgtgtgtatgatttttttttaatttcttttctttttctttttcctttttaatttagtcgtcaatggctgttctctgagtagcagagagggtttttgaaagatgatgatgatcactgtcacagctgtgtatgatggcttatggggggcctgaaattctccatatgcttttttatatgttagtcttatggttcgttttaaagataaaaagataatgcaaattatcaagttt

SEQ ID NO: 16140 - DNA, 352 bp, Gossypium hirsutum
  Clone ID: uC-gsflnu33B088c09b1
tctttttttttttttggattcttaatcaacgacaatggattttgcaggtacatggaattgtagaggaatgtacaacatcgtctgttcattcaacagggcctaccaagaatttgatggtgcggcaactaatgttcttgaaactatggaatcttgagctgcccaaaagacggtggccaccgatgctgcctaggagaactctacggagaaatggcaatgatgcagagtgggttgagaccgagctgaggagttatgcaagtgcataaaacataggatagggtcctagtgcattgtagatgaagcgactggctatatacggcgcaaggtaatgatagtattgtaaaggatggatgcc

SEQ ID NO: 16141 - DNA, 138 bp, Gossypium hirsutum
  Clone ID: uC-gsflnu33B088c11b1
tgccttgaattgcaacgatatcttaccgtcctccacttttagatcgtcgcagttttctatctcgacccgtttgtattttctggagacccgaaatccgacccggaggtttgaaacgatgtttctcgtggattggttcta

SEQ ID NO: 16142 - DNA, 353 bp, Gossypium hirsutum
  Clone ID: uC-gsflnu33B088d01b1
cctcgcgtccgcccacgcgtccggaagagtagatcttggcttctctccttcgttcgattccgcttaattatagcccgcgtttctctcagacgtgaaaaatggggctgtctttcacaaagctatttagccggcttttcgccaagaaggagatgcgtatactcatggttgggcttgatgctgctggtaaaactaccattctttacaagcttaagctgggagagattgtcactaccattcccaccattggatacaatgttgagaccgttgaatacaagaacatcagctttactgttagggatgtttggtggacaggacaagatccgaccattgtggtgacactactttcaaaacac

SEQ ID NO: 16143 - DNA, 364 bp, Gossypium hirsutum
  Clone ID: uC-gsflnu33B088d03b1
ataatccaagataaggaaggcatcccttcagaccagcagcgtatgatcttcgccggaaaacagattgaggacggacggaccttggccgattacaacatccaaaaggagtcaactctccacctcgtcctccgtttgcgcggtgggatgcaaatcttcgagaaaaccttgaccggcaagacaatcactcttgaggtggagagcttcgacacgatcgacaacgttaaggcgaagatccaagacaaggaaggcatccccccagaccagccacgttttatgttggtcggaaaacaacttgaagacgggcgtaccctggccgactacaagattcagaaggagtcaaccgctccatctttgcctttcgttg

SEQ ID NO: 16144 - DNA, 375 bp, Gossypium hirsutum
  unsure (1)..(375): unsure at all n locations
  Clone ID: uC-gsflnu33B088d04b1
ttgatttgaaaatgcttgctcggctcgcgtatcgacgttttctcgagatccgtcaagctttccgtcaaccttttcaggcctctcgatctttgactactgccctgaactatcatcttgataccccagataataancccgaccttccatgggaatgttcggaggcgaacaaacataaatgtcatggagatattgtcttattatgcatgcaaccacaagcaagttgcatttattccttggctagatcttgctacaactcatcatggttgatggctaccagatgccgaagtgaatgcattttcgaaggttatagaagttgttactattaaagcgtatgacgttagccacataatatattcattgcttcaactgaccaaa

SEQ ID NO: 16145 - DNA, 256 bp, Gossypium hirsutum
  Clone ID: uC-gsflnu33B088d05b1
ttttatgcgtccggttgaatgtaggatatgccaagatgaggatgtagactcgaatatggagaccccttgtgcttgctgtggcagcttgaagtatgcgcattgcagatgtgtacagagatggtgcaatgagaagggcaacactacctgtgaaatatgccattagcaattcaggccaggttataccgcgccacctccctcgtttcatattgggcgtattccaatgaactttaggggcaatttgggagatatctaggag

SEQ ID NO: 16146 - DNA, 308 bp, Gossypium hirsutum
  Clone ID: uC-gsflnu33B088d06b1
tgcttccttagtgggtccctagataaatcggccaagctatgggacacaagaacattgactcttatcaagacatacggtactgaacgcccagtcaatgctgttgcaatgtctccccttcttgaccatgtggtgcttggaggtggccaggatgcatcagctgtcacaactaccgatcattgtgctggaaagtttgaagctaaattctatgacaagatacttcaagaggaaattggaggtgtgaaagggcattttgggcctataaaagctttggcttttaacccagatgggaagagtttttcgagtggagg

SEQ ID NO: 16147 - DNA, 157 bp, Gossypium hirsutum
  Clone ID: uC-gsflnu33B088d07b1
tgaactcaaagggctctttggtaagattagaaaaaaaaatgggatagagctaaagacaaagaaaagtcagtggatcaacatgatgctgcttactattagtttcatgtaggcattagaagggtttaaaggagggtgaggggaaaacatatgcacggta

SEQ ID NO: 16148 - DNA, 323 bp, Gossypium hirsutum
  Clone ID: uC-gsflnu33B088d10b1
tcccacgcgtccgcccacgcgtccgttttattttcctattttgcccggccttttttcaaaatctcgtcgattaattcgtacgttcgcctcgattgaacatttcggcgccgccaattttgattttcttgagtttcttcgacacacttcagatccgtttaatcgccatcagggctagtttgcttcaatttgttgtaacttgagggttgttgaaaagaaaaacaaaggtgtcatctgggtgccccagatgagaagaactcatgttattgacagttgaaggaggagggttcttcagattttcagtgtttgggtattgcaagggcttt

SEQ ID NO: 16149 - DNA, 476 bp, Gossypium hirsutum
  Clone ID: uC-gsflnu33B088e01b1
ttcttttaatatttgttcaaagctttcgattacaaatccctcgcgaaagatgcagatctttgtgaaaactcttactggtaagaccatcaccctcgaggtggaaagctccgacacaattgataatgtcaaggccaagatccaagacaaggaagggatcccccctgaccaacagaggcttatcttcgccgggaaacagcttgaggatggccgtacccttgctgactacaacatccaaaaggagtccaccctccaccttgtccttcgtctcaggggtggcatgcagatcttcgtaaaaacccttactggcaagacaatcacccttgaggttgaaagctctgacacaattgataatgtcaaggctaagatccaggataaagaagggatccctcctgaccaacagaggcttatctttgccggtaagcaactggaagatggtcgcacccttgctgactacaacatttaaaaagagtctaccc

SEQ ID NO: 16150 - DNA, 316 bp, Gossypium hirsutum
  Clone ID: uC-gsflnu33B088e02b1
ttcatgcgtccgattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccaccttgtcctccgtttgcgcggtgggatgcaaaatctctagaaaaccttgaccggtaagacaattac

SEQ ID NO: 16151 - DNA, 494 bp, Gossypium hirsutum
  Clone ID: uC-gsflnu33B088e04b1
ctggattatcaaattttattcccgtcctaattggggacaaggacgtttgttctgagatgaaggtgatacagcagggatttgatgcctctcttttttggggaggatcacagatttctgccaataggtcgtcatgtgaaacatcaactttgcgacaaaaagcatattctgaacttgttttagatatagcatggttattgagggagcctaaatcggagaattttcaagaaactatggcctcttctcaaattcagagattcaattgtttattgaattttctcatacaaaacaaatcaactgtcattttgaagaaagtcttacaaaatcttaagaatgtgatggaggaggctgggtttaatggaaccgatgatcctgatacaaggttattaaagaagtatatggattacggtagagatatccttaataacaagcttcaagaaggtgaaaggccggtgcttctttcagagtacatcgagcaagaaggaaaatggaattct

SEQ ID NO: 16152 - DNA, 451 bp, Gossypium hirsutum
  Clone ID: uC-gsflnu33B088e05b1
gcaggtacaaagtagattgtgaaggaaattggggggcaactgaatatttgaatagagtaacaaaaaggttctgctttggagttcataaaaatatccagaggaggacatggtgggcacccgaattctgatattaagattcatacttcaattcttttttgacagttaacttgttattgcttggttttcataggatcagtgatggacatcattcagcttcattgtttagtttctggcattggtgctcatgacataggcagagggaacgaagacaaaataaagagtatagagggactaaatggcagatctttggaaaggcccttatacagaaaacgaggaacaaatatgcctttatggtttttggagccttacaggaatcatgtgcttttggcaatttaacctccctggatagaattggcagagattgctttttcctctaacttgcggaatgctt

SEQ ID NO: 16153 - DNA, 212 bp, Gossypium hirsutum
  Clone ID: uC-gsflnu33B088e08b1
tgggacgaggaggagctggtgctgtccaacagacttagctaccaatgccgatgatgcagcagcagatgatgcccagggggcatgcctatcgttacccccctggtcgtaacatgcctgaagttccactgtctaatgttggtggaggcatgttttttgttctcatccactatcctgttattttttctttccgcacctcacattttctccttttt

SEQ ID NO: 16154 - DNA, 245 bp, Gossypium hirsutum
  Clone ID: uC-gsflnu33B088e11b1
tccacgcgtccgaacactccctttttccccatttattctctgctagggtttcaaaagaaacccattcatgcgccgccaccatgaccgtcgctcctccgccgtggacggtggtcggagcggtaccaaaaggggtttttccttggtttaaaaaaacatgttttgaaggacatgccttctcagccggaaaacccgagagaaagggctcctcttccgtggacggttttaaccatggggagggagggctc

SEQ ID NO: 16155 - DNA, 509 bp, Gossypium hirsutum
  unsure (1)..(509): unsure at all n locations
  Clone ID: uC-gsflnu33B088e12b1
tttttgacgcgtgggcggacgcgtgggtgcaatctcttctttttggagtttcatcacaccagatattacaatgggttcaatcggtgaaactcaaatgacacccacccaagtctcagatgatgaagccaacttattcgctatgcaacttgccagtgcatcagtcctccccatggtcctcaaatcagccattgaacttgacttgctcgagatcatggctaaagctggtccaggtgctttcttgtccccaaaagaagtggcttccaagctccccaccaccaaccctgatgcacccgtcatgctggaccgtatcttgcgtctcctggctagctacaacgtcctcacttgctccttgcgtaccttccctggtggcaaagtggaaagactctatggccttggccctgtctgcaaattcttgaccaagaacgaagatggtgtcactctttccgcccttagtctcatgaatcaagacanggtccttatggagagctggtactactttgaagatgctg

SEQ ID NO: 16156 - DNA, 332 bp, Gossypium hirsutum
  Clone ID: uC-gsflnu33B088f01b1
ttcatcgtccgcccacgcgtccgattcattcaatcagcgatgttaagctacttgtggcatcaactgcatcgggttctagctgctcaaccgtgtcattatcatcttctgctgattccatgtcctctcatgcctgaagaggttgggcttcttcttcgtgcattgggttatccttctaaaacaattatctacctggcaggatctaaaacttttggaggtcaacgtcttctgatccctctacgtgccattgcatgggaacctagttcatcgcactacattgtgcagcaaaacagacctgtcagacttagtacgttctgaagcacctttgcctgctg

SEQ ID NO: 16157 - DNA, 491 bp, Gossypium hirsutum
  Clone ID: uC-gsflnu33B088f03b1
tgttatatcatacccaactattggtgatgcaccacacatgaaggttattgcagacgagaatcctatgagggtgcgaaacgcaacacagactctggatcttcattatgaagcagtggcagatggcgtggctcaaccagctgagcagaggagagcggtgatcgaaaaggaacaaatggagaaggcatcagccgctgtcgctgcaccatcatgagttcagattagaacatggatgctcatacataattgttattgattcagaaatgggtattttatgaaaccaagagttgattccacttgcaggccattcaagtcattcattggctcatacgggcttgaaggtgatcaaaaccccaaataggtcaaggttcaaatgcatcgagattttgtgtgtataaagtacttttcatccgcaaaacacggggttagggaacttcgagtttgccagaattggcttgcctggtgagtccgcccaactcatccatcaggttctg

SEQ ID NO: 16158 - DNA, 157 bp, Gossypium hirsutum
  Clone ID: uC-gsflnu33B088f06b1
agtagatgcaaaagaaggttgggtctgtgatggggaggtctgcactagagcttcatgaattatgtccatgtatacaccaacacactagttggctgtcctgttgatgcagcttggatcatgtgtgtgctatgtaataaaatcttgagatgcagtgttg

SEQ ID NO: 16159 - DNA, 384 bp, Gossypium hirsutum
  Clone ID: uC-gsflnu33B088f07b1
ttgttcacgcgtccgccccatagccaagaccttgcttcttctttctaagcaagcacctttaagccttaaccttcatccccttttatttgttcctttcaagatttttcattaaaaaggctaaagagaaagcatgggaaattctttttttttaggaatattggtaacaatatccctgtgccttcagttgtttggtggaggtgcttatggtcttggtgtgaattggggtaccatggcatcacataaacttccccccaaaacagtggttcatatgttaaaagacaatggaataaagaaagtgaagctttttgatgcagattcaactactatgaatgctcttgcatgaagtgatatcgaagtcatggctgctttttcctaatgattcat

SEQ ID NO: 16160 - DNA, 213 bp, Gossypium hirsutum
  Clone ID: uC-gsflnu33B088f09b1
tccacgcgtccgcccacgcgtccggtcgtgtgtggaattcgttttcagttattgcctccatgttgggaacttcttatttggctttgtcccactccttttccttttattttttttcgttgaagaagctgagccgcacgaaatatgtaaatttacaagtaattttagtattgtagacaaattttaactatctatcttatgttcttccttgtgttg

SEQ ID NO: 16161 - DNA, 375 bp, Gossypium hirsutum
  Clone ID: uC-gsflnu33B088f12b1
tcgttttgagctttcgtgttcgtctattgaattcttttcctcactttctcgaaaaaaaaaatgtctttaggttgcaattgcggatctaactgcagctgcggtgacaactgctcatgcagcaggaaccttaaccttggatattcggagaagacaaccagcactcagaccattatctccggagatgcgccagtgaagatgacctttgagggaccagagatgaccgcttctgaatcaggacatggatgcaagtgctggatcaaactgctcttgtgacccacgcctctgttgaaaatgcttgatgaaagccatagattatgaagagaagagcagccgctaaaatgacaggcctctgcattgatatatcgtcaaggatgg

SEQ ID NO: 16162 - DNA, 210 bp, Gossypium hirsutum
  Clone ID: uC-gsflnu33B088g01b1
tttattcgttcgttatgtttgtctttgctgtcctgcctttccttactgattattgaagcgcgctccttttatatttataacgtgaacatgaaagttatacttactttgataaacaagaagaagccgattaagtggtgcaaagtctattacattgacaagctgtcacgttgaacgcatgtctttaattcaatatctaatctttaaccactt

SEQ ID NO: 16163 - DNA, 355 bp, Gossypium hirsutum
  Clone ID: uC-gsflnu33B088g05b1
gtaatagtcagatctcatctgcaccacacgacgccatggtttaggagacctgcagggtgttatttcctaaggaagaataagccatactccaaatcttgaaactgacgacgggtgccagatcctatgaccagtatttgtggcgaaaccatgaagaaacaaggttgtgacgggtaacttttttgtgttcacatttgaggatcgcttgaaagatacgaactcatgtgagggattgctagcttgcccgttacgcctcatccaagagcaaggtatacccatgtaggcatcgaagctttaaatttcccagggctggttccaccctaacgtgtatcccatttgtaaccgggatgcttttaaa

SEQ ID NO: 16164 - DNA, 331 bp, Gossypium hirsutum
  Clone ID: uC-gsflnu33B088g07b1
ttgcttaagctctacgttttttgcactctcgttgttcgccgagtgtactcgtcggagacatgtcgccggagagaattataatcgatgcaaaagatgaacctcggttacagttcatctttcctttcgttgacaacaagcacttccttccttcctcctatgttgcaccagaagctagagagaacaaaataatgaatgataagagtgacatatatggaatgggtctgattttaatagaattattaacgggaaaaactccggccgatgctgattgtaaagtgcattattcaagcatggcggagagggctcgttattgctactcagattgtcattt

SEQ ID NO: 16165 - DNA, 358 bp, Gossypium hirsutum
  Clone ID: uC-gsflnu33B088h01b1
ttaaatgctaaaaatttctcattttcttcagcttaaagtgcttttggctgaaaattgaccaaattaacttgtcgtcttctcccacaaactttcttttccctcatctgctggttctttggaactgtcttctcccacaaacgtgcttttggccgaaaagaacagaaatttgatttctcattcaggataactgctactgctttgaggcaacccttcagtgcttaaaagcttaaaagatacccaggagaaggtgctggaagaacatgaacaacttggttttatcccttgcttctaaatttaccaaattgctaactcttgtactaggctaagaaactccgcagctttaggacactgctgtgga

SEQ ID NO: 16166 - DNA, 240 bp, Gossypium hirsutum
  Clone ID: uC-gsflnu33B088h02b1
gttgatgatcattggtcaccggggctgctgtggacagagctcataatggattgttcaaacgactcagcctctgggaactaatgattgcagagctactagcaaaaggaccgagagatgctcagaacgctatgctttctggcggtgccgatggtggatagggtgtgatattgcactgtaacaggcttctggcgctacaacccgttactgctaaagtaaagtgcatgccagaagctggcttgt

SEQ ID NO: 16167 - DNA, 454 bp, Gossypium hirsutum
  Clone ID: uC-gsflnu33B088h03b1
ctcactcgtccgccaagctgtagccatggtggaaagggaccaagtaaggcctctagcgccggctgctgacgctccaaccagtgatgacggagaggctgctttgcaactcaaaaaagtcagacgcaagaaactcatccgatgttgcgcttgcatcgctgctttgttcatcatcttagccgtggtcattatagtgttaattttcacagtgtttcgagtcaaggatccgatcatcaaattgaatgccgtctcacttacaaatctggacctaatcaatgctttcatccctacaactggggccaacatatcattaatagccaacgtctgcgtgaaaaatcctaacatagcgtctttcaagtataggaacaccaccactactctctattactaccgcaacgaaatcggggatgcttgaggccctgggggcaccggaaaggcccatcgggccatacagatg

SEQ ID NO: 16168 - DNA, 370 bp, Gossypium hirsutum
  unsure (1)..(370): unsure at all n locations
  Clone ID: uC-gsflnu33B088h05b1
gcatgancgtaacgatcattaacaaaatatggttcagcttcaacaagctagctcaacgttgcacttctttcagttagatctttcttctcgcttctgattcaaatcagatcttaagaaaaccgtgaaccgcatcgatctgatctgcaaaattactagggatttcgtagggcaaaaaatataaacgaaagaagaaatggcgggggcagcatctgcactatttcttctagatataaagggccgtgttctggtgtggcgtgactaccgcggcgacgtctctgctgctcaagctgaacgctttttttaccaaatcttcatcgaaaaagagggtgatccgcagttgtaagatccagtggcgtatgaaaatggagtt

SEQ ID NO: 16169 - DNA, 368 bp, Gossypium hirsutum
  Clone ID: uC-gsflnu33B088h06b1
gatacatcatgtgcatttctttattagtctcacatgattctcactctgtgcctcctttttctctccaatgttagatgaatcgatccaggacgaaaaaccattcttatcagggatggtggatggaagcaccaatttgccagtcaacctttcttgcttagagctgaataaaccaagcttggatgagaccaaccagcgttgttctatttgatgtcttgtctattctactagaggaaacttgatttttagttagagaaaaatgcaggttaaacacttcacaaggccaggacgtttatcgcccttttgtgttgcctgaggaaggaagcatgaattcctgaggcccaccacatttaactcttttgagcactttt

SEQ ID NO: 16170 - DNA, 458 bp, Gossypium hirsutum
  Clone ID: uC-gsflnu33B088h07b1
ttctttacgcgtccggaaaaccccagctgataaacataaaggagagctgttgtagcggacacctacttcacccagcaatagcagaagcaaggcatattttggccttttaattgattctttatcttggaacttgatgctgaagagaatttagtcaggcaagttagaggtttttgcagaaattttattttctatggattggttgtgctgctttaattcctctcagcatggaggggggcgttcatcatttacttctggcaaggggaaaagccatgagggtataatgcggtttggattcagcctagtaaaagggaaaggaagttatcctatggaggattattatgtcgcttagttcatgcagataataggtcacgagttggggctttttgctatatatgatggtcatatgtgagatagtgatcctgcctacttacaaaagcattttgtttttcaatttccta

SEQ ID NO: 16171 - DNA, 481 bp, Gossypium hirsutum
  Clone ID: uC-gsflnu33B088h10b1
tccacgcgtgcgcccacgcgtccggaaaggaaacgtgttgggtaaacctatgcactcgctagacgtgaaccggagcgatggcaagaacaattcaagaaccggcgacacggtgcgccgccttaagatgtacaacacacgggccaagcgtaacgctaaagggaaaatcttgagtcatgagtttcaggctaaagacctaccgaatacacgtatccaacctgatcgccgacggttcgggaatactagagttgtgaatcaaaaggagctcgaatgtttacgagatgagctccaaagccggatgtcaagcaattacaatgtcattttgaaggataagaaattgcccttatatttcttaaaggaccatgctaagcaagctagagcttatattctgcacacagagccttttggagaatgcacctggaccaagacatataggaagcgtccaaagctcctagctgtagattattgagttttaacttaagaa

SEQ ID NO: 16172 - DNA, 350 bp, Gossypium hirsutum
  Clone ID: uC-gsflnu33B088h11b1
tgctgcgccggatggcgaaaccccggtgcctacagctaatagcacaccggttcagcctccagcggtcccacctgcagatgtaccaccaactattgcttcactaccagcagttgtgccacctattgctccaatacctgcgggccgcccttccgtctttaaaccacctgtgcctcaaaatggagaggtgaaagctgttgattgagactctgaccatgaggatgatgggcgagctacagatggcgaatatgagaactcataagagagccgactgttttgggagccacaagaaaaggccatgcatgaacttttgatgaaaccgccctgctgctgcactggcagcctctactaat

SEQ ID NO: 16173 - DNA, 221 bp, Gossypium hirsutum
  Clone ID: uC-gsflnu33B088h12b1
tccacgcgtccgcggacgcgtggggtttgggtcttctttcttaccttctctttcttttttgcagatgttatatttgatgattctttgtgcctttccttttttgcttttagatttttgcgtagaataatttttgatattttctatcaagatgacgtttttcgcctcgaatttattcgggttccgaaatttattagtgtgctgatcgggtcctaatgtttgat

SEQ ID NO: 16174 - DNA, 494 bp, Gossypium hirsutum
  Clone ID: uC-gsflnu33B089a03b1
gttaattgtatgcagaatggacaaaagataacattccctggcgtagctgatgaagcgcctgagactgttactggggatatagtctttgtccttcagcagaaggaccatccgaagttcaagaggaagggagaagacctatttttggaacatacgttgtctcttactgaggcattgtgaggctttcaatttgttattacccatcttgacggtcgacaacttctaatcaagtcgaaccctggggaggttgtgaagcctgattcttgcaaggcaatcaatgatgaggggatgccattataccagaggccattcatgaagggttaattgcacattcagttcactgttgaattccctgattcccttagccctgatcaggttaaggcacttgaggccaatctgtcttcaaaaccaaccttttagttgagggatatggagctagatgagtgtgaggcgaccccgctctatgatgtgaacattgaaaaggagatgaggaggaa

SEQ ID NO: 16175 - DNA, 366 bp, Gossypium hirsutum
  Clone ID: uC-gsflnu33B089a04b1
actcggtatagtgctatggtatgccgtcacaaattacaggacctggatctttgttcttctgtatggctactccatgggagtggaattgacaactgataatgtcattgctgaatacttgtacgacaggtttaatctcaaactacacacagcagggataattgccgccacctttggcatggcaaaccttgttgctcgtccctttggtggttacgcttcagacaaagcagcccaattatttggcatgagaggcaggctttgggtcctatggagcttacaaactttaggagggggcttctgtatctggctaggccgtgccaattctcttcccattgctgtcctggcaatgatcctcttcttcattggagc

SEQ ID NO: 16176 - DNA, 259 bp, Gossypium hirsutum
  unsure (1)..(259): unsure at all n locations
  Clone ID: uC-gsflnu33B089a05b1
cnggtanatcgctcggccttcaaggaaagtttagccctgaagtactcaactggttgtttgttaagggattatttggctggtttctgcaagtcatgttgctgaaagtaacattactctcattaggcagcggtgaggcacctttgctcgacattatggcatatgcagggtatactttcacaggactctgtttggctgttctcggaaggatcgtatggagataatcatactactctttgatgccatggacatgcttatgcat

SEQ ID NO: 16177 - DNA, 119 bp, Gossypium hirsutum
  Clone ID: uC-gsflnu33B089a06b1
ccggtaaatcgctcggactgaaagggatgctatgaacacacataggacagtgatgaacaccacaaactagaaacttcacctgtggtgattgaaaaggcggattattgaaaccgtgcatc

SEQ ID NO: 16178 - DNA, 505 bp, Gossypium hirsutum
  Clone ID: uC-gsflnu33B089a07b1
tttgttatttgaaagttgctgactttggagtcagcaagctgctcaaggttgcaaacagagttaaagaagacaaacctgtgacatctcaagagacttcttgtaagttttctacactgggcaaaactctttatcctccatcgttatctatttatacttggggttttgcttgtgaattattggactagccatctgatttggcctttgttgagaaaatcagaggcaggtagcaggatttgttgttttgattcctaattaactgtttgattaacttgtttactggagaagtgtgttaaaatgatgactaaagatgtttgtttcatgtcatctttcaaattttgcattttaatttgaatcaaataattgaaagctaagtatcctttcttttttaatggtaaatacatcatgatgtatcaatccttcctgagcagggagatatgtggcacctgaagtttataggaatgaagagtatgatactaaagttgatgtgtttcatttgctttgatat

SEQ ID NO: 16179 - DNA, 219 bp, Gossypium hirsutum
  Clone ID: uC-gsflnu33B089a09b1
tctgatacatttcttaattagcctcgtatatctccattgccaatggaagggccactataatatatatatatagattatttgagaaattcagtgtgttaatccatattacccttaaaaaattatggatgctgtgtaaattttgagacacattgtcttcacttcaattgtaattgatttaataagtgtgattgaatgagtcacatattgccatcctgtaaa

SEQ ID NO: 16180 - DNA, 135 bp, Gossypium hirsutum
  Clone ID: uC-gsflnu33B089a10b1
tcggtcctatcgtactaataaccgcatcaggttttcaaggtgaacagactttggtcaatggaacaatgtatgcaagggaggctggctaaatggactctgaaccttgggaaaaggattggctctgagggctgggca

SEQ ID NO: 16181 - DNA, 481 bp, Gossypium hirsutum
  Clone ID: uC-gsflnu33B089b01b1
agtagtgcaactgcaacgcctaattctagcagtacaaccatgactccacctccatcgaccactccaagccggtatgagaaccagaagcgtagggattggaacactttttgccaatacctgcgaaaccataggcctccactctcactttcaatgtgtagtggtgtccatgtccttgagttccttaggtacctggatcaatttgggaagaccaaagttcacaaccagacttgccctttctatggtctccctaaccctcctgctccttgtccttgtcctcttagacaagcttggggtagcctggatgcactcattggccgactcagggctgcctatgaggagcatgggggtaggtctgaagggaaccctttttgagctagagctgtgaggatttacttgagggaagtcagggatttccaggccaaagctagaggtggtagctatgagaagaaaaggaagaggcctaagctgaaggtacctgtcc

SEQ ID NO: 16182 - DNA, 169 bp, Gossypium hirsutum
  Clone ID: uC-gsflnu33B089b06b1
gcgtattgatgttgatggagggccagcagcaaaggcattgaagccgaaattcaatgtcttctcaaagactgtgacatctcacacaggggtgcaagtgccggaattcgatattaagtatttcgtggctggtgctgtggcctttaaaggtgatgggggtgcgaactgaaac

SEQ ID NO: 16183 - DNA, 450 bp, Gossypium hirsutum
  Clone ID: uC-gsflnu33B089b07b1
tttacactgtattcgatttgttcataatgtgagttattcgttgtttttttcccttgaatatatgttcatggtattccaacttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggctccttataaaaaaccaaacttatcactcccttgaattcacataaaaagtttttttttgggccccccaaaaataaataaggggccgggcttttaaaaaccaggagatggaaaaaaccgggggttcccaaattaatatcctttaaaaaaaaaatcctttttttaggatggggttaaaaaaaaaaaaagcccctacaaaaacccttttccaaaaatt

SEQ ID NO: 16184 - DNA, 306 bp, Gossypium hirsutum
  Clone ID: uC-gsflnu33B089b09b1
tcgatcggaatattatactcaatgattggtaccataaaagcacttatgaacaagctgctggcttgtctgctattcccttccaatgggttggagagcctcagtcactcttgatccatggaagaggaaagttcaactgctctactttaactactccaagtttagacgctggtatttgcaatgctacaaatccagattgtgagcctttcagattaatcgcagtccctggaaaaacttatcgattgagaatctctagtttaactgctctatcagtcctcagcttccaaattgagggtcacaattatgaca

SEQ ID NO: 16185 - DNA, 114 bp, Gossypium hirsutum
  Clone ID: uC-gsflnu33B089c04b1
ggtgcattggaggtgatttggaggatatagagccgagcacagttctatgaaggacccaagggaatgcggcggagacccgaaaagttaccccatgagcgagaaaaaggcaagagc

SEQ ID NO: 16186 - DNA, 399 bp, Gossypium hirsutum
  Clone ID: uC-gsflnu33B089c05b1
gtttattaatgatttttactcaagccattatgcttcctgcttggaatatcttggaaacctcaaatcaaacctgatgcttgacattcatttatatgaccatgttgagaccctgtatgatcaaatccgcaacaaagccctcatccagtatacccttccatttgtgtcggttgatatgcgaatgatggctgatgcctttaaaacaagtgttgtggggctagagaaagaactagaagccttgattactgacaaccagatacaggctcggatcgactggcacaacaaaattctttatgcacggcatgcagatcaaagaaacgcaactttccaacgggttttgcagactggcaatgagttcgatcaagaggttagggcaatgctgctgaggacaagtctactcaa

SEQ ID NO: 16187 - DNA, 302 bp, Gossypium hirsutum
  Clone ID: uC-gsflnu33B089c07b1
tcgctacgcgtccgggaagagcttccttttttttttttctctccttttccaccgccgtcgatctcgatccttatcctcgttttcaaacaagctcgaaaaagatggccaacgctgcatcgggaatggctgtgcatgatgattgcaagttgaagttcttggagctcaaggcaaaaagaacccaccgcttcattgttttcaaaattgaggagaagcaaaagcaagttattgtggagaagtttggtgaaccaaccgaatgctatgaggattttactaaatgtctcctcgctgatgaatgtcgatat

SEQ ID NO: 16188 - DNA, 467 bp, Gossypium hirsutum
  Clone ID: uC-gsflnu33B089c10b1
tttgttttttgagcccttcaactcatcattcccccgcccaactctttcaaaatccattggtaatggtgtggagttcctaaatcgtcacctttcggcaaaattgttccatgacaaggagagcatgcaccctttgctcgaattcctcagagtccattgtcacaagggcaagaacatgatgttgaatgacagaattcagaacttgaatgctcttcaacatgttttgaggaaagcagaggagtatcttggtaccctacctcctgagacaccatgtgccgaattcgaacaccggttccaggaaatcggtttggaaagaggttggggtgacaccgcagaacgcgtgctcgagatgatccaactccttttggatcttcttgaggcacctgatccttgcacccttgagaagttccttgggagaatccccatggtgttcaatgttgtgattctcactccccacggatacttcgctc

SEQ ID NO: 16189 - DNA, 382 bp, Gossypium hirsutum
  Clone ID: uC-gsflnu33B089c11b1
ttgctacgcgtccggagagattgggaaaaaaaaccatctcttcgtggagatggaaaatcgattcaggctacgaatctctcgcatgtttcgatcctcgtttggctcctgccggacccggaacgtctccgacgttgctgaaaaagttgtcccctcacttgaaaaccacaacaggttccggtgcatggagtcatcgtcgacgccgccacctaaggttcgacccttaccttccatttgcaaacccagataccctgaatctcatcaaccaacccaaggcacaaggcgtaaagtgtctgcttgttaccctccttttcttctctctgccactgattttgatggccgcaagtgtccttccgcttcccctatatcgcctttgaaccttttt

SEQ ID NO: 16190 - DNA, 304 bp, Gossypium hirsutum
  Clone ID: uC-gsflnu33B089d08b1
ttggtacgccacatggggacgtgtaattttggcggggcagcctacgaagacacccaagcacttagtgcgtattctatcctcctgtgcctatataatgacgcgcatattaaaatattttgtgcatataaactgtaactaacaaggtccacgatcgggagacgtaacgagatgagagactaatgcaagcagacagaggtgcccatctaatagcgactgaaggaattaaaaatagaggtgttactgatctgaagaaccgaggtcctcctggggctgaggctgtggcggttgaggagaggagattgac

SEQ ID NO: 16191 - DNA, 527 bp, Gossypium hirsutum
  Clone ID: uC-gsflnu33B089d09b1
ttttatcgatccaatcaatcgcctcaactacctcaccgaacacatatccaatggctccgatcgctgtcggcgacgtgttaccggacggtactctctcctacttcgacgccgatgataagctccagcaggtgtccgtacattccctggctgccggtaaaaaggttatcatctttggcgttcccggtgcctttacccctacttgcagcttgaagcatgttcctggattcatcgagaaagcgggggagcttaaatccaagggcgttgatgaaattatttgcattagcgtgaatgacccctttgtgatgaaggcatgggccaaaacttaccctgagaacaaagatgtcaagtttctagctgatggttcagcaacatacacccatgcccttggtcttgagctcaaccttggcgataaaggtctcggcactcgttctaggaggttcggactcttggtcgatgacctcaaggtgaaggcggcaaatgtcgaatctggaggggagtttaccgtgtcaagcgctgatgatatcctt

SEQ ID NO: 16192 - DNA, 509 bp, Gossypium hirsutum
  Clone ID: uC-gsflnu33B089d11b1
tttctacgcgtccgcccacgcgtccgatttttccttaaaatatcaaaatcatctgtatattcctataatttttgccctgaattcactaccgtccacaatatttttggtcacccctgcatttttcacagccattaataaacaggatttaaagcttggaagcagaggagcaaatcgttgaaatcagatcggaaaggcaaaggaagaaaagagtgaaagatttgggttttgagaaaatcaattcaaaacgactgggttcactctttttttcctgccttgctgatctttttggggttcttccacaaaaagaaactaaaaaatttgggtgatctgtgttgaaaaagaaataaaaaatggcgacattccaaggaactcaacaaaaatgcaatgcatgcaacaagactgtttatttggtggataagttgacggctgataatagggttttttcataaggcttgcttccgttgccaccattgcaagggtaccctcagcttagcaactccactcatttg

SEQ ID NO: 16193 - DNA, 401 bp, Gossypium hirsutum
  Clone ID: uC-gsflnu33B089d12b1
tgtctcacgcgtacggatccctccaatatttggcatggatgaatttgggtggtgttatgagtggaattctgcaatgacaaagttaacctgttggaaccgagatgaagtggaggataaaatgctgttggagcgaggagcctgcggcgaaatgggtcaccttaataaaccggtcactaaacaaggcgaattatgttactttaagaggacccagatccgttggttcacccgagggttcactggttttccctaaaattaaacttagaaaggccagcaaagctttgaggacagagaataaatggaagctgaagagctgcaactgttctataggtttggaaaggaagaatagcaaagaattctgtttccggtgccctcaatcgcaaacgtatgaaaatgatatttta

SEQ ID NO: 16194 - DNA, 519 bp, Gossypium hirsutum
  Clone ID: uC-gsflnu33B089e01b1
gttattgtccaagcaagggggccaaatgttcctttgggaaattctagctttcttaaaagctcaaaagaaaacattattcagttgtggaatgctgtcagacagcccaacgtatttcttcccacagtttttattttcttgtggcaggcaacaccacagtcggactctgccatgtttttctttacaacaaataaacttggtttcaccccagaatttctaggacgtgtcaaacttgttacttcagttgcatcgctggctggagttggactgtataatggatttttaaaaaatgttcctttgcggaagatttttcttgccacaacagtaactggtacagttcttggaatgacttaggtctttcttgtcatgggattgaaccgacagtttggaataagtgatgagtggtttgcaattggggatttcttgattattacagtccttagtcaggcttctttcatgcctgttcttgaacttgctgcaaaactatgtcccgaaagaatggaagcaacactttttgcaacc

SEQ ID NO: 16195 - DNA, 167 bp, Gossypium hirsutum
  Clone ID: uC-gsflnu33B089e03b1
aagtggaatttcttttcttttttcttttcttttttagattcaatatggcttgaaatccggggatcttaggtgaattgtcttttagatttgttttagttctggcgagatggagatagaggtaacgggttcgagcagcaaggaatcgtttgcgatggtagtaggggggt

SEQ ID NO: 16196 - DNA, 417 bp, Gossypium hirsutum
  Clone ID: uC-gsflnu33B089e04b1
ctgcatagatttgtttttgtagctcaactccccaccaagttcccaaatggcaccccaagctgaagtgcaacaacaagaaatcatttaccgatcaaagcttcccgatatctatatccctaagcaccttcctttacattcatattgtttccagaatctgtccaacgttgcctccaagccctgtttgatcaatggaaccacgggcaaagtctacacttacgaagaagttgaactcactgctcgccgagtcgcttcggggcttaacaagctcggcatccaacaacgccaagtgatcatgcttttgttacccaacactccggagttcgtcctttctttccttggcgcttcgtttcgtggcgccattgcgacggcgggtaatcctttctttaccccggcggagatatcgaagcaggctaaagc

SEQ ID NO: 16197 - DNA, 448 bp, Gossypium hirsutum
  Clone ID: uC-gsflnu33B089e06b1
tctcactcgtccgcttcgctctttcatctctgcaaatcagttttttttccttctcttctcttatcagttctcacccaccaacgtgtccgctagtgttttccggatctgacccgtatcccttgtcggatcgtatcggcacaggtactgcacccaaattaccgagtccggggaacgaaggtcactgccactgtccaatccgaaaatggcgtcgagactagcgatgctaaaacattccgccgccaccgactacggttcttttttaggtctgaggagatggattcatgcttcagcgctccctccacccttgggcgctccaatcggtcatcccccaccatcacaatcgttggttttccccgagtctgatcaaaccccagaaagcaataataacagcaacattgggtttgggtttgggttccggtttccctaggtttcccttgggaggaggatc

SEQ ID NO: 16198 - DNA, 289 bp, Gossypium hirsutum
  Clone ID: uC-gsflnu33B089e08b1
tccacgcgtccgcccacgcgtccgagaaaagaggttttgggagattggtagaatggggacaagagaagtatatgaggaaaagctaaggaatggaaatttgcaccacgatccaaccatcaaccctggcttaggttccgctcgttgtcctcgttgcctttccctcttaaaccctgattccgacaaagctgaatggacaattacttcagttttggaggatgccactgcatctgctggctctggtattggaggattgcttagtgcagtacattgcttttattctggtatccct

SEQ ID NO: 16199 - DNA, 68 bp, Gossypium hirsutum
  Clone ID: uC-gsflnu33B089e09b1
ttctttacgcgtgggttattttttggcccaaatatttgtattggacttttaattttgggatttttatt

SEQ ID NO: 16200 - DNA, 262 bp, Gossypium hirsutum
  Clone ID: uC-gsflnu33B089e10b1
ttcgttacgcgtccgggctaaaatctcgagaccgggatgctttagtggtgccaatgatgaatgcagcggtgctaatgatttatctcgacttcatcaaatgtggctgtacgccataacagctttcgttgctgcaggatatgccttcggaatatgatcatatcctatagtatccgaactctttatcattagattgttcattctgaggcctgcttcagtccattgccatatatagctcagcctctctagtagttttttcgagggg

SEQ ID NO: 16201 - DNA, 261 bp, Gossypium hirsutum
  Clone ID: uC-gsflnu33B089e11b1
tgtttacgcgtccgcccacgcgtccgctcaaaacatactatcaggtgttggatccaaagtcaagaactcaatttctaaggtgaagaaagcaattactggtaaatcttctcatccaaaagaaccaaaagcaatatcaccaaagtgaagcgagaaatgaagatcatcctcaattcttagtacataatcacatattttatgatttgttttataagggtttgttttctgtcaaatattttattgatttgataagcttggtgagtt

SEQ ID NO: 16202 - DNA, 439 bp, Gossypium hirsutum
  Clone ID: uC-gsflnu33B089f01b1
tttattgtacgtccacgcgtccgaaaagaaagtcaatattttttactaaatccctgtaaattcgccaaaaagacttaaaaatccataattcgttgtcttcccgtaatggattttagtcagcctcctgttgaaaattatgccaaccccaagacttgtttctttcatgttctcttcaaggctgcagcattggctttttacatcctttcagctctctttttcaacagctttgtgatcatatttgtggtgactgttcttctttccgcccttgatttttgggtggttaagaatgttagtgggcgcatattagtcggtttgaggtggtggaatgaaattaacgatctctgcgagagtgtatggagatttgaatgtcttgaccaagagttcgtggcttcgatgaacaagaaagattcatggcttttttggtgggccctttaccttt

SEQ ID NO: 16203 - DNA, 320 bp, Gossypium hirsutum
  Clone ID: uC-gsflnu33B089f02b1
attttatagcaagtaatggaagagaaggtgactcccaacaatgttgatattgccaaagtagcaccaacataccatctatacaccccttcagaggtggaagctgtcattactcgcctatgagaatgcgctgccatcatacgatcttaccatgcaacaacctgctttactgtcataatgatgcatgacttgagggggagaagcttgtatttgtttcttggggatcaagctgtgaaaacgtatttttgggtgggcactaaactcatctactcttttagttggataaattaattacaccagatcaaaaaaaagaaccttttttt

SEQ ID NO: 16204 - DNA, 358 bp, Gossypium hirsutum
  Clone ID: uC-gsflnu33B089f03b1
gtcaatttactataaaacttttgtagactcttcgtttcgaagctagtgtttggcctttggtgacgaagaatcagattggttctataagcttctcttatcttcaactcttgactctcaagtgttttactctacgcagcagaagcagaagtcaaaaaggcacaaggctataagtagagaccatgccaaagaacaaggggaagggaggaaagaacagaaagagagggaagaatgaagctgatgatgaaaagcgcgaactcgtgttcaaggaagacggccaagagtatgcccaagtgcttcgaatgctaggcaatggccggtgtgaagccttgtgcatcgatggtactaagcgcctttgcca

SEQ ID NO: 16205 - DNA, 259 bp, Gossypium hirsutum
  Clone ID: uC-gsflnu33B089f04b1
gttagttgaggaaaatcatgggtgccaaagttctcttcttctttgctttgctttccttttcagctgtgtcggcatttgcacaggatgaggaagaccaaggtcttgttatgaacttctacaaggattcttgtcctcaggctgaagacattctcaaggagcaagttaagctactgtacaagctgacacaaaaacactgctttttcttggctgataaacatcttccatgacatgtgctgaccattcattgtgatgctttact

SEQ ID NO: 16206 - DNA, 465 bp, Gossypium hirsutum
  Clone ID: uC-gsflnu33B089f06b1
gttctttttgacataggtcatgaggaggacatggttatagagctggcaaatgaagtaaggaaggtgcttgcaacattggggaatggggtttccaaggagaagcagctagtaggatctcctctgaagatgccactaaaatcccaaacccagacctacatccctacaagtcaattgcttctgcttcccaaagctgttgcaatggactcctagcttttcaaagaactctctagtctctaacagaagagaaggccagtaacttaacgagaagggcgaaccattatatttctgtttctaacctattccttcagtctaaatctagttcttctagtagagaagatttttttgtccaagtatatatccagagcgacatctttagggtcttaccagtattactactactgatttagcctgattgtgatcttggatattaaccgttaaaaggtcttagtttttgtgaaagaaatg

SEQ ID NO: 16207 - DNA, 196 bp, Gossypium hirsutum
  Clone ID: uC-gsflnu33B089f07b1
ttggataaagtacattcctactgtattggctagtgggattctgcacttggaaaatagatctttcgaaattgattcttgggatggtaaaaaggttcctgatgtgcttgcaaagtgcaatttgattccagaaacgggaaaaggtgacgctttcccctttggtatactgtgcacgaaactgttcgaatattgatatgct

SEQ ID NO: 16208 - DNA, 383 bp, Gossypium hirsutum
  Clone ID: uC-gsflnu33B089f10b1
ttctttcatccagcaaatcttcaattaaattggatccatacaattggcatataaagagatggagaatggaggagtagagaacgcccacgcccacggcgacggcaacggcaatgggcaggcggcgtcgtatacttattgggtgagagaaacgacggcggacgctgctccgctccctgttcctaagaagctcactgctcaagacatcctttcaactcaatctcagtctacatctattgtttctgtttggaataaggctggaacttgggaggagaaaaaccttaataactgggctactcaaagattaaaggaattgcttaaatctgtgggttcattggatttatcttgtggcaaggctgaaatttctgatgtaaccaagtgtgttg

SEQ ID NO: 16209 - DNA, 344 bp, Gossypium hirsutum
  Clone ID: uC-gsflnu33B089f11b1
ttgcctcacgcgtccgcttcatctgggcaaaggcaaatctcattaccaggcaaaggcaaatctctctttctaagatggatcgtaatcaagaccaaaatgcaattgtcggagtcgtggcttcagttttagcttttgggctctctggattaaaaattaaaaactaggaaggaaattgcttctcaccctcgtgtgaatcgagattatgaaaaagaaaattatattaatagtattttatatagtggtgaccagcattgtattgatatgataaggatgagacccggtgcttttttttaatttgtgtgatattctttgtatgaattttttttgcttctgtcatcataaat

SEQ ID NO: 16210 - DNA, 437 bp, Gossypium hirsutum
  Clone ID: uC-gsflnu33B089g01b1
cctacttgtgcgaacatcccttcccgtcttcagccggaggtaagtcatggttaagcataacaacgttgtgccaaatgggcacttcaaaaagcactggcagaactatgtgaaaacctggttcaatcagccagcaagaaaggttagaagaaggattgcaaggcaaaagaaggcggtaaggatctttccaagaccaacttctggacctcttcgcccaatcgtccatggccaaactttgaagtacaacatgaagttgagagctggcaagggtttcactcttgaagagcttaaggctgctggtatttcaaagaaacttgcacctaccattggtattgcagtcgatcaccggtcgaagaacaagtcccttgaagggctttaagccaatgttcaaaggcttaaaacttacaggccaaacttgttgtctttccaagacgagctcg

SEQ ID NO: 16211 - DNA, 277 bp, Gossypium hirsutum
  Clone ID: uC-gsflnu33B089g02b1
ttcattggagttttggtgtcttttagtgcttacatatgttcttataaatatgatgtcagttttttgctataggacttgggtgttgaataaacaacctgtaaattagtgtgttttggacaagaagtttgtgcagtctctaatatgattttgtagggtgtattggtactgattaggtaggtggaaactacaggggtttgaagcctgtctagtttggaagttgggtaaatgtagtggcttactcttttttgagtttaatgaaatattttgactttatctt

SEQ ID NO: 16212 - DNA, 317 bp, Gossypium hirsutum
  Clone ID: uC-gsflnu33B089g03b1
aataataccttttttttcagtctgctctccctaaaaagcttccattttttttcctttttaaaattcctctatttctctgtttcttcacaacaacaacaaaaaagtttcaatccaatctcaagtattcatgtgggaggacaagggtcggccattgccgaaatttggtgaatgggatgtcaatgatcctgcatcggctgaagggtttaccgtgagttttaacagggcacgggatgagaggagaacaggtagcaaacctgagtcaccagcaaaagctgtagctcacggttaacctggaccgggatcttagaaaccccaga

SEQ ID NO: 16213 - DNA, 297 bp, Gossypium hirsutum
  Clone ID: uC-gsflnu33B089g04b1
cctacttgtccgcagcaccttctccgtcttttcaatatgggaggtaatgcttccattaatatgacagaagacagtgggtacgggttcccaaattacataccatccccaatgccaaactttgtagacgaagaccgttcacgttctggcaaagctgttgtagggtggttgatagatatggcctccttgcgatggttctattacttcccttatctaacttatcaacaacctgtatttttttcttttttcatattcttcttttatattctcctaaattttctcttttgactggctcattct

SEQ ID NO: 16214 - DNA, 238 bp, Gossypium hirsutum
  Clone ID: uC-gsflnu33B089g07b1
ttgatagctcttttttgggtcattaatagacatatctggattttaacccccccccctttttttctcatctggttgtttggatgtctagaaaatttgttcctttttcttcttggcttttctttgttgcctctggttgagttttagctttttctttttgttggaattctttatggtcacagtgctttgttgtgaggtttgcatttttgcattcttaatttatttcttatctattactatt

SEQ ID NO: 16215 - DNA, 287 bp, Gossypium hirsutum
  Clone ID: uC-gsflnu33B089g09b1
tttttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaaattagc

SEQ ID NO: 16216 - DNA, 406 bp, Gossypium hirsutum
  Clone ID: uC-gsflnu33B089g10b1
tttgtatccccccagaccagcaacgtctcatctttgccggaaaacaactcgaagacggccgtaccttggccgactacaacatccagaaggagtcaactctccaccttgtccttcgtttgcgcggcgggatgcaaatcttcgttaagacgcttaccggaaagacgatcactctcgaggtcgagagctctgacacgatcgacaacgtgaaagccaaaatccaagacaaggaaggcatcccgccagaccagcaacgtctcatcttcgccggaaagcaactcgaggacgggcggactttagccgattacaatatccagaaggaatcgactcttcatctggttctacgtctttgaggtgggatgcagatcttcgtcaagactttgaccggttagaccattactttagaagt

SEQ ID NO: 16217 - DNA, 472 bp, Gossypium hirsutum
  Clone ID: uC-gsflnu33B089g11b1
ttggtacaaatggagtccagctctgcagatccgaactgtacttttaagcatccaggcactcttgagtgctccaaatccagatgatccactctcggagaatattgctaagcactggaaatcaaacaaggctgaagctgttgagacagcaaaggaatggacgcgtttatatgcaagcggtgcatgaagaccggtggaaccgtttgctctcataaaataacatttttatgcaatgtaagctattcaatgtcaattccatattgaaatctggacgaatgacagtttgaaagagtttgatatttgcaaccaaaaaaaaagcttccaggtgctacccttttagtagtaattcggtcggaagcaatctctaagcttgtatgataatacacatggttctttaaaacttccaaaggctttaactatgggaatttttctctaatattgtggaattcagattctggctatatgtggtgggaat

SEQ ID NO: 16218 - DNA, 505 bp, Gossypium hirsutum
  Clone ID: uC-gsflnu33B089g12b1
tttttacaaatggagtccagctctgcagatccgaactgtacttttaagcatccaggcactcttgagtgctccaaatccagatgatccactctcggagaatattgctaagcactggaaatcaaacaaggctgaagctgttgagacagcaaaggaatggacgcgtttatatgcaagcggtgcatgaagaccggtggaaccgtttgctctcataaaataacatttttatgcaatgtaagctattcaatgtcaattccatattgaaatctggacgaatgacagtttgaaagagtttgatatttgcaaccaaaaaaaaagcttccaggtgctacccttttagtagtaattcggtcggaagcaatctctaagcttgtatgataatacacatggttctctaaaactcccataggctttaactatgggaatattctctaatatggtgatttcagaatctggctatatgtgtgtgtaatgaatctatcaactggaaatgaaagaagggttgatt

SEQ ID NO: 16219 - DNA, 356 bp, Gossypium hirsutum
  Clone ID: uC-gsflnu33B089h01b1
gctattttgagactcttctatttagcaatggctgcttctctagctcttaagaggctcgtctcatccaacatcctccctagctccttacgcgtcgccatcgttccatccatctccagactctttaacaccaacgccgccacgcctgatgaccacgatgatcgccgtcgtgctgacggtttcttcccagatctgcaggggcggcgccagggggccaaaaaagatatgtttgatcctttgtctccaacaaggagcctgaacatgatggatcaagtcaaggggaatcgatttctctccacatcccgtgacattccagggcttgggagcgaggccaaagaatcaaacccttcgccgttatc

SEQ ID NO: 16220 - DNA, 296 bp, Gossypium hirsutum
  Clone ID: uC-gsflnu33B089h05b1
cgatgcgtggggttagcgagcagaagcaaagagcctccaaaaaacacttcaaccctctagccatgacattcaagcgtaggaatggtggccgaaacaaacatggccgtggccatgtcaagttcatccgctgctctaactgcggtaaatgttgccctaaggataagtcaatcaagaggtttcttgtgaggaacattcgtggagcaagtctgttgtcagggatcgccaggaagcctgcgtctatgacacgtacactctgtccaagctgcctgtgaagattcatatactgagtatcatga

SEQ ID NO: 16221 - DNA, 215 bp, Gossypium hirsutum
  Clone ID: uC-gsflnu33B089h07b1
tttgctaaatccgccgccccacctatggaatgagcgaatcctactctacttacggccaatctgatggcacccacaacggtagcgcaatgtcgaaaccccaatttcatggtcatgggaatggctacggtagccacatgagcaacgggatggctcacactcaagcatatggctctaaccatcacaacagccctggaaaacaccatggctctgggtat

SEQ ID NO: 16222 - DNA, 225 bp, Gossypium hirsutum
  Clone ID: uC-gsflnu33B089h09b1
tggtgtgtgtgagtacccaaatgtatttcctgaagagttactgggtttaccaccaatacgagagcttgagtttggtattgagttaatgctgggtacaacgtcaatatcgataccttcgtacagaatggcaccgactgagttaaaagaattaaaattatatcctgtttgctgtactttaagcgtcgtgttgtctatttaaatgcaagttttgatcatattgttgtt

SEQ ID NO: 16223 - DNA, 214 bp, Gossypium hirsutum
  Clone ID: uC-gsflnu33B089h11b1
tcgtacgcgtgggcggacgcgtgggcgcgacagcaaccgaattggctgaagttgctgccaaagagggaaagactttctgtgtcactcgtattgatgttggtttagatgcagctgctctccgcgaagcggtttcaaaagttatccaacaaaagggtatgccggttatggttttgagtatcgacgaaaccacaaacacggctggcgtttatactgg

SEQ ID NO: 16224 - DNA, 255 bp, Gossypium hirsutum
  unsure (1)..(255): unsure at all n locations
  Clone ID: uC-gsflnu33B090a02b1
gtcctgncgacaaggatggagatggttgcattactaccaaggagttgggaactgcgatgcgatcacttgggcagaaccccactgaggcagaactgcaagatatgattaatgaagtctattgctgatggaaatgggaccattgtttttcctgaattacttaacctgatggcaggaacaatgaaggatacagactttgaggaggagcttaaagaggcattcagggtgtttgacaaggatcagaatgggttcattcct

SEQ ID NO: 16225 - DNA, 479 bp, Gossypium hirsutum
  Clone ID: uC-gsflnu33B090a05b1
cctacttttccgcccacgcgtccgggtttttagggcttttctaacttttctgattattttttgataatccggagttcaatcatctaaaagaagccctaaaatccttgaatcaggtctgagcttgtggtttgttaggcctctttgatcaaactaagtttcatgtctgatcttgacgttcaaattcctactgcctttgatccctttgctgatgcaaatgctgaggactcaggtgcgggtgcaaaggagtatgtgcatattcgtattcagcaaaggaatggtcgcaaaagcctgacaactgtccaggggttgaagaaagaattcagctataacaagatacttaaagacctgaagaaggagttttgctgcaatgggaccgtggtccaggaccctgaattaggacaggtgattaacttcaaggtgaccagcgtagaatgtatcaacctttcttgttcaggcttgcatagtgaagaggaaaacat

SEQ ID NO: 16226 - DNA, 397 bp, Gossypium hirsutum
  Clone ID: uC-gsflnu33B090a06b1
cttgctttctttatcgttgaagtgcgccaaaatcgaagccttggagaagcgagttgatatggagatgggcaaacatctcaacttagtccaagtaaacaagaccctgactttaaacacatctaaaaaactagccctgccttgtgcatttcaggctttaatgaacttctcgaaagcttctgttcaggtctttgaggccatccatggccatgctcagccagaaatcccttgtaatgaagcatcagagacctcagcaaactaaatttgactgaactgtgaaatttgtatgaaatggctctttatttttgccgaaaactgtcaaatacttgatatctaagctgtaaaggaaacaaggactacaaggtttttctttgcatatatatagatgcacatttaattg

SEQ ID NO: 16227 - DNA, 495 bp, Gossypium hirsutum
  Clone ID: uC-gsflnu33B090a07b1
tggtatcgtaacattcttcagcatgatcttcgagtttcgagtgattacgttagcaagcttgttgggcataaatccgaggtttgtggattgaaatggtcacatgatgaccgtgaacttgcttctggtgggaatgataatcagcttttggtttggaaccagcattcacagcaaccaattcttaaattgactgaacatacagccgctgtgaaagccattgcttggtcaccccatcaaagcaaccttcttgcatcgggtggtggaactgcggaccgatgtattcggttttggaacactactaatggtcaccaattgaacaacatagacacagggagccaagtatgcaatctatcatggagtaagaatgtgaatgaaatagttagcactcatggatactctcaaaatcaaattatggtgtggaaatatccatcaatggcaaaggttgcaactctaacaggccatagttttcgggtcctttacctagccatgtcgcctgat

SEQ ID NO: 16228 - DNA, 259 bp, Gossypium hirsutum
  Clone ID: uC-gsflnu33B090a10b1
tcgtgccgatattctcaagcaaaacggagtctctggtgacagtatcttatttgaccaaggagctaggaccgttcttgccttcgaaactatacgcgccgacggagagcgtgagttcatgttttataggaatcccactgctgacatgctgttgacgccggaggaattgaatcctgatcaaataactatccgccaaagtattccactacggatcaataggtgatgacttaagtgcggtgcacatacggatcacttacaggct

SEQ ID NO: 16229 - DNA, 342 bp, Gossypium hirsutum
  Clone ID: uC-gsflnu33B090a11b1
ttgctacgcgtccgcccacgcgtccgggatatgtggctttatctttctgagcatgaaaagttcaatgattttggaaacgaagcttctcttgtatggcatgagactaacattccttatgtcacttggggtcctgaaagtacccgtactctttctttgaaatactatccttcccaggccttgaaaaacaatggcagtctttatgcccacgttttctttgcacgctctggttaccctccagatcctaatgaccctgaattccagcctcaagctacctttgggaggacttactctgttgtggcatacttacccaagtcaagatcagatatgagctaaagtcctttt

SEQ ID NO: 16230 - DNA, 479 bp, Gossypium hirsutum
  Clone ID: uC-gsflnu33B090b02b1
gttagatcgacgaggagacctcaaataagctagaaggattgcctggtgttctctttgtgctcccagattcttatgtcgatcccgagtacaaggactatggtgctgaattgtttgttaatggggagattgttcaacgatcaccagaaagacaaaggagggtggaaccacaaccgcaaagggcccaagacagaccaaggtacaacgatcggactcgttatgttcgtcgcagagagaacatgaggtgaaaagtataattagaaagaaagaaaatgatttatagaactccttttaagtgtttcttgagatatgggagcattactattatgaagataagacatggaaaagaaaagcttatgttgatgttttttaatgtagttctgaatctgaacttgaatgttttgtggtctgcttgagtttcagcgtaaaactgatgtaggattattatgatgttacctgtgtttattttccttctccttaga

SEQ ID NO: 16231 - DNA, 207 bp, Gossypium hirsutum
  Clone ID: uC-gsflnu33B090b04b1
tctacatgtgccgaactccgaatccagaaacaccaactgaaacataacaacaaaaatggcggccggcaagaagacaaagaagacccatgaaagcatcaacaacaggttggttcttgttatgaagagtggaaaatacactcttggttataaaacagtgcttaagtctctaaggttctccaaagggaaactgattattatttccaacat

SEQ ID NO: 16232 - DNA, 519 bp, Gossypium hirsutum
  Clone ID: uC-gsflnu33B090b05b1
tttatttctctgtatattgaaattttctttctcgattttctttttagccaaaaaagatgcagatctgcgtcaagactctaaccggcaagacgatcactctcgaggtcgagagctccgacacgatcgacaacgtgaagaccaaaatccaagataaggaaggcatacctccagaccagcagcgtctgatcttcgccggaaaacagcttgaggacggccggaccttggccgattacaacatccaaaaggagtcaactctccacctggtccttcgtttgcgcggtgggatgcaaatgtttgtgaaaaccttgaccgggaagacaaataatcttggagtgtttagagttcgcacggacggacaacgttaaggtgaagatccaagacacggaaggattgcccccagaccagcagcgcctgatattcgccggaaaacaacttgaagacggtcgtgccttggccgagtacaacatccagaaggagtcaacgctccatcttgtccttcgtttgcgtggcgggatgcaa

SEQ ID NO: 16233 - DNA, 490 bp, Gossypium hirsutum
  Clone ID: uC-gsflnu33B090b07b1
tgttttgagagcgtcaacagaagattgcgtcattagtggttatgagattccagaaggtaccaggctctttgtcaatgtgtgggctcttggtagggaccccaatcaatgcgagaacccgcttgagttcataccagagcgatttcttagtgaagagtgcaggcaaggcaagaaccagtttttggatgtgaggggacaacacttcatcctgttgccatttgggagtggaagaagaagctgacctggagcttctctggcactacaggttgtcccaacagtccttggcataatgatacaatgctttgattggaaggttagagatggagcacatggcactgttaatatggaggaaaaagctggaatgactcttcttagagctcatgcattgatttgtcactccagtcacaaggctatctccatttccagcagcatgagtattccgatcagaccctagcaccttgcagacatgcttggactatatctaaatatctag

SEQ ID NO: 16234 - DNA, 225 bp, Gossypium hirsutum
  Clone ID: uC-gsflnu33B090b08b1
tgctacgcgtccggaacgataaccgagcttccattaatctgtttaccgataaatgtggttactccaggttccgtacgccggccattttggttaacccggtgttcgttcatcgactcactgtttcaaaccaagttaccgtgatcgaactttccctttcccgacgccgtgttgtcgttcctcttcgtgtatacaccaataaattcaaccaagcgcgggtaaacggcg

SEQ ID NO: 16235 - DNA, 196 bp, Gossypium hirsutum
  Clone ID: uC-gsflnu33B090b12b1
tggtagctcacggggagttcatggtgggtctcaaggtccacacaataaggagcatatcactctcatagctgttgactcagctcaaggatttaaaagccgaactttctctccttcgtgttgccaaggtcactggtggtgcccccaatatgctctccaagaataaggtggtgaggctattcattgctcaagtattgac

SEQ ID NO: 16236 - DNA, 119 bp, Gossypium hirsutum
  unsure (1)..(119): unsure at all n locations
  Clone ID: uC-gsflnu33B090c02b1
aaaatantaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaagcaatccggggcggcgct

SEQ ID NO: 16237 - DNA, 503 bp, Gossypium hirsutum
  Clone ID: uC-gsflnu33B090c03b1
cctactcgtccgctttcccctgtataattatattaggttttcatggatttgtggcttttatctgattccagtttagtgtcagattctaacattttagaatgatgtcatttagatatttagtgagcatcagatggcaaagttaaaacaaaatgaggcactcacagttgagagggaaagggagattcaacaggttgcggagtccgtaaatgagcttgctcagattatgaaagatttgtcagttcttgtgattgatcagggtaccattgtggataggatagactacaacattcaaaatgttgcaactacagttgaagaaggcctcaaacaactacagaaggcaaaagaacacagaaacagggaggcatggtgatgtgtgctacagtgctcgttataatgtgctttgtcatgttggtcctcctaatcctcaaggagataatcttttgattcgcatgcatgtttttttcgttgatgatttccagtttgaccagcggtgagagcccatt

SEQ ID NO: 16238 - DNA, 473 bp, Gossypium hirsutum
  Clone ID: uC-gsflnu33B090c04b1
cttacttcgtccgtggagaagctggtcaactcaatccgacggtccacgttccgccttggccttatgtaagcgatgatctaacggcggaggacaacttcagtgataacggcaaccccttttacctccaggaagcgttagcagcgctgcaatgttacttgccgtccgacgaactgggtttcgagtcggattccgagattttgagcctttacaatccggattctcccgtcgattcttactcgtgcgatcatttccggatgttcgagtttaaagtccggcggtgcgggcgtggccggtcgcatgactggaccgagtgtccatacgctcatcccggcgagaaagctcgaccggaggaccccaggaagtttcattattccggtaccggcttgctccgatttcaggaaagggaactgtcggaaaggagactcttgcgagttcgctcatggggttttcgagtgctggctacaccctgctcg

SEQ ID NO: 16239 - DNA, 470 bp, Gossypium hirsutum
  Clone ID: uC-gsflnu33B090c05b1
cttactcgtccgcccacgcgtccgcccacgcgttcgcccacgcgtccgtgacccgtcttgcgagagagttttttgctttgcctgctgaagagaagcttcggttcgatatgtctggtggcaagaaaggtggtttcatcgtctccagccaccttcagggagaagcagtgcaagattggcgagagattgtgacatacttttcatacccattgaggagcatggactattcaaggtggcctgataagccagagggttgggttgaagttacaaaggagtacagcgagaagttgatgggcctagcttgcaagcttcttgaggtgttgtcagaggccatgggtttagagaaggaggccttgactaaggcatgtgtggacatggatcagaaagcggtgggtaacttctatcctaaatgccctcaacctgacctcactttaggactcaagcgccacactgacccaggcaccatcacactt

SEQ ID NO: 16240 - DNA, 514 bp, Gossypium hirsutum
  Clone ID: uC-gsflnu33B090c06b1
tttttgtggtgggattttcaattaacaatggcctccaaagcaagcagctccctcttccaaagcctgagacgctacatcaagaagccatgggagataactggaccctgcgccgacccagagtacaaaaacgcagtgcccaaagccacggagtatcgtgttcgctgccccgccaccactttgcaaaagcccatcgtccctacctccgaccctgaaaccgtcttcgacatcaaatactacagccgcgatcaacgccggaaccgccctccgatccgccgtaccatcttgaagaaagatgacgtggtgaagatgatgagagagaaaacatttgatgtcaacgattttccaaaggtctacttgactgctaaagttgaagaggatgagaatgccgttggcggaggctaccagaaataggcgagcactgagcactgagcacttatggctgaatttaatggtgcaccagtcccatctgattcactctcttagtagcttggtattgaacacatgcaggtattgg

SEQ ID NO: 16241 - DNA, 344 bp, Gossypium hirsutum
  Clone ID: uC-gsflnu33B090c07b1
ctttcaccgaactttccaccatttttaagaaaaataaaagcttcaattccgcaaggttcggctaagccaattcccatccatggtcatcagaaagctcaatcggctggaattgtgtcagagcacaatcacactatccctcaatccttttggtagcctttggttaaattagtaatggttataaatggcatgtaataggttaaaagttattcaagtgatttggcttgttttgagtggtgccaagcttgttgtggttaatgatgatagatgatgacatgttttggaatggttatttgctatggttggcataggtttaaattaagactctgagatggtgtctgagacta

SEQ ID NO: 16242 - DNA, 482 bp, Gossypium hirsutum
  Clone ID: uC-gsflnu33B090c08b1
tcgtcgtaaccttagtttgttccacagaagtgattattggttgagaaaacatggggaaggacaagcataagcctgatgataagggtctgttttcacatcttgctcatggtggtcatggacaccctcctggcggatatccaccggctggagcgtacccccctcaaggctatccaccagctggctacccttctcaaggaggatacccccctcacggctatccaccatctggctatcctggtgcatcccattcagggcacagtggcatgggagcgctgcttgcaggtggtgcagtatctgccgcagctgctatgggggctcaccacgtgcctcatggtgctcatggtgctcatggtgcttattgtgcttatggtgcttatggtgctcatgggtttgtcatgttcatcacgggacgctctactcttactgcggtgctatgttttttacttttttctcctctttctctatctctctctttctttctt

SEQ ID NO: 16243 - DNA, 80 bp, Gossypium hirsutum
  Clone ID: uC-gsflnu33B090c09b1
ctcagctccttttatcgagttcattaaggctcgatttcgttttttcgccatggcaccgatcaagatcgacctgactgtat

SEQ ID NO: 16244 - DNA, 480 bp, Gossypium hirsutum
  Clone ID: uC-gsflnu33B090c10b1
gataatgaagggtctgcaggcacttatattggcaatggtaatggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgacttcgggttttcttttcctttatttcttttatgtgttgtgtttcgattggtatttatagtcgtgtgattctcaccataatatatattagatttgttcc

SEQ ID NO: 16245 - DNA, 502 bp, Gossypium hirsutum
  Clone ID: uC-gsflnu33B090c11b1
tttatatgatgaaagggagtgagaattgagaaacccagttgcacaaccttcaatggttgcgaatgaagccatttttttaattacccagtttcatacatctcagctacccattcctcatcttcagttcctaatggcagatcttaagttttctttcgctgaaacttttctttgtagtgcttttgctgcttgttttgctgagttctgtaccattcctttggacactgccaaagtcagactccagctccaaaagaaagcagttggtgacgaagttaatttaccaaaatataggggcttgttgggtactatggctaccattgctaaggaagaaagattatcagcactttggaaaggaatagttgctggtttacatcgccaatgcatttatggaggtctaaggatcgggttatatgaacctgtcaaaacgctattagttggtgctgatatgttggtgatattccgttgtaccaaaaaatatagcagctctatgactggtgctctagct

SEQ ID NO: 16246 - DNA, 72 bp, Gossypium hirsutum
  Clone ID: uC-gsflnu33B090d02b1
cccatgcgtccggcagtcataagtttggagtgtggaatgttgtagagtgttttagcctcaagaaacacacta

SEQ ID NO: 16247 - DNA, 440 bp, Gossypium hirsutum
  Clone ID: uC-gsflnu33B090d03b1
cttcttccaggaaacaatttgtcattgatgttttgcatccagggaggcccaatgttgccaaggcggagctgaaggagaagctttctaggatgtatgaggtgaaggacccaaattcgatctttgtgttcaagttcaggactcattttggcggtggcaaatctactggatttggtttgatttatgattctgtcgagagtgcaaagaagtacgagcccaaatacaggctgatcaggaacggactcgataagaaggtggagaaatcaaggaagcaaatgaaggaacggaagaacagggctaagaagatccggggagtaaagaagaccaaggccagtgaatcagcgaagaagaagtgaggtaagatgcccggaacggaaaaaggcgaggatcgcgcttattttaaagcccatgtttttcgagagcgatgcataagtagtctgaag

SEQ ID NO: 16248 - DNA, 370 bp, Gossypium hirsutum
  Clone ID: uC-gsflnu33B090d04b1
attgcagaatctttgacctccgaacatagaaagagctacgtagaatctatgttgatatactagacatgagatggctgagacattgaacgaccggtgtcctgctgatgtgtcgaggaaactgtgtgagtatattgttactcgcagctacatctctgggtaccaagcttcaaaggatgatattaccgtctacgcagctctatctggtgccccatcgtctagctatgtcaatgtttctcgatggtacaaacacattgatgcccttttgagaatctcaggtgtttctgaagaaggctgtggtgtgactgttgagggatttgctcctgctgaggctgttgccactcctccagttgctgattccaaggctgcagct

SEQ ID NO: 16249 - DNA, 445 bp, Gossypium hirsutum
  Clone ID: uC-gsflnu33B090d05b1
cttactttgactgcaaataatattgctcagatatgttacttggatgcacttcggttcggccttaagcggatattttttgccgggtttttcattcggggccatgcctatactatggacactctttccgtcgctgttaatttctggtccaaaggtgaggctgaagcaatgttgctacggcatgaaggttttcttggggcactaggtgcattcatgagctatgagaagcagggtcttgacggcttgactgtgaataaagtaccgcagaggatccccatcagtgtatgctctgccggcaataagatttattgctcaatgaacggtaaatcaaatggcaacgaaagtattgagtgtactgtatacggcacatagagatacagcgtacaagacagggattcttgtggaatatctaggtaactgtccaagagaggaactctccatcggagaa

SEQ ID NO: 16250 - DNA, 341 bp, Gossypium hirsutum
  Clone ID: uC-gsflnu33B090d06b1
cctactcttacgggaaagaagaagatgttcgattgggagcgaacaagatctcagagaggcagcctattgggacagcagcccagtcccacgatgataaggattacactgagccacccccagcacccttgcttgagcccagtgagtagacttcatggacgatgtaccgagctggaatcgctgagttcgttgctactttcctattcttgtacatatcggtgttgactgggatgggagtccttaaggacaaaaccaagtgtacaactgttgggattcaagggattgcttgggcttttggtggaatgatcttcgctcttgtttactgccactgctggaatctcagg

SEQ ID NO: 16251 - DNA, 218 bp, Gossypium hirsutum
  Clone ID: uC-gsflnu33B090d07b1
ttctcactgtcatcttggttcaaccattaccaaggtggatatatttagggatgctgctgttctcatggtcaactacattgatgaaattcgtgcccaaggtttcgaggttgattatttgaacattggaggtggtttgggtatagattactaccacaggggctcgcgcacttcctacacttagagatgctattaacgctgtcaaggaatagctacattta

SEQ ID NO: 16252 - DNA, 181 bp, Gossypium hirsutum
  Clone ID: uC-gsflnu33B090d08b1
atccactggcaccatcggcaagcgtctttcaagtattaatgtagagaatgttgaagacaacaggcgtgctctccgtgagctcctattcacaactcctggagctcttcagcacctcagtggtgctattctctttgaggaatccttttatcaaaataccgctttgtgcaagtcttttgttgat

SEQ ID NO: 16253 - DNA, 297 bp, Gossypium hirsutum
  Clone ID: uC-gsflnu33B090d09b1
tggagaggttaccagtagttttgatgcttgaaagaaagtacgtgacagtttacctcaagaatacaacctattctcgttccaggacgaattttgctcaatacgagattctggtgagttttcgatacttcattttgaactaacaacagacattatagagtattcgaggaaccattgcatactttcttaaaagaatgtgtggaaaggctgtatgctttaatgacaaactaatttctttaaaaggatatgataattcaaacctaattatgtagattcaacttacactgttcttttgtttcc

SEQ ID NO: 16254 - DNA, 360 bp, Gossypium hirsutum
  Clone ID: uC-gsflnu33B090d10b1
tttcctacgcgtccgtggtactctatatcgacaggttgtaggcagcttgcaatacttatgtttaactcgtcctgatttatcttttgcggttaataaagtgagtcaatatatgcatcaacctcatgatgttcattggacagctgtgaaatgtatcttgagatatgttaagggtacgattgatcataggttgttatttcaagcctctggtctgagcttaactggctttagtgatgctgattgggcaagctcacttgaagatcgtaagtctacttccggattttgtatatacttaggggataatcttgtaggatggatgtcaaagaaacagagtgttgtcatccggtctactacggaagctga

SEQ ID NO: 16255 - DNA, 398 bp, Gossypium hirsutum
  Clone ID: uC-gsflnu33B090d11b1
gctaaccagcagtgacccctcccaaccctccgccgcccacgtcaacttgctgctccgccctctcccacgctgacatgcgttgcctttgctcatataagaactccaagctgttgccttcccttggtattgacccaaaccttgccatgaaattgcctagcttgtgcaagcttcctcatcctgcaaattgttagttcctggctctccatatttgatctcaaatgtgagggaaaatcatgcttattataagcctctacttcacattattgtactgagcttcgggttttctttttcccttaatttcttttatgtgttgggtttcgattgggatcttataggccgtgtaatatcacatacgtgtgatttctcaccaataatcatatattagtattgtttcaccc

SEQ ID NO: 16256 - DNA, 106 bp, Gossypium hirsutum
  Clone ID: uC-gsflnu33B090e01b1
cccatgcgtccgacaaaaaaaaaaaaaaaaaaaagagagagaaaataaaaaaaaaaaaaccgataaaaaaaaaacaatataaaaatggggcttgcgttctgacggc

SEQ ID NO: 16257 - DNA, 352 bp, Gossypium hirsutum
  Clone ID: uC-gsflnu33B090e05b1
cctgatttgcagctcatacaataccaagctgacacgtggacgcattgctacgggctcatcagagattatgaaaacagtttgatgatggcttcctcgatgtttatttcgcacttctcagtttcctgttttagttcaatcgttaactcttatggaatgggtaaatttcactttggggcagcagagggtagctggaataataggtttctttattctttgttactcatctctgtaagctaatccgctgcaacatgccagctcgctctggagccggggattgtattagtagaacacgtgaaacttgtaagaatgcagatgctatgtatttggatcatcgctggtgctaaatatattc

SEQ ID NO: 16258 - DNA, 121 bp, Gossypium hirsutum
  Clone ID: uC-gsflnu33B090e06b1
ctttgtcaacagccgaccctactaatggtactgtaagtggaccggtgaccgtagcaaatggagtggtatttggtggttcgacatacaaagatggaccagtgtatgcaatggatggtaagag

SEQ ID NO: 16259 - DNA, 495 bp, Gossypium hirsutum
  Clone ID: uC-gsflnu33B090e09b1
tgagcttgggcatattgttgagtctcctattattcgtacggctacttccattgtgcctcttggttggaatggtattcctggcgagaagagtacggaacaattgaaggttgatattactggattcaggttgcatatgtgcactctggttcatgctcaagtaaatggcaaatggtgttcaactaccgtggaatcatttccttcggcaccagactactcagctgggagtggggaaccacccgaattacaaaaaataagagtcttagtaggagctcccttgaggcgacctcctaagcatcagacactagctgattctttgatgaccatgttcccttcaattaattcagagacagttaatctcaataaagaacatgatatggcatcatctcatcaagaaaaatacgtaaggccagaaggtttgagtgactttttcattttctgtactagtgatttttcaactgcgtcaaaggaggttcatgttagaactcgcagggtgca

SEQ ID NO: 16260 - DNA, 165 bp, Gossypium hirsutum
  Clone ID: uC-gsflnu33B090e11b1
ttaacaatactggagcagaaatggcaatgccgatccccagtcggtaactgtgcatcaacggcgattgggctgagcctctgctcaagaaacgcatacctattattaaccctactactgaagaaatcatgggtgatattccggcggcgactgctgaagatgtggatg

SEQ ID NO: 16261 - DNA, 493 bp, Gossypium hirsutum
  Clone ID: uC-gsflnu33B090f02b1
agcaagttatggaaacctgctgatattcttgagtcggaagaacttgcaaatgaaatacaaggttgtgtgatgaagatgattaagaaaagagaagacagagttgtgaatggagaagctgatagctttggcaatgattttctaggattacttgtaaatgcctatcatgatttggacgacaaaaacatgccttcactgggagacttggtagatgagtgcaaaacattctaccttgcgggataagatactgttaattccttacttacttggacagtctttcttttagcaattcacggagattggcaagagaaagctcgaagagaggtgattgatatatttggtaaccaaaatccacattctgaaagctttgttaaacttaaaattttgatcatgattattaatgaaacttcaagattatatggtctagctaatggccttatgagaaaaactggtagtaaagttctaattggaaaggttgtgtttcctgcttttttta

SEQ ID NO: 16262 - DNA, 416 bp, Gossypium hirsutum
  Clone ID: uC-gsflnu33B090f06b1
cttactcgtccgcaaacatgacacaaatgtccgatcctttaactgcattgatgtatgcagtccaggtgatgaattttctgaagacccttattattagaacacttaaaggaagagaagattctatggtagactctgctcctgtctctcgcttagagccgtctgataagaatggacagcaaagctcttcacaactactcaaagatgccagtgaagaggttaaaaacgaaagcaaaggagagaaagcttttgttgctcaagaacctgccttagagagccctacccactctgctgaagagaatttgacaactgaaactggccctcaaagtttcctaacttcaatcgagaacatttgtgctggaaaccgatctcttgccaataactgtccttggactttagtttttaaatgaacttgttta

SEQ ID NO: 16263 - DNA, 480 bp, Gossypium hirsutum
  Clone ID: uC-gsflnu33B090f07b1
tcctacgcgtccgcccacgcgtccggaagtgcatttgccgttgctttgatttgctttgtggtgaccgctgtcggtggtcaatctccggcagcctcacctactaaagctccgccggcagcgactactcctgccactgctcccgctactgcccctgttagcaaacctaaatcaccggctccaactgctgcccctaccacttccccaccaacttcttcaccaccggctgcggctccggagaagtctgcggcggttccagccccatctaaatctgctccggcttcttctcctccggctgctgctccggtgagttctccaccggctccagtacctgtgagctctcctccagccaaatcgcctcccgttgctgcaccgacgactccaccagagagctcggcctctcctccggctcttgttgcggcaccaactactgctgaggttccggccccagctccaagcatgagctagagcaaaagcttgaaa

SEQ ID NO: 16264 - DNA, 472 bp, Gossypium hirsutum
  Clone ID: uC-gsflnu33B090f08b1
tcctacgcgtccgcccacgcgtccgcccacgcgtacgcaaggaagaaggaaacaatgaagctactggtgagaccaaggaaggagaagataagaaagaagacaacaatggcagcaacaatgaggatgaatctatgaagaagatgatctactattatcagccgctctacgttattgaacgaatgccaccggctcctcagttgttcagcgatgaaaatcctaatgcttgctgcatttcatagtcaaatgatcatactagttgacagtatatagtgtatatgtatatattttgttgagtccgtgccactggtaatgagaattttagagcaaagcggtggacggatcgcatgatgatcaatcagcgaatgtggggaactcgggataatcacaatacaagtgaggctaataataatatgattattatgtattaaaatgtatcatattgtaattaataatatgattgtatgaaaaatga

SEQ ID NO: 16265 - DNA, 410 bp, Gossypium hirsutum
  Clone ID: uC-gsflnu33B090f10b1
tctcctacgcgtccggcttcaccggccatgggtatcgacttggtcgccggtggcaagagcaagaagacgaagagaactgctcccaagtccgatgatatctacctcaaactcatcgtcaagctttaccgatttctggtaagaaggactggcagcaaattcaatgctgtgattttgaagcgtctttttatgagcaaagtgaacaagcctcctctctctctatccagattgattgaattcatgaagggcaaggaggataagattgcagtggtagttggaactgtcaccgatgacattcgtgtatatgaagttcccgctctgaaggttactgcactaagggtcactgagacagcgagggcgagaattgacaaggctggtggggaatgtttaacatttgaccaacttgctcttct

SEQ ID NO: 16266 - DNA, 466 bp, Gossypium hirsutum
  Clone ID: uC-gsflnu33B090f11b1
tttcttttacagcaagttatggaaacctgctgatattcttgagtcggaagaacttgcaaatgaaatacaaggttgtgtgatgaagatgattaagaaaagagaagacagagttgtgaatggagaagctgatagctttggcaatgattttctaggattacttgtaaatgcctatcatgatttggacgacaaaaacatgccttcactgggagacttggtagatgagtgcaaaacattctaccttgcgggataagatactgttaattccttacttacttggacagtcttccttttagcaatccacggagattggcaagagaaagctcgaagagaggtgattgatatatttggtaaccaaaatccacatcctgaaagcattgtcaaactcaaaattatgaccatgatcattaatgaaacttcaagattatttggtccagcaaatggcctaatgagaaaaactggaagagaa

SEQ ID NO: 16267 - DNA, 411 bp, Gossypium hirsutum
  Clone ID: uC-gsflnu33B090f12b1
tttgtgaaactaggtgtgaaacaatggcgtcctcggatcttattggcaagctcgagactgatgtcgagatcgatatttctcccgaaaagttccaccatatgtggtgccacaggccgcaccatgtccaccacactagctctgaaaaagtacaaggatgcgatttacatgaaggtgaatttggaactcccggcgtcgttatctgctggagatatgtgcatgatggaaaggctaaaactgcaaagcaggtagttgaagttatggaccatgagaaaaagtcattaactttcaaaatgcttgaaggagatctgatggaggaatacaaaagcttcgtgatttcaattccaaactttccccaagagcgattgttaaggcagcatcgcgcactgacctctggtttttgaaatgcttctc

SEQ ID NO: 16268 - DNA, 466 bp, Gossypium hirsutum
  Clone ID: uC-gsflnu33B090g03b1
gttcttacctttggagcagtagacgccgaggaatccactttggaccttgatattggtcttgccaagacgttgcaggcttgtttttaagtcactataccactcgggtggagccacagtaccccgtcaagccacgaggatatctggcctacctattctcgtggtttcagcatgaccactaacggcaacgtaccccatccagctcgaatccttgctccaagcacaatgtgacttctctaaccattccggaacatcgacatgggacatggcataaatgtacttgggaaccttgtaaccatgtttagtaagtcctaggtcttcaaacagtggattcgggttgtacctacagcttccacagaactgcgataatggatcgaaatcaaaagcatcgtaagtcgtcttgacgaagctatcgtacttgacaactttacgtctaaaccaaggatggagtggctcaatgagcccctcc

SEQ ID NO: 16269 - DNA, 53 bp, Gossypium hirsutum
  unsure (1)..(53): unsure at all n locations
  Clone ID: uC-gsflnu33B090g05b1
cagacgtccgaccacccaccgacgtantgaaggactttggctgattacaatat

SEQ ID NO: 16270 - DNA, 369 bp, Gossypium hirsutum
  Clone ID: uC-gsflnu33B090g06b1
catggttatgggacaaacaccggaactttgagcacagctctgttcaccaatgggctcagctgtgggcctagctatgagattaagtgtgcgaatgatggcacgaggtgcctgcctggttccattgcgggcactgtcaccaatacttgccctacgaacaatgctcttacaaacaatgctggtggcaggtgcaacccttccctgcaccactttgaccttcatcaggctgtctttcaacacattgctcagcacaaagctggaatcgagcctgtaatttacagaagggtaccatgcaggagaaagggagggataaagttcacaatcaacggccacttctactgtaacctagacctcatcagaaacgtcagcagt

SEQ ID NO: 16271 - DNA, 322 bp, Gossypium hirsutum
  Clone ID: uC-gsflnu33B090g07b1
tgataaagctgggtttatatccggaggatcatgaatggcgaggaggctacagtctggaaagcgatgactaaaacccctgcctccattgtgctaataatctacaaaccagtctacatacgagaattttaggtaccggtatgatcgtcatgagaatccatacaacaaaggggtcatcaggaacttcttggaggtattctgcaccagtgttcctccatccaagataaacctcagggaaaaggttccaaaggaaccagtcattgcaccgagaacagtgagtggaggttttatcagtccattcaacgggaaagctatttggtgacat

SEQ ID NO: 16272 - DNA, 378 bp, Gossypium hirsutum
  Clone ID: uC-gsflnu33B090g10b1
tgatggaaggactttggctgattacaatattcaaaaggagtccactcttcaccttgttcttcgtcttcgtggtgggttctaagccttaaggtcttccttaatgtgggttttctggttttacgtgaaggattgtgccctttgatggccttttaaataatttctagtctttgtttaccggttgcatctatgtatggtttctctttgaatggaatttgcatatttacctaaaaaaaaaaaaaaaaaccaaaaaaaaaaaaataaaaaaaaaaaaaaacttaaatacctatcttactttaaactataacataaattgggggggccgttttagggaaccaagttttccctcccggtgttgggaaggtataatttttttttagg

SEQ ID NO: 16273 - DNA, 376 bp, Gossypium hirsutum
  Clone ID: uC-gsflnu33B090g12b1
tggttcttttattaaaaaagaaaaaaaaagaaggagggtataaacaaaaaaacaaagagaaaaaaaaaagacagaataaaaacgttaactaaagaaaaactattgctgctaactagctacacggaggtgatcctgatgaaataacaaaataggggggggctcgtttttggggcccaggtttttctcgcccgtttttcggcctctgatgcttttatttggggtgcgcaagttaaatacgcggggcggtgttttccacgtgtcgataggggagaacctggggggtccccaaatttatgtttttgagagcgatgtcctttttcccaggggggttctattttagaaggggcccctttggttgttttttcaaaaatttggg

SEQ ID NO: 16274 - DNA, 158 bp, Gossypium hirsutum
  Clone ID: uC-gsflnu33B090h02b1
accatccattaggggggaagcatgaaaatgtaacaaatgagggttttttttttgtcagaaaagtgaaaagaaaatcatgttttgtcttattgaattaatggatgaaagaccatgacactttgtttaaaaagatccgagtattggattcatcttacaat

SEQ ID NO: 16275 - DNA, 171 bp, Gossypium hirsutum
  Clone ID: uC-gsflnu33B090h10b1
ctcacgcgtccgaaagtcgtaaccgtcgttgaggaagaagctgacttttcaagcactcgatacgacttcgtcaaatgctttgaagaatgcctgagattttacacagtctactttgaaatgcttgaagaaagcttcaccccaaccagcaatgagaagcttatgctgtagagg

SEQ ID NO: 16276 - DNA, 445 bp, Gossypium hirsutum
  Clone ID: uC-gsflnu33B090h11b1
tgatatttctttattgggacggtgttcgacctgaacttgtgatttcagaacctgaactaattaaagaggttttgaaaaatagtgaaaagacttttcccaaaaggaagcctaccattttcattaacaagctactaggggacgggcttgtgaccgtggaaggtgaaaaatgggtgaagtagcggaagttggcgaataacgtttttcatggggaaagcttaaaggacatgagaccagcaataattgctagcgttgaaacaatgctaaagaaatggaaaggccaagtaggcaaagagatcgaagtgttccatgaattttaattattgacttccgaagtgatctcgaggacagcttttggtagcagttacttggaaggggagaagatttttgaaatgttgaacaagttgtcaatagttctgagccgaaatctttcaacactagaattccc

SEQ ID NO: 16277 - DNA, 66 bp, Gossypium hirsutum
  Clone ID: uC-gsflnu33B090h12b1
ttgttcactatcattacagtagaatggcaaaggaactgtgaccactattgggatctttgtgatgtt

SEQ ID NO: 16278 - DNA, 480 bp, Gossypium hirsutum
  Clone ID: uC-gsflnu33B091a01b1
ctccgcgtccggggttttggagggtttgaaggaggaggtaaagttgaagcctttgaaggctttgttgacttggctggctgggaattactcatttcaaaacaatgagaagaaaaacgatggggttttgaagaaatgggatttcaaagattgaaacaaagggaaaattttgaggaaatgaagctgtaaagattgaagcaaataaggaaaaaacatctacaggcagattgaaattagagtaattgagaaaaacgcaatggctcaaaagatgttgatgatggcggtccttgtgatattggggacgaagatagcgacatttacggctgcggatccgacttgtttgcagagcttgatgtcttgtgctccttacttcaacaacgccactctccaactgaaaggcgattgctgtaaccctctcagacaagccgtcgctactgaacttacttgcctttgcagcctcattaataactctactttgcttag

SEQ ID NO: 16279 - DNA, 477 bp, Gossypium hirsutum
  Clone ID: uC-gsflnu33B091a02b1
tgtcttttcttgtgtctgttttgttctacatcgggtcagggtcttgagactgttgagatgagccattttatcacccctgaaaacattgaaagacttaagcaggcacaagaagctgacagagttcaagtatttttcttatacaaactatagtcttggtctgttcaaacttcaaactgtctatttcttttacgattttcgaaaatataacgtataaaaccatagaacatcagacctcaatactgcttgaaatatcttagtatggcatcgaaaaaaattcttctgcttgtttatccttgtgttggaaaatgtttccccagcattcaacttattcttgtccaaagtttgattttgaaccgatgcttcaagttttatgtctttggtctttgttttaatcttcagcttgattacactcaaccaattccaaaggaggtgccaaaagaagctgctgttgctgatggtgatagccagattggcact

SEQ ID NO: 16280 - DNA, 325 bp, Gossypium hirsutum
  Clone ID: uC-gsflnu33B091a05b1
agtcctgaccaactctccgccgccgtcaccggggccgcatctgacaccgtctcagatccaagcaatgggccgcgtccgtaccaaaacagtgaagaaatcctcccgtcaggtcatcgagcgctactactctcgcatgaccctcgatttccacactaacaagaagatcatcgaagaagttgccattatcccatccaagaggctccgcaacaagatcgccggcttctcgacccatttgatgaaacggatccagaggggtccggatcgcggaatttccttgaagctccaagaggaagagcgtgagcgccgcatggattttcgtccccga

SEQ ID NO: 16281 - DNA, 216 bp, Gossypium hirsutum
  Clone ID: uC-gsflnu33B091a10b1
tccgccaaaaaaaaaaagcaaaacaaaaagggagaaaatcaaaaacaaatgggagcaagaaccaaggaccgaactagccttcgaaactatacacgccgacggagagcgagagatcatgtcttataggaatcccagtgctgacatgctgcagacaccagaggaatagaatcctgatcctaaaagacccatcaaagaagaccactacggagcaataac

SEQ ID NO: 16282 - DNA, 351 bp, Gossypium hirsutum
  Clone ID: uC-gsflnu33B091a11b1
tccacacgtgcgatctgcttgatttaaaagggaggcctttcataagatagtgggaacaaacaaagactgcggaacggcacatgggtgagtaaatcagctgtagctcgttggatgtgacatgctactccgataacgggcgtgttccgcgagcttgtacacgcatcgtaccctgccttttgtaatgaatggctttgtttcctaagaggtcctctttttcttgccgccagagctctgtgattcgtaccacctggtccattggagtgaaacctccttgttccagtctcagtgcattatgttcttcctatgggttgatggtgggagaccccttggtgagcacttaagagagctcgt

SEQ ID NO: 16283 - DNA, 393 bp, Gossypium hirsutum
  Clone ID: uC-gsflnu33B091a12b1
tctacacctccagctaccgttctagacgatggactcttacaaacccgtgactgcgaccagataactactgcataggggaacgtagatgcaatagacctgccggtgatccacaacgaccagactgggaagacaacggtgctacccatgtcaatgaacctgacctcatgccaacatctacaggtttagtaactgcgaaaaagcactcacaacgcgctcatgccaacagttgaccatgctcaaacgcctactgggacactggcttgaaccatacattaaacagtatcagtgcattatgtaccgcagatcactgcatggcggaagaccctagaggagcaccgtagcggtttctagtgatgctgaattgcactcgcctgaccggctgagcctaagctg

SEQ ID NO: 16284 - DNA, 484 bp, Gossypium hirsutum
  Clone ID: uC-gsflnu33B091b03b1
ttttaatgaagctattattgaagaacgagagcaggggatcaaagaagttcagcaacagatcagtgaggtgaatgagattttcaaagatctagcagatttggtacatgtgcaaggaggcatgattgatgacattggttcgaatattgaaaattcccattccggaactgtgcaagctatttcacatcttaaaagggcatccaagatccagagagcaaattcatcaacaaggtgtttgctggtgttaatctttgggatcattctccttattttcatcatagttgttgtggcttaagcctacagatttggcatctcgagcttaaaagttctccgaagcagtgagtcaggtggtatgccatccaaagcatacagtaatatgtataatctgtaatactaattttttatgctgtaggtaaagaccctctatggaggctctctgttttgcagcaaagcatgtaaaatagattgcctcgtgtaataaaatttc

SEQ ID NO: 16285 - DNA, 334 bp, Gossypium hirsutum
  Clone ID: uC-gsflnu33B091b07b1
tcgaatcatcaacctctcgatagtgagaagaggaggctgtgacacgcattgagttgcctatcttcggtttccatgcggcaaaagtcctcgttactcctacaatcacccttaagaggctgctttccaccttgggattcgaagaaatcgaacaatgtgtcatgttgaaaaggtaagacaaccaatcgggttttaacattcatctgcaatttgagattttctttcggggtttgtcgccttaattgtgggactgttgttctcatgtattgtacactaatgtggtgttaactccttgccctcatagtgtgtctagtgctttctccggcattgttttgcc

SEQ ID NO: 16286 - DNA, 272 bp, Gossypium hirsutum
  Clone ID: uC-gsflnu33B091b08b1
tgtccaaacactagaccagtggtcctgaactgggaaaggatataagacttcgaagccttttcaccatgagagctaagcggaagaagaagcgtatgaagaggctgaagaggaagagaagaaagatgaggcaaagatctacgtaggctaactttatcttaaagccagcaattcggtctatgctggtatagactataggttgcttaaatgataccccaatataaaaggactgcagttatctttaaggaaactagtcgaagaaaccggaagctttt

SEQ ID NO: 16287 - DNA, 336 bp, Gossypium hirsutum
  Clone ID: uC-gsflnu33B091b09b1
tccacgcgtccgcccacgcgtccggaagctggagcttgttgctcgtgtaactgtcgctatagagaaccctcaagatatcattgaccaatctgcaagaccctatggtcagagggctgtcttgaaatttgctcagtacactggctgtcatgccatcgctgggaggcacactaggggaacattcactaaccaactacagacatcttgtagagagccacaccttcttatcctcacagatgctatggccgaccacccaccgtctcaggagagggttcttagggcagttcctaccatagctttgacgaacacagactcacctacgggtgttgatcccacttg

SEQ ID NO: 16288 - DNA, 335 bp, Gossypium hirsutum
  Clone ID: uC-gsflnu33B091b11b1
tgtccacgcgtacgcccacgcgtccgcaacgggggctccgtactcaacgatccggaggaacagcgccgccgcatggtcgagcagctcgagcaggcgcatgcccgcggcgagaaggaaaagcagctcgacgaggaattcctcgacgccatggaccagggcatgccgcccgcaggcggccttggcatcggcgtcgaccggctgatcatgctgctcaccaacgccccgtcgatccgcgacgtcatcctcttcccggcccggcgcaacaaggactgaggcccggagacggaaaaggcagccggaaggctgccgtgtctgtcgaaaacctcttacttggc

SEQ ID NO: 16289 - DNA, 130 bp, Gossypium hirsutum
  Clone ID: uC-gsflnu33B091b12b1
ctccagatcacaaggacaccctctctactcgggggtgcttaacaaaactaggccgctaacccatctcacgggggagccccaccataaataccaccccccataaaccagatttaacatccccaaaaaacac

SEQ ID NO: 16290 - DNA, 161 bp, Gossypium hirsutum
  Clone ID: uC-gsflnu33B091c01b1
gtctgatgttatgaataaagatgaaaaaatcatggagatatcaaagagaatcaagtgctcaattggatgtgcttcaaaggcaatttttttcttttattttctatggttttattacttattgattttctttttgttggtttaaatttttgaaataattgtcc

SEQ ID NO: 16291 - DNA, 287 bp, Gossypium hirsutum
  Clone ID: uC-gsflnu33B091c03b1
ttttgaggatcgtctaatgaagtggacctttaaaactgtgaaacgctatcgagaaaggtggtgcatgtttaatgataacctacaagccactgctggagtggcacttgctgtattgttaggaactgtaagatacacaaggaggatctttggatgattttccaaaccacatgatagttatggagagagcccgaagtgcagggattgctgttctatagatggatgatcaagccgatgtgcaggatgacaggaaacgcatatacatgtggacataacaccttcactacttg

SEQ ID NO: 16292 - DNA, 353 bp, Gossypium hirsutum
  Clone ID: uC-gsflnu33B091c04b1
ttcacgcgtacgcccataccccttctgttgaacagcaatgatggcaactgtgcgagttacctcctctagtatcgttcaagcttcgatcccgaaccgattcacgagtgccattgtcaaggccccgacttctcttggatcttttaagaacatctacaaaccttttggcttgaaatgttcctccaatcacaaaacatttatggcagcttataagattaagcttgtatgaccggatgtcgaggtgagcgagtttgaagcccctgacgatcaatacattttagatgcagccgaggaagcaggagttgaactgccatactcttgccgagctggagcttgctccacatgtgccgggaaga

SEQ ID NO: 16293 - DNA, 231 bp, Gossypium hirsutum
  Clone ID: uC-gsflnu33B091c07b1
tgagcctcttgatggcaactggcctacaattcttaagaacacatttgtagaccgtgcttgatgcaccactaccaattatatacttctcactcagattctcagtcaccctcataatgtcctcgtatacatgaagtgccatattcatgtgaaggatcaccaatttcggtcttgagtaagtaactgccgtcaagaagtccatgaatcaataacaagggccataaatttcaatag

SEQ ID NO: 16294 - DNA, 464 bp, Gossypium hirsutum
  Clone ID: uC-gsflnu33B091d03b1
tttgtttcagttcacctcaggaaaatggcgaacgatgagcacttgcacaaagcttttgccttctttgatctaaatcaaagtggtttcttagagatagaagatctgcgagattccttaaacgatgaagttgataccagtgaggaagttatcaatgccattatgcttgatgttgatactgacaaggatgggcgcataagttacgaggagtttgttgcaatgatgaaagctggtactgattggagaaaagcatccagacaatattcacgagaaagattcaacagtctaagcttgaagttgatgagagatggttcattgcaattaggcaattgagtacaagtctaatggaaatgaatgaatcaaagaacagtaagtacccttgctgtggaaggggggaaaaagagggaaaaacaaagattatccttgatttttgtttggttggatatcggtcaatttctttttaattt

SEQ ID NO: 16295 - DNA, 479 bp, Gossypium hirsutum
  Clone ID: uC-gsflnu33B091d04b1
tttacgcgtccgctttggtctgggtaccaactttatgttttctttctcctttcagaaaaacacttccttcatcctaagtaatttgtatctgtttcagacaaagagaaaatctctagttttgaacaagggctgtgaaaaggagaaatagatggaaagaaagggcttagttttatgcagtgttgtcgcctttctgggagtattatcagccgctactggttttgctgctgaagctactaggatcaaggcttcagaagttaagtttgtatccactacacaatgttcttatccccgaagtcctgcacttggtcttggcttaactgccgctgccgcacttctggtagctcatataattattaatattccaactgggtgtatttgctgcaaaagaaccagtcgaagttggaactcctactggacaaaagctcttgtcttctatgttatttcttggttcacatttgttatagctttccctctcttgc

SEQ ID NO: 16296 - DNA, 337 bp, Gossypium hirsutum
  Clone ID: uC-gsflnu33B091d08b1
tccgatcgcagtgcaatgaacaacggtggcgccgagtcgtccggtgcgttaagttctcttcatgaacttcgttccgctttagcaataggattcaaaatccgagcgttttgttgcacagtttgtttttggacttcctcaaattacctttggtcaattttaactgaaatttagacctgattttgacttcctcaaatttattgttctcttatctttgaatttttatgttcggcgctctacttgcctaatgcctttctcggacctttcatttcatttttgttaaatttgatagtgtattttgcttttcattgagttgtattatccggaagaacggttcatt

SEQ ID NO: 16297 - DNA, 358 bp, Gossypium hirsutum
  Clone ID: uC-gsflnu33B091d09b1
tccacgcgtccgataaccgcctatatgcatgggcaagttaaaaggaccccgattccacacgctgcaaaaaataaatagtgcacgacaaatatatgctaaatacgaggacctgatgaggtatcgaaacttcatttcgaactaacaacagacattatagagcatacaaggaaccataggatactttcttaaaagaatgcgtgaaaaggctgcgagcggtaatgacaaactaatacccttaaaaggatatgatcattcaaacctaattatgtaaattgaactaacactgatttggcgcatcccgatggtccataacaacaaaggctcatactagaatggcaatggaacaggctatgaaatg

SEQ ID NO: 16298 - DNA, 439 bp, Gossypium hirsutum
  Clone ID: uC-gsflnu33B091d10b1
tcccacgcgtccgctcttctcttcgtaatctggcaaatatctttcctttggctcatcgaatatgatgcaacaaccagcagctggtggcgtggctccgccaccttccatggcggctgatcagtctcaggctcatcagtaccagcaacaaccgcagtcgcagccttggatgatgatgtctcaacaacagcagggtggtcagccggttcctccacctaccggttggacgccgcaacctgttcctccgcccactcagatgcagcagtactccgccggttctgctgctgctggctccggtgagattcgatctctttggatcggagatcttcagccgtggatggatgagaattacctcatcaatatctttgctcaaactggagaggtggtttaggctaaggttggggcggaataagcaaattgctttaccggaaggacatggggt

SEQ ID NO: 16299 - DNA, 100 bp, Gossypium hirsutum
  Clone ID: uC-gsflnu33B091d12b1
tgccacgcgtccggtttgtgatcatcaggcggggaattctgaaataacaagctgtaactattttgcttagaataaaacacttctgagcttaattattatt

SEQ ID NO: 16300 - DNA, 473 bp, Gossypium hirsutum
  Clone ID: uC-gsflnu33B091e03b1
ttcacgcgtccgcccactcgtccgcgtgacccaaggaaaggggttagggtctggttaggaactttcaatactgctgaagaagctgcgagagcttatgatgctgaggcgcggagaattcgtggtaagaaagcgaaggtgaacttccctaacgagactccgcgtacctctccaaagtgtgcggtcaagacaaattctcagaaaccactttccaagtcgaatttgagccctgttcagctaaatctcaaccagaattacaattacttgagccagcctgagcaggaatacttcgataccatgggtttcgtagaagagaagccactggtcaatcagtttgcatatgtggaccctgttcctacgtctatagatgctggatttaatcaatcagataatgcccccttgtacttcaattcggaccagggaagtaactccatcaattgttccgactatggctggggagaacagggtgccagaac

SEQ ID NO: 16301 - DNA, 199 bp, Gossypium hirsutum
  Clone ID: uC-gsflnu33B091e04b1
tctcaggttaaagcatcttctgtaattgtaatggtattttcacattattgttttgtactttacaataattgtttctttttttcttgggaaaaaaaaaaaaaaaaaaaaaaaaaaaaaaaaaaaaaaaaaaaaaaaaaaaaaaaaaaatccaaaagatccaaaaaaaaaaaaaaaatccatgctaatacaaaaatctaat

SEQ ID NO: 16302 - DNA, 455 bp, Gossypium hirsutum
  Clone ID: uC-gsflnu33B091e05b1
tttctcgcgtccgatgaaaaccaacgggaaagaagggccaaagccgaataatcacctttgcaaagttttgatttcatttctttgtattaagtatgcaaaaatgtgcgtatattcctctttttcgtaacctcttacagagattaagaactatggctttatatccgaaaaaaagaaagaaaaagaaaaaaaaaattaaaaatacaattttcattcccttctatttgctattctgccatttttgtttgtatttgccgttgtgttcgtccttcttgcaggtacggggtgcgctggcatcgtacggaggctgtgctggcgtggttgctggagactgaaacatacggaggagctgagggggctcggttgcggcgcaaagcgagggggagccctagggtttctggacttgtaattttctgggcctatcgggcctgtatttgggtttctgggtcaggatagat

SEQ ID NO: 16303 - DNA, 436 bp, Gossypium hirsutum
  Clone ID: uC-gsflnu33B091e06b1
ttctaacaagacgtcagctaagatgaatatgggcaatgctaatggggaggatgctattgaggcactccaagcacaagctcacatttggagacatgctttcaacttcgtaagcttcatgtctctaaaatgtgcacttgatttaggcatccttgatatcattcatgatcatggcaagcccatgactattaccgagctggttgctgcgctacagatgctcaaccctactaaagcatgtgacatttataggctcatgcgcattctagttcactcggacttctttgcacgccaaaagctagacaatgatgctcaagaagaaggatatgttcttaccaactcttctcgtattttgctcaagaataatcccttctgcataacgcctactttgaaggctacaatggatcctatcataacaaagccttggagttttctagggacc

SEQ ID NO: 16304 - DNA, 240 bp, Gossypium hirsutum
  Clone ID: uC-gsflnu33B091e08b1
tccgacggtgagagccttcgtgactgacgagcaacatttcacgaagagcgtggatgagcgaaccgcagctcttgacctcaacaacgacggtgtcctctccaggtccgagcttcgcaaggccttcgagtctctgcgtctcctggagacccacttcggcgtccacgtcttcaccacctccgacacggtcaaaccctcagacacccccattttagagaggttggattgctatcgcctttgccc

SEQ ID NO: 16305 - DNA, 270 bp, Gossypium hirsutum
  Clone ID: uC-gsflnu33B091e09b1
ttgatcctctgctgtagtatgtatttactatgcgggtattgtgtaatatcatgcttcctattctgcattacagatatttttcagttctgggctggagcttatggaactgttagatggacattgtgatatcctcgcattgataggataccagcgaaatgtttttttatttttttatttgaagccgtgacttaagatgagtttgaagacgtctactaaactgggagaggggtacccccccattacaaaaaaaaaagaatattaaaaggaact

SEQ ID NO: 16306 - DNA, 272 bp, Gossypium hirsutum
  Clone ID: uC-gsflnu33B091e10b1
agaaacacacacactccttgacagagctcaactatatcaaattcacggagaggttgacaagtgtggcagctgcgattgcactgacaagagccagtgtgtgatgaaaggtaacagcttggtcatagagactgaggagagctacatcagtaccgacatgaagaagcctctgtcttagaacgatggcaagtgcaagggcggaactagctgcagctacacaaactgtacatgtggcagacactaagcagacacatagaatgatgaagttcgggagc

SEQ ID NO: 16307 - DNA, 461 bp, Gossypium hirsutum
  Clone ID: uC-gsflnu33B091e11b1
tcccacgcgtacgcccacgcgtccgattcctgatttcttgggagagagtgtgtcagtgttccttcccctcttttacttaatttctctgcgacatggctctctccgtcgagaaaaccgccgccggccgtgagtacaaggtcaaagacatgtctcaggctgacttcggtcgtctcgagatcgagttagctgaggttgaaatgcctggcttaatggcttgtagaaccgagttcggccctgcccaacctttcaaaggagccaaaattactggttctcttcacatgaccatccaaaccgccgtttttattgtaacccttaccgccctcggagctgaagtccgttggtgctcttgcaacattttctttacccaagaccacgctgacgctgccatcgctcgtgactccgccgctgttttcgcttggaaaggggagacccttcatgatactggtggtgtactgagagag

SEQ ID NO: 16308 - DNA, 428 bp, Gossypium hirsutum
  Clone ID: uC-gsflnu33B091f01b1
tcttcgcgtccgctttcctcattgatccagaagcattggcatcagagttgcagaagaagtttgcttgcagtacaacagtggcagaattgccaggtaagaaagggcttgaggttcttatccaaggtggggtcattgatgatgttgcgagacatctgcttgagcaatatggaatcccaaagagatacattgaagttcttgataaaaccaggaaataagaagtgataaatggttagtttctcttctgttaagtattatgtcatccataacttgttaggacaaagttgctaaggttggtgcatgtgttttgtttatctattttgtcaatgtgtacgcgtatcttttggtggtggtttttctttttctcttagactactcctactgatgatgatgatgttgatgataagggaagttaaaggcttattttgttt

SEQ ID NO: 16309 - DNA, 491 bp, Gossypium hirsutum
  Clone ID: uC-gsflnu33B091f02b1
ttttcgcgtccggggagatatcgtaacaccagagacctttaaatgggcagctagtgaccctaagatcattcaagcgtccacaattatttgtaggtttatggatgatgttgctgaacacaagttcaagcataggagagaagacgattgctcagcaatcgagtgttacatggaagaatatggcgtaacagcacaagaggcatatgatgtattcaacaagcatgttgagagtgcttggaaggatttaaatcaagagtttttgaaaccaacagaaatgccaacagaggttttgaatcgtagcctaaaccttgcaagggtgatggatgtgctttacagggaaggcgatggctatacatatgttggaaaagcggcaaagggtggaatcacttcattgctcattgaaccaattgcactttgaaattatgttaatttttcctctccaagcttgtttcttaagaaatagttattaagttctaattaataatgctttataa

SEQ ID NO: 16310 - DNA, 482 bp, Gossypium hirsutum
  Clone ID: uC-gsflnu33B091f03b1
cttaaaacgttaaacgcggctttctctctatttcttttctgcagcgagttactgagtcaacaccacgatggccgaacgaatccaccccggcgactcaccaccgtcttccggcgaacactcgaattccaagccagctcctccttcttcagataaaccaattccacaacccggaacttacgtcgtccagatcccgaaggaccaagtctaccgcgttcctccgccggataactcccgccgctacgctcatctgtcgaaaagtaagtcgagtcgcagcacctgttgccgctgctgttgctgcttgttaacaactatcctctctctcctccttgccgccgccattgccgctgctgtgatctacttcgttctcaagcccgaagctccaaactactccgtcgagagcgttgcgatcaagggattcaacctcacgtcaccttctccgctatcgccagaattcgacgtcaccgtccgggctgacaacggca

SEQ ID NO: 16311 - DNA, 480 bp, Gossypium hirsutum
  Clone ID: uC-gsflnu33B091f04b1
tttcacgcgtccgcccacgcgtccgttttgctcgatctgaatctggttaaaataacagaagaacaatggaagagctgagatcagctgtggaggagcacatggaattaatggcggatctagttcagaagctatcctcggagcttcgttcgggcctccgacccgcctatgataactttatgggcttcttccatgcaatcgactggaaggagccatggttaatgtgcttactggcattccatgttttcttattgatagtaacaatcttctcgaggaagaacactaacttccagatgtgtttgttccttctggcattgctcggtgtttattttgcggagttactgaatggattccttggtgacaactggaagaaatttgcaaagcagaactattttgatccaagtggactttttttgtcagtactctggtctggtcctcttctcattattgcaatcatcatcttgataaatactctcttttcat

SEQ ID NO: 16312 - DNA, 464 bp, Gossypium hirsutum
  Clone ID: uC-gsflnu33B091f05b1
tttagggagtatcaaaagtctatcaaaaagacagaatatgaaacaataaaaaaccagtggcagagtatctctcctggacaggcaaaaagatttacaaaatttagagagaggaaaggccttatagagaaagatgtggtaaggacagacagatcgctctctttctatgatggggatgacaatccaaatgtgaatcttttacatgatattctcttgacctactctttttacaactttgatcttggttactgtcaggggatgagcgatctgctatctccaattttgtttgtgatggaggatgagtcagaatcatttggtgttttgtggctctgatggaacgccttgggcccaattttaatcgcgatcaaaatggcatgcattctcagctttttgcattatctaagctggtgggagttgctggacagacctctgcacaaatatttcgagcagaatgactgcttgaatta

SEQ ID NO: 16313 - DNA, 381 bp, Gossypium hirsutum
  Clone ID: uC-gsflnu33B091f06b1
ctacgcgtccgggcgaattcaccatgcttgagcttgctgaggtggtacaagaaacaatagacccgaatgcgaagatagagttcaggccaaacacagaagatgacccgcacaagaggaagcctgatatctcaagagccaaagagttacttggttggcaacccaaggtctccctccgaaagggtctccctctaatggtttcagacttccgacaacgtatctttggtgatcacaaggtcggcagcagcaccaccaccaccaacgactcatcatcttaagatggcctatatactcttctcacagacagagcgataaaaatatataatggttaagaggaaaagagcttgccgttggcttttcccttttgaaacaattaatatttta

SEQ ID NO: 16314 - DNA, 388 bp, Gossypium hirsutum
  Clone ID: uC-gsflnu33B091f08b1
tccacgcgtccggaaagcagttgggattgagtttgcaaagcattttagatcccacctggatcccattgaaggtctctttgggaccaagtagagagcacaagtgagagcgaaggcagtgcaagtgatgaagtgcttgttgttccttatgataacttagcacctatgtcttgtgatattgctgaatctaagcaacttttggataagcttgttgtggtgaagtataatggagctttgggaaagaatatgggtttcggtggtcccaaaaagtatttggcatcgtttgaagcaaatggggtttcagtcactgtgcatgaatgcagtttgctaaaaagcttttgcacttcattgacagtagcacacctgtatgtagttatatgtccctatattg

SEQ ID NO: 16315 - DNA, 321 bp, Gossypium hirsutum
  unsure (1)..(321): unsure at all n locations
  Clone ID: uC-gsflnu33B091f09b1
ttcacgcgtccgtccaagtcatatttgtatgcgaatattaatgttttgagaggaattggagtccctgaatcgaatatccttatgctgctttaccgtcatcctcgaaaatttttgtatagtccggttcgacttaaggagattgtggaggaagtcaaaggaatagggattgattcttcaacgaagaagtttcttgctgcggttattgctttgagatcaatgagcaaatccacactagagaagaaatttgatgtatataggagaggnggttgggtcggaccaagagattcgtgaagcttttcacaggttatccttcctgtgtta

SEQ ID NO: 16316 - DNA, 478 bp, Gossypium hirsutum
  Clone ID: uC-gsflnu33B091f10b1
ttatcaataaccatgtcttctctgtttctcctcctcttatccaccgccatcaccgccgccgtcgcttccattcccgcctacccttcagtgtcgacagactgcaccgtttccgccgaggatgataacccggttcccgttcgtcgtgaagtttacggcgacgggagaatcttcgacgttagccatagatacaccgtggatatgccttcgtgggggagcaaagatggtctgggtcagttcctttggcttccgtcaagcatgaagaacggttcaaggtccaataattccttgatgaagctgcagtcggtccattccggcacccacgtcgacgctccgggacatatggtcgacagctacttcgacgctgggttcgatgtcgacacccttgaccttgatgtccttaacgggccagctttattagtggatgtgccgagggatagtaatataaccgctaaagtgatggaatcattgaacattccca

SEQ ID NO: 16317 - DNA, 466 bp, Gossypium hirsutum
  Clone ID: uC-gsflnu33B091f11b1
tttatacgctctcaaacctggcaagtgttctctttcttggccttttcctttccattatcgtgaccgctgttctcgagctccgatggagtggtgtcagcatcgaggacttatggcgtaacgagcagctttgggtcatcggtggcgtttcagcgcatctctttgccgtcttccaaggtttccttaagatgcttgcaggcattgacaccaactttactgtcactgccaaagcagctgatgatgcagattttggtgagctctacattgtgaaatggactacacttttaatccctccaacaacactcctcatcgtcaacatggtttggtggtcgttgccggattctctgatgccctcaacaaagggtacgaagcttggggaccactctttggcaaagtgttcctttccttctgggtcattcttcatctttatccattcctcaaaggtcttatgggacggcaaaacaggaca

SEQ ID NO: 16318 - DNA, 240 bp, Gossypium hirsutum
  Clone ID: uC-gsflnu33B091f12b1
tcgacacttggggggatactagtatgggcggggatcttatagacaagctggggactgatcaccagatcgatatttctcccgaaaagttccaccatatgtggtgccacaggccgtaccatgtccaccacactagctctgaaaaagtacaaggatgcgatttacatgaaggtgaatttggaactcccggcgtcgctatctgctggagatatgtgcatgatggaaaggtctaaaactgcaaag

SEQ ID NO: 16319 - DNA, 421 bp, Gossypium hirsutum
  Clone ID: uC-gsflnu33B091g01b1
tgataaccgaggtttctggaatggaagaaagaagagtaaagggagaggttatgtgcggcactctcgacctgactgctctcccactagattgtgtcaccctcattatttccttgacctcccctcgagatgcctgtagattgtcgcttgtttcaactgcttttaattcggctgctgaatccgatgctgtttgggaaagcttcttgccatcccaataccaggaattaattccctcatcgctctctttctcgtccaagaaacaactttatcttagcctctgtgaaaatccccttctcattgaagctggacgaaagagtttttggctcgaaagagtgagtgggaagaaatgttacatgctgtcacccatggacctctccattatatggagtgacaccccagattattggagatgggtgtctatacc

SEQ ID NO: 16320 - DNA, 390 bp, Gossypium hirsutum
  Clone ID: uC-gsflnu33B091g02b1
tttggaaaagatgcagatattcgtgaaaacgctaaccggcaagaccataactctcgaggtcgagagcagcgataccattgacaacgtcaaagccaagatccaagacaaagaaggaatcccaccggaccaacaacgtctcatcttcgccggaaaacagctcgaagatggccgtaccttggctgactacaacatccagaaagaatcaacacttcatcttgttctgaggttgagaggtggaattattgagccttctttgatggctttggctcgcaaatacaaccaagacaagatgatttgccgcaagtgttatgctcgtctgcatccaagagccgtgaactgccgcaagaagaagtgtggtcacagcaatcagttgaggccgaagaagaagat

SEQ ID NO: 16321 - DNA, 355 bp, Gossypium hirsutum
  Clone ID: uC-gsflnu33B091g03b1
cttacgcgtgggggagcaggagttttcttgacactttttcttaggtcaatgcaaagggtgaagaagcttgataaattcgagaagatgatatgatgttaaaactcacaaggcaaaggatttatttcatgtatatgctcattgatcagtcagttaactgccttattcgcatcaaattaaatttatatgtaatttttttccctcatatttgaggatgttccatttgactttcatatcaagcacccgaagaagaaaaaaagacgagggaaatgcctccctgctgggaaatatatagatatgtaataaaagatgctttcaacagtagaaaaggaaaattccagttcagcaacatactaat

SEQ ID NO: 16322 - DNA, 135 bp, Gossypium hirsutum
  Clone ID: uC-gsflnu33B091g05b1
tgtcacgcgtccgcccacgcgtccgcccacgcgtccggtttgatattacttatttaacagaagcaatatcagctgtagtatgagcaaagtattttgatgaatgtaagtgtgcatataaaatcaagtgattattat

SEQ ID NO: 16323 - DNA, 245 bp, Gossypium hirsutum
  Clone ID: uC-gsflnu33B091g09b1
tccgaaaatgtgaaaacctctgcctgatttgtggggtatatttacatatccatgcaattaatggaccagcttttaatggattcttgatatattttaagacttgtgtttcctctgcaatgctgttatggtatattgagcaataaagctggcgggtgctggcttagagttttaaagagtagtgtggaaatgctctgtaagttaaaacattgcagaggcctgctaagtgatgcttcatatgaaaactt

SEQ ID NO: 16324 - DNA, 421 bp, Gossypium hirsutum
  Clone ID: uC-gsflnu33B091g10b1
ttgaatgcctcataaagaggtggacagagcatgtgatgaagacacggttcaccagcaacgggaaaggagagactacctcggtgtccatccgcataagctagagggtgtcagctacatcggcattcacatcccagtcggtcgagtccaagccgacgacatggacgaactagcccggctagccgacacgtatggctcgggcgaattcagactcactgtggagcaaaacatcataatccccaacgttgagaactcgaaactagaagcattactaaacgagcctctattgaaagaccggttttcaccccaaccaagtattctcatgaaagggctagtagcttgaactggtaaccagttttgcggacaagccattattgaaacaaaagctagagccttgaatgtgacggaagaggctgaaaggcta

SEQ ID NO: 16325 - DNA, 325 bp, Gossypium hirsutum
  Clone ID: uC-gsflnu33B091h01b1
ttttgagtatactaggttaaaggcattgaaaatggcttttagtttctttcgttcatttccaatttccagttttcccgtacactcaaaatcgaaacgcttctcatatgatgggtcaagctttcataggttaattatttcttttgcctcacaatgtgaagctacaaacaaaatttctattgaagatgatatcgtaattagacgatcggctaattacgacccatctatttgggattatgattatattcaatcactcagaaacgattttgtacaggatgaatcatacaaggaacgagcaagcaaactaaggaagaagtgagggatgatg

SEQ ID NO: 16326 - DNA, 309 bp, Gossypium hirsutum
  Clone ID: uC-gsflnu33B091h02b1
tgtttactttgttttagttgccataacgtcaccttccaattcaacccacaatgaggcaacaatatgtcttcactactctcacgttgctcatcctgttttccctcagttgttcaacaacattagcccaatctccggcactggccccggcaccttctggcccgacaaacgtcaccaagatcctcgaaaaagccggtcaattcaccctcttcattcgtcttctaaagtccactcaagtggccaaccagctgctcggtcagctcaacaattccaacaatggtatgaccgtttttgcaccaacggacaatgctt

SEQ ID NO: 16327 - DNA, 227 bp, Gossypium hirsutum
  Clone ID: uC-gsflnu33B091h03b1
cctcactcgtccggcaaaacatgtcatagacatgttgtgttggtgcatcatgggaggaaacaataaaataaagagcatggacaataaaatattagtgttagtaggatgagaaacaaaaaaaaaaagaaaggatatgtgtgattgtacccccccttgccgtgagttgaaggaaagaaatacacaaaaataagataaaaaaggaaaaggtaagaacagataattgttac

SEQ ID NO: 16328 - DNA, 347 bp, Gossypium hirsutum
  Clone ID: uC-gsflnu33B091h06b1
gtagacccccgctaattctaaaagaaagaaccagagttttctttctctttaggtgacgtttattgtccttttggaatttttgatactaaaaaaaggaagcaacgaagaagggaaatggagggcaaagaagaggatgttagattgggagccaacaagttcacagagaggcaaccaattgggaccgcggctcagagtcaagatgacgggaaagactacactgaaccaccaccggctccatttttcgagcctggcgagttaacctcatggtctttttatagggctgggattgccgagtttgtggcgactttccttttcttgtatatcactattttgactgtatgggagtt

SEQ ID NO: 16329 - DNA, 334 bp, Gossypium hirsutum
  Clone ID: uC-gsflnu33B091h08b1
gcgtccacgcgtgcgcccacgcgtccgcccaaaggtgcaattgatctgtttcatgggtcagcaaagctagaaaaacaatgactaaggatatcgagactgcagagcaacatggaggggagttctcggccaaggactaccatgatccaccacctgctccattgattgatgctgaagagttaaccaaatggtcgttctacagggcagtgattgccgagttcattgctacacttttcttgctgtatgtcactgtgttgaccgtgattggttacaaggtccaaaccgaccctgctagaacactgttgacccccattgcggcggcgttggtattcctggt

SEQ ID NO: 16330 - DNA, 469 bp, Gossypium hirsutum
  Clone ID: uC-gsflnu33B091h11b1
ttattctcagttaccactctcatcgactctaaactggcctcggaccagatcaaaatcaaggacagataaaggatggagtggattgactgcagcacatgatccttcgagatgttcttggggtaatgctgcaacaaatgatagagaggatatatcttcaacattgtccgatcctggtccaatttgggatgctgaaccaaagtgggacactgaggctaattgggatgttgaaaatcctatcgagttaccagggccatcagatgatgttgattcaggaataaataaggaagttgtcccaagacttgaagataaatgggtattgaccaaggggccatttcttggcatcattgtgtgcaaccatgcatgcagaaccgtgcaaagttctcaagtggttgctccaagagctgaacatgatgacaataccatggatatgcttttagttcatgggagtggccgttgaagtttgatcaga

SEQ ID NO: 16331 - DNA, 503 bp, Gossypium hirsutum
  Clone ID: uC-gsflnu33B092a01b1
cacctttatttaagtaaacccaaaatcttgattccgaatgagattaacgataaaagggagttgataaatcagcatcagaaacaagagtatatagatacagctatgcagcaagatagaggaggaagagggagtgagcaaggcatgaagcagaaccagcagcaagatcaaaggttgaagccgttgacgggcgagaatcagcagcagcatcctcctcaaaagtgtcctcgttgagagtatgttaatacaaagtttcgttactacaacaattacaggctctcgcaacctcgttatttctgcaagacttgtagaaggtattggactcaaggtggaaccctaaggaacgtgcccttgggcggtggttgcaggaaagggaagcgcacaaaggttatatcttacggtgaaaattgaaggtctcagacgatgatacctcagcagcaagcagtccagcaacacagcttgacatcaccgcatagtgtgatctgttctaatactatgatcagcgt

SEQ ID NO: 16332 - DNA, 528 bp, Gossypium hirsutum
  Clone ID: uC-gsflnu33B092a03b1
ggcgtcttcttttatgttttctcgcggccatcacaagggtctctctggcactttttctcgtctatataaactcaagcagagtcgctcttagaacccatcttcatagcattttctagagagaaagagagagtttcttattagctgctgcggaaggtttattttctttactaaagaataaaagctttttctgcagtagcgttcaagtttttaccaatccaaaatttcaatttaaagaaaaaggagaaaacagaaatggctctctctttcgcaaacgctaagcttttctctactttcgttgtcgatggaatctctaacgttatctccagacgaggatatgcggcggcgtcacaaggaattgtgtcgagtggaataagaggaggagcaggaaggagcgctgctgctgtagtcaagaaaacaggggaagagatgtctggtggagctaaagagaaggtttcatgggttcccgacccggttaccggatgctacagacccgagaactgtgccaacgagatcgacgtggcggagctc

SEQ ID NO: 16333 - DNA, 349 bp, Gossypium hirsutum
  Clone ID: uC-gsflnu33B092a04b1
gttaattatgttttgtcctccaactcacaaagtggtaaaaggtgagcttaagaatggttctgatgactgccttgcgagcttgatgtattcgaattaccaaggtgctccagtagcgattaaaaaagattcatgacccactccatttgcgcagaatatgctagtagacggtctgtacggaggcctggtgtatgatgttgttagggttaagtggattattatttggaccactgagtgtaaggtggctactaagatcattccgaccgaaaaccatattgcttgggaggatatagcgagcatgcttcagccctacgagagctgtgacaacttgaccttatcatgtgggggtgca

SEQ ID NO: 16334 - DNA, 96 bp, Gossypium hirsutum
  Clone ID: uC-gsflnu33B092a05b1
aaaaattatttttattactagaaaaacaaaaaataagggaaagatttacaaaaaaaaaacgcgagataaaacaaatatatacgaacagataagagg

SEQ ID NO: 16335 - DNA, 533 bp, Gossypium hirsutum
  Clone ID: uC-gsflnu33B092a07b1
ataggtttatagacttgagcgcgagcaacaaaaaattgatgaaatgtttatgagagaagcattgctggaagccaagaaagctgctgattcttgggaggtgcctgttggggcagtactagtgcagcatgggaagataattgctcgtggacgtaacttggtagaggaattacgggattcaactgcccatgcagaaatgatctgtatacgggaagcttcgagcatcctacattcatggaggcttgcggatacaacactttatgtcacacttgaaccatgtcctatgtgtgccggagcaatacttcaggcaagaattgacactcttgtgtggggagctcccaataagcttctaggagcagatggtagctggataagacttttccccgatgaaagaggaggaaatgggtcagaacagacagacaagccagcagctccagtccatccgttccacccaaatatgggaatcagacggggggtatcggcatccgaatgtgccgacatgatgcaacaatttttccagcttaggagaaagaata

SEQ ID NO: 16336 - DNA, 393 bp, Gossypium hirsutum
  Clone ID: uC-gsflnu33B092a09b1
ctttcttgtatacatatttataacaacttccaatggatgtccctttattttccttcttctgcgaaataccatgggaaacatcggaagtagcggttcacatggctggcgtaggaacggtagtcgtcggaaccaccctccgacgccgcatgcgccgcaaccgcctgctccatctcaacctcaacctgaaatcactgccaatcgctacgtctgtgccgccgccacgccttaccctgcccagtaccccaacacgaaccctccccaatgctatcaatatccaggctactaccagcctcagccggcggttcccttgcctctttccgcgccttacgatcatcaccatcgaggcggtccggacatggaacccggccattggggtaggtatccttatgtacc

SEQ ID NO: 16337 - DNA, 466 bp, Gossypium hirsutum
  Clone ID: uC-gsflnu33B092a10b1
ctcactcgtccgcggacgcgtgggtcaggctggtattgtgaagaaggatagcatcaaaatccacggtttttaagtctcggctacgagagtttccaggagacttaaaaggtctatcatcttctaagccggaagagctacccgatgaagtattagttatttaggtggtgtcatattatctataatgttagtctgatactctgatatattgcatcctatgtttcttgtgctgtcaactctttaagctatatgtgatgttgaatgacaatgataaccgttgcatattatacataaatagttgtcaaacaaaaaaaaacaaaaaaaatatcacttcactccaaaaaaaaaaaaaaaaaaaaaaaaaaaaaaataaaagcaaaaagaatatgggggtcccccgtttagaggctccagcttttcttccgcttccatcactcgcctttctttttttaaaagaaaacctcctttt

SEQ ID NO: 16338 - DNA, 496 bp, Gossypium hirsutum
  unsure (1)..(496): unsure at all n locations
  Clone ID: uC-gsflnu33B092b01b1
gaaatcgggtcggatcccaaagatgggtgtaacaccaaaaatcgctccatccatgctttcatcggattttgctaacttagcatcagaggcaaagcgcatgcttgacttcggagctgattggcttcatatggatatcatggatgggcacttcgttccgaacctaaccattggtgctccagtcattgaaagtttaagaaagcacacaaaggcatatttggattgccaccttatggtcactaatccgattgattacgttgaacctttgggtaaagctggtgcatccggtttcacttttcatgttgaggtatcgaaagaaaactggcaagaacttatccaaaaaattaagttgaaaggcatgaggcctggtgtggcgttaaagcctggaacaccgattgggaggtttatcctctgatcaacagcgaanatcccgtggaaatggttcttgtgatgactgtggaacctggatttggtggacaaaagttcatgccagaaatga

SEQ ID NO: 16339 - DNA, 322 bp, Gossypium hirsutum
  unsure (1)..(322): unsure at all n locations
  Clone ID: uC-gsflnu33B092b02b1
gccaaatcatgnggttgttgaacttaaaacactgttctgttctccccctttcctcttggtgtgcggtttcagttccatctatttgtccatggatcttacacctcagcaacttatccagttcaacggctccgacccatccaagcccatctacgttgcaatcaatggtcgcatctacgatgtcaccgccggcaaatccttctacggtcctggtggtgcctacgccatgttcgccggcaaagatgccagcagagctcttgcaaagatgagcaagaccgaagaagacgtctgtcccaaccttgacggcctctctgaaaaggagatg

SEQ ID NO: 16340 - DNA, 549 bp, Gossypium hirsutum
  unsure (1)..(549): unsure at all n locations
  Clone ID: uC-gsflnu33B092b03b1
cccactcgttcggcaacactgttagcgtacctgttggaggatgggctgtcatcagattcgtagctaataatccaggttaattttccaacatccatcatttacttttttcttttcaactagtttttgtcaacctagtactctgggaaaagcaaggataattttttagtgttgaataaaatttttaatttttatagtttatatttttataaattttaaaggattaaatgaaatttttataattttaaaaagttaaaatataattttattttaattaatttaaaattttaaaaaaatttaaagaacttaaatgagaatttatcattttaggggcgggcccatgccctagaatcccctctgctagtatttgaactcaattgtttcaatgcatccgaaatgaacaggtgtttggtttatgcattgccactttgacgggcacatgtcaataggcctgtccactgccttcattgttgagaacggaccaacttccgacacaaccttgccttcnccgccaacggatcttncacaatgctagacattttttggtttatt

SEQ ID NO: 16341 - DNA, 535 bp, Gossypium hirsutum
  Clone ID: uC-gsflnu33B092b04b1
ctccatttctctctgcaaccagcggcacccaaagatgcaaatcttcgtcaaaaccctaacggggaagaccataaccctagaggttgagtcttccgacaccatcgacaatgtcaaagccaagatccaagacaaggaaggcatcccacccgaccaacagcgcctcatctttgccggcaagcagctcgaggacggccgcaccttagccgactacaacatccagaaggaatccaccctccatctcgtgctccgtcttaggggaggtgctaagaagagaaagaagaagacctacaccaagcccaagaagatcaagcacaagaagaagaaggtcaagctcgctgtgctacagttctacaaggtggatgaatcgggtaaggttcagaggctgaggaaagagtgccctaatgctgagtgtggtgctggaactttcatggctaaccatttcgataggcactattgcggtaagtgtggactcacttatgtttaccagaaggcttgtggagattaagtagggctcgtgcaaaagatggatctttta

SEQ ID NO: 16342 - DNA, 400 bp, Gossypium hirsutum
  Clone ID: uC-gsflnu33B092b05b1
ggccaataggaatggcaacacaaaaaaaaaaattattttttttaaaactaacaatcattagtatgataaggggacagaactatttaaggttaaggactatttaaatttaatttcaaaggagacagaactagcatgcattggtacttccatgttgacaggcaacacccttttttcaaccaatctataaagggtaattgctatatcaagtccctgaacattttatataatcacacttcaattcagtaccgccaatttatcaagtgacaccactattttttaaaaaaaaattagagaaaacattgaccggtgggacaatcactttggaggttcaagagttacgcacgcttacatacgactgcatagaagatctaaggcgtggaatagattcacttaaattagc

SEQ ID NO: 16343 - DNA, 168 bp, Gossypium hirsutum
  Clone ID: uC-gsflnu33B092b06b1
gaatttttgtttaaattttcggtttctattgttggtcttggtagttggaaaaaaaaatgtattgttttccccaatctcgaggtcattccattcttgatggaaattaacaggttaagtcggattctttaatctttaaatataaagataccagatttctttggattcttt

SEQ ID NO: 16344 - DNA, 440 bp, Gossypium hirsutum
  Clone ID: uC-gsflnu33B092b10b1
tttattcccacgttactgctgagttctacaatgacgatggtgccatggttgcagttggtgcgcacactagcctcatctccacccaacatgatgagactgtttcctacgatgacatcgctgctgacctcacggagcatgtcatcaatcctgtcatccctgagaagtgcctcgacgagaagacaatctaacaccttaacccatctggtcgctttggaatcgggggacctcacggtgatgcaggtctgaccggacgtgagatcattattgacactcatggtggctggtgagcccacagcggtggggctttctatggaaaggacccaaccaaggtgggcaggagtggtccttacgttgttaggcatgctgccgagagcattgtaacaaatggacttgcccagagatgcattgtgcacgtctcctatgctattggcgtgccttga

SEQ ID NO: 16345 - DNA, 557 bp, Gossypium hirsutum
  Clone ID: uC-gsflnu33B092b11b1
tttactcgtccggtatattgaaattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgaggtcgagagctccgacacgatcgacaacgttaaggcgaagatccaagacaaggaaggcatccccccagaccagcaacgtgtcatgttcgccggaaaacaacttgaagacggccgtaccttggccgactacagcatgcaaaaagagtcaacgctccatcttgtccttgcgttgcgtggcgggatgcaaaattttcgttaagacgcttacgggaaagacgatcacct

SEQ ID NO: 16346 - DNA, 118 bp, Gossypium hirsutum
  unsure (1)..(118): unsure at all n locations
  Clone ID: uC-gsflnu33B092b12b1
aaatangggactatcaagaaatctagagtgtttttgagttttgctgctacaaattgcagctcaagcttttatatattgtgggatcatagaagaaaagctgtgtgatgctgatttacaa

SEQ ID NO: 16347 - DNA, 547 bp, Gossypium hirsutum
  Clone ID: uC-gsflnu33B092c04b1
gagacttgctcccgtgatgattaaggaggttactaggagagttcatttggagaatatttggcaagcagcttatactgctggagttgttcttccaacaccaattactacttgccaatactggcataggtcactaaaccccaagaagcttattgatgttggcttttctaggcttgggcctaggatgacgatgagccgaaccattaaactttacaagttacctgatcaaccagccacccctggatttagaaagatggagcttcgtgatgtccctgctgtcactaggttgcttagaaattacttgagccagtttgttggttctccagattttgatgagaatgatgtggagcactggcttcttcctactgaggatgtcattgacagttacttggtcgagagcccaaagacgcatgacataactgacttctgtagtttctacacacttccgtcatcaattcttggcaaccagaactattcaattttgaaagctgcctactcttactacaatgtctccaccaagactccattgcttcagttgatgaatgatgca

SEQ ID NO: 16348 - DNA, 215 bp, Gossypium hirsutum
  Clone ID: uC-gsflnu33B092c06b1
cccactcgatcgcccacgcgtccgggaagttctccaagagtaaaggcataggagtttttggcaatgatgtaaaggatacaaaaatacctgtagaagtgtggagatattacttgttaaccaatagacctgaggtttctgacaccttgattacatggtacgacttgcatgcaaaactgaataatgagttgcttagtaatttgtgcaactttattaat

SEQ ID NO: 16349 - DNA, 343 bp, Gossypium hirsutum
  Clone ID: uC-gsflnu33B092c09b1
tttgctccaccgcacttactcataaaacaggacacccgtgatttttgagtccggaaggtgaaggaggcacacaattcatgctcaagacgggccagcggcttcataatctgaccaggtgggcggcttacattcctttacatcgggtactccagaccggaactctgaagaggctgacaatcctctatcaactcgggtccatgcttgggaaagagatcatttgccttcgttttcaataaaccaggtcgacagagactcagcatggggtgcctttcatcaagctgctggtgcaccagatcctggcataagaaccggcagctttcgccaaaggcatggatctgctagg

SEQ ID NO: 16350 - DNA, 298 bp, Gossypium hirsutum
  Clone ID: uC-gsflnu33B092c11b1
ctggatgcctacattttgctctatgctaaacaaggtataccttggttttcaactgcaataaaagtgcaaaagccttgtgcagaccctggaatttctgattcttcaccaaagtctgttctaaatgacatagactttgcctccaatcttgaggtggaaaagagtgccaattgtagtgccaatgaaactaaagatgttgctgatagagcttcaactcaattctcttgtgatgtgttcaactagtcagtctgtttctcatatgtattatttattttagttttgattctaaatctttattttc

SEQ ID NO: 16351 - DNA, 123 bp, Gossypium hirsutum
  Clone ID: uC-gsflnu33B092d01b1
cccactcgttcgccctcttcttctgttgctctgaacttattgtctctatttgaggagcaagttttgaggttgtggtctaaaaaacgaaaatggtgaagatctgttgcattggagctggttatg

SEQ ID NO: 16352 - DNA, 553 bp, Gossypium hirsutum
  Clone ID: uC-gsflnu33B092d03b1
cgccctttatttttttttttttttttttggagacaaaccaagagcagcaaccgatatatatttttataagagtttaaccaccaccgatgaaagcgtaaaccgagccaccatgaacgagctgtgaaaaaccttaggaggaaaggacagttcgatagccaccagatggttcacccactatgaaagcgacgctcgaagacaatctaccagaagatgaaccccgagacatggatatggccgtggctaggacaccagttaatacccaaccaaggaaagagaagcctgaaccaaagccaccagtgtatgaaccaccaaagaaggaaaagcctaagcctaagccaccggtttattcaccaccaaagaaagaaaaaccagaacccaaaccaccagtttatcagcctccgaagaagcccccagtttatgagcctaaaccaccaaaaccaccagtttatgtaccaccaaagaaagagaaaccaggacccaagccaccagtttatggaacatcaaagaaaccacgtatggtcactatccaggacacccttcattggggaagcct

SEQ ID NO: 16353 - DNA, 518 bp, Gossypium hirsutum
  Clone ID: uC-gsflnu33B092d07b1
ttcagtttttcaatatctgcttttgatcaatcgaaatggcttcacaagtttctcaaatgccttcttcatcacccctttcttccaataaggatgaaatccgtcccaaagccgattttcagcctagcatttggggagatttcttcctcaattgtcccgacaagaatattgatgctggaactgaaaaacgccaccaacaattgaaagaagaagtgaggaagatgattgtggcaccgatggctaattcgacccaaaagttagccttcattgattcactccaaagactgggtgtgagttaccatttcaccaaggagatcgaagatgaactagagaatatctaccataacaacaatgatgccgagaacgacctctacactacatctcttcgattccgactactccgagagcatggatacaatgtttcatgcgacgtattcaacaagtttaaagacgagcaagggaatttcaagtcatccctgacaagcgatgttcgaggattgttgaactttaccagcttccta

SEQ ID NO: 16354 - DNA, 72 bp, Gossypium hirsutum
  Clone ID: uC-gsflnu33B092d09b1
ggatcaacaccgtcaacgaagcccaatcgcgcagaagtggaggcggtggcggaggatttggaggaggaaact

SEQ ID NO: 16355 - DNA, 94 bp, Gossypium hirsutum
  Clone ID: uC-gsflnu33B092e02b1
aacctcgtcccacgacgtgtttgtcggcagctggaaaccgaccaagaacgacacgttggccaagcgggtcccggggtttggagccaccatgaat

SEQ ID NO: 16356 - DNA, 113 bp, Gossypium hirsutum
  Clone ID: uC-gsflnu33B092e03b1
gaacacttaattcccgttccattctcgatttctaaggtacaaactaagtccgtgttttcctctctgggatctgggttgattcatttagtagtgtaatttcagtggtaaggatg

SEQ ID NO: 16357 - DNA, 525 bp, Gossypium hirsutum
  Clone ID: uC-gsflnu33B092e05b1
gttagttgttccttgaagaactctactgtagttgctggaggtggtgctatagatatggagataagtcgatacttgaggcagcatgcacgcacaatagctgggaaatctcaactttttattaactcttatgcaaaagcacttgaggttattccacggcagctttgtgacaatgctggatttgatgcaactgatgtgttgaacaaattaaggcacaagcatgcacttccatctggtgagggtgcaccttacggagtggagatcaacactggcggaatagcagattcatttgcaaactttgtgtgggagccatcagttgtaaagatgaatgcaatcaatgctgcaactgaggctgcatgtcttattctaagtgtcgatgagactgttaagaatcctaagtcggagagtgcacagggagaagctgctgcaagtgccatgggtggcagaggtcgcggaggtggtttccctggccgtggacgaggaatgaggaggcgttgagatagcttgttcatttttttggtatcgaat

SEQ ID NO: 16358 - DNA, 386 bp, Gossypium hirsutum
  Clone ID: uC-gsflnu33B092e06b1
gactctagtttgacgagaaatgatctctactgaactaggagatcgttaaaagagtgattcagacttgacttgggatcattgcaactgaagtaacacatgatgaaagccatactttaagaaaataaaagagctgccaaaagaacaggcatctgtagtgatatatgggcaaggatggatagccctactgtgatatacttgtgtctatgattgtaccctgagatagccattatgctggaggtgcgtttttaggttaccaatgcaatttccctccagattcatactttaaaagccttcctaaggtcaccgtttagggaccaaaggtctttcatcctaacataaacagacaatggaagcatttggtcttgatatccttaaagaacaattgg

SEQ ID NO: 16359 - DNA, 259 bp, Gossypium hirsutum
  Clone ID: uC-gsflnu33B092e07b1
ttactcgtccggaacaaggagctctaattgatgacatcggaacacatatcgaaaattcacaggctgctactgtacaagcaaaatcccatcttgtaaaagctgcaaagatccagagatcaagttcttctctggcctgcttgctcctggtgatattcggaatcgtgcttctcatcgtgatcgtagtacttgcagcctgatcaagaagagtaagttcaaagatcttgtcatttctagtcttggtatgtagtttgtggttatt

SEQ ID NO: 16360 - DNA, 256 bp, Gossypium hirsutum
  Clone ID: uC-gsflnu33B092e09b1
tttatactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggcctaccattccaatatatgaagcaccagatcggaggacatgatgaaagtaatttttcatacagttacgatttaatcgaagtgtggccc

SEQ ID NO: 16361 - DNA, 542 bp, Gossypium hirsutum
  Clone ID: uC-gsflnu33B092e12b1
gtagtctagagctcatctctctgcttcaaagctcctgtccaggtagaattctcttcttcctttgcgttgtgttctttgttgttcagtcgccatggcttcaaagcggattttgaaggaactcaaggatttgcagaaagatccacccacttcttgcagtgctggtccagtagctgaagacatgtttcattggcaagcaacaatcatgggaccctcagatagcccttatgctggaggtgtgtttttagttaccatccatttccctccagattatcctttcaagcctcctaaggtcacgtttaggaccaaggtcttccatcctaacatcaacagcaatggaagcatttgtcttgatatcctcaaagaacaatggagccctgcactaaccatttccaaggttctgctctcaatctgctcgttgctgaccgatccaaaccctgatgaccctcttgttccggagattgctcacatgtataagactgatcgggccaagtatgaagccactgctcgtagctggacccagaagtatgccatgggatgacagt

SEQ ID NO: 16362 - DNA, 328 bp, Gossypium hirsutum
  Clone ID: uC-gsflnu33B092f01b1
aaaaaatagatagttctttcttttcttttttttactctctccctctcccttttaaaactctcctccacattcggcctataaggctgcttggtggtccgttacaaccgttggccgacgacggcggtggagcgcaacccaggtacgcccttttcctctctttttttttaaatctatgcatttttttattaaaatagattttttaaaagaaggaagtaaatgaataaacataaaaaacaaagataaacaggacaaaaacaaaaaaaacatcaactttcactccaaacaaaaaaaaaaaaccaccatatataaaaataccactcatataatg

SEQ ID NO: 16363 - DNA, 445 bp, Gossypium hirsutum
  Clone ID: uC-gsflnu33B092f04b1
ctctcaccatgtgtccatcttgtgaaagaatcggcggtgttagcgatggcagttccaagaacccattttcagtattgccttcaaagcctcatttctataatcgcttcaccaatccttctgcagcatgttgattccaagttcgttaattacaacttaaaatcagtagccaaagaaaggacgagaatagaccctccccataacccctctattttttggttaagggcttgtagtaaatcaaaattagtgtggactataaattaatttgtagaaaaccaatagtaaaaattactgatcaatctcctcatccatctttaaatgttttttgtaaatattcattagaaattaagatatactagtatatctatctcttattattcattcttttgttccatctttaatgatacactacttggttccattgctttgataatatggaatgaataaa

SEQ ID NO: 16364 - DNA, 484 bp, Gossypium hirsutum
  Clone ID: uC-gsflnu33B092f05b1
aacggcaatggctctctctcgtttcgtttacttaatcatgctggcattgcttttttgctccgttatagcacaatctccgacgccgtctcctgtttcttcgccgaagaaatctccgtcatctactccgacaccgatctcttcacctcctacaatatctgctccgtctccgtcggaggttccgtcagcgactacaccgtctccagcaactgttgagtcacctccatctccttctgctctgtcaccgaatgccagccccacgtcaatttgtgaacctcctgcatgggctccggcaccagtggatataccagccatacagttctgagagccgcagacatcaaggctctgggatctttcaggagcaatgcttaagtccagctttcattttcttacgaacttcaaccaaaaaagaaatggagaaccttgagttcagtgtggaccattgaaatgtaaataaatatttatgaacaagggtgtcttattttct

SEQ ID NO: 16365 - DNA, 453 bp, Gossypium hirsutum
  Clone ID: uC-gsflnu33B092f07b1
ctcactcgtccgggaacataatatataagtctccttgtttcagcttaaatttccagccatgaatcacaaccagcaacacttcaatcaatcatcagcaggtcggttctcttcttcaatctttcctttcttatatagcttacatgaaaaacccagaaatattaatgtggtttagtacttgtttaatgatcaaacagctgcatacccaccaccaccaccctccacggcgccaggaccctacgtgactgcaccgccggccggttacccgatgagcaaagacgagtacagtcagcaaaatccggctgctgtcgaaaccaagtccagaggtgatggattctggaaaggatggtaagtactacctaatacctatacatacatacatacatacatatatacccaatgaaatcttctttttctttaatatattatatatttactgatgaaatcgcatcgttc

SEQ ID NO: 16366 - DNA, 525 bp, Gossypium hirsutum
  unsure (1)..(525): unsure at all n locations
  Clone ID: uC-gsflnu33B092f10b1
cttgtttcccagcaagccgccaacttacgctcctccgcccaagccaccgaccaagccaccaacttacgcccctccacccaagccaccagtttatcctccaactaagccgccaactgcgcccccgactaagccaccagtgcatccaccgacatatcctccaccatcgccttctccagctaagccgcctacttatcctaaaccacaaaggagcctagtggctgttagggcgttgttttttgcaagtcatgcaaatacgctggatccaacaccctgttgggagcaaaacctattttgggcgccactgtaaagctgacatgcaagaacaccaaatacaagcaagaggccactgcgaaaactgacaagaatggctatttcttcctgcaagcaccaaagaccgtcaccaggcttggagcccacanatgcacagtgtctctagtatcatcgccaatggctaaatgcagcaaaccatctaatcttcatggtggattgaagggagctaccttgaggcccgggaaggcatttact

SEQ ID NO: 16367 - DNA, 95 bp, Gossypium hirsutum
  Clone ID: uC-gsflnu33B092f12b1
aaataaatcaataaaaaaaaaaaaaaaacaaaaagaaaaaattgggtggtcgatctaggggggccaacacttacgactagggcattccaccccca

SEQ ID NO: 16368 - DNA, 446 bp, Gossypium hirsutum
  Clone ID: uC-gsflnu33B092g01b1
gggcctgttaccatccttaactggtcctttgtcagaaatgatcagccccggtttgagacttgctaccagattgccttggccatcaaggacgaagtggaggatcttgagaaggccggtatcaatgttatccaaattgacgaggctgctttgagagaggggttgcctcttagaaagtcggagcacgccttctacttgaaatgggctgtccactccttcagaatcaccaactgtggtgtacaggacactacccagatccacactcatatgtgctactccaacttcaatgacatcatccactcaattatcgacatggatgctgatgtgataaccatcgagaactcacgttcagatgaaaagcttctttctgtattccgtgaaggagtgaagtatggtgctggaatcggccctggtgtctatgacatccactctcccagaataccattaac

SEQ ID NO: 16369 - DNA, 345 bp, Gossypium hirsutum
  Clone ID: uC-gsflnu33B092g02b1
tgatcttaatagagggggcaatagcaggttcttgaagactgctgcgtatggtcattttggtcgggatgaccaagatttcacttgggaggttgtcaagccactcaagtgggacaaggtccaggcttaattggagcttcatcacattggttctatgtctgatttatttgatctgctgtctgctaccatatgaggctgcttttcttacaatttcctttaatttcttttttgggtttgaaatttgattaaaatttatatttatgcatatgatatgatatgagcgataatgaatgttattattattacaatttgaaagataataacagaaaatgaattaaagcatttttc

SEQ ID NO: 16370 - DNA, 78 bp, Gossypium hirsutum
  Clone ID: uC-gsflnu33B092g03b1
aaaatttaatattaagacaaaaaaaaaaaaaaaaaaacagagagggatttttttaaaaaaaacggggcgcgttaaaaa

SEQ ID NO: 16371 - DNA, 274 bp, Gossypium hirsutum
  Clone ID: uC-gsflnu33B092g04b1
gattgttgttaccttgtttggttcaacaccagcagtgccggaccatgtgttgaccaaggcattccaaattggtaccaaagaagtcaacaagatcaaaagcagactttcccctaagtaagaaaaaaaaaaagaagaagaaggtaatttgagttttgaggtgaaaaatcataaaattgtttctttggagttgaataatgtgatttaaattaccaaaatatgttcactttgaggcaatataatcaacatactatgatgtattgaatttaagaaacaa

SEQ ID NO: 16372 - DNA, 267 bp, Gossypium hirsutum
  Clone ID: uC-gsflnu33B092g05b1
gcagatgttttgacaagggctacttcaagatggaaatgggcaaaaacatgtgtggagtggcaacatgtgcatcataccccgctgttgcttgatctgagggagaaatcatgaactagttcaaagtgccggcttaacagcctacaataaggtccaagacatgtaaaagaagcaaatgtattgtacacaacaaagacaatactgcaaattttcttccattaaatgcttgatgtgtaactaatttgccaatattgaaaaatatatttatat

SEQ ID NO: 16373 - DNA, 426 bp, Gossypium hirsutum
  Clone ID: uC-gsflnu33B092g06b1
caggcttagtcagttttccttttgtttttgtcgtatgtagtcgtaggatcagctgagcagtgtggaaggcaagcaggtggcgctctttgccccggaggtctatgttgtagccaatttggctggtgtggcagtactgctgactactgcacagttcctgggtgccaaagacagagcagcggtagcggccctgcccctgggcctggtgggctaaccaatcttatatcaagagagacgtttaatctgatgcttttgcataggaacgatggggcttgtcctgcccggggcttctatacatatgatgctttcattgctgctgcccgttccttttcctgcatttgctacaactggtgaccaagctactcgcaagagggaaatagctggcttcttagcccaaactttcccatgaaactactggtggggcagggt

SEQ ID NO: 16374 - DNA, 415 bp, Gossypium hirsutum
  Clone ID: uC-gsflnu33B092g10b1
ttcactcgtccgcccacgcgtccgttgttttactcaaaaagatccctctccaacaatggcttctaatcccaaggtcttcttcgacatgaccgtcggtggccaaccagctggtcggattgtgatggagctctttgccgattgcactccccggactgctgagaacttccgtgctctctgcaccggcgagaaaggggtaggccgtagcggcaaacctctccactacaaaggctcatccttccaccgggtgatccccaatttcatgtgtcaaggaggcgactttaccgccggaaacggtaccggaggtgaatccatctatggagccaagttcgcggacgagaactttatcaagaagcacacgggacctggcattcttttcatggcgaacgctggacccggaacatacgatctcaatttt

SEQ ID NO: 16375 - DNA, 529 bp, Gossypium hirsutum
  Clone ID: uC-gsflnu33B092g11b1
gtgaatcacagcttcaacagcttatgctcaaatatgtgcaccgtatcacacatgggcggtttgacaaggaactgaacaaaaaatttagggactgcacgacttgtggttgatttcgataggtggtggactggtgaggaatctgtgaatgttctcttagaagccgcaggccaaggtccaatctacatctgatggagctgattccactctttcaaaccccctgtgtgaggagtctgctcaaaattcttcaaaatactctaacagacagagcatacatccaccacctgcctttggctcatcgcctaatcttgaagcccttgcacttgaagcaaataagtctaaggatcaagatggagatagttctttacttgacagttcacatctttcccggagtgcattaactgattaggtcctgtcaaagttcaacttttttatctcagagcaattctttaccaccattctttagttgacttcagttttagtcctatgcatgaagtttcattttcatcagaagaccaaccaaaaatttctt

SEQ ID NO: 16376 - DNA, 281 bp, Gossypium hirsutum
  Clone ID: uC-gsflnu33B092h02b1
acaaaatcctaaaattaagccaattttcagtatttttttaactatggcttcaaatcccaaggttttcttcgacatgacgatcggaggtcaaccggccggccggatcgtgatggagcttttcgcagacgtcactcctcgtactgccgagaactttcgggcactctgtaccggtgagaaaggcgtcggtcgttccggttaaccacttcactacaaaggctctaagtttcaccgcgtgatccctgatttcatgtgccaaggaggtgatttcacagtcgttatac

SEQ ID NO: 16377 - DNA, 284 bp, Gossypium hirsutum
  Clone ID: uC-gsflnu33B092h05b1
cccacttgttctgtggccattcaaggtcatagcaggacctggtgacaaaccaatgattgtcgccaattacaagggcgaggagaagcaatttgctgctgaggaaatctcttctatggtccttattaagatgcgtgaaatcgctgaggcttaccttggttttacagttaagaatgccgttgttaccgtccctgcatactttaatgactctcagcgtcaagcaacaaaagatgctggtgtcattgccggactcaacgtcatgcgaatcatcaatgaaccaactgctg

SEQ ID NO: 16378 - DNA, 383 bp, Gossypium hirsutum
  Clone ID: uC-gsflnu33B092h11b1
cttgctcgtcccttctaactttggttcttaacacagctcaaattatcaatcaaatcatgtaatttatcccaatttcagatttcaggcaatctttgttctaatggccgcaatcaatgtctctccactcttcacctcctcttcttcacttcgcactttctcttcttatgctccccaaaatacccctaccctttccttaaactcacgctttgccccttccctgtctttcccttccttttctctgagacctcccatttccacaaaaactcgctctttaataatcgcttctgctgtcaagaacctctcggaggtcgaacccattcccgtcccggccctcccgaggtatttgccgttaagctcccttctgatgctggagtctacgcccg

SEQ ID NO: 16379 - DNA, 261 bp, Gossypium hirsutum
  Clone ID: uC-gsflnu33B092h12b1
attatgcaaaaatccccatgctattcttcggttggaccttgctggacgtgatcttacagattccttgatgaagatcttgactgagagagggtactctttcacaacaactgcggagcgagaaattgttcgtgatatgaaagaaaaactgggttacgttgctctagagtttgagcaggaattggagactgccaagagtagctctgccatcgaaaagagttatgaattgcctgatgggcaagtgattacaataggggcggagag

SEQ ID NO: 16380 - DNA, 338 bp, Gossypium hirsutum
  Clone ID: uC-gsflnu33B093a01b1
ttttatacactatttgcggttgtccgaggtgtggggcgtctacttgccgctccaaattccggtcacctcgatccgccgctacttacacttcgcaacaacagaaaggatcgacgagcggttgcccaagtcagcgaggtatgggcgagatgcgcttaacaagactgagtttgaggggttcgcgttggcgctgctaccgcggcagtaacatcagcagcaacagcatcagctaaaggatgatattgccactggagaaccaataccaagagcagaagcagtcacagaaactgtggccgagacaaaggaagaaagcattcgctcatgctgacacacgagatgat

SEQ ID NO: 16381 - DNA, 464 bp, Gossypium hirsutum
  Clone ID: uC-gsflnu33B093a02b1
ctgttttctcttctttttagagtttcatcacaccagatattacaatgggttcaatcggtgaaactcaaatgacacccacccaagtctcagatgaggaagccaacttattcgctatgcaacttgccagtgcatcagttctccccatggtcctcaaatcagccattgaacttgacttgctggagatcatggccaaagctggtccaggtgctttcttgtccccaaaagaagtgggttccaagctccccaccaccaaccctgatgcacccgtcatgctggaccgtatcttgcgtctcctggctagctacaacgtcctcacttgctgcttgcgtacccttactgatggcagagtggaaagactctatggccttggccctgtctgcaaattcttgaccaagaacgaagatggtgtcactctttccgtccttagtctcatgaatcaagacaaggtctctatggagagctgg

SEQ ID NO: 16382 - DNA, 344 bp, Gossypium hirsutum
  Clone ID: uC-gsflnu33B093a06b1
cttatataaaaaaaaaaaaaaaaaaaaaaaaaaaaaaaaaaaaaaaaaaaaaaaaaagacaaatctaacttcactagaaaaacaaacaaaaaactgcaactatagagaaccactatcaatttggcggggcagcattgacagaccccccttttacaaaccgcgtggtggggggtgcactctgggggcccccagctcccccccccggcgttgcccccggacctttcccaactggggcccccagaaaaacccccgggcccccccggcgtaccaacaggggaggagacccccccgtgcccgccccacaaattggttggggcccccacacggttttgactcggggcttt

SEQ ID NO: 16383 - DNA, 564 bp, Gossypium hirsutum
  Clone ID: uC-gsflnu33B093a07b1
ttcaacctctctttccgtttctccgatttctccgccgtctacttcccgctccaaattccggccacctcgctccgccgctacttacacttcgcaacaacagaaaggatcgacgaacggttacctaagccgtcaaggaatggcgacgtgcacgtcgttgtacgaagttctagggattcccgtcggtgcttcgaacgaggaaatcaaatcggcgtaccgccgattggctagagtttgccatccagacgtggcggcaatcgatcggaaagattcgtcggcggacgagttcatgaagatccacgcggcgtacagtaccttatcggatccacaaaaacgagccgtatacgatagtaagcttgtatggagaaaccaacggccgttgacttcggtttctagggcttcaggatatagagggaggagttgggagaccgatcagtgctggtaaaccgagtcgactcagtcacgctaccgagtttggaggtgaactcatcaacgatatttaaacttacatggatctgacagttaatcagtcagtacatatatatatataaagctgtttactaacga

SEQ ID NO: 16384 - DNA, 514 bp, Gossypium hirsutum
  unsure (1)..(514): unsure at all n locations
  Clone ID: uC-gsflnu33B093a08b1
tttcttcgttctgctaaaccctccaacctggtttaaaatttagttaaaacgaggaaaaaatgccactgggattgatattagggataggaaggacgtttcgaaggaagcgtacctcatcgctcgatattctctcgtctaaacgagcaccaagagattattacaaggggaaaaattgcaagtctactggtttccacactcgcaaaggtggatatgttgtgatgcaggagaagttgccaaactatgtggttcctgatttgactgacttcaagctcaaaccaatgtatcccagtgcccaactgaagtcaaaaccgcagaggctgctgaatcagctaaataatcagcagatggagtgagataggttgtttgatcatgtctttcatcatctaaccgcagccatgttaaactagaacatagtctttnggggtgcactgccttaagtcaaggtcttgcgagntctttatttttgtcctacattctaaactattaacaattgcctgtaatgtcagagatctga

SEQ ID NO: 16385 - DNA, 502 bp, Gossypium hirsutum
  unsure (1)..(502): unsure at all n locations
  Clone ID: uC-gsflnu33B093a10b1
tttacgcgtccgctccatttcccgtccgcttgatttccattagacggtgagaaccatgccgatccgaaacatagccgtgggccgacccgaagaggcgactcaaccggacgcactcagagcagctttggctgagttcatctccacactcatcttcgttttcgccgggtcaggctccggcatggcctttaacaagttgaccgacaacggagccaccaccccggccggtctcgttgccgcttctatagctcacggcttaggacttttcgtcgctgtatccgtcggcgctaacatatccggcggtcacgtcaatcccgccgtcactttcggtgctttcgtcggcgggaacatcagtcttttacgcggcatcctttactggatcgctcaactacttggctcaaccgtcgcttgcctcttgctcaagttcgctactagtgacatgaccgtaccggctttcggactttcatcgngagtaggtgtgtggaacgcggtcgtttctgagatc

SEQ ID NO: 16386 - DNA, 489 bp, Gossypium hirsutum
  unsure (1)..(489): unsure at all n locations
  Clone ID: uC-gsflnu33B093a11b1
tttctagctgacatgaaatcagccgaaactgaagagagcatgatggaaaacgaaggatgtctagcagttgttccatgggttccctctcagattgcttcagtagaaagtagagatagcgaacagcaagttccagcgttgatggaaactgatgaaatggatgtagaagagagctgtagcaacagtggaagtatgcaggaagagcatgggtatgaattggatgggttgaagccaagagacgccctccataactgggcgcagcagcaacattgcatgcttccccagcctcctcaaaacccttttactccaatcacatggtctgattgataactggggattatagtgttgccttttccttttgtaaatggttttgtcgtgtaatgttaggggttaagaaatgagatggacagagcctgagtangaggtgatggggtcttcctctcttgcttgcctgcttcattcaacgattttgaggggcataaatgcttgaaa

SEQ ID NO: 16387 - DNA, 494 bp, Gossypium hirsutum
  Clone ID: uC-gsflnu33B093a12b1
ggttctccatggagggcctcattccgtctctttgtcaagcttctcaaagtcattggcatttctttcttcacttggtttcagcttattaattgtaaattatagaggttcactgggatttggcgaggaagcattgcaatctcttcctgggaaaattgggtctcaggatgtcaatgatgttctcacagctatagatcatgtcattgagaaaggacttgtcaacccatctaaaataactgttcttggtggttcgcatggtggctttctaactacgcacttgattggtcaggcaccggataagtttgttgcagctgccgcacggaatcccgtttgtaatctttcatccatggttgccacaacagatattcctgactggtgttatgtggaatcttacggtagaaaaggaaaaactatctttactgaagcaccttcagctgaacacttaactcacttctacagcaggtctcctatattgcatatttctaaggtaaagctcc

SEQ ID NO: 16388 - DNA, 528 bp, Gossypium hirsutum
  Clone ID: uC-gsflnu33B093b01b1
ccctttcgtccgctccatctcaattcaaacaaacccattaaatttatctgatcaaatccattatcaacaatggcttctctcaaattccccattgttctcttcatttcttctcttcttctccactcttctctagctgagatgatttgtgaagatttgcccaaagacgtgtgcgcgttttcgatagcctcatcggggaaaagatgtgtgttggaaacggcggtgaagaaagacggcgacgtctagtatcaatgccggacgtcggaggttgtggtggagaggatggcggagtatatcgagactgacgagtgtgttgctgcttgtggcgtcgatagaaactccgtcggcatttcatcagattctgttctcgatcaacagttcaccgccaagctttgtacccctgcttgttaccaaaagtgtcccaatattgttgacctttacttcaacttggccgccggtgaaggtgtatttttgcctgatctttgcaacgctcagcgatcgaacccacggcggagcatggtggagcttatg

SEQ ID NO: 16389 - DNA, 525 bp, Gossypium hirsutum
  Clone ID: uC-gsflnu33B093b02b1
tcgcccatgcgtccgcccacgcgtccggtttcttgaaacggcaaaggacttgcctaccattatgacttcgaacattcattgtattagcaccatgatgaagtgcatagcgcgtggtgcggttgaattccttaagaaaccactttctgaggataaactaaggaatatatggcagcatgtggttcataaggcattcaatacaggagggaatgaccttactgaatcactacaaccagttaaagagtccgtggtttcgatgttacaacaacaaccggaaaatctaaaacctaaaaacgaagactcggaaacaacagaagatgcatctatgattcatgaaaatgacagtgaaccacctgcgggtaatgatgagtacccggctgcttcaacaccacaattagaacagggaggaagattgttagacgatagagattgccaagatcatactcattgctcaatagaaaaagggagcggcgatcaagatggagaagccgaatctgtcgaaactaccggtggcaatacaactgcaca

SEQ ID NO: 16390 - DNA, 431 bp, Gossypium hirsutum
  Clone ID: uC-gsflnu33B093b03b1
ccctcgcgttcgcccacgcgtccgcccacgcgtccgaaaaaaaaaaaaaaaaaaaaaaaaaaaaaaaaaaaaaaaaaaaaaaaaaagggcggaacgttctgaaaggacccaagagttaggtacaagtgcatgaaaagaaataacttttatatagggggggggccgttttaggggatccaggtttatttccccgggcttgccaggtaatactttttttttgggggcccttaatttcatttcatgggccgccgttttccaccgttggggtgggaaaaacctgggcgttccccattttattggcttggagacaattcccctttttgccaggtgggttataaccaagagggccccacccggtggcctttccaaacgtgggtccactctgatgggccattgggcccccccttgtagggggtcattatccggggggg

SEQ ID NO: 16391 - DNA, 280 bp, Gossypium hirsutum
  Clone ID: uC-gsflnu33B093b04b1
tcgccctcgcgttcgcccacgcgtccgcccacgcgtccggttcactgattcttttctggtttcctttacattttttacatttgttaatttcttggtgttgttacctgcctatgtgtatacatatacatacatacatacgtacatggttagttttttagacttcgagttattttatttactgttgttatgtgatttgacattttatacacagcttggtctaaatatatattataagcgattttacttgaagcaaatacatgaatatctttcagtttttccc

SEQ ID NO: 16392 - DNA, 522 bp, Gossypium hirsutum
  Clone ID: uC-gsflnu33B093b06b1
ccttctcgtccgcctctctaccagccgcagactgggtagctatgagctctcttgttcgaaatgccacatccaattttagccgtagagtggatgggtacgaactgttggatcaaagcggcgaaacaagggaagaaaatccctctcaatataggacgtcttccaagaggagacctcacagcgtggtggcttccctgagttacaggcgagatcgagctaagaaaaggcagattttcttgaggtcatacaagttatcagccatggacaacaactggggacaacccaagccaaagtcgcggaaactgaagaagatggtgcttaaggttaagaccgtggtggtatcactggtgtcgtttatgcgaattggttccttcaaatcttgtaactgtggatcagcaatttgtgcagctgctcctatcgccattaagaagtgttgctgaatgattaaggagtaaagtttgtgctgtaagctatactttctctctagttaatattctctcaactttctaactttttgactattat

SEQ ID NO: 16393 - DNA, 394 bp, Gossypium hirsutum
  Clone ID: uC-gsflnu33B093b08b1
gttgcggacagaataccacagaacatatgtgtggcccatagcacacagtactgacaaatcaagaaaagaaggaattgctggacaaatatagggtaataggaaacacagctacctcggattctggttagtgatccagttgcctaatattacggtgtgaagcggagacacgtggtgaagcttactcgacatagtgtgactgctgacacgtatgagacataccgatatgctggatgagctctttctttctttttaggggtcatgcatacggatgaaggccatgctcggcataggctactgaaaaaactactcaggctccacagatgatatgtggactgtcccatgcagctaataggcagctgggagtcatagcgtccaagactatatgcgtggttgc

SEQ ID NO: 16394 - DNA, 455 bp, Gossypium hirsutum
  Clone ID: uC-gsflnu33B093b09b1
ttttgatatcagatgcagtagccgatggtgatgatgcggaaaaagttccccagtcgggtcattacaaggaagaaagcacgcgggtggctgatcttcttgagaatgaaaagaaagcggttgaagaacttaaagtgcttgttcgagaagcgcttaacaagcatgagtttggtgggtttgcaatgccgcagcaacagcaacagcaacagcaacagcaacagcaacaaccaaaggatgattctgccaaagaagaaccaaaaccaaaagcagaagcagtcacagaaactgtggccgagacaaaggaagaaagcatcgctcaggctgaaacaggagatgatgaagagaaggttgctactgctactatacgatctgacgcagtggaagacgatggtgccaagactgtagaggccattgaagacactattgtttcagtctctgcttcagttcaaccagagcaa

SEQ ID NO: 16395 - DNA, 440 bp, Gossypium hirsutum
  Clone ID: uC-gsflnu33B093b11b1
ttcacgcgtccggttttccaagcaaaaatcatgccttactctgatgatcgcagcttggttacctgtgctgctgatggccaggttcgacatgctcaaattttggaacgtggtgttgaaactaaactgctagccaaacatcagggacgagctcataaagtggtcattgaaccagggagcccttatatattttacacttgtggtgaagatggattagtgcagcatattgatcttagaactgcagcatctaccgaacttttcacttgccgcccagtcgatgatagcagggcttacatgccatttatccatctcaatgctatcgctattgatccaaggaacccaaatctctttgcagttgcaggatcggatgaatatactcgcctttatgatattcgcaagtataaatgggatggctcacatgatattggtcaacctacagatta

SEQ ID NO: 16396 - DNA, 399 bp, Gossypium hirsutum
  Clone ID: uC-gsflnu33B093b12b1
cgcgttttatatcggcacaaataggagttccttacttgtgttgtagaagccgaagaaaaaaaaatggtgaacatagcttttggtagcattggtgattcttttagtgttgggtctctcaaggcttatttggctgaattcattgctactttgctttacgtgtttgctggtgttggatcagctattgcttacgggaagctaacctcggatgcagcactagacccaccaggcttggtggccatagcggtcgctcatgcatttgcgttgtttgttggggtacccattgcagccaacatctcaggtggtcatttgaacccagccgtgacctttggcttggccatctgaggaaacatcaccatcttgaccggcctttttactgggttgcccaatgccttggctcaa

SEQ ID NO: 16397 - DNA, 470 bp, Gossypium hirsutum
  Clone ID: uC-gsflnu33B093c02b1
gtttttgacagaatttatcttcttgaatgggcatggaacctgtatgaaaatgatcaaagcttgaacctggtcgatccgactttagccgaattcaacaaaaccgaagctttgcgagtgctcggggtggcactgttatgcactcaggcttcaccgtcaatgcggccactgatgtcccgagtcgtcgcaatgcttgccggtgacatcgaagtgagcaccgttacatcgaagccaagatatttgactgactatgatgttaaggatataacaggcactttcatgagtgaagaaacacaaacattcatggcatccagcagcaacgagaacacaatgaagagtaacaacaacgccgctacggtgacagatccgagtccctcccccgtaaatgtttctgggttcagtgacatcctcggagaagggaggtgaagagtccttggaatcagatgtaaatatcggatacggtgtatgctcat

SEQ ID NO: 16398 - DNA, 474 bp, Gossypium hirsutum
  Clone ID: uC-gsflnu33B093c03b1
ctttttcgtccggttctctcgatctaaagaagggattgctgtgtttgagatggagtacaaacattggatgcaagtacaaaacagacaattaggtgaactgagaactgctttgaatgcccagataagtgatattgagcttcggatagttgtagaaaatggcatgagccactattttgaacttttccgcatgaaatcaaccgttgccaaggctgatgttttctatgtgatgtctggtacgtggaaaacatcagcagagagatttttctcatggattggtggatttcggccttcagaacttcttaaggtgctcttggctcagctagaccccttgacagaccagcaaatttttgaagtttgtaacctgaaacaatcatgtcagcaagctgaagatgccctttcgcaaggcatggagaaactccaggagactgtatctgcgactttagcagctggtcaactgggccaaggtacatactt

SEQ ID NO: 16399 - DNA, 554 bp, Gossypium hirsutum
  Clone ID: uC-gsflnu33B093c04b1
gttctataaggaaaacatgccttgccatgggagctcagatataacgttgctgtcgggattgctgaaggcctagattacctacataatgagctttctcgacctgttattcatagggatatcaagtcttcaaatattcttctttcagatgggttcgaaccaaagttatctgactttgggttagcaatatggggaccaactgattcgtcatttctgattcaagctgatgttgttggaacatttgggtatttagctcctgaatattttatgtatggtaaacttagcgacaagattgacgtctacgctttcggtgttgttctactcgagttgctatcaggaaaaagaccgataagctttgagaatctaaaaggccagcaaagcttggtcatgtgggcaaagcctataatagagagtgagattgtgaaaggtatattggaccccaatttgaatgggaatatcaatgagactcatatgcataggatgattcgagctgcgacactttgcatcacacgttcaggtcgacttcggccaaagatgagacagatacttagagctgt

SEQ ID NO: 16400 - DNA, 482 bp, Gossypium hirsutum
  Clone ID: uC-gsflnu33B093c07b1
tttctcagcaatttcttctcattttcgagaacatttctttaaagattttttctatatattctttgaagatattaatcagaaaaatggcgctggtttctttcatcggaagggttctttttgcgtcagcgatcatcctctctgcttggcaagagttcaatgaatttggcgtcgctggtggtccagcggtgaaggagctgaggccaaagttcaacgtcttctcaaagactgtctcatctcacacagggttgcaagtgcctgaacttgatatcaagtatgtggttgctgctgctgtagcctttaaaggtgttgggagtattctctttacctttggcagcaccatcggagcttatcttctggttttgcatcaactcattcttactcccattgtttatgacttctacaattaccagaaggagaagaaagaatttggccttctttatacgaagctctcacacaacttggcgctgttaggggcatcgctg

SEQ ID NO: 16401 - DNA, 467 bp, Gossypium hirsutum
  Clone ID: uC-gsflnu33B093c08b1
gcgttatattaaaaatgtccggcgaggggagtataatttgtacgcatgggtccatggtttcattggagactacaaatcggatctcagcatcaccattcaacctggaaacatggccaactcgggtaccctcatatatgatccttcaagatacggccctacattgtgggctatcgggattcctgaccggacggttgctgagttcttcataccggagcccgacccaacatttgttaacccattgtgcctcgatgccgccgacagattcagacagtacggattgggggatcgctactcagatatttatggtcatggtgatgtcgtctacactgtgggtgtgagccatcatcctcgggactgggtctgtgctcatgttctcagaaatacagggaatattaccgactggccaacaaccacatggcagatgaaatgcactctgcatgatgtgaacgagaaaggaacctacactg

SEQ ID NO: 16402 - DNA, 487 bp, Gossypium hirsutum
  Clone ID: uC-gsflnu33B093c09b1
tttattattgctgtggtaagttcacggcagaaggaaacaagtagcacctctggaatgcgtgagagtgttgagacaagttcgcttttacagcatagggcaaaggaagttgttccaaaacgcacaatacagatggaagaagccatacaaaatcgtgattttgcatcttttgcaaaattagcctgtgctgatagtaaccaattccatgcagtctgcttggatacgttgccacccatattctacatgaatgatacatctcacaggataatcagctatgttgagaagtggaatcgttctgaaggaacccctcaggtggcatatacatttgacgctgggccgaatgcagttttaattgcacgagatagaaaggcagctgctcaattaattcagcggctgcttttctacttccctccgaagtctgatactgatctggacagctaccttctcggtgataagacgatacttaaagatgctcgactcgagggattga

SEQ ID NO: 16403 - DNA, 451 bp, Gossypium hirsutum
  Clone ID: uC-gsflnu33B093c10b1
gttatctttcagagtgatcgaaggagatctaatggaagagtataagagctttgtaatcacgattcaagtttcgcccaagagcgagggtagtggcagcgtagtgcactggactttggaatacgagaagctgcacggtgggattgagcatcctgagactctgctgcaattcgttcaagatgtctctaaagacattgacggccacctcacccaagcaagttaagcagtatcacatgatgctattgttgccgctacttgaagcactattcatctatttaatgaataaagtgacaacttcctttctcatgtattttgatctgaatatgtacgtttagatcaatatgcagtcacggggaggagctttgtattttcttgcatgtttgtctttttaattctgtatgaattcaatgtgtcctatgcttttatttgtgttctaataaatatttgtaagtat

SEQ ID NO: 16404 - DNA, 542 bp, Gossypium hirsutum
  unsure (1)..(542): unsure at all n locations
  Clone ID: uC-gsflnu33B093c11b1
gtttttgcttgcatgtgcttctgtggacattttgtaaaaagagaatttgagaccttatatattcacagattctctgctgaaaccatgccaatcatgaacttatggaaaaactgcgcttattattggtcttttgcttttgttattgggtacattgtcaatcgtcctgattttgtgtttccaaggatgagctatgttatcaccggattaattgtgttccttatcagtgaactattgaatggcctcagtcacattcaactcagaaatctcagaagacccggaactagggacagaggcataccaacaggcctcctcttcgaatacgtttcctgcccaaactatacctgtgaaattactgcttgggttggattttccattttgacctgctcccttgccagtgctctgtttacattggttgggtttggacagatgcttgcttgggctcagaagaagcacataagatacangaaagaatttccaaactatcccaagtccagaaaggtccttgtacctttcatttactgagatcagattattctgatatg

SEQ ID NO: 16405 - DNA, 520 bp, Gossypium hirsutum
  unsure (1)..(520): unsure at all n locations
  Clone ID: uC-gsflnu33B093d02b1
cccacgcgtccggccacatgaatatgcacctgtggtgaatgccctaagaaaaaggcctcaagcttggcttgatttcatgatgaagtttgagctggggctagagaagccagatccacgaagagcattacaaagcgcattcaacattgccgtttcttacatattgggtggattggtgccactccttccttacatgttcattccaagagcccaggatgcggtggctgcatcagtggtcatcaccattgctgcactcctcatcttcggctacgccaaaggttacttcaccggcaacaaaccggtaaaaagcgcattccaaactgctctcattggtgccattgcatctgctgctgcttttggcatagctaaggttatccatcctaggaagttttatgctttgtttttaagaactgaaaatatgggtttcctttaatattnttcatgttggtatttagattaaaatctcaaatcttcatgtaattctctccttttacctgtacgaatgagtaaatcaccatttcaa

SEQ ID NO: 16406 - DNA, 467 bp, Gossypium hirsutum
  unsure (1)..(467): unsure at all n locations
  Clone ID: uC-gsflnu33B093d03b1
atttcagcattctctcattctttacccggaacacaaataaacactaagaacaagacaatggcaccaaaagctgagaagaagccagctgagaagaagccagctgaggagaagaagacggtagctgagaaagcccccgccgagaagaagccaaaggcaggcaaaaagcttcccaaggaaggcggagctgcggccggagacaagaagaagaagagggccaagaagagtactgagacctacaagatctacatcttcaaggtcttgaagcaagttcaccctgatatcggtatctcaagcaaagctatgggaatcatgaacagcttcatcaatgatatctttgaaaagctcgcccaagaagcgtctaggctcgcaaggtacaacaagaagcctaccatcacttccagggaaatccagaccgctgttaggctggtacttcccggtgagctngcgaaacacgccgtttctgaagg

SEQ ID NO: 16407 - DNA, 485 bp, Gossypium hirsutum
  Clone ID: uC-gsflnu33B093d04b1
ctttttcgttcgatcgaatgctggggcgaacaaggcagcatcgagtagcactactttgaatacaaggaaacttgatgaggaaactgaaaatcttgctcatgaaagagtgccaactgaactgaagaaagccatcatgcatgctcgaatggagaagaaactcacccagtctcaacttgctcagatgatcaatgaaaagccccagattatacaagagtacgaatccggaaaagctattcctaaccaacagattataggtaaactcgagagggcactcggtgcaaagctgcgagggaagaagtgaggagggtcttatcgttaatcaaacagaagttgaatatggggtccagttcttgagtcctaaaaaatggtgatgtaaataaatgcactctacagttactatggctcgcatgtaataacagcgtcttcgatgttatctgaagactatgactatgactgatgaaatgaagtgtgttcttgactgttgc

SEQ ID NO: 16408 - DNA, 516 bp, Gossypium hirsutum
  unsure (1)..(516): unsure at all n locations
  Clone ID: uC-gsflnu33B093d06b1
cccacgcgtccgcccacgcgtccgcccacgcgtccggagctgtttcctttaacttctctttgtctccttttctctaagaagaggagcctgtgatatagattgaagaagcaagttagatttaaaaaggacaatgcggttgtttccatcgaattcgagtaagggtcagagtaatggtggaagcaatcgcgctttgttgcatctcaatgtatatgacctcacacctataaataactacctttactggtttgggattgggatataccactcgggtatagaagtacatggtttggagtacggatttggagcacatgagtaccccacaagtggggtgtctgaagtggaaccaagaagttgtcccggcttcatattcagaagatcaatagtattgggcagcactaacttgtctcgttcagaatttcggtcacttatggagcagctttccagatgtaccatggngacacgtaccatttaanntgctaagaatgcaccatttcaccaatgaagtatgcatgcagc

SEQ ID NO: 16409 - DNA, 527 bp, Gossypium hirsutum
  Clone ID: uC-gsflnu33B093d07b1
ttgaaacaaaggccttcatcttagcactccgccgccccttatctcatcgcaatcatgatcatcccagaaaagaaccgcagggagatatcaaagtacctctttcaagagggtgtttgctacgccaaaaaagattacaacttggcaaaacacccagaaatcgatgttccaaatcttcaagtaataaagctgatgcaaagcttcaaatccaaggaatacgttcgtgaaacttttgcttggatgcattattactggtaccttaccaacgatggcattgaatttttaaggacttaccttaatctcccctctgagattgttcctgctactttgaagaagcaaactaggctggctgggggtcgtcccatgggtccttctgatagccgcctacgtggtccgccacgctttggcgacggtgagaggcgattcggtgacagggatggataccgtggaggtccacgaggagtcggtgatttcggtgataaggtggtgcgcctgctgattatcagccttcattcaggggccctggttca

SEQ ID NO: 16410 - DNA, 544 bp, Gossypium hirsutum
  Clone ID: uC-gsflnu33B093d08b1
gcgttcaccctctgactctcctaccatatctgacagagtcatcaacaaggaaatcccatctaccgtggtgtatgaagatgataaggtcttagcttttagggacatagctccacaggctcctacgcacattttaattattccaaaatcaaaggatggcctaactggtttgtctaaggctgaggagaggcactgtgaaatccttggctgccttctatatactgcactgcttgttgcaaaacaggaagggctggaagatggattcaggattgtgatcaatgatggccctaaaggatgtcaatctgtgtatcacattcatgtccacctctcttggagggcgccacatgaactggccttcaggctatatatagaggttatagatgctataggtattatatgatagcttcaataactaaagccgtcgtgtgggcttaatcgatgaacgatggagtacgctcttgaatagggaaaactaatgaaccttgtgaaatgcattgcttggaatctcagaatcaaccatcgaacatagaacaagtgttaaaagggc

SEQ ID NO: 16411 - DNA, 380 bp, Gossypium hirsutum
  Clone ID: uC-gsflnu33B093d09b1
tttttgccacaccaagccctatgtgcggtcaaaagcaaggaaatttgagagggctagaggaagaaggaacagcaaaggcttcagggtttgagattccaactgcactggaaaaaaaaaaaacttatcaacccatcatgataatgggaatgctcagttttgttttttttgctttccacctttcctgttctttttcttttgcatgattgtaattaggaatcttttatactcggattaacggaacggatactagagtgactgaagaacggtgatggatgtctgtatttcttatgtatagatcagaacaggattgagttccataagctgataaacacaaaaaaatttaatactggatactgggttatgggcggccgttctagatt

SEQ ID NO: 16412 - DNA, 453 bp, Gossypium hirsutum
  Clone ID: uC-gsflnu33B093d10b1
tttatcgcgtccggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctgttggtgttaaaatcttataaaaatatatatcggttgctgc

SEQ ID NO: 16413 - DNA, 498 bp, Gossypium hirsutum
  Clone ID: uC-gsflnu33B093d11b1
tcttattatggggtttgctgttgtagcactagtagttaaagctgttttgcttgtgcagctttcactgttgctactgagcaccttcactgtctctgctaccatttggcctcaggcttctcctcctgattaccaggctgtttcacctgtagtcccgcctaggcacccaccaaccgaccaccatcaccaccaccctcaccctcaccctgaccctgatccacccactaagcccccaacccccactcctcctgcagttgatccaccacccaaggcgccagtgcaaccaccaaccaagcccccgacttctgctccacccaagccaccagttcaacctgcaactaagccaccaaccaaacctgcaactcaacccccgtctaaaccaccaactcagcccccaactaagccaccaaccaagcctgcaactcagtccctgaccaagccaccaacacacccaccatctgatgctccggccaagccacctacatcgagtcatgtggcagt

SEQ ID NO: 16414 - DNA, 516 bp, Gossypium hirsutum
  unsure (1)..(516): unsure at all n locations
  Clone ID: uC-gsflnu33B093d12b1
ttttcgcgtccggttctctgtgcgaatttcggggatcaaatactctttcacaaaaaggagagaatataagtaattaattaacacaactttttttcgttgttgttgaaaaagctcatcttttttttgatagttagagtgagcaatggctaagaatgtgggaattcttgctatggaaatctacttccctcctacctgtgttcaacaggaagcattggaggctcatgatggtgctagtaaggggaaatacaccattggacttggacaagattgcatggccttttgtacagaagtggaagatgttatctctatgagtttaacagctgttacttcactccttgcaaaatataagattgaccccaaacaaatcggccgtcttgaagttggtagtgagactgtgatcgacangagcaagtccattaagaccttcttgatgcaaatctttgagaaatctggaaacactgacatcgtaggggttgactcaactaatgcatgctatggagggactgcagctctatt

SEQ ID NO: 16415 - DNA, 218 bp, Gossypium hirsutum
  Clone ID: uC-gsflnu33B093e02b1
ctctctcgtccggtttgtttgagggcacacctagtatccggaaagatgcacaaaggtttattcagcttagagaagactacaagagtgcgaagcttgcatctaggctcagctctttatggtcgggtgtctagttgatgtagaggtggggtagtggaaggccctcaaatatgccaactttttgtgcgtcgtagtatatgcacactttagtcagctggcgt

SEQ ID NO: 16416 - DNA, 543 bp, Gossypium hirsutum
  Clone ID: uC-gsflnu33B093e03b1
ccttttcgtccgggatggcgccatttgtgcaaaaaggttcaagaggcttgtgagaaattcggttgttttgaggtggtgtatgatacgatatcgacgaaagttcgagaagagacttttgggttgatgaaagaattggttgaggtcccggtggaacggaaacaaaagaacactagtcccatgccttaccatggctgggttggaccatgcgagcaagtttctttgttgtatgaaggcttcggaattggaaatgcctccaactatgattgtgttaaaagttttactcaacttatgtggcctgaaggtcacccacacttttgcgacactatatataccatgggaacacaaatggaggagctaaacaagttaatctggttaatgctaattgatagctatggattaggagatgactcactgaagttgaactacacaacattggtgcggatgatgaaatacatggctcctccacccagggagtatgagagaggactttttgctcatactgataaaccagtcagtacacttatttgtgaggatcaagtttca

SEQ ID NO: 16417 - DNA, 428 bp, Gossypium hirsutum
  Clone ID: uC-gsflnu33B093e05b1
ctttttcgtccggaaacttgcagcataggttactgaggaatctggtggtctggcagtgtagtgtactatttggtttctgctaagctgctgtgttcacaacattgcactgttttagaaaataatgaacggctctattggctggccgggctgggtacttgttttgttcatcatagcatccacaacattgactttttggcccattacttgtaatttcactgttcgcaacatatcatgatctatgtattttgctatatcatagatgtcgcataaggataaaaataaatgtattctaagatatgcacatgaagctgtatcatgtgctgcagtgaatagcatcaatatatgcattagcaaaatagctcgggtgctagcgctggagctacaggcgtcttcccgcgagtttaagcagtaaaaaaggaaataacgct

SEQ ID NO: 16418 - DNA, 516 bp, Gossypium hirsutum
  unsure (1)..(516): unsure at all n locations
  Clone ID: uC-gsflnu33B093e08b1
tttacgcgtccggttggcaccatttatagcaaaaacgagctcaaaaaattattggatatccatgcgtttcaccaagagagtggcgtaagccgaagagacgccatcatccttgcaggtgtgttggactttgctcaaaagaagttagagcagattatgacccctctcgataaagtttttatgctggatatagagtgtagtttagacgtccatactcttacatcagttgcagaaaatgggcacagccgtgttcctgtctatgagggcgagagaaacaatattgttagttgtttgtacatgaaagatcttgctttggtcaatccagaagagggaatcccattgagaactttcctaagtttttatggaaggcagattcctaaaattagatctgataaaacgttagattatgtgctgacagaattcaagagtggcaagagtcatatggcgatagtgcaaaggtgcgatggggctaattccacaaacgatgataacatcngtatagccactatggaggacgtg

SEQ ID NO: 16419 - DNA, 507 bp, Gossypium hirsutum
  Clone ID: uC-gsflnu33B093e11b1
tttttggccgtggcagccaccgagaccagcaaagacccgacccaacctaactacgaagtcaagcttttcaatcgctggtcttttgaggatgtccaggttactgatatctctttgagtgactacattggtgcccaagcttcgaagcacgcaacctatgtgccgcacactgctggaaggtactcagtgaagcgtttccggaaagctcaatgcccaattgttgagaggcttacgaactcactgatgatgcatggccgaaacaatgggaagaaacttatggcagttaggattgtgaagcatgccatggaaattatttatctcctgactgatcagaacccaattcaagtcattgtcgatgctataatcaacagtggacctcgtgaagatgctactcgtattggttctgcgggtgttgtgaggcgtcaggctgttgatatttctcctcttcgtcgtgtgaatcaagccatctatctcttgaccaccggagcacgtgagtctgcattcagaaac

SEQ ID NO: 16420 - DNA, 448 bp, Gossypium hirsutum
  Clone ID: uC-gsflnu33B093e12b1
gtcctagatcgcgagcgccgcccttccttttgtgttttttttttttttttttttgttttttttttttttcttttttttttttttttttgtttttccttgtttctgaaaaaccccaaaaaactccggagttatttttattaaaaatcggggcaacttcattggagggacaagggtctaaaacccaccgaagtggggacaccccccccaaagggctcccggaaaagaaaatctgaaccgggggggtcaagaccaggggggggggaaaaaaaaaaggccccccctccgaccccaaggaatcaaggggggcccgggcgtcttgggagggagcctcacccttaagagctttctcgaaggcccattaacctcccgattccatcttttgcattctacaaccccctcccaacaaacaaaaggcctgggggttatctccgatcaattttagagccct

SEQ ID NO: 16421 - DNA, 474 bp, Gossypium hirsutum
  unsure (1)..(474): unsure at all n locations
  Clone ID: uC-gsflnu33B093f01b1
cgcgcgttctgtccagctgtgaagctagcataatggaagccaaatggctggttcttttttcagtggcggcaatgctgatggacctggccaactgccaggaatctgtgaagccattggtgaagatggtcaagggcaagaagctgtgtgacaaagggtgagaatgctatgggcggtcaaagtattgctgcaaccataccatttctgattacttccaaacttaccagtatgaggacctgtttgcgaagcgtaacacgccggtagctcatgcggttgggttctgggattaccataacttgattaggctggtgctcattatcagcctcacggatttggtaccactggggaaaagctccagaatatgaaggaagtcgctgcttttcttggacatgtcggatgccaaactctatgaggctactgagcagctacagggggaccatgggctaggngtgattgctacaacaagaaatgagccct

SEQ ID NO: 16422 - DNA, 531 bp, Gossypium hirsutum
  Clone ID: uC-gsflnu33B093f03b1
ctttgattaagacagaagcatggccagccagctcgtaggaacaaagagagcttgtgtcgtgggtggcagcggattcgttgcctcattgctggtcaagttgttgctcgagaagggttacgccgttaacactacagtcagggaccctgacaaccagaagaagatctctcaccttgtaacactacaagagttgggagacttgaagatctttcaggcggatttaactgatgaagggagctttgatgcccctattgctggttgtgaccttgtcttccatgttgcgacacccgttaactttgcttctgaagatccagagaatgacatgatcaaaccagcgactaaggagtggtgaacgttttgaagcttgtgccaaagcaaaaacagttaacgagtcgtcttgcatcatctgcgcagctgtgtctatcacacactggatggacagatctcgtatgacagagaagactggccgatatcgagttcttacatcagaaagccaccaacttggggtaccctgcatccaaacgtggctgaaag

SEQ ID NO: 16423 - DNA, 487 bp, Gossypium hirsutum
  Clone ID: uC-gsflnu33B093f04b1
cctatttccccataccccttctgttcaacagcaaagatggcaactgtgcgggttacctcctctagtatcgttcaagcttcaatcccgaaccgattcacgagtgccattgtcaaggccccgacttctcttggatcttttaagaacatctccaaatcttttggcttgaaatgttcctccaatcacaaaacattaatggcagcttataagattaagcttgtaggaccgaatggtgaggtgagcgagtttcaagcccctgacgatcaatacattttagatgcagccgaggaagcaggagttgaactgccatactcttgccgagctggagcttgctccacatgtgccgggaagattgagtcgggttcagttgatcaatcggacggatccttccttgatgaaaaacaaattgccgatggatacgtgctgacttgcgtttcgtacccgacctcagatggtgagatccacactcacaaggaagctgatctttact

SEQ ID NO: 16424 - DNA, 399 bp, Gossypium hirsutum
  Clone ID: uC-gsflnu33B093f06b1
cgcgcgatatcaaacggacaagctagaaataatgaggggagcacttttacgttgtattctgtcataaaccgcaaatcccaaggtcctatcagtgggtcgctcagtggagaattcagggggccaggcccactcacgaacccacatgaccgtcctaatcagcaatagccttttattgggagctcgtctccacaaggcatatgttctgaccgttttgcttctataattaggttgcgtgagaggattctgtcgtacccacgtccatggaatcgccgacaccggcagagtctagggttggtgcgtaaacatttgggattacgacagacgctcgttgatattacagggtgtgccgggagctgacagggagattcgaaggctctgatattgactgttgatgacccg

SEQ ID NO: 16425 - DNA, 321 bp, Gossypium hirsutum
  Clone ID: uC-gsflnu33B093f08b1
gcgttcttgcacacagaagagtgggcgtgagcttgggaagtttaaagcttgatgaggtcacctttacgctcatatgagggagaggattgagattaagggtgctgatctttaagcgagtcgaagtgaacagtagatggagggtctctgacaaccaatatatgatttggctaatcgaccgaatctgtgaggggggggaactggagaattgtagcgggctgtgatatgatcgactggggtttactggccactgggagggggagggactaggcatgcatgataggggtgccagatactaagggctggtggtgctagagactgtgg

SEQ ID NO: 16426 - DNA, 284 bp, Gossypium hirsutum
  Clone ID: uC-gsflnu33B093f09b1
tttacgcgtgggcggacgcgtgggcaagcacagaggcaacacccaagagagttttcatccgattgtagtcattggtgcctccctggggtgcctgacatttggaatgagatgttaagtgcaatggtctaagaatgtcaccaatggtgaattggctttttaactgtttctaccaaaaatgtagtctttaagtttcatcaagttagattagttgaggtttatgcattggttttggtctgaaaaagttttagagtgatggtatgtatgtttggcatattcaatttagt

SEQ ID NO: 16427 - DNA, 507 bp, Gossypium hirsutum
  unsure (1)..(507): unsure at all n locations
  Clone ID: uC-gsflnu33B093g03b1
ctttttcgtccgaaattacactaattccaggagatatatctcatgaagatttgggcattaaagattgtaatttagtacaagagatgttgaatgaggttgatgttgtggttaaccttgctgctacaaccaactttgacgaaagatatgatgtggcacttggtctcaacacatttggagctaaatttgttgcaaatttcgccaagaaatgtgtgaaactaaaagttttggttcatgtatccacagcttatgtgtcaggagaaaagacagggcttatacttgaaaattcatacagcatgggagaaacacttaatggtgtttcaggcttagacattaattntgagaaaaatgttattgaacaaaaattgaatgaactaagattgctaggtgcttcagacaaggatattactcaagccatgacagatctgggcattcaaagggcaagattctatggatggccatatacatatgtatttacaaaggcaatgggagaaatgctagctggggaat

SEQ ID NO: 16428 - DNA, 502 bp, Gossypium hirsutum
  unsure (1)..(502): unsure at all n locations
  Clone ID: uC-gsflnu33B093g05b1
gttttgtctccttgaggtcatggcggaatttccttcagccaagcctccacttggtgttttctttgcagctgttgctccaaggttgcagcctagatattattcgatatcatcctcaccaaggttggcaccatcaaggattcatgtaacttgtgcattggtttatgagaaaacgccaacaggtcgtattcacaaaggtgtttgttcaacttggatgaagaatgctgtgtcctcggggaaaagcgatgactgcagctgggcacccatttttgtcaggcaatcaaactttaaacttccttcagatgctaaagtgcccatcataatgattggccctggcactggattggctcctttcaggggattccttcaggaaaggcttgcactgaaagaagctggtgctgagttgggtccatctgtattgttctttggctgcagaaaccggaaaatggatttcatatatgaagatgagctcaacaactntgtcaacagtggtgcactatctgag

SEQ ID NO: 16429 - DNA, 528 bp, Gossypium hirsutum
  unsure (1)..(528): unsure at all n locations
  Clone ID: uC-gsflnu33B093g06b1
gactaattaacttccactacatccaaattcaagtccatttgctgtgctgtgagtgaattggagagagatgaaagggggaaaattgccccagatggcaatgaagcgagaaagaggagcgagaaaggagactccaaatccctcaatgcctatttcaagcagaggaagtcacgaacagaagacttcaaatgccgggatcttgaaggagaaaatcagaaacaaataagagaatcgggaaatgaaaataagggcaagccgggaaaagggttcttcgcttgctatctgctaacctctctcagccctcgtcataaaggccacacctatatcggatttactgtgaacccactgcgtcgaataagacagcacaatggggaaatggggtgngtgcttggaggacaaagagccgacgcccgtgggatatggttgggtgcatatatggttttccaaccaatgtatctgctcttcagtttgagtgggcctggcagcatcctcgagaatcagaggcgtgaggcaagcagctgcaactttaaa

SEQ ID NO: 16430 - DNA, 461 bp, Gossypium hirsutum
  Clone ID: uC-gsflnu33B093g07b1
ttctcgcgtccgcccacgcgtccgcccacgcgtccgcccacgcgtccgagcttccatggtcctccttttggcactcaacattctctttttttccctagtcagtgcttgtggctcttgctcttcacccacccctaaaccaaggccaaacccaaaccccaacacccccactcctactccatctgcacgaggcaggtgccctagggatgccctcaaattaggtgtatgtgccaatgtgcttaacctagtcaatgtcaccattggttcacccccagtgatgccatgctgttcccttctcaatggccttgtcgacctcgaagccgctgcatgcctttgcaccgctatcagagctaacattttaggcatcaaccttaacatcccagtttcccttagcttgctcctcaacgtttgttcaaggaacgttcctactggcttccaatgctaaaccatcactgttccctaca

SEQ ID NO: 16431 - DNA, 460 bp, Gossypium hirsutum
  Clone ID: uC-gsflnu33B093h02b1
gcgcggacgcgtgggcttcaccacagtccccgttttagtgactgcgtatatctgccattacaatgtccacagcatagataacgaactggaagattcaacccagataagaccggctgtgcgaacagctctggctttatgctcaactgtttacataatgacaagctttttcggattccttctatttggcgacgccacactggatgatgggcttgccaactttgataccaaccttggcatcccctatagctccctgcttaatgatgctgtccgagtcagctatgctgctcacctcatgctcgtatttgccattgtcttctatccactgcgactcaacatggatggcctcctcttacctgattcaagtcctctagctcagtctaatacaaggtttgcttgtattactgccggactatagcagttatcttcttgggtgcgaatttcatacccagcatctgggatg

SEQ ID NO: 16432 - DNA, 507 bp, Gossypium hirsutum
  unsure (1)..(507): unsure at all n locations
  Clone ID: uC-gsflnu33B093h03b1
gcggtttattgcattttcttgtttgtgttaccggctgaggatcctcaaacctcgcagaagaaagaagaaagagaagaatcatggaacacgataagttggattacgtactggttccattgggactgctgctgctttctctctatcatctatggcttctttgcaccattatcaagcatgctacaaggactgtcatcggcttaaatgcccattctcgtcaccaatgggttgtctccatgatgtctgatccgttgaaaaatggtgttctagcagtacatacaatacgcaacaacataatggcgtcgacacttttggccacgatagcaatcactctcagttcactgattagtgttttcgttagcagcagctcagactctggcaacacatgctccgaaatagtttttgggaacaagactcggctactgtcttcatcangtatttttccatcttgctgtgtttccttggtgcttttctttgcaatgtgcagtctattagatactacgcccatgt

SEQ ID NO: 16433 - DNA, 575 bp, Gossypium hirsutum
  Clone ID: uC-gsflnu33B093h06b1
tcgccttttcgtccgcccacgcgtccggtttgagaaatgcatctacaggtcatggacagatgaagagttcggcaaaaggtggtggaaaattcttgatagatttgaactcaaggatgatgaatggatgaagtcgttgtatgaagaccgcaaaaagtgggttccaacctatataatgaatgttctgttggctgggatgtctacggttcagagagccgagagtgtgaactcattctttgacaagtacgtacataagaagaccacagtgcaagattttttgaaacattatgaagcaattttacaagataggtatgaagaggaagcgaaagcaaattctgattcatggagcaaagtgccagcattaaaatctccatcaccttttgagaagagtgttgtgggggtatacacacacacattattcaagaagtttcaaatcgaggttgtgggtgcaattgcttgtcatccaaagccggaaaatcatgattcaacatgcagcatttttagagttcaagatcttgaacagactcaggattctattgtactttgaatgagatgaaaggagaagtttcttgtatatg

SEQ ID NO: 16434 - DNA, 489 bp, Gossypium hirsutum
  Clone ID: uC-gsflnu33B093h07b1
ttaatattgcagaaactggtctaaatcttctattggagatgctaaaaaactttcaggcttctgaattttgcaaccagttctaccgaacatactttttgtcaattgagcaagaaatatctgccgtcttgacagacacatttcacaaacctggcttcaagttgcatgtcttggttttgcagcacctgttctgcctggttgagagtggtttgttgactgagccattgtgggatgctgctacggttccatatccatatccaaacaatggaatgtttgttcgtgaatacacgataaagcttctgagtacatcattccccaacatgactgctgctgaggtttctcaattcgtgaatggattatttgactcgagaaatgactagtccacttttaaaaatcacatacgggactttcttgggcaatcaaaagaattttcagatcaggacataaagatctctatgcagaagaagctgccctacagagggaaagagagcg

SEQ ID NO: 16435 - DNA, 414 bp, Gossypium hirsutum
  Clone ID: uC-gsflnu33B093h09b1
gcgttttcgcgtccgaaatcagtcaagaaaggcgacgttttcgtgttcccaaggggattggttcatttccagaagaacaatggcgacaaatcggcatccgttatagcaggatttaacagccaattgcctggaactcaatctattgccgcaacattgtttacatcgacaccggctgtcccagacaatgtgttgacaaagacctttcaaattggcaccaaagaagttgacaaaatcaaaaacaagctagccccgaagaaaacttagaaaattggcttctgtaattgaaaatatcatacgtatttctgtcggggattgaataatgtaatttaagagcaaatattggttttgtatgtggtaacgtcgccaattcactatattttctttgaattatctactcatgtgttgtttttaaaa

SEQ ID NO: 16436 - DNA, 509 bp, Gossypium hirsutum
  Clone ID: uC-gsflnu33B093h10b1
ttatcaagttatcgctgccggcccacacctccttcctcaattcattttatcactgcaacaggtaactaccacctcatcaacatgtcgtctcaccacctctctgagttggactccaccaccgattccgtcgcgtcctctccacgctccgagcaccatgctcctcatgatgcccgtgtacggttcatgtgcagtttcggcggaaagatccttccacgtccacatgataatcagctccgttatgccggtggtgatacccgcatcgttgccgtccatcgttccacctccttcgcagccatcctcaccaagctctctaaactctcaggaattgccaacgtgagtgttaagtatcagcttccgacgaggatcttgacgcgttgatttcagtgatgaccgatgaggatctcgagaacatgatggaagaatatgatcggctagcacagaatcataaccctcggttgcggattgttcttttctccaaaggcgatgactctcgaaccagtagcatcagc

SEQ ID NO: 16437 - DNA, 418 bp, Gossypium hirsutum
  Clone ID: uC-gsflnu33B094a02b1
ctactcgtccgtgataaatcatccccataccgtgagctagcagatttgtcaagttctagaagcctgaatttgagtaggagcttgagttgtagagcagatgtcatgaggggtacatcttctccttatgccgaccgaaaacattttgaaagcaccccgcctaatggatgggagaaaatttttcctggaagaccacatggttatggaaagaatttccctttattaaattatggggccaataatggagtgctctcaaggaataattctcaatcttctcttgggagtgcttccatcaagacttttgtggatgaggatataactagcattcaatcttttgttgcaagatttaagaagcaacttgctaatggtcagattcagagcacggaacttgaagtagatgagtccagaaagagtatgaaag

SEQ ID NO: 16438 - DNA, 386 bp, Gossypium hirsutum
  Clone ID: uC-gsflnu33B094a04b1
tttttatggactttgatcttgccagcacgagcactggattagagctatggcttgacagtttattgatggatcatattgggtatacctgcaactgcttgtaaatgcatatcccgtgcatgataatcacccttcctagtattcattgcttgactgaattactgggttcccacggtgtttgcttcgttcgttagttcatatactactcaaggccactacacttgtaaatatgctgtctctgttatcagactggaactgtgttctcgactcttttatttggaaaattttcatgccacacatattgtttcgtatcaaagagctgattgaacgtggcaaacttaatttgcgattgtgaattatcaaggcttctctatgggtattactagatt

SEQ ID NO: 16439 - DNA, 204 bp, Gossypium hirsutum
  Clone ID: uC-gsflnu33B094a06b1
gctagtccaacacgagtgttagacacctatactgggacataactgaagagcacaagcaacataagagattactatgccccttccctccctactttattattggctgtgattcttaagcactgacagctcaggtgggagtgtcgggtatgtgcacaagataggcctgattagtcttttttaaaggtgtccatgcatttggagact

SEQ ID NO: 16440 - DNA, 381 bp, Gossypium hirsutum
  Clone ID: uC-gsflnu33B094a08b1
tcccacgcgtccgattccaactgctaggagggggttctattcttatcagctggctgccaagccgaggctgcttgagccagtgtacttggtggagatccaagccccagagcaagcacttggtggtatttacagtgttcttaaccagaagcgaggacatgtgtttgaggagatgcagaggcctggtactccactatacaacattaaagcatatcttcctgttatcgagtcatttggattctcgagcaccccgagggctggaacattaagtcaggcttttccacaatgcgtgtttgaccactgggatttgatggtatcagatccattggaacctggttccaagcaggcacccatgttgctgagattccgtagaagaagggattg

SEQ ID NO: 16441 - DNA, 142 bp, Gossypium hirsutum
  Clone ID: uC-gsflnu33B094a09b1
cctttcgtaggctcgatatcccacctgctgcggaggctgtgaatgttgacaaaatggaggtggtggatgctgcattccctcttctaaagggtgttgacgctacaactgatgctgatgaggcatgcactggattcaatgatgc

SEQ ID NO: 16442 - DNA, 155 bp, Gossypium hirsutum
  Clone ID: uC-gsflnu33B094a12b1
tgcataatgggaccaaggcagggaaagctggggatgttacacagggggctaacgcgcttgtgtaatgaggagatataggcactgttgttaatcaataggatgagaaggttgaggcttagctaaccccatgacctccaagagagccaagtgagatg

SEQ ID NO: 16443 - DNA, 191 bp, Gossypium hirsutum
  Clone ID: uC-gsflnu33B094b02b1
gtaagatcctctgactcaccaggctaagatttgtgattttggaagcgcaaaagcgcttgtcaaaggtgaagctaacatttcatacatttgttcgcgtttctatcgggccccggaactcatctttggtgccactgaatacacaacctccattgatatctggtctgctggatgtgctcttgctgaattttcgc

SEQ ID NO: 16444 - DNA, 427 bp, Gossypium hirsutum
  Clone ID: uC-gsflnu33B094b05b1
ttttcgccctttttttttttttttcacaaactagatctcttttttttaaaaaaaaccatcaggtgtttaatgctccaaatccatgataaacgatccattgtccaacacaagaataacgacaacttaaattaagttctagcaaaacaaaaaacatgaaaatctcaaacataactttgaaggcctctccaagaaactcctattgcaggcatcccagatagcaaattatattttgttgaatgcaacaatgtcacaactctgaacatactcattgatcggttcagccgtcagatgttcctcgatgagagtgtcaactgacaccaaatcatccacaatggtcatcataatttgcaatttcttaattccataaccaacgggcacaagcttagatgctccccaaaagcagccttccatctgaacacttcttact

SEQ ID NO: 16445 - DNA, 234 bp, Gossypium hirsutum
  Clone ID: uC-gsflnu33B094b06b1
gtagataaaaaagttcttttttttcttttctctgggtttagttgaaccacttgagatcttttcacaaatattaccaaatatgccttcaaagtgcgaaatttgttgtgagctcctcatcgccattttgctccctcctttgggtgtttgcctaaggcacggttgatgcagcgttgagttctgcatctgtctgctcgtaacgattctgggttacatccctgggataatctatgccct

SEQ ID NO: 16446 - DNA, 537 bp, Gossypium hirsutum
  Clone ID: uC-gsflnu33B094b08b1
tcggacgcgtgggttcaggttggtgatcttgcagtccttgatatatcagcaacaactattgagcaagatgagtctaatgttcaaaaagttccagctgcagagagtaaaggttttcagtttgatacagaagatgatgataaagtacttcccggtttccttgattcaataatcggtattcgacaaggtgaaaccaagtcctttccgtatgtatttccagaaacatggcaacaagaaaatcttcggggtgttgaagctcaatttactgttgaatgcaaagaactattctacagggatttacccgagttaaatgactctattgccgataagctttttcctggttgcaccgacttaaaccaggtcaaggagttgttattgcaaaagtgccaagaaatggagcaagctgtgaaagaccaaccaccgattatgcaattctagaccagctttgcagatggttgagatcatattccccaatccttgttgaggaacagggtagcagctttatgagctagacttttgagattaagcgaatgtaagtta

SEQ ID NO: 16447 - DNA, 141 bp, Gossypium hirsutum
  Clone ID: uC-gsflnu33B094b10b1
taataaaaaacaaaaaaaaaaaaaaaaacgggggggttttttataaaaaaaaagggcgaaaaaaaaaaaaaagcaccaaatccatgataaacgatccattgtccaacacaacaataacgccaacttaaattaagggctaac

SEQ ID NO: 16448 - DNA, 423 bp, Gossypium hirsutum
  Clone ID: uC-gsflnu33B094c02b1
tgttatttgaaagaaaaaatggttctgctagacaaaatgtgggacgatgtagcagctgggcctcaacctgaacgtggtctcggcaggcttaggaagatcaccacccagcctttgtccatcaaagatgaaggagaaaagaaaaagtaccagaggtcgttgtcgctgccgaatagtccagtgtcaggtccgacacccgtgacaccgacgactccgacggcgcgtaaggagaacgtgtggaggagtgtgttccatccgggtagcaacctagccaccaaaagtataggttctgatgttttcgacaagccacaacccaactctcctaccgtctatgactggctttacagtggggagaccaggagcaagcatcgctgagagggtggcgactgacaagcggctagcaggctgctctcgtgagccagggct

SEQ ID NO: 16449 - DNA, 507 bp, Gossypium hirsutum
  Clone ID: uC-gsflnu33B094c06b1
cctactcgtccgatctgctaaaaagaagaataagaagaatcataggagagaagagaagagaggataatttttttttacttttattttttgagaggcaaaaaaaccccaacaatattcccatggatttgacttcaacaacgacgacgacgacgataaccgccgtgtccggagctgttaacgacaaagagttagctgtcgaccctttcttggttgaggctcttcaaaatcctcgtcatcgtctcaccatcttgcgaatggaacttgatatccagaggtttgtgcaaaattcagagcagcagcaatttgagttccaacattttcccacttcttatcttcggcttgctgcacatcgggttgctcaacattatgggctggtaactatggtttatgataatggtttaaattggcttggaaacagaatcgtggcgaagaaagcaggggatatcaaatgggctgctgtttgtttgcttgaatttcagccaaaacttcgaaatgataaaccagagc

SEQ ID NO: 16450 - DNA, 455 bp, Gossypium hirsutum
  unsure (1)..(455): unsure at all n locations
  Clone ID: uC-gsflnu33B094c07b1
ctggaagagagcttgagaggatcttgtaacagttttattcgcagtacatcagatgtaagaagcatgagcaatgggccttctaggcgtcagtctctgggtggagctgataacttctcaaaacttacatccaatgggtttttgtcaaagaaatcgccaagctctcaattgagatcctctttgtcttctagtacagttttgaagcatgctaaaggaacatccaaatcatttgatggaggcacaaggtcattagagagggctaaattgcttttaaatggaacaggctcaaatacttcattcaaccagccttctgacagaaccaaggagagtgaggcacaaaatgatganaagcccactgattttcagcctgtggacacagaggataaatgtccaggtgtattgtatgatttgctgcagaaagaggtcatagctttgagaaaagcttgtcacgagaaaga

SEQ ID NO: 16451 - DNA, 53 bp, Gossypium hirsutum
  Clone ID: uC-gsflnu33B094c08b1
tggaaaatattttactcctcaacttgaaagagcgtgttttcctgacattttac

SEQ ID NO: 16452 - DNA, 355 bp, Gossypium hirsutum
  Clone ID: uC-gsflnu33B094c10b1
tcccacgcgtccgcccacgcgtccggaagctagactgcatgaaacagtgggtcccacgtgattcttctgctcctataacgcatgcaacgttctcatgtgatagccaactggaatggcttttgaagtatgtcaagtaagagtctcattttatgatgctggattatttagaattctgattgcaatatagtctgtgtttctgtagaataagagtgaattttaatgcattgtgctttattatgtaagatggaatgctatagcatcaagatcacaaatggtgtctatgttgtatcatttagcccatgcattgaaatttattttactaattccattctgattttgccttaatatgccattc

SEQ ID NO: 16453 - DNA, 241 bp, Gossypium hirsutum
  Clone ID: uC-gsflnu33B094c12b1
tcccacgcgtccgcccacgcgtccgcccacgcgtgcgtccacgcgtccggctacttgagcgagtcggcgtgcatattgtggagtgcgcttgtgttatcccaatggtccggaattgtttatggattatggtaaaatttgtattggaataccaacagtgagttgcttggaacatgactgctctccaaaccttgtaaaaatttgttaaaaacttcatttaaatgaaccttttcttttcttgttc

SEQ ID NO: 16454 - DNA, 330 bp, Gossypium hirsutum
  Clone ID: uC-gsflnu33B094d03b1
tctctttcgtccgctttgttacagagatgatgtatagtcaatatcagtgatgtttaccttttacttttcttcgctttttctttcttaatggaagcgatcttttatacttttattatatgtatgggtatcctctttctttctttctttctttcttttctttttcactttatggttttgcaattgtggtaatttccgttatcagtatgccccttgttgtgacgttgttcctctgccatcgccagcattagtgattctttcatgtactttgctgtcacccacattaccaaaagtcatcaattactaatatcatgacagctttttggtcttttt

SEQ ID NO: 16455 - DNA, 243 bp, Gossypium hirsutum
  Clone ID: uC-gsflnu33B094d04b1
cctacgcgtccggttcccatggggtccggatggtgtgtttgttagaaaggagcatcgctagggatggccggatggatgcatatctttccgagttcggcgcatttttatcatttctctgagaaatcaatcagataattctgtggatcttttgtaattttagcactcgatttccggtttatggactttgaattgcaagttcatcaggtcttctatcatggttgagcctgcctaccatacctctgt

SEQ ID NO: 16456 - DNA, 261 bp, Gossypium hirsutum
  Clone ID: uC-gsflnu33B094d07b1
cgggcccgggccgggaatcccgggggcgacccacgtttccttactataaaaaaagaccgagggataaaacaaagggcttggttgaagctgggagggaccataccaggccaacagctgtcgatggaaagaaggatgaaagggctcccaaaaggagagttacaggctagcattgggggagagtttctacctgaaagacccggcaggaacatagatgctgggactgaaaaacgctaccaacatttgaaagaagaagcgaggaag

SEQ ID NO: 16457 - DNA, 110 bp, Gossypium hirsutum
  unsure (1)..(110): unsure at all n locations
  Clone ID: uC-gsflnu33B094d08b1
tancctgcagaaagaccgatggctctttcgtgaggctctgttgatgctttgaaggaccatatcaggtcaactgctgccgatggaaagatgcaccagtggctccggtaagg

SEQ ID NO: 16458 - DNA, 292 bp, Gossypium hirsutum
  Clone ID: uC-gsflnu33B094d12b1
tcccacgcgtccgctctaaaaaaaggtaaaaaggccgtctcaaaactaagaatagtgttgtggccttttatagccatttttacaatggttacttgctatttctttgctcacgtcgcaggtcatgaagacgtggaggaggaacgggcgtggggcgtgctacacacgagctgggacgaacgtgcgaggtggagtgcgtggtgactgccggtggctgcgttcgtgcggcgcatggagtagcctagggttcttttttgatttgggctattggagagttttgggctttagaattttg

SEQ ID NO: 16459 - DNA, 426 bp, Gossypium hirsutum
  Clone ID: uC-gsflnu33B094e01b1
tgtagataagcacttgaaaacaagaaaaatccgagaagcataagaggctgctcgaagatcaagaataacaaaggctgttgtaaggattcgctttccagataaccacacattagagcttacatttcatccatccgagacacttcagagcttggttgaccttatttctaaattgattgctcgaccagatttgccattctacttatatactacgcctcctaagaagcaaataaaggacatgacacaggatttcttctctgccggtttcattcctggtgcaatcgtgtatttttcatatgatctgccaaaaggtgaggatgctgcagctgcaaattcaggcccctttcttcaggaagagatcatgtctttgaagggttggaagtcattgctggagctgagcagccagagtcacttcaatctgcccctgag

SEQ ID NO: 16460 - DNA, 67 bp, Gossypium hirsutum
  Clone ID: uC-gsflnu33B094e06b1
ctcactcgtccgaaaaaacaaaaacataatgaatggcaaaataaaaaaaaaaacgggggcggaatct

SEQ ID NO: 16461 - DNA, 306 bp, Gossypium hirsutum
  Clone ID: uC-gsflnu33B094e07b1
tcgttggtgtcctccctggcatcaaggtcgacaagggtaccgttgagcttaacggaaccaatggcgaaactttcacccagggtctagatggccttgcacagcgatgccagaagtactatgaagctggtgcccgctttgctaaatggcgtgctgtccttaagattagtgctaatgagccaaccgagcttgcaatccaagaaaatgccaacgggctagctatgtatgctgccatctgccagcaatgtggccttgtccccattgttgagcctgaaattcttggtgacggatcacatgacattaaaaagt

SEQ ID NO: 16462 - DNA, 552 bp, Gossypium hirsutum
  unsure (1)..(552): unsure at all n locations
  Clone ID: uC-gsflnu33B094f01b1
tttacgcgtccggagctttcgtgtttgtctatggaattctttccttcactttctcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgaatagaagctttgtttgtggtgaaaataatgtataagccagttggttgggagcaaattttccttttgtccaaaggattttttgctgctcattcatggtgactnggtttaatggtttatctgttgtta

SEQ ID NO: 16463 - DNA, 282 bp, Gossypium hirsutum
  Clone ID: uC-gsflnu33B094f02b1
cgcgtataattggagggtttgatcgatggactcggttgatattttaacaacaataaccgtacgtcaccaacatggactgatcttgaagggaggaatgacactgacgaggactgagagtgtcaagctattcgtgaagctcaaagctggaaatgaaattgcagaaggctggcaaggatccagacatgccaaagaggtctgatcgtgcctacgctgtgcacatggaggagtatcaggagccacacaagatggatgagcctataaactactacagagctgctgtgg

SEQ ID NO: 16464 - DNA, 459 bp, Gossypium hirsutum
  Clone ID: uC-gsflnu33B094f03b1
gtacgcgtgggcggacgcgtgggttagaatcatgggtgttgtgagttatgagtttgaggtaacctccccaattgctccagccaggcttttcaaggcttttgttcttgaggctgccaagatttggcccacggctgcccctcatgcagtcaagagtgttaagctcgaaggtgatgctagtcctggaagtattgtaaagatcacctttgttgaaggccttccataccaatatatgaagcaccagattggaggacatgacgaaaacaattttttcatacagttacagtatgattgaaggtgggcctttaggggacaagcttgagaaaatcagctatgagaaccagtttgtggcagctgcagacggaggaagcatttgcaagagctcaataaaatattacacccgtggcgactatgttatcaccgaggatgaaatcaagactcttattaaagggagtgaggttg

SEQ ID NO: 16465 - DNA, 404 bp, Gossypium hirsutum
  Clone ID: uC-gsflnu33B094f07b1
tttaattggaggctttgattgatggacttggaggaaaattcaatcggaaaaaatgggggaaatttacatttgctgctataattttcgattctgacactgaagatgcctgaagatatcggcaacattttcaatgcttcgagtcttcctgtttttgcagagctagtgatgcaatactgccatagttttggtctaagaacctgccaatgcattgcatgtacttttttatgagggaacacaatatatacttgtgtatattttctactacaaagcttctgtgtgtatattctgttgcaatcagttgtttcttactgccttgcagtacttgttccttgctggtatatgagaatggtaataatttctcatgcttcaaaaaaaactttctttatattatactcattcatacg

SEQ ID NO: 16466 - DNA, 284 bp, Gossypium hirsutum
  Clone ID: uC-gsflnu33B094f08b1
tctccacgcgtccgacaggattcacgccagattgttccctctgttgttcagcttttaaagaagtacatgcctcgaaggaagactggtgaagaaacaaactttacctatgtcgaatgcttgttgttttcattccaccatttagctcacaaggctcccaatgccacaaatagtctatgtggttacaagattgtgactggtcaaccatcagataggcttggggaggactactcagagtattatacggagttcactgagagattgagtatatttgaagacctaactag

SEQ ID NO: 16467 - DNA, 291 bp, Gossypium hirsutum
  Clone ID: uC-gsflnu33B094f10b1
tgggaatcagggttcctctgctgtttctataagtcatttctcaattccctttcttttttttagtcagattctggatttggaaaaaaaaatatcttctctgtcttcggatttcctcacgttttcttaaatcatcgatcaacgccgacctagaacaagaataaaacgaggaacaaacaacctctgattgtcgaattaacgagaaaccaaaagcaaacgcataaagaaatcatgggttctgaaccagatgaaagaactagctttcctccatcggagccaaaactttgtgccaac

SEQ ID NO: 16468 - DNA, 439 bp, Gossypium hirsutum
  Clone ID: uC-gsflnu33B094f11b1
tcgtccacgcgtccgcacaacttaccaactcaaaaaccccaagttttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatttatagggatctaaataatgaatttaaggttgaataatttgtgtctggtgtagtttgtgtggtgacttatatctgtcagttaacccttctctcctttactatgatgtaatggctatgcttatggccttatctg

SEQ ID NO: 16469 - DNA, 439 bp, Gossypium hirsutum
  Clone ID: uC-gsflnu33B094f12b1
tcacttcttctcttctttgaactcaaagtcccagttaatattagaattatgggtgttgtcacttatgactatgagtctacctccccagtcgccccttccaggcttttcaaggcctttactgttgaagctccgaaagtttggcccacggctgcacctaatgcagtcaagagtattgaggttgaagctaatcctagctctggaagtatcgtaaaaatcaactttgttgaaggccttccattccaatatatgaagcaccagataggaggacatgatgaaaataaattttcatacagttacgatttaatcgaaggtgggcctttgggggacaaacttgaaaaaatcagctatgagaacaagtttgaggcagctgcaggggaggaagtatttgcaagagttcaaaggaattctacactgttggcgcaatgtaatcactgagatg

SEQ ID NO: 16470 - DNA, 201 bp, Gossypium hirsutum
  Clone ID: uC-gsflnu33B094g01b1
ctcatgcgtccgcccacgcgtccgcccacgcgtgcggtcgagttcttgttttggcttcaattcttattttctcttgttttgcagagacatgctatggggcgatctcattctcatcccttcaaagaacacttgttgttactgcttctcatagacaaggacttttgaaagccgggggagacaagatcacagtgagatggggat

SEQ ID NO: 16471 - DNA, 279 bp, Gossypium hirsutum
  Clone ID: uC-gsflnu33B094g03b1
ttactatccagtttccacgtgcggaaaaacaacggtgagatcaaagtttattgagaaaaaaaaaagagagagtgttattgggactgaaaagttttgttgttcctgaggatggttgaggtgagtcaagagtggactatatcgaggactgttaagtcttcctctccatacaagcctccttctttgagctctagatttgttcatacgaaaggcgatttgaaagcgccatggtgacctatggctacctggcccgattcattttttctcgggcagactgtagaa

SEQ ID NO: 16472 - DNA, 89 bp, Gossypium hirsutum
  Clone ID: uC-gsflnu33B094g08b1
ctttcttcacgcgtccggaaaattttggatcacaggggtgattattcaaatacccagactgataggacagggtattcaaatgatgatcg

SEQ ID NO: 16473 - DNA, 343 bp, Gossypium hirsutum
  Clone ID: uC-gsflnu33B094g09b1
tcgtcacgcgtccgggcctgttcctcctccttcggtgaaagagtgcttcaaattctcactcaaaaaagcttcttaatggatctgggctgaatttgtgtagtcaaccatctaaccatagcaatggagatgggatggacttaacacttgttagcaacaaaaggaggaaagaactttttcggcatagaaacaatgatgattgctatttgcctgccattcctccatctgaccgaattccggatatggaaattcatcccagtgagccacactggttaaaagacttcagtgggataatgaaaaaagtgtatgggcccgtgaccgttgtaaaaactatctacgaagatga

SEQ ID NO: 16474 - DNA, 388 bp, Gossypium hirsutum
  Clone ID: uC-gsflnu33B094g10b1
ttgtcagtctcgagctcggattgaggagcttgagactgagcgaaggtcctcaaagaagaaactcgagcagttcttgaggaaagttagtgaggaaagggctgcatggcggagcagggagcatgagaaaatacgtgcagttgttgatgatgttaaagctgaattgaaccgggaaaagaaaaaccgacagaggcttgaaatagttaattcgaaattggtgaatgagctggctgcgaccaagttatcggcaaagcaatatattcaggattacgaaaaggaaagaaaggctcgagaactgatcgaagaagtatgtgatgaacttgctaaggaaattggagaagacaaggctgaagtagaagaattaaggcgagattcaatgaagcttcgagag

SEQ ID NO: 16475 - DNA, 319 bp, Gossypium hirsutum
  unsure (1)..(319): unsure at all n locations
  Clone ID: uC-gsflnu33B094g11b1
tancgcttttttctattctctatgcgtgtgtacagatattatatgcgtaaaaaatcaaggtacaaataatggctttttatagccaaatttatagaataaatggaaaaataaaaatacattttccctctgtcatttggctgtacatgctgttgttgcttcttctcgtatattcttttgtaggtatggagcaacggtcgtacggagaaagccactcatgaaagccgtgcgtgagttcgattgctgcactggtgtgttctagaaacccttaggtttctggcattttcaagcagctgggccttttgggccattcgtgtatagt

SEQ ID NO: 16476 - DNA, 331 bp, Gossypium hirsutum
  Clone ID: uC-gsflnu33B094g12b1
ttgttggctcttatttgggagttgcctacggtggggggacctaatggtatcgatcctctgtgtgtatactctgctggctacgaaattaatcaattacagtggtctgctgcgcaacctgattggattgccattgccttttccaacaaattgcaggttctcaaagtttgaggttttcacactgtattttcctgcttgaagtctggtcttctgtttcatagactgcttaagcttgtattcccctttgacttgaattgcggaatcagttttagataagcctgtcaattctgacttgatttgtggaatcagctttatgttagctgacaattctgcc

SEQ ID NO: 16477 - DNA, 164 bp, Gossypium hirsutum
  Clone ID: uC-gsflnu33B094h02b1
ttttaattttctcttttggagataatctatctgtggtttttctttttttgattcctttggctcttgcgcagctagcaaaacaagatggcagatggcgaggatattcaaccacttcgatgcgataatggacctggaatggttaaggctggatttgctggtgatga

SEQ ID NO: 16478 - DNA, 355 bp, Gossypium hirsutum
  unsure (1)..(355): unsure at all n locations
  Clone ID: uC-gsflnu33B094h04b1
anttcattgacccaatgaagaacttgaaagagaaggacatcatgcgacagacgtgtacttgagcttgtggattatgttagttctgcgaatggaaagttttctgaatccgttatgcaagaagctgtgaagatggtgtctgccaacctgtttcgacctcttactccacagcctcgtgaaaacaaggtgctagaagccttcgatttggaagaggaagagccattggtggaccatgcatggcctcacttgcaaattgtatatgaattctttctgagatttgtggcatcttccgaaactgatgctgaattggccaagagatatattgaccattcttttgttcttaaaatattggatctct

SEQ ID NO: 16479 - DNA, 401 bp, Gossypium hirsutum
  Clone ID: uC-gsflnu33B094h05b1
ctcacgcgtccgcaaatgtgaatcttttacgtgatattctcttgacctactccttttacaactttgatcttggttactgtcaggggatgagcgatctgctatctccaattttgtttgtgatggaggatgagtcggaatcattttggtgttttgtggccctgatggaacgccttgggcctaattttaatcgtgatcaaaacggcatgcattctcagctttttgcattatctaagctggtggagttgctagacagacctctgcacaaatatttcgagcagaatgactgcttgaattatttctttttgtttccgctggattctgatacagtttaaaagggaacttgaatatgagcaaacaatgcgattgtgggaagtatttgggacgcattatttgtcggagca

SEQ ID NO: 16480 - DNA, 216 bp, Gossypium hirsutum
  Clone ID: uC-gsflnu33B094h09b1
tcgtcacgcgtccgcccacgcgtccggaaaaactgttgcctctgaaactatggctccgttctctatacgtagccgtcttcaggcttctgcgctaagcaagaggcgtcttaaatccaaagccaagcatgtaattataatttttttcgggtggtctttttgcaaattttcggtgccatatcttgctaatttacaattggaatgggggacaagggagga

SEQ ID NO: 16481 - DNA, 263 bp, Gossypium hirsutum
  Clone ID: uC-gsflnu33B094h10b1
taataaaaaaaaaaaaaaaaaaaaaaaaaatagggaatcttaaaaaaaaaagggggcgatcactacaagaaaccggttggccgcttcggagatacgaacattgcgttctttttcatgcgtctcctaaagttattttatttgccctccattttaatttaattgcctgggaggagcctccgcccacccggctaaagccctttcgagactaaccttatttgcttgcttgatcatacacctttatgacgctgacttattgcccatgc

SEQ ID NO: 16482 - DNA, 442 bp, Gossypium hirsutum
  Clone ID: uC-gsflnu33B094h12b1
ttgtccacgcgtccgcccacgcgtccgatcgggagtgctttcgatagttcagatagtcggcttagcacggaccaggtcaaggaggttaacaggagaagtgcctcgcccctaattagtttagagtattctagtggttgggatcctttagacaaaggtaggagtgggaatgggttttcccaggaagtttttgagagctttatgttcaatttagaggaagtaaagcgtgcgactcagtgtttctcggaaacaaatttgttggggaagagtaatttctcagccatctataagggctccttaagagatagttctgctgttgtagtaaaatgcattgccaagacaagctgcaagtccgatgaatctgagtttctgcaaggtctcaagatattgacttcattgaaacacgaaaatctagtgaggttgagaggcttttggtgtcaaaggg

SEQ ID NO: 16483 - DNA, 58 bp, Gossypium hirsutum
  Clone ID: uC-gsflnu33B095a04b1
caaacattttctatatcagaaaaaaaaaaaaaaaaaaaaagggaaagttttatttaaa

SEQ ID NO: 16484 - DNA, 184 bp, Gossypium hirsutum
  Clone ID: uC-gsflnu33B095a06b1
acgccaaagcttcccttctttccctcttcattcaaccaatgagagagctatttcccttctaggttggggcacagccgaataccctttcggtgcttacatcgataccatgaaacaaaccattctcgaagctatcgaagtagggtaccgtcactttcgataccgattgctctttaccaaacatgaa

SEQ ID NO: 16485 - DNA, 53 bp, Gossypium hirsutum
  Clone ID: uC-gsflnu33B095a08b1
tgtatgtctgtggagacgacgcgctcgttgagggccaaggattgatttaagaa

SEQ ID NO: 16486 - DNA, 384 bp, Gossypium hirsutum
  Clone ID: uC-gsflnu33B095a09b1
gttggattgatggtctcaaggcccatgctgcccgacatgtgaccgataagatgatgttcaatgcttctttcatatttcctcacaacacaccaactacaaaagaagcatattactacaggatgatttttgagaggtttttccctcagaactcggctagattgactgtccccggaggagctagtgtggcatgcagcacagctaaagctgttgagtgggacgctgcctggaaaaacaaccttgacccttcgggccgggctgccttgggggttcatctctctgcttatgacgcagagactcccctcagcaacaagccttccaaggttattgatagtataccacggatggactttcctggagttgccatacagagtttatgcctgccta

SEQ ID NO: 16487 - DNA, 382 bp, Gossypium hirsutum
  Clone ID: uC-gsflnu33B095b02b1
ggatccatgacttccaatgctggagctctaccctgccgaagaggcaggcaatgctagatagtatatcccccacccaatcaattaaaatggttgaaaagccagccatttactagctctttcccatcattcaaaaagcactaccaatcaaatatccatattctctgtagtctatcctccccatctaccagcatcatcgcatattctgattttaagtgtaaatttattcatttttacacattgtcattattttgtcctacccactctactcattttgtttgtcaatctgtgcaacctgcttcaactctagtgaactaaaaaatccatcttaagagcaggtacgcaagcgttgtccttggttcccttttcctttatttgccccctt

SEQ ID NO: 16488 - DNA, 132 bp, Gossypium hirsutum
  Clone ID: uC-gsflnu33B095b03b1
cgccgctaatcttagggtttgacaaacctctcacaggcggtggccttttttattattcacttcggcagattccatggcaccaaagaaagacaaagcccctcctccttcatccaagcctgcaaagtctggagg

SEQ ID NO: 16489 - DNA, 382 bp, Gossypium hirsutum
  Clone ID: uC-gsflnu33B095b04b1
gttggtgttcagtatggaaaattgcatgtattttgtatagtaggtgataccctcaaggaagaggcagtacttgagaaacaccgaggtgcaattactgtcattcgttactcaccagatttctcaatgtttgcatctggagatgcaaatcgagaagctatagtctgggatcgtgtctctcgagaggtaaagcttaaaaacatgttgtaccacactgctcggataaactgtcttgcttggtctcccaataacagcatggttgctactggatcacttgacacctgtgtaataattttatgaggttgacaagcctgcatctagccgaatgaccataaaaggagctcatttaggtggagtctatgcattaacctttactgttgaacac

SEQ ID NO: 16490 - DNA, 97 bp, Gossypium hirsutum
  Clone ID: uC-gsflnu33B095b05b1
acgcgggcgatggattttttaaagaccaacagaaccagacgtagggggggttataaaaacggagagggggtgcactgctcaaaaacctggacaaacc

SEQ ID NO: 16491 - DNA, 183 bp, Gossypium hirsutum
  Clone ID: uC-gsflnu33B095b08b1
ttttaatgcgatgttaattggagcaatgtttctcagtttgaaaatgccatcttgcaaaggttaacctgcaaagaagttacatctagaggcgatgactgttatgtggtgttatttgccattccctcctattatatactttttttctttcttatcttcctttttttattcttccctcttttattt

SEQ ID NO: 16492 - DNA, 151 bp, Gossypium hirsutum
  Clone ID: uC-gsflnu33B095b09b1
ttcacgttaccggtggggcggcggctaatatcatgaacagttagagcaccagcagcgcctctgtaataagcagaagtgacggcacgagaacctttcttgaccagcagtgtcggccggtggctcgatgaactcaagactcattatgatgcca

SEQ ID NO: 16493 - DNA, 126 bp, Gossypium hirsutum
  Clone ID: uC-gsflnu33B095b12b1
acgtttttgctcccgctagccgatccgttctcttaacgtggacgtttttgtatatacttgacccccgacccagcagtccagggtttgttgttatttgaattgcccgtgaaggaggtataattcaaa

SEQ ID NO: 16494 - DNA, 282 bp, Gossypium hirsutum
  Clone ID: uC-gsflnu33B095c02b1
tgacaattttcttcataaatttccaccctgagaatggtggaaacgaagaaccccctccatctgatcaacctgttgaaaatgacggaaacgaggaagttcctgcttcaccaaatcaaaatgaggagcaggatccttaaagtttctcatttacagacatggctgttattcaaaatagataacctggtaactatttcggggattgaacctgaaatatgaaccacagtttggcaggggacgaagatgcataatgaagtaatgattcagaaatgctgggtttgattt

SEQ ID NO: 16495 - DNA, 133 bp, Gossypium hirsutum
  Clone ID: uC-gsflnu33B095c04b1
aaagcccttcactattctagggtttttgccgcaccaccaacagaagaaatgggtaaaggaactggaagctttggaaagagaaggaacaagactcatactctctgcgttcgatgtggacgatgaagctttcatt

SEQ ID NO: 16496 - DNA, 106 bp, Gossypium hirsutum
  Clone ID: uC-gsflnu33B095c05b1
ggcctcatgaaatatatattgacaaggatggatgcctgcagggtctataattatgtctctgcctgcgccttgtgaaatagaagctttgtgtgtggtgaaaataatg

SEQ ID NO: 16497 - DNA, 560 bp, Gossypium hirsutum
  Clone ID: uC-gsflnu33B095c08b1
ttacgctttcggaagattcgagtcaggaaacataagggtgagaaggagtgtatacaagggtgtgaatgttcctactcctactatttctctttcttcctttctctttctattatatttcatttttttattattcttatctttctcttttctcttttttcctttttttttatttttttctatatccttttcttccttttattctttttctttattttattttcttttactttaatttttcttttttctctttatttttttatctatttttttatatactttatcttttctttttttttttctttcttttttttttttttttttatttctattctatttataatttttatattttttttttttttttacttttttaattttctctcttatctttttttttttatttttttctttctttctttttttctttttttttttttctcttatttattttctttattttttcatctctcttttctattcttattttccttcttttttttttttttttcctttctcttttttctactcattccttttctttttattttttaacttttttt

SEQ ID NO: 16498 - DNA, 161 bp, Gossypium hirsutum
  Clone ID: uC-gsflnu33B095c09b1
gtttgatcattgaattctttccctcactttctcgaaaaagaaaatgttttcaggttgcaactgcggatctaactgcagttgcggtgacaactgctcatgcagcaggaaccttaaccttggatataccgagaagacatccagcactcagaccattattctcc

SEQ ID NO: 16499 - DNA, 458 bp, Gossypium hirsutum
  Clone ID: uC-gsflnu33B095c10b1
cttgaaacagcagcaacagcaagtggaaagaggagagttctccccttgtggtactccaactggccttgattctagagatccatttgaccttctgctagggtcaaggatgttttacaatacccaggacttgttatggaggagaaagttggaggagcaagctgatctccagcaagcccttgagcttcaaaatagaaggttgatgggcctgcaactccttaatgtgaagaagcatcaccatcacagggctctttctagtggaagtcccattccatcacctacccactcaccaaacccgttcagccagtcacttgtacttactcaatttcacttcaatcagaaccaccactcaaccgttacttgtaatcatcgtcaatactatacttactaccatacaaaatgcgtacataaaaggcagtgaaggaagtggttcatccattcctttatttttgttgaaatat

SEQ ID NO: 16500 - DNA, 186 bp, Gossypium hirsutum
  Clone ID: uC-gsflnu33B095d02b1
gaagcctggaatatagctccttgtgcaatggttgcacaggagtctaacgctccagtttccagcagttgctgccaacaggtgaagaaaataggccagaatccgcgatgcctgtgcgccgtcatgctttccaacacggctaagagttccgggatcaagccgtaaattgctatcactattcacataacg

SEQ ID NO: 16501 - DNA, 255 bp, Gossypium hirsutum
  Clone ID: uC-gsflnu33B095d03b1
ctccgtctctttcgaggctactcgtgtagaacctgatcctgatgatggagaagataatttgccggaaacaaggcatataccggaggaattgctgaacatcctcgacgattcagatccggttagtggaccagatccggcgattcagggacttgattcggtcatcaggagtttcgaagaagagatcttaattccggaacaggtggctttaccggaaacggtattggattccggcgagtcgaggcccgggttagggtt

SEQ ID NO: 16502 - DNA, 120 bp, Gossypium hirsutum
  Clone ID: uC-gsflnu33B095d08b1
gtaagataagaaaagcattaatttactgttggggttgcctgtttcagcaatgaatagctttgaagagctgatgcacgtttaagcagaataaaaaaaaagacatgtttaatagcaagttat

SEQ ID NO: 16503 - DNA, 276 bp, Gossypium hirsutum
  Clone ID: uC-gsflnu33B095d09b1
ttttatttatctttcgctccactgcactatccctattcttccacctttttcttttctttttttttaatgatcctttcttgccaaaaatacccaataattcctctggggaaaaaaaagattagttgagttcacaatcatgtcaggtgatattgccagagattctgctgaaggctcctcacggttctccgtcagccaccacattcaacctcaatcgcctccgatgagccggtacgaatcacagaaacggcgagactggtacacctttggtcagtattt

SEQ ID NO: 16504 - DNA, 489 bp, Gossypium hirsutum
  Clone ID: uC-gsflnu33B095d10b1
tttacgcttccgcccacgcgtccgcccacgcgtccggctaagctgattctgctttgtcttcttgctattttctgctttgcattaacaagtcatgcagcaacatatgttgttggagacacttctggttgggacataagcacagatattgattcatgggctactaacaagacattcaatgttggtgatgttctactgttccaatactcatcatctcacagtgtaagcgaagttaataaagaaagtttcgaaacttgcaatacaacaaatagtttgacaactttttctaatgggaacacaactgtaacactttcaaatgctggaaagaggtattttgtttgtggcaacaagttgcattgtcttggagggatgaagctttaagtaaatgtactagaagatgataaaaaatccgaaaccgttggtgctcccgaagctcaaccggaacctcatgctacgatttcccaagccttcttcgaagaccaacaatctttc

SEQ ID NO: 16505 - DNA, 114 bp, Gossypium hirsutum
  Clone ID: uC-gsflnu33B095e07b1
atctcatttacacccaaacaagcaaagaagtccaagatagatatcatgggccgtggagttagcagcggtgggggacagagttctttgggttacctttttgggagtggagaattc

SEQ ID NO: 16506 - DNA, 538 bp, Gossypium hirsutum
  Clone ID: uC-gsflnu33B095e09b1
ttcaattagcagtgaagaagatatgttggcaacgccagttattcaaatgcccacaattactgcagttaaggctgtttccctctcaaatccgaaccaacatccatttcttcgcccacatttggttggtttttgtttgagaaaacccaaaatcccttccaccactcgaacagcccttttttgctgcaaatctcagcttcaagattttgcccctcttacttccgctgcctatggaacccttcttttctccggcggtctctttgcctttactaaatctgggagtaaaggatcgctctttggaggcctcactggagctgctcttatggcatctgcttattatcttatgcagtcaacagagacaaaagcaattggtgatgcccttggttttgggtctgccttccttttctcctgtgtatttgggatacgattggcagccactcggaaaccgattcccgcaggtcctttattaggtctttctatctgtgcattggttgcgtttacctcagcttatttacaagatcgtctttgacctttgtctttt

SEQ ID NO: 16507 - DNA, 289 bp, Gossypium hirsutum
  Clone ID: uC-gsflnu33B095e11b1
cctacgcttccggggaaacataggatacaagctgaactcaaaaggctagaccaagaagctagattcttagaggaagagctggagcacttggaaaagatggagaaggcatcaactgcatgcaaagagatgctgagtaaagtggaaagtacacctgatccactccttccaatcacaaatggtcctctaaatctgacgtgggatagatggtttgaaggtccccaggaatctcaaggctgcaaatgttggatactgtgacaatattgcttatttggatgactttttccctatt

SEQ ID NO: 16508 - DNA, 568 bp, Gossypium hirsutum
  Clone ID: uC-gsflnu33B095e12b1
tctacgcttccgcccacgcgtccgttataaattagtaaggttttatttttttaaaaaatttttggtatttaacttaatgtttaatatatataattctatttattaccatcctggcgctgccctttatttggttcttggttttttcttcttttctcttcctctccttttctttttttttttttttgccgacttgtttttttttttcctgggtccgtttttttattttcttctgtctttgttaacctccctggctttttcctctttcttttttccttttgtgtgctcccattcctctttttcttttcctttcctcttttttcctcttctgtttcttgctttcctgttccttctttccccccccgtttccctctttttttattatttgttcttgtgtcctctccccttttttgtgtgtctctttctcccttttgcctggttttttttttttttcccctttctttcttttcttttttctctttccttttgttctccttcacttgcccgttctttttcccctttcctttccattttctttttctttgtcctctctctttctttgttttttccc

SEQ ID NO: 16509 - DNA, 154 bp, Gossypium hirsutum
  Clone ID: uC-gsflnu33B095f03b1
ctttcttgacttatgtaaagaagactgttgataaagtatcaggagctatgaagaaccaccagatacccaaatcgcgtgcaaagattgatcactatattgagtcatctcagcggaaattgacaaaacttgtgatgggttatgatgataaggatgt

SEQ ID NO: 16510 - DNA, 290 bp, Gossypium hirsutum
  Clone ID: uC-gsflnu33B095f08b1
ctgacttaagagtcactgaacgagtcgagttcgaactcagattacccaaaatggcattcacattgaggagtgtgaaagtaccgcccaactcaacgagtttggaagaagcaaggagccgggtcttcgatttcttcagaaaagcttgtcgatcaatccccactattatggatatctataacctagacgacgtcgtcaccaaatccgagctccgttcttacatctcctccgagatccctaagaactctcatgttacttaaccctaacgtaattgatttcgctgctgtttaagg

SEQ ID NO: 16511 - DNA, 112 bp, Gossypium hirsutum
  Clone ID: uC-gsflnu33B095g01b1
gagaagtttaatatcgctggctgctttctggcgtctctggcggggctaaacatagactcgcgtaacgtaccaaaacgagctggcgaatctgggagaactcaccctaacaaac

SEQ ID NO: 16512 - DNA, 174 bp, Gossypium hirsutum
  Clone ID: uC-gsflnu33B095g02b1
cccacgttttctcccacgcgtccgggaaatcaacaaaggtggggcttacactctttaaaggcgaatgacaaaaccaaaccattcttcatcatcagaagctgaaagctggagcagcaacaatactaataactccaattcatcattcccaacatcaacttctttggaaactgtctt

SEQ ID NO: 16513 - DNA, 153 bp, Gossypium hirsutum
  Clone ID: uC-gsflnu33B095g03b1
cccacgtgttctataaaaaaaaaaaaaaaaaaaaaaaagaaaaaaattaattaaaaaaaaaaataaaaaaaaaaaaaaaaaataataaataggggggggcgttcttggggatccaggcttttttccgcttgctttgcgcgttcttagttcttt

SEQ ID NO: 16514 - DNA, 126 bp, Gossypium hirsutum
  Clone ID: uC-gsflnu33B095g08b1
atgttgtgtaggataaaaggaagaccatagcacggaacattttacttaataacatggttgtgtacatatgacgtatggctagcatcggtgttgctacctctttagttcttgaatttttataatttt

SEQ ID NO: 16515 - DNA, 390 bp, Gossypium hirsutum
  Clone ID: uC-gsflnu33B095g11b1
gattattccaaaggaacaagagagaaaatgagtcgaggaagtggtggcgggtacgatcgccatattaccatcttctcccccgaaggtcgtcttttccaagtcgagtatgcgtttaaggcagtgaaagccgctgggatcacatcaattggtgttcgagggaaagactccgtctgtgttgttactcagaagaaagttcccgacaaacttttggatcagactagcgtcactcatcttttccctattactaagttccttggattgttggctactggcatgacagctgatgcaaggaccttggtccagcaggcaaggaatgaagcagctgagtttcgtttcagatatggatatgagatgcctgcggatgtattgtccaaatggattgctgacaaa

SEQ ID NO: 16516 - DNA, 163 bp, Gossypium hirsutum
  Clone ID: uC-gsflnu33B095h02b1
ctcacatcctatcaactggatactgaattcaactcaacggtggattactttgatatctggaaacaatcttatttgaaaacttatgctgatgttgaccttgagcttaagcaccatcctggcattgatgctttccgtagcggcactacagctttgacgatcatca

SEQ ID NO: 16517 - DNA, 140 bp, Gossypium hirsutum
  Clone ID: uC-gsflnu33B095h04b1
cccacgcttccttccacgcgtccggggatgcatttattagataaaaggtcgacgcgggctttgcccgttgctctgatgattcatgataactcgaccgatcgcacggcctttgtgcccgcgacgcatcattttatattttt

SEQ ID NO: 16518 - DNA, 148 bp, Gossypium hirsutum
  Clone ID: uC-gsflnu33B095h06b1
aaaacgctaattcaccacctcttatagtgatggttgggtgcaggggattaatatgattagcagtggctagcgagaaactcatagagaactcaacgaaaagctcagtgtttgtaaaggcgatgttattgatcgcttctatggtttttct

SEQ ID NO: 16519 - DNA, 136 bp, Gossypium hirsutum
  unsure (1)..(136): unsure at all n locations
  Clone ID: uC-gsflnu33B095h08b1
ctgtactttccaggaaattgcaggaagcaaggacgctgggggtcaatacgagagccacactgctttcactcttcctggactctaccgngttgcacatggcatcgatgtgccagatcccaaacccaacattgattcc

SEQ ID NO: 16520 - DNA, 164 bp, Gossypium hirsutum
  Clone ID: uC-gsflnu33B095h11b1
ctacgcttccgcccacgcgtccgaccccatatcctctgtctctgagtaatacatacagaagaaaaggatgctgaattcagcccaaacatcttcttctcaatcctcagttttctgggttctggtttagggttatgggcgcacccgtttctttatatgaaacaatc

SEQ ID NO: 16521 - DNA, 159 bp, Gossypium hirsutum
  Clone ID: uC-gsflnu33B097a06b1
gaactgtgaactgcctgttcgggatctcgggggaggcttaattctaatggaccgttcatatacacaaccaccgacggggaaaccattcctatcatagcccgcccgtgacgaccctttccgaaaagcttccgctgaagaaaatcccaaggaattatggga

SEQ ID NO: 16522 - DNA, 341 bp, Gossypium hirsutum
  Clone ID: uC-gsflnu33B097a10b1
tcgtcttttttgaaagaaaaacccatccttgttggtgtctgctaaaccagaggcgttattcaacctccccttcgcctccatatcttcgaatcagatccccgaatcctcatcaaagcttcaatttcagtgaagcaaacaaagattcagaggctccttcaacaacagataagtctccctttccccttatagattcattttttcatgcaatagataaaaatgatgaaacagaaatgaaaatcaaggaagaacacgatctaaaatcaccttcaaactaatttcaaaatgatttttctttcagcattccatgtgtatttctgcgggaaaacaatgatccccgttac

SEQ ID NO: 16523 - DNA, 77 bp, Gossypium hirsutum
  Clone ID: uC-gsflnu33B097b03b1
ttctcgcgtccggaaggttttccgaactaggggcgcttctactcgtagagctcagcttgtctaagaacctagccggt

SEQ ID NO: 16524 - DNA, 109 bp, Gossypium hirsutum
  Clone ID: uC-gsflnu33B097b04b1
acatcagatggttgtctgcctctttacctggttggagttaaatcaatagatgtcagtcgaaaattccgattgtatgtatcattcattttgattttactattagttctat

SEQ ID NO: 16525 - DNA, 513 bp, Gossypium hirsutum
  Clone ID: uC-gsflnu33B097b05b1
ttccttgatatgtccactgatgagcttgtcaagctcttccctgctcgagctcgcagaaggttccagaggggtttgaagagaaagcccatggctctaattaagaagcttcgcaaggcgaaaagggaggctccacctggtgagaagccagaaccagttagaacccacctgcgtaacatgatcattgtacccgaaatgattggaagcattatcggtgtgtacaatggcaagacattcaaccaagttgaaatcaagcctgaaatgattagccattaccttgctgagttttctatttcgtacaagccagtcaagcacggtagaccaggtattggtgctacccattcttccaggttcattcctctaaaatgaagtcttatccttgcaactttggatactttatttggtgcttgcatgaagagatattttatgttgatcaaattttgattgatgcactgggacatttttatatcgttccgaatgttatattttaaaatacaacttgtgttgtttttgagg

SEQ ID NO: 16526 - DNA, 108 bp, Gossypium hirsutum
  Clone ID: uC-gsflnu33B097b10b1
ttcgtccaaagcaggcctacgcttgtatacatgagcatgggataacatcataggatttcgatcctattgtgttggccttcaggatcggtgtctcgatttacaaggcct

SEQ ID NO: 16527 - DNA, 96 bp, Gossypium hirsutum
  Clone ID: uC-gsflnu33B097b11b1
ttttactcggtccacagactagctctataggggggtttttttaacagttgggtctttgacacacactcaaaccaaaagaaatcactcccctcgaac

SEQ ID NO: 16528 - DNA, 103 bp, Gossypium hirsutum
  Clone ID: uC-gsflnu33B097c04b1
gctcgccacagccgttgatcccaaaaagggaaggggggttactatagcaccatgggctatagccaccatcgagggggccaacatctcggcagtaggcaccctc

SEQ ID NO: 16529 - DNA, 107 bp, Gossypium hirsutum
  Clone ID: uC-gsflnu33B097c09b1
tcgtcccctttccataaatcttgcttcaaatgcaggcattgttaagggacattaacgttgggtaactactcatcaatggaaggtgctctttattgcatgcctcattt

SEQ ID NO: 16530 - DNA, 252 bp, Gossypium hirsutum
  Clone ID: uC-gsflnu33B097d01b1
ttcactcgtccgttcactttcccaagaaaacagccaaatttcccagaaacctctaaaaactccccccaacccatgccctctcctctgggttcaccgacaagctcccggtctgtaacccagaccgtcaatggctcccaccgtttcacgatcaaagggtattccttagccaaaggcatgggcgttggcaaacacatagccagcgagagctccactgtgggaggctatcaacgggcaatacactttttatcctga

SEQ ID NO: 16531 - DNA, 161 bp, Gossypium hirsutum
  Clone ID: uC-gsflnu33B097d05b1
catagttagaatccggcggatactcttctttagatgatgttatcacagttcctccttctaaaagagacaagatggagacatttttcctgggtgaaacattgaaatatcttgtcttgctttttggagattgctctgctatactacttgctttattttgcttt

SEQ ID NO: 16532 - DNA, 101 bp, Gossypium hirsutum
  Clone ID: uC-gsflnu33B097d06b1
catgccaagaaaatggatatggacttatctcccaagtttccttcgacgttcgtggcgacagaagatggcggatactataattggtcagttgccttttcttc

SEQ ID NO: 16533 - DNA, 165 bp, Gossypium hirsutum
  Clone ID: uC-gsflnu33B097d09b1
tcgtccacgcgtccgcccacgcgtccgcccacgcgtccggtctgtattactcatcgtacttcactgcacaaactctattgctacatggaccggcatttcttacataaagctgcgttttcatgttgaacaatggtgtcactcctacgacatccaggtggatccact

SEQ ID NO: 16534 - DNA, 69 bp, Gossypium hirsutum
  Clone ID: uC-gsflnu33B097d10b1
tcgtgtacgcgtgggcaaaggtagtagatgactggtttaatttagataagggtgggcttaaaaacttgt

SEQ ID NO: 16535 - DNA, 448 bp, Gossypium hirsutum
  Clone ID: uC-gsflnu33B097e02b1
ttcatgcttccgctcctcctcccactttatgaggggggttatttacagcttctgcaccttcagctccaacttcttcacccagttttttctcctcccgcaacttcaccacctgtttctacacctccagcttctccacctcctgcatcttcaccttcagatttttcaccttccgtcactccttcaccagttttttcaccttccgtcacttcaccaccagtaacccctccacctgcaactcctcctgctacctcaccaccagcttcattggcttctcctccagccacagttccagctttctttccagtacaaacaccattgaccctcgcaccagcttcgcctaccgaggccccagcacctacccccggggctgcttcgccaggcccagctggcacagacactagccgtgccaatcaaaagtggaccgcacaaaagttgatgggacgcttac

SEQ ID NO: 16536 - DNA, 100 bp, Gossypium hirsutum
  Clone ID: uC-gsflnu33B097e03b1
cctcgcgtccgccacgcgtacgtcacgcgtgcgttattcttccgatcagtctagatttaaaccatggcaacgaatgaagtcaaagttttgggttcctggc

SEQ ID NO: 16537 - DNA, 66 bp, Gossypium hirsutum
  Clone ID: uC-gsflnu33B097e05b1
tcctctcgtccgaaaaaaaaaaaaaaaaaaaagaaaaatttatttaaaaaaaagggcttactccac

SEQ ID NO: 16538 - DNA, 71 bp, Gossypium hirsutum
  Clone ID: uC-gsflnu33B097e10b1
ctgacggctatgcatcttgatgccctcttgtgaatggatcctataagtgattgggcaggcaggggggctga

SEQ ID NO: 16539 - DNA, 116 bp, Gossypium hirsutum
  Clone ID: uC-gsflnu33B097f02b1
ctcgtaagagccaacagaatctattggcattatgacggttgattgaagattaatcagtctaccaaaaatcacagggctgtcggtaaattgttctgtcatatccatcgtccacaatg

SEQ ID NO: 16540 - DNA, 510 bp, Gossypium hirsutum
  Clone ID: uC-gsflnu33B097f03b1
gctcctccaccaacccaccaccatcaccaccaccctgaccctctccctcacccccatccttatccacccactaagcccccaacccccactcctcctccagttcatccaccacccaaggcgccagtgcaaccaccaaccaagccaccagttcacccaccacccaagccaccagttcaacctccaactaagccaccaaccaaacctccaactcaacccccgactaagccaccaactcagtccccgactaagccaccaaccaagcctccaactcagcccccgacgaagccaccaacacacccaccatctcatcctccggccaagccacctaaatcgagccaggtggcagtgcagggcgttgtttattgcaagtcatgcaagtacgccggagtcgacacccttttgggagctaaaccaattcttagtgccaccgtaaggctgacatgcaaagacgctaaaaacgaataacggtccagttcaagactgacaagaatggttttttctttctgcaag

SEQ ID NO: 16541 - DNA, 53 bp, Gossypium hirsutum
  Clone ID: uC-gsflnu33B097f04b1
ctcctctccatcaagagcgaaataaggccacgcaggggcattcttaaaaaaca

SEQ ID NO: 16542 - DNA, 119 bp, Gossypium hirsutum
  Clone ID: uC-gsflnu33B097f06b1
ccctcattgcatgcctctcacactggaatatgggaacactgtctcgcttgccccgacaaaggattatcaagccaacagattggttcctggagttcttcagctacccgaaggctcacact

SEQ ID NO: 16543 - DNA, 397 bp, Gossypium hirsutum
  Clone ID: uC-gsflnu33B097f10b1
tcttctgtaacaacacggagtaaggcacagttaaatgctactctgaatcattacaatactgcatttgggaatgctatcaacaaggatttgaaggccgaccctgaagacgaattcctcaaattgctgagagctgcaatcaagtgcttgactgtccctgagaaatattttgagaaggtgctacgtcaagcaatcaataagctgggaacagatgaatgggctcttactagagtggtcgccactcgggcggaggtagacatggtgcgtattaaggaggaatatcagcgaagaaacagtgtgaccctggaaaaagcgattgctggagatacctctggagactatgagaaaatgctgcttgcgttgattggagctggagacgtctgagctgctttcctatatt

SEQ ID NO: 16544 - DNA, 66 bp, Gossypium hirsutum
  Clone ID: uC-gsflnu33B097g06b1
tttcatacagccgacctcccagaaagcaaaccagaggggctagttagatgagcgacccaaaaacaa

SEQ ID NO: 16545 - DNA, 108 bp, Gossypium hirsutum
  Clone ID: uC-gsflnu33B097g11b1
taagatcctacggacttcagtcaaagactagcacctgagttcggaaactgtgaattgcagccctatgaaatgcccattgtttccccggatatttcgaaattgcatcat

SEQ ID NO: 16546 - DNA, 319 bp, Gossypium hirsutum
  Clone ID: uC-gsflnu33B097g12b1
tctcacgcgtccgcccagttatggagtttgctgaggcactttggtttgagatcaaccgggcttttgctgtcctacgggatattgcatcaggaagagatctcaagaagttcctatctgtgatcgccggcttatgggtcttgtctattgtcggaagttggtgcaacttcttaacactgttttacatagtctttgtacttcttcacacagtacccgtgctttacgagaaatacgaggacaaggtggacccatttgctgagaaagcaatgcatgagattatgaagcattatgcagtgtttgatgcaaaggttctaagcaagat

SEQ ID NO: 16547 - DNA, 180 bp, Gossypium hirsutum
  Clone ID: uC-gsflnu33B097h03b1
gtaatttgggacaccaaaggagcacaggaaagctaaaccttatcatgatcacgtctttgttttctccattgctgatgaccacatatggttccgcaattatcagatatctgttcctcacaatgaatcagacaaaatggttcgagggggacttgataaaatgacccttgttgaggtttcttt

SEQ ID NO: 16548 - DNA, 51 bp, Gossypium hirsutum
  Clone ID: uC-gsflnu33B097h06b1
ccctcgcgtcacaacacaacgtgacatgtgaaaaagtgatatttaataaaa

SEQ ID NO: 16549 - DNA, 106 bp, Gossypium hirsutum
  Clone ID: uC-gsflnu33B097h07b1
ctcgctcacgcgtccgaaagaattcccagaaggtgcggttttaacaacaactgcgccttatgacactataaggtcaaaatcattgtggaccacctccccacttcct

SEQ ID NO: 16550 - DNA, 95 bp, Gossypium hirsutum
  Clone ID: uC-gsflnu33B097h12b1
tcgtcctagagctctacaatttttgttagtgaacgtctacttttatagcgattggctattgtccccacttgagaagcctaggccacatgagagag

SEQ ID NO: 16551 - DNA, 181 bp, Gossypium hirsutum
  Clone ID: uC-gsflnu33B098a03b1
cctaacatttcagtatgtcaatgtcatatggtggattctcatcatcgtcatctgatgaagaatccatggcagcctcaccattgccaagatccggaagatatagtaggtcaatgagctattcagtcaggatggtgagaagagctgtggctattgcgcgccatcccaagagtttcatagttgc

SEQ ID NO: 16552 - DNA, 55 bp, Gossypium hirsutum
  Clone ID: uC-gsflnu33B098a04b1
cattaactaaaaaataatccaaaaaatatcaacaaataagggtttccctttaagg

SEQ ID NO: 16553 - DNA, 83 bp, Gossypium hirsutum
  Clone ID: uC-gsflnu33B098a05b1
aaatagcgtggctgactacaaggtgctctttgtattttagcgtttcgcattgctccctctctgccccacacagatggcgaatg

SEQ ID NO: 16554 - DNA, 349 bp, Gossypium hirsutum
  Clone ID: uC-gsflnu33B098a09b1
acctcccacgcgtccgcccacgcgtccgaaaaaatgggagatcagttagcgaaaggagaagaattcgtgaagaaagcagagaaaaagctaaatggttggggcttgtttagttctaaatatgaagacgccgccgatttatttgataaagctgctaattgcttcaagcttgccaaatcatgggacaaagctggatcaacttatgtaaagttggcgaattgccatttgaaatcagacagcaagcatgaaacagctcaagcttatgttgatgctgctcattgttataagaaaacagctacaaaggaggctatattttgcttgcagcaagcagtgaacttgttttgcgatattt

SEQ ID NO: 16555 - DNA, 180 bp, Gossypium hirsutum
  Clone ID: uC-gsflnu33B098a11b1
cactcaacgacaaacctttcattattacacaccggtgtccattacttctctgaccaaaactccgcctctgacaccacctgccgccaccaatgtccatcgccgtctgcctcttcacccccttcccacttttctcttctagttcccttaccattactcactaaactccacaccacttttacc

SEQ ID NO: 16556 - DNA, 90 bp, Gossypium hirsutum
  Clone ID: uC-gsflnu33B098b02b1
cctcgcgtccgatttcaatcaagaagagctccagctagcattggcccggatggttgatcacccaagtcagaacacgagagtgatctgatt

SEQ ID NO: 16557 - DNA, 122 bp, Gossypium hirsutum
  Clone ID: uC-gsflnu33B098b03b1
aatagttgtgattaaatctcaattttcaacatagtagagggactgaaaccagaattagaccaaaactaaaaatgaccaatggttgccctttggtttctagtaatattctgtcgacaatgatg

SEQ ID NO: 16558 - DNA, 73 bp, Gossypium hirsutum
  Clone ID: uC-gsflnu33B098b07b1
taaaatgctgaaactgaggaagataatggttttaattctgatccccagcctacagatgagggagggattgaaa

SEQ ID NO: 16559 - DNA, 101 bp, Gossypium hirsutum
  Clone ID: uC-gsflnu33B098b11b1
acctgcacatcatgctcctcctccagctcctgctcagagtggaagtggtggatccttgctcggtggcataggctctaccatagctcagggcatggcatttg

SEQ ID NO: 16560 - DNA, 75 bp, Gossypium hirsutum
  Clone ID: uC-gsflnu33B098c04b1
ctactcgtacggtactgtacacttcctttgttggggagattattttctcaccaggggcaatgaaaagagacatag

SEQ ID NO: 16561 - DNA, 202 bp, Gossypium hirsutum
  Clone ID: uC-gsflnu33B098c06b1
gcttaataaaaaaaaaaaacaccctaaagagacaatgagaaagctgctagcctttgcctttcttttcttcttcttttgggataaaacattagctcaaatagctccggcgccgccgataaaggtggacaacatcacttccatcctcgaaaaaggtggccaattcaccattttcatcaagctcttgaaagccacacaggtggct

SEQ ID NO: 16562 - DNA, 77 bp, Gossypium hirsutum
  Clone ID: uC-gsflnu33B098c07b1
acctcacaaatgagcctggagaaacgatttggtcagtctgctgtttttgatgcctctacactaaaggaaaatggcgg

SEQ ID NO: 16563 - DNA, 72 bp, Gossypium hirsutum
  Clone ID: uC-gsflnu33B098c08b1
aactaccacgcgtgcgaccacgcgtacgcccacgcgtacgactacgcgttcgtggatattgatcaagaatgg

SEQ ID NO: 16564 - DNA, 335 bp, Gossypium hirsutum
  Clone ID: uC-gsflnu33B098c09b1
ttgtaatgtcccctttggagcctgatatgacgcaagaacattcattaaccaaagaaagtacaatgcccaacgatccagctggagccaaagaaaataaacaatttctgccattcatttcttctccacccgtatctgcttcaccaatttctgaaagaccaagtgatccaacacctgcgattttgaaaacaaatagcgaggccaacatagatctggaggatgttttagctgctgctcagtcagctgctgaaactgctgagcgcgctgcagttgcagtttggtcagcagcaagtcttgcacacgtcagaattgtcgttcttacacagaaatggaatggc

SEQ ID NO: 16565 - DNA, 105 bp, Gossypium hirsutum
  Clone ID: uC-gsflnu33B098c10b1
gcctaaaaaatctttccagtttctattttctaaaaacaaaactgaaaatgtcttgctgcggaggaaactgtggctgcagctctggttgcaagtgtggcaatggct

SEQ ID NO: 16566 - DNA, 123 bp, Gossypium hirsutum
  Clone ID: uC-gsflnu33B098c11b1
aactccacgcgtccgcaaaatcgctccgcagcagggcttcttcgacgttccagtccccttccatgttcgaccagatgacgacgaaatgaggacgctttccgacgaatctcgaaacggtacaag

SEQ ID NO: 16567 - DNA, 408 bp, Gossypium hirsutum
  Clone ID: uC-gsflnu33B098c12b1
tggttgaagataatgatgactttatcgcatcagaatcagatagacaaatgcttcttataaagcagcaggatgaggagttggatgaacttagtgcaagtgttgagagaattggaggtgttggtcttacaatacatgaagaacttcttgcacaggagaaaataatagatgacttgggttctgaaatagacagtacaacaaaccgactggattttgttcagaaaaaagtggctatggttatgaagaaggcaagtgctaagggccagattatgatgatattatttttgctaggtttgttcattattctattcattctgggctttctcacttagtcttctgattgtttacccaagtttgattttggattaaccatgggaggctgggaacataaaggagttggttggtgtgatg

SEQ ID NO: 16568 - DNA, 122 bp, Gossypium hirsutum
  Clone ID: uC-gsflnu33B098d10b1
gcctgccacatctcgacctctttatgctaatcttcttcaagtagccccattcccacctactgcatcttcaggggtataggaattgcgatttcaatccactttacattctcggtctactccat

SEQ ID NO: 16569 - DNA, 155 bp, Gossypium hirsutum
  Clone ID: uC-gsflnu33B098d12b1
tctttaattcttctgtttgatgatccatctgcttgcttatacagcttcacccacagacggtgtctgctcaaggctgcagcaattgaaatattgtttttttttttttttggttctgtaacattccaagtcataaattacgtaaatgattcagttgt

SEQ ID NO: 16570 - DNA, 240 bp, Gossypium hirsutum
  Clone ID: uC-gsflnu33B098e01b1
aaccctgacagacgaaacggaccagccgaggacagacggacgtgggacaaccacagggactatgggctcggaccattcgacggcgcagccaaagcagccaacgactatgaggactccatcaacggcccagacacgcacgaacagataaccactactgaatataaagatacatggcccgcttccatgtacttaaacaaggggtagaaagtagggaggaacacatcgggaaaaaaagccgag

SEQ ID NO: 16571 - DNA, 73 bp, Gossypium hirsutum
  Clone ID: uC-gsflnu33B098e04b1
gactgcaggctagaaaaagattggtgctctgtgcagattttttacgctggtaaatcctgcaggttcacttgaa

SEQ ID NO: 16572 - DNA, 116 bp, Gossypium hirsutum
  Clone ID: uC-gsflnu33B098e05b1
ataatttttcaacacacaaaattggttttaacaattaaacacaatctaaagcggtgttggttgcagccgttgcacggtttcgtggctgatcctctcttgttctaaatcttttgttt

SEQ ID NO: 16573 - DNA, 107 bp, Gossypium hirsutum
  unsure (1)..(107): unsure at all n locations
  Clone ID: uC-gsflnu33B098e08b1
gcctcnatatttcagaatttgcttcctttcctggtggcattattttctctcgacaccgctaacaacccaaaacgctctacaaggaagggcagtaccgaccaaaccag

SEQ ID NO: 16574 - DNA, 58 bp, Gossypium hirsutum
  Clone ID: uC-gsflnu33B098e09b1
tgcacacttattttttcaagttgagaatgcacagatcgttggttcggtcattcatggg

SEQ ID NO: 16575 - DNA, 85 bp, Gossypium hirsutum
  Clone ID: uC-gsflnu33B098e11b1
gactccacacgtccgcccacgcgttcgaacacgcgtcctttatctaaacacatccttaccaactcaaaaaccccaagttatcacc

SEQ ID NO: 16576 - DNA, 162 bp, Gossypium hirsutum
  Clone ID: uC-gsflnu33B098f01b1
ccgtggagctctgctttcgccaaacaaacgcgagatttgtagatttattcaccttgggtatgagcctccgaatcaatggctttgccgaaccagcaaactgttgattatcccagcttcaagctcgttatcgtcggtgatggaggatctggtaacacttctttt

SEQ ID NO: 16577 - DNA, 77 bp, Gossypium hirsutum
  Clone ID: uC-gsflnu33B098f05b1
caataagagctttcgtgtttgtctattgaatggtgggccttacttacacgaaaaaaaaaacgtcaccaggaagcaaa

SEQ ID NO: 16578 - DNA, 82 bp, Gossypium hirsutum
  Clone ID: uC-gsflnu33B098f07b1
tgcaatttcccattttttggtctttctttatgccaactgataatcaaatgaaagacatgaaaccgaattccataatgggatc

SEQ ID NO: 16579 - DNA, 53 bp, Gossypium hirsutum
  Clone ID: uC-gsflnu33B098f08b1
tgatctcatcttgtgatttgagcttcgtgtttgtgttgttttaagcaattttc

SEQ ID NO: 16580 - DNA, 439 bp, Gossypium hirsutum
  Clone ID: uC-gsflnu33B098f09b1
tcctggtttacactgtatacgccacagctgttgacccgaagaagggttacattgggatcattgcacccattgcaattggtttcattgtgggtgccaacatcttggctggtggtgcctttgatggcgcatccatgaaccctgcagtctccttcggaccagccgtggtcagctggacgtgggacaaccactgggtctattggctcggtccattcgtcggcgctgccattgcagctattgtctatgaggtctttttcatcggcccagacacgcacgaacagctttccactactgaatattaagatttatggccttcttccatgtacttaaacaagggtttgaaagccgggtggatcactttggttttcattgttgtgggtgtttatcccaggcttggttctctctattggcatgtgctggtcctgtgaacttgttttttctt

SEQ ID NO: 16581 - DNA, 70 bp, Gossypium hirsutum
  Clone ID: uC-gsflnu33B098f10b1
acctcccacgcgtccgggatatgtcatctgatggagttcttgctgatggctcgccaaatgaaactggtga

SEQ ID NO: 16582 - DNA, 120 bp, Gossypium hirsutum
  Clone ID: uC-gsflnu33B098f11b1
gcctccaatctcatatctctcctttgttccccgggggctctttctttaggtaaccctaaccctacctcaccaaccaggattcaacatgaagggaggaaaaaataagacagacactaagag

SEQ ID NO: 16583 - DNA, 116 bp, Gossypium hirsutum
  Clone ID: uC-gsflnu33B098f12b1
gctgccacgcgtacggccacacgtgcgttaggcggcaggactctgactgtacgatcctccaagcagtatcctcaatccaatcatgtaaactaataaaggaaacttgaaaaaggaag

SEQ ID NO: 16584 - DNA, 85 bp, Gossypium hirsutum
  Clone ID: uC-gsflnu33B098g03b1
tcataatcacctcaagaaaacacatagtatgaagggggaaatttttttaacttgttttctctaagaggcccacatggatccagaa

SEQ ID NO: 16585 - DNA, 254 bp, Gossypium hirsutum
  Clone ID: uC-gsflnu33B098g06b1
gctagactatcgaattctttccttcactttctcgagaaataaaaatgtcttcaggttgcaatcgcggatctagctgcagctgcggcgacagctgctcatgcagcaggaaccttaaccttggatactcggagaagacaaccagcactcagaccatcatctccggagtcgcgccagcgaagatgacctttgagggaccagcgatgagccctactgtatcaggacatggctgccagcgtggctccacccgttccttg

SEQ ID NO: 16586 - DNA, 52 bp, Gossypium hirsutum
  Clone ID: uC-gsflnu33B098g11b1
acctccacactcgccgtctcgcctctcgcttattggatcaagatctggtttt

SEQ ID NO: 16587 - DNA, 112 bp, Gossypium hirsutum
  Clone ID: uC-gsflnu33B098g12b1
acctccacgcgtccggttctcttttgattgcacaaaaccaaatcatctttgctttgctattttggctcgttatgttaagaaactggattacgcacagctaaacattgaggag

SEQ ID NO: 16588 - DNA, 272 bp, Gossypium hirsutum
  unsure (1)..(272): unsure at all n locations
  Clone ID: uC-gsflnu33B098h01b1
tngtgatacgtcctcctactattcttggtgtcagggaacatgtatttacgggaagtgtctcttctttagcttcttttatgtccaaccaagaaagcagctttgtaactcttggtcagcgtgttttagcaactcctttgaaggtccggatgcattatggccatccagatgtttttgatagggtttcccatataacaaggggtggtatcagcaaggcattttgtattaataaacataagcgaagattttcatgcccggcttcaatttctacttta

SEQ ID NO: 16589 - DNA, 119 bp, Gossypium hirsutum
  Clone ID: uC-gsflnu33B098h03b1
tcgtgagaaacctcccaaggtttacccggctgaggatgtttagaaggcgcttcttaacaagcgcaaacctaaacccactcaactttgagtaagtttttcaccagggactgtgttgattt

SEQ ID NO: 16590 - DNA, 75 bp, Gossypium hirsutum
  Clone ID: uC-gsflnu33B098h05b1
cctactcgtccggagagttttgttactgcttatcacaggtgactgaattctgaggatttgccacaacaagatgca

SEQ ID NO: 16591 - DNA, 55 bp, Gossypium hirsutum
  Clone ID: uC-gsflnu33B098h06b1
cctacgcgtacgaccacgcgtccgagaacatcaaatcagttattgtggacgttcc

SEQ ID NO: 16592 - DNA, 106 bp, Gossypium hirsutum
  Clone ID: uC-gsflnu33B098h11b1
aggagactattggttacattttctcatttggtgcagttggtgcactcttgggggcaatactctaccaaaatatattgaaggattattcttttccagactagctttc

SEQ ID NO: 16593 - DNA, 86 bp, Gossypium hirsutum
  Clone ID: uC-gsflnu33B098h12b1
gctgctttttacttctgcttacataggatcagggggagcattaggaagaaaattgggaggacttactctagaaaaggacataacag

SEQ ID NO: 16594 - DNA, 416 bp, Gossypium hirsutum
  Clone ID: uC-gsflnu33B099a01b1
tgtactcgtgggcaggatttggctgttccgttagagtttcggaagaagaaggtaatagaatagaacctctcaaagagtgagacacagacagaaaaagcatcgaaatgagttacgagagaggtcctcaagatcattatcctcctcctggttattcctctccttatcccccaccgggctatccatcagcccctcctcccccatcttacgaaggctatcctcctccgccaactggatatcctgcctatcctcctcagccgactcgccagccctacgacggataccaaggctatttcgctgaagggtatccaccttcttcgccccctcaaccttatcctcaattccaacactaccaccactatgaccacttccattaccagaaccagtctgattctggctgtctctctttttgcatggct

SEQ ID NO: 16595 - DNA, 81 bp, Gossypium hirsutum
  Clone ID: uC-gsflnu33B099a05b1
gactagagcactagaaggagaaaaggatccattgaagatttcattgtaacagtgccgtcgcagtgtctagcacatgactgc

SEQ ID NO: 16596 - DNA, 199 bp, Gossypium hirsutum
  Clone ID: uC-gsflnu33B099a07b1
tctttgtgcgacctactgtgagactcagctgggttgaaagggctgaagcgatctggcttcgcagctatgggaaacgttgaaggaggcgacaacggtgtatacgggccttatcttggtcactttttttacggctctagctctgtaatgggctcgttactatgtagcaaagggtctatttgggtaatccactttttcttat

SEQ ID NO: 16597 - DNA, 110 bp, Gossypium hirsutum
  Clone ID: uC-gsflnu33B099a11b1
gcctgcggaaagttgtagaaaacgagggggacgtgcagagtatttaagctaaccccccccgaccaacaagaaaaaaatgtattataatagggaaacaataaaataattat

SEQ ID NO: 16598 - DNA, 62 bp, Gossypium hirsutum
  Clone ID: uC-gsflnu33B099b01b1
atagtaccaagctagatctatcagatggaatgtatctgtcagtggagctcgcccgaacccac

SEQ ID NO: 16599 - DNA, 72 bp, Gossypium hirsutum
  Clone ID: uC-gsflnu33B099b02b1
ccctcgcgtccgtaaaaatcaaagaaaaaaatctcttttcttttgttgtaatcccttgaatcttccgatatg

SEQ ID NO: 16600 - DNA, 69 bp, Gossypium hirsutum
  Clone ID: uC-gsflnu33B099b04b1
aaatacaatagacttattgactctgggaggtatcgtaatattttggatatgaatgctggattgggagga

SEQ ID NO: 16601 - DNA, 71 bp, Gossypium hirsutum
  Clone ID: uC-gsflnu33B099b06b1
gatggtcaatgcgatgaagctgctgtacgaggggaagactactgcataggtagaggaataccgaagtgctt

SEQ ID NO: 16602 - DNA, 148 bp, Gossypium hirsutum
  Clone ID: uC-gsflnu33B099b10b1
tctgttcaacgagaaccgttacaataacatgggaaagttcaatcagaatcaagaggagttcgaagaagagttcgagccatgaaaccatacgtatatgctaattaattagcaaaatgagagtaaagatttaaaggctttatttattggg

SEQ ID NO: 16603 - DNA, 367 bp, Gossypium hirsutum
  Clone ID: uC-gsflnu33B099b11b1
ttctttttcctgcagcctgcagctgttctcacaagtagtattagttgttatttctgtcattgttagtggagctgtgttaaataagtgaagtatacacaatcttgcatggagtttttcatatataatttggagcccttccaaaaatagaagagcgtagacaaagaacatgaatccttcccaatgatattagttggaaaccagtagcataaggggtcgaaatctcatctctatttcctaaaggaagcaaaggatacatgagtgtatactatgtcccaataaaggaaggtgaaccatcattagtcaacatcttgggttgtagagaaagtgaaactcacagctaggcatgagggatgatgggtgggatgtg

SEQ ID NO: 16604 - DNA, 317 bp, Gossypium hirsutum
  Clone ID: uC-gsflnu33B099b12b1
tctctcacgcgtccgacctgccactgatgaggaacttcccactccatatgttgaggaataccgatgtgctctggaagcagaaatgctgaagtatgttagtgaagcttatccaaaaggttcttgttcagtgtactgcattaatggaaaagatgtggagggacccggatatgatttcgaacttgttgcagtgatttctgctgctagacttagcccacagaatttttgcactggaagttggcggtcgatatggaacattgagtgcatagatgatattcaagtttcggaattaaaaggcatattgttagtcggttctcatc

SEQ ID NO: 16605 - DNA, 142 bp, Gossypium hirsutum
  Clone ID: uC-gsflnu33B099c01b1
ttcatgcgtccgcccacgcgtccgactcgttcacataatcaaattaatacaaactgtttacattccaggatggaggtttttgccaacgaagacaaacagggagatgaagaaggatcacagggttcttaaagagttgcttttg

SEQ ID NO: 16606 - DNA, 52 bp, Gossypium hirsutum
  Clone ID: uC-gsflnu33B099c03b1
gttatgtatacacatatcagatattcagggggcttgcatacctccatagtgt

SEQ ID NO: 16607 - DNA, 104 bp, Gossypium hirsutum
  Clone ID: uC-gsflnu33B099c05b1
atcactcagtccttcaagattctcaatgtctccacaactcaatagaatcaggtcagtgcatctcaatatgacccaggtggtcagagcttcccgaaatttctctt

SEQ ID NO: 16608 - DNA, 73 bp, Gossypium hirsutum
  Clone ID: uC-gsflnu33B099c06b1
gtctttggtcaatggaacaatgtaggcaagggaagttggtaaatatggatccgtaacctcgggataaggattg

SEQ ID NO: 16609 - DNA, 132 bp, Gossypium hirsutum
  Clone ID: uC-gsflnu33B099c07b1
tcgtcgtactagcggcgctgcacaaaatgtcgtcaacggagtctatcatcctccaactacatgaaaactgcgtcgttaaattaggtaacttcaagctgaaatctgggatcttctatcttatctacatagact

SEQ ID NO: 16610 - DNA, 258 bp, Gossypium hirsutum
  Clone ID: uC-gsflnu33B099c08b1
tcgtattaaaaaaaaaaaaaaaaaaaaaaaaaagagtaaataatataaaaaaaaaaaaaaagaaaaaaaataaaaataaaataagggggggccgtttttggggttccatgcttccgctcgcggtcaagggatgtttgggtttttctttgggggcccctaatttccttttccgggccgcttttttccatcgttttgcttgggaaaaccttgttgtttccccccttttttttgctttgcttctcttccccttttggcctg

SEQ ID NO: 16611 - DNA, 75 bp, Gossypium hirsutum
  Clone ID: uC-gsflnu33B099c10b1
tcgttcacgcgtccgcccacgcgttcgtccacgcgtacgatcggtggttgacggcaacgttagggagttcggaga

SEQ ID NO: 16612 - DNA, 127 bp, Gossypium hirsutum
  Clone ID: uC-gsflnu33B099c11b1
tcttcacgcgtccgctttggtgctgcaattgggaagggtaaacaagctgccaaaacagaaattgaaatgttgaatctgtccgtaatgacttgcacagaagggtatattttaatttatctaaatattt

SEQ ID NO: 16613 - DNA, 82 bp, Gossypium hirsutum
  Clone ID: uC-gsflnu33B099d01b1
ctctttctgtatctcatggctcgaactctgaaaagtgcatgcagttcgatggtcaagctgagatattaaccaaatgaaagag

SEQ ID NO: 16614 - DNA, 171 bp, Gossypium hirsutum
  Clone ID: uC-gsflnu33B099d02b1
cctacgcgtccgataatatttaataaataaataaattcatctaccataatattctactaatctgcatattattcatcttttatctacaactttccatggcttgctcaagcggttcatcatttggttcatcaaccttggtcacaatctcaggctttgatgatgtatttcaag

SEQ ID NO: 16615 - DNA, 114 bp, Gossypium hirsutum
  Clone ID: uC-gsflnu33B099d05b1
ttaggtcaagatggactgaagaatcctttggcggttcatttagcaatctatcaagcagtgtgactactcattctgtgcaaagttttaatgtagaaccattggttccttctaaag

SEQ ID NO: 16616 - DNA, 271 bp, Gossypium hirsutum
  Clone ID: uC-gsflnu33B099d06b1
ttcactcgtccgcttggatgccgatacctctcctgatgctcttctcacaaagctcaaagaaatgattcagccttggaggaatctttacatagcaacaaacgagccattctataattactttgataaattgaggtctcaatataaggtccatctgcttgatgactacatggaattatggagtaacatgagcgagtggtacaatgagacaacattgctgaatgatgggaaaccagtcgagtccgatggctacatgagagttgctgtggacatc

SEQ ID NO: 16617 - DNA, 162 bp, Gossypium hirsutum
  Clone ID: uC-gsflnu33B099d09b1
attctccctttctgctccttatttattttctttcaccttttcctttcaagatcgagagaaaaaagaatggcagaggagcatagatgccaagcgccagaaggccatcgtctttgcgttaataactgcggctttttcggaagtttggcgactatgaacctttgc

SEQ ID NO: 16618 - DNA, 83 bp, Gossypium hirsutum
  Clone ID: uC-gsflnu33B099d10b1
ctcgtgtacacgtggaccgacctgggataatcggtctgatttatccagattcccacctactgtatcttcaggggtataggaat

SEQ ID NO: 16619 - DNA, 439 bp, Gossypium hirsutum
  Clone ID: uC-gsflnu33B099d12b1
tcgtttcacgcgtccggtacctcaaaatgggaacctgcaacatggtggtggcttcaaccccggataccgctcgagctttccttaagacccttgacttgaatttctctaatcgaccatccaatgctggtgccacccacatagcctataactctcaagacatggtgtttgctgagtatggtccgaggtggaaattgcttcgtaaactgagtaacctccacatgcttggtggcaaagcccttgaggattggtcccaagtccgggctgttgagctaggccacatgcttcgggccatgtgggagtctagccgaaagggtgagccagtggtggtgccggaaatgttgacgtatgccatggccaacatgatcgggcaagtgatactgagtcggcgagtattcgtgaccaaagggtcggagtcgaacgagttcatggacatggtggt

SEQ ID NO: 16620 - DNA, 98 bp, Gossypium hirsutum
  Clone ID: uC-gsflnu33B099e01b1
acggatctagggatagatgtccttcccttcctcaagaaagtgtggacgaatctttgtaaatcatatttgttggaggcaaaatggtattacattgtata

SEQ ID NO: 16621 - DNA, 147 bp, Gossypium hirsutum
  Clone ID: uC-gsflnu33B099e03b1
tcatgcgtccggaggatttttggccaggatgcaaaaactagctcaacagcaaaatgagataattgaaactgtcaaccgtgaaagaaaatctcattagcaaatcactgcatatgagctcaacgctttgttctcccaatgtcaggagct

SEQ ID NO: 16622 - DNA, 52 bp, Gossypium hirsutum
  Clone ID: uC-gsflnu33B099e04b1
ccctcgcgtccgcccacgcgtccgctttgactaaggttgtattattatatgt

SEQ ID NO: 16623 - DNA, 156 bp, Gossypium hirsutum
  Clone ID: uC-gsflnu33B099e05b1
atagatcggggtcttcttcttgctcagatggaagcttgaagcaacaattagaggaattacagaaacagcttggaaagaaacagagattcgaggaggcagttatctttatcaattacttttttaaactccattatcctttagcttcttctatctttt

SEQ ID NO: 16624 - DNA, 59 bp, Gossypium hirsutum
  Clone ID: uC-gsflnu33B099e07b1
tcgttcacgcgttcgaccacgcgttcgatgaccttgtttaccatgcatttcttagggct

SEQ ID NO: 16625 - DNA, 78 bp, Gossypium hirsutum
  Clone ID: uC-gsflnu33B099e11b1
ttcgtataagcctgtgacggtactaacggaggaagatgaagaaataattaaatctgcagagaatgacacaactcactt

SEQ ID NO: 16626 - DNA, 344 bp, Gossypium hirsutum
  Clone ID: uC-gsflnu33B099e12b1
tcgttttaacacaagttacaaactcaaaaaccccaagttctcactttcaaaaaacttcccacattcaccatgtctgacaggtgcggcaactgtgactgcgctgaccgcagccaatgcacgaagggaaacagcaacaccatgatcattgagactgagaagagctacatcaacactgctgtgatggatgctccagctgagaacgatggcaagtgcaagtgcggtactggctgcagctgcacagactgcacctgtggccactaagccaacatacaatggtcatgcttcaggtcatggcatatatagggatctaaataatggaattaagggtgaatattttgtctgtt

SEQ ID NO: 16627 - DNA, 129 bp, Gossypium hirsutum
  Clone ID: uC-gsflnu33B099f01b1
tttcatctcaaaataaatccacttcattcgaacccgaattttcctttcaagaacccagattttctttctccgaacgggattacggccggttaccgaggtcacccagatttgtttattccatatcgggga

SEQ ID NO: 16628 - DNA, 332 bp, Gossypium hirsutum
  Clone ID: uC-gsflnu33B099f03b1
ctcatttctagatggagaaaccataaaacctttgggggcagcactcacctttcatcagttcttcgaaggcatgggacttggtggatgcatttctcaggcttcattcaagggtcgatcggctgacatcatgtcacctgtttttctcgctgacaacaccagtaggaatcgctttaggaattagcaataacaaatgcatacgatgagaacagtccaacggcactgattgtggaaggattattgaacgcggtatcatctgggatcataatatacatggcgttggaggatccttcagcccctgctcttatgtaccccacgattccatatcattgtta

SEQ ID NO: 16629 - DNA, 257 bp, Gossypium hirsutum
  Clone ID: uC-gsflnu33B099f05b1
cctcgcgtccggctttaaatgaaatgtgggacattttacgcttcctcttccgcttaccttcctcagtctcctcttccttgctttcctcgtcatcttcttcattatcttcactttcgtgttctttgccctcgtcatcaccaacatcttcattttcatcttcatctctcatcctcatctttcaacatcatcctctcctttttcttcttccttttctcctgaatcattaccgcccgcttctctctaacttgctcttattt

SEQ ID NO: 16630 - DNA, 172 bp, Gossypium hirsutum
  Clone ID: uC-gsflnu33B099f06b1
ctcattcgtccgtctatatatctatcattttacacttgagcactttatttgcctttcattttatatcaatacgaaaaaagtaatttattaaaaaaaagaaggaaatttaaacacagcaagtgaaactactaacactaaaaaagaaaaaaatataaatataacaaaaaataat

SEQ ID NO: 16631 - DNA, 285 bp, Gossypium hirsutum
  Clone ID: uC-gsflnu33B099f08b1
tcgttcagaaagtccaaagaccataaaacctttggtggcagcactcacctttcatcagttcttcgaaggcatgggacttggtggatgcatttctcaggctaaattcaagggtcgatcggttgcaatcatgtcactgtttttctcgctgacaacaccagtaggaatcgctataggaatagcaataacaaatgcatacgatgagaacagcccaacggcactgattgtggaaggattattgaacgcggcttcatctgggatcttaatatacatggcgttggcggatca

SEQ ID NO: 16632 - DNA, 84 bp, Gossypium hirsutum
  Clone ID: uC-gsflnu33B099f09b1
tcgttcacgcgttcgcccacgcgtacgaccacgcgtgcgttcacgcgtccgctatattgcaactacaagaagaaatgcccaacg

SEQ ID NO: 16633 - DNA, 87 bp, Gossypium hirsutum
  Clone ID: uC-gsflnu33B099f10b1
ttcgtctgagttcatatttcgactggcaaactgaggtgccaatgaatgaaagaaaaacagttgaagctgcgagtgagactcactttg

SEQ ID NO: 16634 - DNA, 131 bp, Gossypium hirsutum
  Clone ID: uC-gsflnu33B099g01b1
accgttagagctttcgtgtttgtctattgaattctttccttcactttctcgagaaaaaaaaaatgtcttcaggttgcaactgcggatctagctgcagctgcggatccggctgtactcgcggttagaactgt

SEQ ID NO: 16635 - DNA, 115 bp, Gossypium hirsutum
  Clone ID: uC-gsflnu33B099g05b1
ttcactcgtccgcccacgcgtacgcaatctttgcgaagaaccaaagatgccgaagaacaaaggaaagggaggaaagaaccgtaagaggggaaagaacgaggccgatgaccagaaa

SEQ ID NO: 16636 - DNA, 277 bp, Gossypium hirsutum
  Clone ID: uC-gsflnu33B099h01b1
gttgttttgtatgggatccgaaaatcgtccacttctttggtgttttcccttatgtcaaaattcaaaaaccaaagagccagtgaaaaaaggcatgcttgcttcacaaggcaattcttttttacccagaaaagatgaatgaaagaaggttgttttgtcccatattttaaaattcatattagcttcaaaacccccatcacttgaatcttgtaaggctttcatggatttggacttgcagaaattagtttcctgtatttgtgatagaaataggggggggggg

SEQ ID NO: 16637 - DNA, 163 bp, Gossypium hirsutum
  Clone ID: uC-gsflnu33B099h02b1
gagtagcgtatgaagaagctcgaagattagtatgagcatcatttcgagactgattgcccacaccgcccttatggagagctcagagccaggaaatctacgcacaggctaatgcgaaaaatcgtcagaacccatagttctgaaaccttgggttgttgccgccatg

SEQ ID NO: 16638 - DNA, 347 bp, Gossypium hirsutum
  Clone ID: uC-gsflnu33B099h06b1
attgttatagagaagctgcgtttataccacaggttaacagtgacctggacacacaaaactttgaaaagtttgaagagttgggggctcaagtacaatcttcgaccagatcaggtccctggagaaagatgctttcttcgaaggatgcaaattttgtaggttatacgtacaagaatgttgagattgtcaaggaacattatcttccaggcattgctgaggtgaagaagaaaagcattgcacctaagagaccttctgtgaaattattgatcgacactcctggaccttttgatcccccaacaaagggggagcttctttaacctcttgccaacttaattcgaggaacctgaaag

SEQ ID NO: 16639 - DNA, 213 bp, Gossypium hirsutum
  Clone ID: uC-gsflnu33B099h10b1
tcgtcacgcgtccggggattcatgtgatcactccaaacaaaatggccaattcaggaccacttgataagtacctaaagttgagagcttttcaacggtaatcctacacacattactattatgaagcaactgtaggagcaggtcttccaattattagcactttactaggtctacttgaaaccgggtacagaatatttgcttattgagggttttttt

SEQ ID NO: 16640 - DNA, 86 bp, Gossypium hirsutum
  Clone ID: uC-gsflnu33B099h12b1
tctgtttacaaccaagtgtgagaagtaggaaaagcaagtgcagagaagagaagaaagatgagcagaattggaactggttacgtcct

SEQ ID NO: 16641 - DNA, 370 bp, Gossypium hirsutum
  Clone ID: uC-gsflnu33B100a03b1
cgcgccgcgccgtgaattgccgggtccgcaccacgccttttgttattgtgtacatgtgacctatcttcggttctaaagtggtatctggattttgagccgtcaggagtgagaacattgacagcatcaccttgttatatggggagggcatgtacatgcttgagacaacgcgtcggggccggacccagaaacatgctctgggaataagggctatctcagatgtcatagggggagctaattggctgggacttacggtctttttattaatgtggtgacttgacttctgtttacactactggtacctaggacctgcttaaaaacacaatattcttgttagatggatgtatgaaaattatgtttcaaacctaaaatc

SEQ ID NO: 16642 - DNA, 488 bp, Gossypium hirsutum
  Clone ID: uC-gsflnu33B100a04b1
ttcactcgtccgaagaagaaaaaacccagtattctgtcatcactatggaggccaaatggctgctatgttttacaatggcagcactaatggcagtgtcaaatggccaggaatcagtgaagccattggtgaagatagttaaaggcaagaaactttgtgataaagggtgggaatgtaaagggtggtcacagttttgttgtaaccaaaccatttctgattatttccgaacttatcaatttgagaaccttttcgctaaacgtaatacaccggtggcacatgcggttgggttctgggattaccattctttcattacggcggcggctcagtatcagcctcatggttttggtaccaccggcggtaagctccagagcatgaaggaattggcagcttttcttggacatgtcggcagcaagacttcatgtggttatggagtggcaactgggggaccattggcttggggtctatgctacaacaaagaaatgagtcccagc

SEQ ID NO: 16643 - DNA, 449 bp, Gossypium hirsutum
  Clone ID: uC-gsflnu33B100a06b1
cttcagtctatctttcccgtctctgcatttacgttctatttttttttagatttattttttttaaaaaaaaactaaagggatttgagttcgtgtggatttgaagtactttcttgagcatatatggaccgtgctgaactatccactgaacaggttctgaagagggacatcccatgggaaacatacatgacaactaagctgatttcaggaacaggcctgcagctgttaaggcgttatgataatagagctgaaagtgtcagggcacagttgttggatgatgatggtccagcctatgttcaagtgtttgttaacatcttacggtgatatctttaaagaagaaacagtggaatatgttctggctttaattgatgaaatgcttacagccaatctgaaacgagccagattattttatgacaggtctcttgctaatgaagatacttatgaaccttttc

SEQ ID NO: 16644 - DNA, 419 bp, Gossypium hirsutum
  Clone ID: uC-gsflnu33B100a08b1
tccatcgcgtccgggccaaatcagtctaacatcataccttctaccttgcagcttcctggtagtaggctgaaaactacacttagtgctcgggatatggatttagacatggaactactggggctggaatgtcgtcgccgccgccagcagcagcaacagttaattgatgagatatctggcctttcctccccaaccagctggaacaattctacagcattttctgccgctggtgaccgaactggtgaactaaatagatttggaggggtgaagccaactaacctcgatgatatttttggatctcttgatcctagtattatgccacaaatacaaggactctcgcttgatgctgcagcatctcagctgcaatctcccactggagttcatacgcgccagaatattaaccagcagctcagggctagcta

SEQ ID NO: 16645 - DNA, 419 bp, Gossypium hirsutum
  Clone ID: uC-gsflnu33B100a09b1
tcgtagaaagccttctcattacatcccagcaattataatattgattttgttgattttggtgtttttcggaagatcagttgcaatattaggtacttgtattggatggtatgtagctcctacaatcaatggggaaggatcaaatttaagaacatcaatgaaaaagaaagattatgggagaagacagagtggaaataaattggttggtgggaaactatccttccaaaagagttaaaaagagttaggtttacctctgcatcacaggatctgatgtaatcatttcgtttctattttaatgtaaaatacagtttgttgtattatacgagttttgagagcaaatctgagttaagttgccttgtaattgtataatttctagtggaaatggattagatattagagttaatgtaaaaaaaaaaaaataa

SEQ ID NO: 16646 - DNA, 402 bp, Gossypium hirsutum
  Clone ID: uC-gsflnu33B100a10b1
gtcgctcacgcgtccgcccacgcgtccggcaaaaagaagtgaaaagagagaaaaaaactgctctattctctcttttactccacacgtcggcactctcccccttttcaactccgactgaagcgcaccaagggcaccgacggcgcaccaccactaaactggaggagaacatgggctatgcgagggcaacgtgctgcgatgttgaggcgattgttgcagcgcggaggaagggaagccagctgttgcgttgttgatttttttttagtttgggttactgtttgggtttggggctgttaattgggccgagcaatttgggcttgtacaccatgaactgtatatatggtcaaaggacgttgaatagtgcgtagacttgttgcataaatattgccatgatgttttggatac

SEQ ID NO: 16647 - DNA, 405 bp, Gossypium hirsutum
  Clone ID: uC-gsflnu33B100a11b1
cgttcggtcggctccacttcctataggatttgcagggttcatggttcattaggctactattcctatcaccggaactggtattaaccctgctagaagcttcggcgccgccgttatttacaacaacgacaaggcttgggatgaccactggatattctgggttggaccaatggtgggagcacttgcggcggcggcatatcatcagtacatgcttagagcggcggctattaaggctttgggatctttgcggagcaaccccagcaattaaaagcttaaaagagaagaaaaccacaatatggttggctcattgggttcataatgcgtcttcattgaaggctcctgcgtgtggcatagtattatgattgatgattattaattcagaccttgctatttattaaaagccagaac

SEQ ID NO: 16648 - DNA, 483 bp, Gossypium hirsutum
  Clone ID: uC-gsflnu33B100b03b1
tcttccacgcgtccgacggtagagaatatcagagcactacgtgctactgctggaaatgtccatgcggcggttgagagacttctaggtaacccggggcagtaattcctcaagataatgcttttaaatttgaacaagaactgtgatgtaagattagttgattcggcctgctgacttagcaaaaccacagattatgctgattccttttttgggcacacgtttactgtttaatgacgtggtaaacaggatgatgtacccagagaacttgatatataggcttatgcgtattcttggatcattccatcttttgcccacgcacttggctgtgtacatacacacattggattaattttgagaactttaaaaggatggttccagcatcttcaattcatgcactctgttgctgttcgattctacggagtcgatgaactgtgagttgcatgtatgttagtgtgtcatgtcctgtgtatataaagggacgtggat

SEQ ID NO: 16649 - DNA, 484 bp, Gossypium hirsutum
  Clone ID: uC-gsflnu33B100b05b1
gttttccacttaaggagttgatagagaggcactgcggaggcatcagaggtggatgggacaatttacttgcagtaataccaggaggttcatctgttccacttttacccaagcacatatgtgatgatgtcctgatggattatgatgcactcaaggctgtccagtcaggactgggaactgctgcagtaattgtgatggataagtcaactgatgttgtagatgcaattgcgaggctttcgtacttctacaagcacgagagttgtggacagtgcacgccctgcagagaagggactggatggctatggatgatcatggaaagattgaaagttgggaatgcaaagttggaagagattgacatgcttatggaggtgaccaagcagattgaagggcacacaatttgcgctttaggtgatgcagcagcttggcctgtgcagggtctaatacggcattttaggccagagctcgagagaaggattaaggagcgtgc

SEQ ID NO: 16650 - DNA, 489 bp, Gossypium hirsutum
  Clone ID: uC-gsflnu33B100b06b1
ttcactcgtccgggcaaaagagaaataaaaacagtttcatttccattctaagtttgtgttttttatttgccttttgtgggttttttttaaaaaaaattcagcaaaaatgtttattgagagttttaaggtagagagccccaatgtgaagtacacggagaatgaaattcagtctgtttacaactatgaaactacagagcttgttcatgagaacaaaaatggaacctatcaatgggttgttaaacccaaaactgtcaaatatgaattcaagactgatatccatgtccctaaattgggggtgatgcttgtgggatgggggaggaaacaatggttcaaccctcaccggaggtgttatagctaacaaagagggtatctcttgggctactaaggacaaggtacaacaggctaattactttggttcattgactcaagcatcaacgatccgagttgggtcctacaatggagaagagatttatgctccatttaagagtc

SEQ ID NO: 16651 - DNA, 425 bp, Gossypium hirsutum
  Clone ID: uC-gsflnu33B100b08b1
cctgaattactgtttcgtcccacgcggccgcctgattggaattctcggatatggagacgaaggtggagttttaactgactttatcgtggacaacaggtcaagcatttttgatgccaaggctggaattgctatgaatgacaactttgctaagcttgtgacttggtatgacaacgaatggggttacagttcccgtgttatcgacttgatccgacacatgtctaaggcttaagtgagtgagtgattgtgcttggtgtatccaagctttagcaattttaatttagaagagatgttatgagagaataaacgaattgtacggagcatatttttgtgtgaagaagggttgtttcagttttattacccaagtacttgaatgtttcaagtttccttttaaaggaatggtattcaaaattataaaaaaagcactc

SEQ ID NO: 16652 - DNA, 99 bp, Gossypium hirsutum
  Clone ID: uC-gsflnu33B100b11b1
tgtctttcatccgggcaaaagagaaataaaaacagccgtatttccattgtaagccagagacttttatttgccataaggggcgcgttgttaaactaaaat

SEQ ID NO: 16653 - DNA, 475 bp, Gossypium hirsutum
  Clone ID: uC-gsflnu33B100c01b1
tttcggaaagacgacagtaatatcacattaagttatcacttaagtccttgttcaatatggaaatcacaatacaaatattaaaggaacatctggattctgtgtaaagagaagaaaaattgagtggttttgatggagcttgtaattcttgtcccatgttctttgttactcattgctttaatcaagttcctttatgattacttgtgggtgcctcttagtatacagcatatgctgaattctcagggaatcaaaggacctccttacagattcatccatggcaacaacaaggaaattatcaaaatgagaaaggaagctatgagcaaacccaaggccttgactcatgatatatttgccaaaacgcagccacatatgtactcctggatcaaaaaaatatgggaagaattttgtttattggaacggtattcgagctgaagtggtgatttcagaacctgaactagtaaagaggttctgaaaatag

SEQ ID NO: 16654 - DNA, 481 bp, Gossypium hirsutum
  Clone ID: uC-gsflnu33B100c02b1
ttcgttattcgtgcaaaaagcatcgagaagggttgggacttgaagttgggggaactggctaggatatggaagggaggctgcattatccgcgctattttcctggacagaatcaagaaggcttatgatagaaattctgaccttgcaaaccttcttgtcgacccagaatttgcaaaggaaatcattgacaggcaatctgcttggagaagagttgtttgtcttgctatcaactccggtattagcactccaggcatgtcagccagtcttgcctatttcgacacttataggagggaacgagtaccggctaatttggttcaagctcaacgagattattttggtgcccatacttatgaaagggttgacatggacggatctttccacactgaatggttcaagatcgccaaaaaactaaaagattaatattattctagcagtactcttcagaacactcccaataagtgtaataaaatctgctctggactct

SEQ ID NO: 16655 - DNA, 324 bp, Gossypium hirsutum
  Clone ID: uC-gsflnu33B100c05b1
gtccgcccacgcgtacgaccacgcgtacgatcgtatacgagattgccccaagttagagcatcaaaaaagcatggctattgcaaattacagaagggattatttatggtctggtggtacagaggagaaatccgatttatgacattaagtgctctgaatacgctttggcttatatcaaacataaagaatgtaggaatgaataccttttacatgttgagttgtgggggccttaatgcaaatcgtgcttctttctttgacgtgaatactacgttcaattatggggaacatagaatgatgcgcctcattgatcgcttagtaagaggagga

SEQ ID NO: 16656 - DNA, 431 bp, Gossypium hirsutum
  Clone ID: uC-gsflnu33B100c07b1
ggaccggcccggaaggactggctggacccacgcgcgcgttactcttggggaaaccctggaactccaaaggtggaagcatttgaagaattgcactaactagaaggaaaaagaatgcgtgtcggaaacaccaagtgttaaaagacagaaaaaaggcggttcaaggcaaatgaagtgctcgtaaaaaaagggaggcgatgatgaaaaagagcagcttgctggaagtatggacaagataaatagcgagtgattttcttccggcttcaagaaaaaaccagtaatgatcattgatgacggaatggcagggagagggaaaacgacgacgctgcataggctagattgccatactcaagcttgaaataacacggggtatgtgatgaagatagaccccgctgaaatgaccctcacatgtgctgctgaaatagatataagag

SEQ ID NO: 16657 - DNA, 521 bp, Gossypium hirsutum
  Clone ID: uC-gsflnu33B100c08b1
cggcaccggcccggacttactggctggacccacccacgcgttttttatcgcttaaggtgactacattcacggtaaagaaagttgcataacgaaaagatgtggtgtgccaccgaataaacaagccactgacaatcatgtacgatgtgctaaagaggaagcaacagcagcacatgattggccgcttgctcaaggatgctatattggcacttgacgaggtgcagaggcacctgttcatagttggaaagaagattgaagaactcgaccgacatctatcaaaggtgtatttagcacatggatggttgaacaagggtacttcaaccgatgatcgtgtaagtatgctaactcgtgagaaagaaggactatctgaactgctagattcggaaaatcaactttacgacatggacaacaacacagtggaatacaaagatttcctaggcttggagcagtccttaaagaaaactgcttgggggaaaactccaaactacctccaacctattgcgatccgaatcgaaaaagctcga

SEQ ID NO: 16658 - DNA, 480 bp, Gossypium hirsutum
  unsure (1)..(480): unsure at all n locations
  Clone ID: uC-gsflnu33B100c10b1
tgcttggttcgaccttagaacaggaactgcatataagggaggaaaggtccataaacttgaagtttcagaagagagcattcctgctttccaaagagctggcacaatagtgccaagaaaagaccggttccgtagaagctccacacaaatggtgcatgatccttatacactggtaatagctctgaacagttcccaagcagctgaaggcgaactctatgttgatgacggaaaaagctacaacttcaaacatggggcatacatccatcgccgctttgtgttctcgaatgggcatctaacatcctctcccgttggcaactctaggttttcgtctgactgcattatcgagcgggttattcttcttggatatacccctggggctaaaaccgcacttgtcgaaccaggaaatcagaaggctgaaatcgaacttggtccacttcggttcggnggacaacatgctgctgttgctgtaaccatcccgaagcc

SEQ ID NO: 16659 - DNA, 457 bp, Gossypium hirsutum
  Clone ID: uC-gsflnu33B100d02b1
gtcgtttatttagcgatttaggcttctcctaagcagttccatgaaatgtttgcccacaaaccgcaccatgtgcaccatacttgttatgacaagattcaaggatgcgatttacatgaaggtgaatgggggaaagtcggtaccattgtccattggagttatgtgcatgatggaaaggctaaaaaggcaaacgaagtagtggaagcagaagaccctgataagaatttggtcactttcagagtgatcgaaggagatctaatggaagagtataagagctttgcaatcactagttatgtttcgcccaagagcgagggtagtggcagagtagtgcactgtactttggaatacgagaagctgcacggtgggattgagcatcctgagactgtgctgcaattcgttcaagatatttttaaagacaatgacgtccaccttatccaaaggagctacacagtatgacatg

SEQ ID NO: 16660 - DNA, 480 bp, Gossypium hirsutum
  Clone ID: uC-gsflnu33B100d05b1
ttcacgcgtccgctcaatcatccacttcttctcttctttgaactcaaagtcccagctaatattagaatcatgggtgttgtcacttatgactatgagaatacctccccagtcgcccctgccaggcttttcaaggcctttactgttgaagctccgaaagtttggcccacggctgcaccaaatgcagtcaagagcattgaggttgaagctaatcctagctctggaagtatagtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaagtttgaggcagctgcaggtggaggaagtatttgcaagagctcaatgaaattctacactgttggcgataatgttatcactgaagacgaaatcaaggctctcatt

SEQ ID NO: 16661 - DNA, 463 bp, Gossypium hirsutum
  Clone ID: uC-gsflnu33B100d07b1
ttcattcgtccgctcttgttcagatagtttttctctgtttcgagtgtttaaaattttgcagacgatgtcaaacttaatactttttgaggatatttttgttgttgataagcttgacccagatggtaaaaagtttgataaagttacccgcattgaagcacggagccagaactgtgatatgttcatgcacctcgatgtaaatacagagatatatcctatgcatgttggtgataaattcacaatggcgttagctcacacgttgaatttggatgggacgcctgatactggctatttcaatccggggaggaagtctcttgcagataagtatgagtatgtcatgcatgggaagttatacaagatatccgatgattcttaaggaaaggacttaaagcggagatctatgtatatatggtgggcttttaatgctattgagaggagaagcttctcatgtttcccactttgaact

SEQ ID NO: 16662 - DNA, 190 bp, Gossypium hirsutum
  Clone ID: uC-gsflnu33B100d08b1
tttggttcttgtccagcattgaataatgaatatgatatttatattaattaaagcaaagatatggctaaaaaacatggacacccttttcatcctaaccctctttgtttccactatatcctttgcagctggggctgctgctttttgggctccaagtttccatccccgtcattctcagggtttagtttttttt

SEQ ID NO: 16663 - DNA, 487 bp, Gossypium hirsutum
  Clone ID: uC-gsflnu33B100e02b1
ttgctcacgcgtccgcccacgcgtccgctcaaaccctaattccttagtttttacagaagatcgggggtttaatcgcagagaatcaaccatgtttaacaggcttttcgggaaacccaagcaggaagcaaatgctctaaccacgttagacaaattaaatgagacccttgaaatgctcgagaagaaggagaaagtacttgtgaaaaaggctgctgctgaggttgaaaaggccaaggaatttgccaaagggagaaacaagagagcggctatacagtccttgaagaggaagagactatatgaacagcaaatagagcagcttggaaacttccagcttcgtattcatgatcaaatgataatgttagaaggtgctaaagccacaactgaaactgtagatgcattgagaactggagcagctgcaatgaaggcaatgcagaaagcaacgaatatggatgatgttgacaaaacaatggacgagatcaatgaacaaact

SEQ ID NO: 16664 - DNA, 478 bp, Gossypium hirsutum
  Clone ID: uC-gsflnu33B100e06b1
actagttctagatcgcgagcggccggcctttgctgatatttttttattgttgtctccggcgctcgaagatcataaaaaaccggagtcgtttcaaatggctacgagaacggatctagatgggaggccaataaagccgatgacgatatgcatgatcggtgccggaggcttcatcggctcccacctttgcgagaaattgatgtcggagacgccgcacaaggtgctcgccttggacgtttacaatgacaagatcaagcacctactcgagcctgactctctcccttgggctggccgtattcagttccaccgacttaacatcaagcacgattctaggctcgaaggccttatcaagatggcagatctcgtgataaatcttgctgccatctgtactccggcagattataatacgcgtgcactagacacgatttacagcaattttattgatgcaacttctgtggtgacgtactgttcagagaacaac

SEQ ID NO: 16665 - DNA, 480 bp, Gossypium hirsutum
  Clone ID: uC-gsflnu33B100e08b1
atttttgttagcaatgtgtcagctgacttggacccggagaagttgcttgagttttttaaacagtatggggaagttgaggaaggtccattggggctcgataagcaaactgggaaaccaaaggggtttgccctttttgtatacaggtcggttgagagtgcgaggaaagcgttagaagagcctcataaaaattttgaaggtcatgttttgcattgccaaaaagccattgatgggccgaaatcgactaaagggggttacggaggaggtacttccggtgggcatcatcagcagtaccaacagcatcagcatcagcaaggacatcagattcagtctcatttccatcatgctaagaagggaaagtactcatctggtggatcagagactggtcatttgatggctccatctggacctactgcagttgggttcaaccctggagttgctgctggtgggtttaaccctgctgctgctgcacctgctttaaac

SEQ ID NO: 16666 - DNA, 479 bp, Gossypium hirsutum
  Clone ID: uC-gsflnu33B100e10b1
ttggtttctaagatattccttccccttcctttcctttctatttcttcttctctccctctctttcaaccttcttctccactttcctttgttgctttttcaacaatggatgcatcttctacaagctcagtcaatgggttctataccttcttgactcgtggcatagatgatcttgaacgtgtttatctctctaataacttcatgtccatacaattccttcaaagggttctttcccttctccgatctttccactcccagctactcctcctcgtccaaaaactccaccttcccgtcggtgataagtggctcgatgaatacatggatgaaagttctaagctctgggaagcttgtcatgttattaaatcaggcatctccggcatcgaaaattattactcggctggctttaacatcatttcttcttttgataatcatcgccatcttactcaccagctttctagacaggtaatccgggcaattcggcg

SEQ ID NO: 16667 - DNA, 426 bp, Gossypium hirsutum
  Clone ID: uC-gsflnu33B100e11b1
tcgttcagctcttttcttctcttgtgacactgctaatatttttttattgtcgtctccggcgttcgaagatcataaaaaaccggagtcgtttcaaatggctacgagaacggatctagatgggaggccaataaagccgatgacgatatgcatgatcggtgccggaggcttcatcggctcccacctttgcgagaaattgatgtcggagacgccgcacaaggtgctcgcctgggacgtttacaatgacaagatcaagcacctcctcgagcctgactctctcccttgggctggccgtattcagttccaccgacttaacatcaagcacgattctaggctcgaaggcctcatcaagatggcagatctcgtgataaatcttgctgccatctgtactccggcagattataatacgcgtccactagacacgattta

SEQ ID NO: 16668 - DNA, 407 bp, Gossypium hirsutum
  Clone ID: uC-gsflnu33B100e12b1
ttgttattttcctacagatgtgtgctcaatgaccgcaacaagccaattctgttcacaatggcaaggcttgatcgtgtcaagaacttaaccggactcgtcgagtggtacggcaagaacgcaaagttgcgtgagttggctaacctcgtagttgtaggtggtgataggcgaaaggaatctaaagatttggaagagaaggccgaaatgaagaaaatgtttgagctgatcgagaagtacaacttgaacggccaattcagatggatatcatctcaaatgaacagaatccgaaatggtgaactttaccgatacatttgcgacacgaaaggtgcctttgtacagcctgcattgtatgaagcctttggattgacaagttgtggaggcaatgattgcggtttgccaacattcgcaac

SEQ ID NO: 16669 - DNA, 464 bp, Gossypium hirsutum
  Clone ID: uC-gsflnu33B100f03b1
tcgttcacgcgtccgcccacgcgtccgttttgcctcgctgtagcaccggtctatggccaatactactccaaaactatcaaggcaggtcctcgggtggaaaagatgacccgacttcgcttcttctaccacgatattcccgatggaaaagatcctactacattcctgatagctcaggccaacatcacccggaaattcttttccccatccccatacggaagcttgtattcaatggatgatcccctcactctagggcctaaccgaacatccaagatggttggaaatgcccaagggctctacttagcattaagtcgagaccctaccaagttctctgcggttttttacgctgattttcgtttaccactggcaagttcaaggggagctcctttagcttgatctcacgatatccgctcacagatttggtcctggccctaacataatgcgtgagatgcaatagtgggaaggac

SEQ ID NO: 16670 - DNA, 481 bp, Gossypium hirsutum
  unsure (1)..(481): unsure at all n locations
  Clone ID: uC-gsflnu33B100f04b1
gtttcctaactttacggcaagcaagggcttcagcagcgaaggttgagggtactctttgatgaatctccaagcatgataggaggaccagccctgcactgcctcatacagcaactccagatgctgactgttgattcctctcatcgtaggctccatcgaaattaatttttactgtttgaacaggtgggcgtttccattttatttcctccgttaaacctttgaatgttctttgtccgacgccatttaactctgatatatagttgtggacaaattttgctatctcctgaccagatttatttttctttttatgaatacgagcattcttgtcccccagatggcccatagcgcacagcaaaatattctgcaaagactggaaggctgttgagcgaaaaccctggacattcgcggaagaggactaaaggtgatccattgnttctactccttcaccacaacggggacaagcggaactgttttttagtcttct

SEQ ID NO: 16671 - DNA, 481 bp, Gossypium hirsutum
  Clone ID: uC-gsflnu33B100f05b1
tgttttctctcattctttacccggaacacaaataaacactaagaacaagacaatggcaccaaaagctgagaagaagccagctgagaagaagccagctgaggagaagaagacggtagctgagaaagcccccgccgagaagaagccaaaggcaggcaaaaagcttcccaaggaaggcggagctgcggccggagacaagaagaagaagagggccaagaagagtactgagacctacaagatctacatcttcaaggtcttgaagcaagttcaccctgatatcggtatctcaagcaaagctatgggaatcatgaacagcttcatcaatgatatctttgaaaagcttgcccaagaagcgtctaggctcgcaaggtacaacaagaagcctaccatcacttccagggaaatccagaccgctgttaggcttgtacttcccggtgagcttgcgaaacacgccgtttctgaagggaccaaggccgtcaccaag

SEQ ID NO: 16672 - DNA, 278 bp, Gossypium hirsutum
  Clone ID: uC-gsflnu33B100f06b1
tatgatagagagatggggcagttgtgcatagagctcaacgtggatatgatgggacttgtgcttgcgctagttatcgccatcgctctcttgctttcctgcgtcaaccaacctccccggccccgccgaccaatggttgttactcatcgtttaggttggtaaacccttcgttttgcgtctttactccccaagttactcgagtaacttaagtctcataaggtcattgaaaattgaatccatgtataaactcctttatttttttgtgaattaagtaattgtat

SEQ ID NO: 16673 - DNA, 437 bp, Gossypium hirsutum
  Clone ID: uC-gsflnu33B100f07b1
ccacttttgcccggtcttttgttattattgatcctcctcttttcactctgttcttcgctaatatcctctctcgcggagttccgggggcatattaattacttcaccctcccctgcttgtcctttcttcttccatcattcctcatttttctgctttggaaatcttctaggcttgtagctaagctaagctaaactaaacttcgaagacatggatcttcttcactcctttagctcattagctcttattctgtatctcattgccttaactctgaactctaaaggtgcattaggtgcttctttcacatttgtcaatcgatgtgggtacacggtgtggcctgggatattagcaaatgcaggccgtcctacactcgacagcactgggttcgagctaccaaaggactcgtctcgttcatttcaagccccaactggctggtcgggtc

SEQ ID NO: 16674 - DNA, 371 bp, Gossypium hirsutum
  Clone ID: uC-gsflnu33B100f08b1
tttatttttaaaaaaaaaaaaaaaaaaaaaaaggaaagatataaaaaagaaatatggccaatactactacaaaactattaaggcaggtcctcgggtggaaagagaatgacccgacttagctgggggtgcccctttttgggggcccaagtttatccccctgcgtttctgatagcttaggttttctttgggcgcccataattttacccatccgcccacggtttcccaccttcaatgggggaaaccctctgtgttgcccctatttaaacatttaggatggctgcccttttccacggggtgtacttaacattaaggggcgaccctactaagctttttgaaaaattttacgctctttttgggcttacgactgcccc

SEQ ID NO: 16675 - DNA, 458 bp, Gossypium hirsutum
  unsure (1)..(458): unsure at all n locations
  Clone ID: uC-gsflnu33B100f10b1
gtantctaactttacggcaagcaagggcttcaggagcctatgatgagggcactggttgatgaatctccaagcatgataggaggaccagccctgcactgcctcatacagaaactccagatgctgactgttgattcctctaatccgaagctccatcgaaattaatttttactgtgtgaacaggtgggcgtttacattttatttactacggtcaaccttagaacggtctttgaccggcgccatataactatggtatataggctgggacaaactgatgctatcttctgacgagattgatttgtatttataggacagctagcattcttgacccccagatggcccatagagcacaggaatatgttctgcagggactgcaagggtgctaagcgaataccctggacattcgcggcggaggactaataggtgatccattggttctactccttcaccacaacggtgac

SEQ ID NO: 16676 - DNA, 394 bp, Gossypium hirsutum
  Clone ID: uC-gsflnu33B100g01b1
tcggtacattggagctacactgcctcctgggtttaggttttaccccagtgatgaggaattggtctgtcattatctctacaaaaagattgccaatgaggaggtcttgaagggtacgttggtggaaattgatttgcatacatgtgagccatggcagcttcctgaggtggcaaagctgaacgcaaacgagtggtatttcttcagcttccgtgacagaaagtacgcgacggggttccggacgaaccgagcgacaacatccgggtactggaaggcgacggggaaggatcgaatggtgatggactcaagaacacaagaggtggtagggatgagaaagacattggtattttacatgaaccgagctcccaatggaatcaaaacaggtttggatcatgcatga

SEQ ID NO: 16677 - DNA, 464 bp, Gossypium hirsutum
  Clone ID: uC-gsflnu33B100g02b1
tcgttcacgcgtccgtcttcctatcatttctttccccctcttccctctctacacgcctaagatacctgaagatggaatctttttaattagttttcttttttaccgtcagcaagtgtttggagaaatgccagaatcatggccaccttcacctcctccacctatacttctgtctcgcctcattcgtttttaacgcacttccgtgctcgggttttcccatcctgtttctgcgggattaacccagggaacaaagggaattcggtgtctctgaagctgaatcttgttcgcgggttggtgtttggggaagataagaaaagggtttcttggtggtcttgttgttgcaagaaagggtgggacaacgacggggatttagcattggaggcagatatttggagttcatgaaaaatagtgacaaacctgaggctttttcagcaagaaagagctggctgatgctgggaggatggatc

SEQ ID NO: 16678 - DNA, 484 bp, Gossypium hirsutum
  unsure (1)..(484): unsure at all n locations
  Clone ID: uC-gsflnu33B100g04b1
attttccagagctttttctcagctctctctctctctctctcatcttttacatggcatctcaagccagcctcctccttcaaaaacagctcaaagatctttgtaagaatccggttgatgggttctcggctggattggtcgatgagaacaatatctttgaatggagtgtaacaattattggacctcctgatactctttatgaaggngggatttttcaatgctatcatgagttttccaccaaattatccaaacagccctccaacagtcaaatttacatcagagatttggcatcctaatgtttatcctgatggncgtgtttgcatatcaattcttcatcctccgggtggatgatccaaatggctatgagcttgcaagtgagcgctggatgccagtccatacagttgaaagtattggtttgagtatcatatcaatgctttccagccctaacgatgaatcccctgcgaatgttgaagctgcaaaagaatgg

SEQ ID NO: 16679 - DNA, 476 bp, Gossypium hirsutum
  Clone ID: uC-gsflnu33B100g05b1
cgaattctaaaaaagaaaaaaacctacaacatgaaacccctcttctccgtcccattcttaaccttcctcttcttccatttctactcagtcccgaccctcagttcctacgtatacgacactagcgccaccaccaccaacgtcatcaactctacagatttcattcgtacaagctgctacgccaccttgtatcccgatatttgctatacttccctttatggctatgccaacgccatccaacaagacccagctcgtctagctcgtgccgccattagtgtcagcctctctaaaggctcgtaacatggcagtctacgtctctaacctctcccgggaagccgattacggcgccgacccaagagccagcgcagccttgacgactgtttctcgacatgggtgatgcagtggatgaatccgtgggtcgctgaagcaaatgcacgggtagtggctccaggttcggagtcttcaagttccaaatgggg

SEQ ID NO: 16680 - DNA, 307 bp, Gossypium hirsutum
  Clone ID: uC-gsflnu33B100g07b1
ttgttattcgtccgtcacctatcatttatttgaggttttatccaagagatgagggtttgatcactcatgatcgagtacattacaattaccaatgaggagttgctgaggggtacgtaggtggaaattgattggtctacatgggagccatggctggtaacagaggcgggaaagctgtaaacaaacgagcggtatatattaagcttccgtgacatgaaatgacgcgacggggcatcggacgagccgatcgacaacattcggatactggaaggcgacagggaaggaacgaatggtgatggactcaagaaca

SEQ ID NO: 16681 - DNA, 525 bp, Gossypium hirsutum
  unsure (1)..(525): unsure at all n locations
  Clone ID: uC-gsflnu33B100g08b1
cggcccggactgactggctcgaccgacgcatgcgttctattttttctctcccatcatcaaacagaacctcccattacattttcctttattttccttctttattacaagtgcaaaagaaatatgagtcagatttgttcctgaaggtaactgcaaaaaaattggaggattggccacaccaactccaggaaaatcgaagaggcctcatcgttttcgagcaggaactaggtctcttcaagagatccggaaataccagaagacctcaaatctactcgttcctactgccagcttcatcagagaaatagagccaatcccaagtggaaatctgcctcctggttttgatcctattgaaggttgcaagcttatcagaaaggaaaatgtattattttcaagattttccctcttctttttttccctttatgaagctgtgagggtgcactataatgaatattntatatggagctttaattctctgcctctggaaggtacctttttttgaagcaatgtaggaatgggatagcaatgtag

SEQ ID NO: 16682 - DNA, 210 bp, Gossypium hirsutum
  Clone ID: uC-gsflnu33B100g09b1
cgttggtttctccatatttgatctcaaatgtgagggaaaatcatgcttattataagcctctacttcacattattgtactgagcttcgggttttctttttcctttatttctttttatgtgttgtgtttcgattggtatcttatagtcgtgtaatatcacatacgtgtgatttctcaccaataatcatatattagtattgtttccacctaag

SEQ ID NO: 16683 - DNA, 442 bp, Gossypium hirsutum
  Clone ID: uC-gsflnu33B100g11b1
ttggttgattaaagccactggttgtaatgtttggttgatccaaaagagtattctgagagatgcagtcacggatttatcattgcattatttggccaaggctaagattatggttgctaaggatgttgagagggaagatattgagtttattaccaagactttgaattgcttgcctattgctaatattgagcactttcgagtggagaagctggggcatgcagatcttgatgaggaggtttcactcggcgatggaaagagtgttaaggttactgggatcaaggatatgtgaagaaccacacatgtcttagttaggggttcgaatcagctgggactcgactaacctgacaggagtttacacgatgccttatgtgtgggaaggtgtttagagcgtaaaaggttcttgattgcaagtgcgggggcccctgaaactgaatcgacggggcag

SEQ ID NO: 16684 - DNA, 61 bp, Gossypium hirsutum
  Clone ID: uC-gsflnu33B100h01b1
gttgagtaaaagtccaagacaaccccccccgggagtcattaaaaaaccaacccacacacaa

SEQ ID NO: 16685 - DNA, 470 bp, Gossypium hirsutum
  Clone ID: uC-gsflnu33B100h03b1
tcggttaacgcctcgtttccgcaaaaaccctagagagaacaaaatggcggaaagagctccaatcgagtccgtacaatgtttcggtcggaagaagacagcggtagccgtaacctattgcaagagaggccgcggtctgatcaagatcaacggttgtcccatcgagttagttgagccggagatcctccgtttcaaggccgtggagcctatccttctcctcggtcgccaacgtttcgccggcgtcgacatgaggattctagtcaaaggtggaggtcacacatctcagatctacgctatccgtcaaagcattgccaaagccctcgttgctttttaccagaagtacgttgacgagcaaagcaagaaggagattaaggatattttggtcaggtacgataggactttgctggtggctgatccgaggaggtgcgaaccgaaaaagttcggtgggagaggtgctagggcaaggttccaga

SEQ ID NO: 16686 - DNA, 391 bp, Gossypium hirsutum
  unsure (1)..(391): unsure at all n locations
  Clone ID: uC-gsflnu33B100h04b1
ctttttgccgcgtgccggtcgcaggacggactgggaattgggataggggagaaatggtttgggaaaaataaaacgaggaaaaattgagaagctattttaggatgtctttggggagcctcagatggagggacgccagcgactatattcacatcagtgaggagatcagattttgtaaatgaacggtacaggattcatgggaattctggagatcaatgctgtgacttgctgtgttttgcagtgggtaaacgtttctttaagctgacaaatccaatgtattacattgcctaaacaagcaatccttttgttggaagtcttcacttctagcatgcaaatttcatgactagattatcttaaacaagtgattttttttaatttctttgattttctgngt

SEQ ID NO: 16687 - DNA, 387 bp, Gossypium hirsutum
  Clone ID: uC-gsflnu33B100h05b1
gttgtatacccgtggggttttgaagatcttcttggagaacgtgattcgtgatgcagtaacctacaccgaacatgcgaggaggaagactgtgactgctatggatgtggtttatgcactgaagaggcagggcaggacattgtatgggtttggtggttagatgatttagggattagatctttctgcgatgttggcggatctggactagttctcatgatatcaagaatgttttaggattaggaatagggcttgtaattaaagggtgctattgggattattggaaattataatttggtcgtgtggttttctttggtgatttgcaattcgtgccatgaattgcagattttaatgaaatttggaatttaatttcggcaaatactttaatttact

SEQ ID NO: 16688 - DNA, 432 bp, Gossypium hirsutum
  unsure (1)..(432): unsure at all n locations
  Clone ID: uC-gsflnu33B100h06b1
gtggtttgtgggaaatcatctcctgataatgaggcaatgaagctagccccatgtgctgaagctgcacaagatgagaatgcccctgtttcagccagttgctgcgcccaggtgaggaaaatcggccaaagtccgaaatgtctctgtgccgttatgctctctaacactgctaaagcatctggaatcaagcctgagattgccgtaaccatccctaaacgctgcaacatagccaaccgtccagtcggttacaaatgtggagcatatacacttccttgaaaggaaaatttgggagacataaaaagtgctggagctcacttgttgtaccacttaatatgtagctttaagcttacctttgtatgaataacagcttaaagcatgtttatattatatccaatnttgaagttcaataaaatcatccatgtttctgcttttaaa

SEQ ID NO: 16689 - DNA, 406 bp, Gossypium hirsutum
  Clone ID: uC-gsflnu33B100h07b1
cgttccggaattcctttgccgtcccacgcgcccggtcgatttcttttgcaggacaatgaccccagggtgtagtttttaagacaggtttagatggtatccgcctgcttgaccctagcaccagccgtactttgagaatatatcccattgagaacatcacaagatgtgaattgaccgacacatctacttttgcattttgggcttacagcctttgtcgacatttgaaccttttacggaacaggggtggaacaaaaccagtgaccctactaacagccctttattgtattggtgcagactctggttttcaggtccggggtattgggttctttagctgattctatttaactctttaaaagttctttctctctcttttgcagggatttgcaatacttttgtttttagataaact

SEQ ID NO: 16690 - DNA, 304 bp, Gossypium hirsutum
  Clone ID: uC-gsflnu33B100h08b1
tcgtttacgcgtccgtaactctattttcatgttatcgtgtttaggccagagcattacgccacacggcataaaatatgcatctcaaagactagatacatttgcatgtgttaggtatagaaaaaggtgcctccatttgggcgataacaacgtatgccccatagaggcttactggccttacactatgttgtcctttgaggcaaaaggcttaacaagcaattgaccccatcattgccctgtattggacaggaggattcttgggctttatggtccggagttatggattctctggcggttgaattgaaag

SEQ ID NO: 16691 - DNA, 362 bp, Gossypium hirsutum
  Clone ID: uC-gsflnu33B100h09b1
gttatttctttcaacaaggacagatctgtttatgaactccgctacttcaatattgccgagaatgaaggggaggaggaagaatgaagaatcagttccacattgtttttttctagtttactgctttattatttcttaggaacctctttttatctatttaaggtgtcatgttctgctttattccttcagaccttactctaatttgcaatgaaattttgattgctgatcgtggttcccgacgaacccagcaaaaacatacaagtactgaaaggtcagcggatctaaactatcctacctgaccatccaacgcctgagacgtcatagcttttcaccagaattaccttaactgaccacactggtccacc

SEQ ID NO: 16692 - DNA, 429 bp, Gossypium hirsutum
  Clone ID: uC-gsflnu33B100h10b1
tgttggctagtgacttcacccttcaaaaccgtagccaccgttccatgccgatctgcttctaagacgccatcgccggcgcgctccggttcaagtctcacgtttctccattcccttccacttatttgcttactcgccgcttctctactggttcagcgggtactgctgtgaagaagagggctgaggatgtaatgcctatcgccactggtcatgagcgcaaggagcttcaggctgagcttgagggaaagaaaattcttgaggaggtaaacactccagtcggaccttttggcacaaaggaatctcctgctgtcgttaagtcctactacaacaagagaatagttggatgcccaggaggtgtaggtgaggatgaacacgatgttgactggttttggctggaaaaaggcaaaccacatgagtgctcagtttgctcac

SEQ ID NO: 16693 - DNA, 475 bp, Gossypium hirsutum
  Clone ID: uC-gsflnu33B100h12b1
attcttttagcttttcatcagctgtctctctgtctctcttatctttgacatggcatgtgaagccaaccttctccttcaaaaacagctcaaagatctttgtgagactccggttgatgggttctcggatggattgatcgatgagaacaatatctggtgaatggagtcggacaattattggacctcctgatactctttatgaagaggggagttattcaatgctatcatgagttttgcaccaaattatccaaacagccctacaacaggcaaatttacatacagagatttggcatgcttatggttatcctgatgggcgtgtttgcatatcaattcttcatcctacggaggatgatccaaatggctatgagcttgcaagagagcgctggatgccagtccatacaggtgagagctttgattagagtatcatctcaatgctttgcagccctaacgatgaatccgctgcgaatgttgaagctgc

SEQ ID NO: 16694 - DNA, 529 bp, Gossypium hirsutum
  Clone ID: uC-gsflnu33B101a02b1
gtttaacttcagaagcaagcagctagcagtttgctttgaattatactactataactccaccactttccaccagatttacattgcagatggcttcatcaatgctgtgggcttcaagggcggcttcttatcttaggatctctgtcttccacagaggcttttccactgttctaaaggatctgaaatatgcggattctcatgagtgggtgaaggttgagggtaactctgccactattggtattactgatcatgctcaagatcatttaggtgatgttgtgtatgttgaattacccgaagtgggagctgctgtaaagcaaggtgaaagttttggagcagttgaaagtgttaaggctactagtgatgttaattctcctgtttcaggaaaagtggttgaagttaatgaagagctcagtggctctcctgctaaggttaactcaagtccatatgaggatggatggattataaaggttgagatgaaagatgctggggagctgaggaacttgatggactcagaagaatactctaagttctg

SEQ ID NO: 16695 - DNA, 350 bp, Gossypium hirsutum
  Clone ID: uC-gsflnu33B101a03b1
cctgcctattcgtacatgtgggcaacctccgggggcgaagtttaatcaggttttggatccgtcacgcgcgagcagatcgacagcaacaccttggatatggtgagggcaggaacaatgcttgacacaacccgtcggagctggacccaaaaatactctattatttaaagtgctactacgtatggaataggagggctaaatccccagtgactttggcctttaacttaattgtgagatttagtcacctatttacatactggacctagccctccttaaaaacacaatattcttgctagttgctcgaatgaaaaggatgttgcaaaacttaaatccccttttcttaacaataaaaa

SEQ ID NO: 16696 - DNA, 489 bp, Gossypium hirsutum
  Clone ID: uC-gsflnu33B101a04b1
gcggtttcttgggataattggaagagaagaatccctttgcagagatgtggaaaagacttcactattatgaaagtgttaccatcgggtgtttaccagtataggttcattgccgatggacaatggaggtatgcccctgacttgccatgggctcaagacgggacgggcaatgctaacaacattttggacttgcaggattatgttccggaagatattgcaagtatatctagtttcgaacctccgctgtcccccgagtcaagttacagtaatttgccgcttggagccgaagatttcgctaaggagccaccactcgtccctcctcacctacaacttcctctccttaatctacctgcatctcacatggagatcccgccacctctgtcgagaccaaagcacgtaatcctcaaccatctgtacattcaaaaggagaaaaatggccaacccgtggtggcactcggttcgactcatcggtttcgagccaagtatgtgact

SEQ ID NO: 16697 - DNA, 457 bp, Gossypium hirsutum
  Clone ID: uC-gsflnu33B101a05b1
gcggcttatctctagccactctttgatcaacttgccaatgggggcttataagtacgtgtcggagctatggaggaagaagcagtcggatgtgatgaggtttttacagagggtgaggtgctgggaataccgccagcatccgtcaattgttagggtcaaccattctactcgccctgacaaggcacgccgcttgggttataaggccaaacaaggttatgtggtttaccgtgtccgtgttaggaggtgtggtcgcaagaggcctgttcctaagggtatcgtgtatggtaagcccacaaaccagggtgtcacccaattgaagttccagcgcagcaagcggtctgttgctgaggagcgtgctggacgaaagttgtgaggtctcagaggtggtaactcgtactggatcaatgaggaccctacgtacacgtactttgaggttattctggaggatgctgcacacaat

SEQ ID NO: 16698 - DNA, 510 bp, Gossypium hirsutum
  unsure (1)..(510): unsure at all n locations
  Clone ID: uC-gsflnu33B101a07b1
ttctttttttcttcttcctcttcctctcttttcttcatagccgccacaccttccaccatctttggaccataatatttttcatctttcttgccaaatcttcaacgttcgaattaattcccctgtcactgttgcatcttacatcatcctcgagtcactgatttcactctccttgtcgatttacctctattcatttgaatcaccattgacgttgagattgtcgaccttagatctatatatattcgctgtagatcgtttgaagcaccagatctaggagaatcttatcaaaattgatccgaaagagtgtgccgaaatagtgacagggtcgtacgggcgtgtagggtgacaggtgtgggccataattatgtagtgtgtgtgtatgtgngtcgtgtgcttcagtcgattgtgtgggcgttacaatgcttattcagttttttttaatgaatactgaataaaatcgatctgtgaatctaattacaatgagaattatcagatctaaaaaggataacatct

SEQ ID NO: 16699 - DNA, 461 bp, Gossypium hirsutum
  unsure (1)..(461): unsure at all n locations
  Clone ID: uC-gsflnu33B101a10b1
tattcgctcacggcgtataaatctgctcaggaaattgcaacttcggagctggctccaactcatcctattcgattagggttggctctgaacttctctgtcttctactacgagatcttgaattctcctgaccgtgcttgcagtcttgccaaacaggcttttgatgaagccatctccgagctggatactcttggagaggattcatacaaggacagcactttgataatgcaactccttcgtgataatctcaccttatggacttcagatatgcaggacaatgcaaccaacgagatcaaagaagctcccaaacgcgaggaagagaaacaagagtgaaatcgccaatcttcacggtacgattttacttctctggttatttttgatggagaaagtgctcggttccgctatccccttgattcccctccagtacttngtcttagatcatgcctctcggtttatgaaccatc

SEQ ID NO: 16700 - DNA, 464 bp, Gossypium hirsutum
  unsure (1)..(464): unsure at all n locations
  Clone ID: uC-gsflnu33B101a12b1
ttgcttttaaaccctttagtatatggtactatctatgccttcccttttctgtcttccctttatggctccaattttctcttcgtttcttgctttaactctcatttttccattaagcaatgctcaaggtccaccttcccctggattctccccaagctccagagtgagcactgtggcttttgataaagggtttcgaaacctctggggtcctcagcaccaaaaactagaccagggctcattaacagtctggctcgataaaagctcaggnagtggtttcaagtcacttcgttcgtaccagtcaggttactttggtgctgcaatgaaactccaacctggttatacagcaggagtgattacatctttctatctttcaaacaatgaagaacaccccngaaatcatgacgaaatcgactcgagttccttggaacaacgccggataaaccctacacattgcagaccaatgtgta

SEQ ID NO: 16701 - DNA, 526 bp, Gossypium hirsutum
  unsure (1)..(526): unsure at all n locations
  Clone ID: uC-gsflnu33B101b02b1
gtttctttcatatatacccaagccacctattgtaaagcctgcaccgtatacacccaaacccccggttgtgaagcctccatatatacccaaaccaccggttgtgaagcctccgacatatacacccaaaccgccggctgtgaagcctccgccatatacacccaaaccgccggttgggaagtctccgccatatacacccaagccaccttactatccaataccgccggtcatatcaccaccaacactgcctccaaagccaccagtctaccccagtccaccaatagtgaatccaccaacaccgccggttgtgaagcctccgccatatacacccaagccaccttactatccaataccgccggtcatatcaccaccaatactgcctccaaagccaccagtccaccccagtccaccaatagtgaacccaccaacaccgccgattctaccaccaccatcaccacctattgtgaagccaccaacgcctnctatcgtgaagccaccttcaccggaaacaccgtgtcctccaccacca

SEQ ID NO: 16702 - DNA, 540 bp, Gossypium hirsutum
  Clone ID: uC-gsflnu33B101b04b1
gtttattataatcggatcaatcattgagtttgttggggtttgtaattaggtagcggcgtacttgattaagaaacgaagaaaagctagatcttttgagccaatgcctatatatggtacccttcctttcggaggagcaagcccctatatcggaataagctcgaaatcagtcaacccccgccctgttcccaacttaaaccttaagttaaagatgccttttgctgaaatattagaggcaaccaataacttcgaggctaagttgttgattggggaaggaggctttggtaaagtctacaaagggattctaagaaatggtctcaaagctgcagtcaaaagaagtgagtccaaacatggtcaggggctgtccgaattccaaactgaggtaatgattctatccaagattcgacaccgccatcttgtttcactgatcggatattgcgatgaagggtctgagatgatactggtttatgagttcatggagagagggactctcagggatcatctatacaagttgggagggaatcccgagagatcatcttcact

SEQ ID NO: 16703 - DNA, 266 bp, Gossypium hirsutum
  Clone ID: uC-gsflnu33B101b05b1
tttattaccaaaaacagttagacaagttgaggaagaacccattcctgagcatgttcagaagatgtttgatgaagtaaaagacactgatcatcatcaccaccatcatcatggtcatgcccatggtcatgatcatgatcatgcagctggatttatggatgcatacggtcttggtcacacatggggaagttgagatgtgtttttccacggtcacggcgtgatcgcatggcccttggtcatgatcatgcatatagatttatggatgcata

SEQ ID NO: 16704 - DNA, 258 bp, Gossypium hirsutum
  Clone ID: uC-gsflnu33B101b06b1
gttattcaatgggtcactcaagcagtaacagtaagtaagatgtataaaagagtaagcggctgcacaaggcggtcgatgaccttatgtcattcaagatcccggccgtgagcggcggcagctgctgctatattaaatgatcattaaataaagggaaggggtctggtatgaatgaggctgcgctagtatgagattggaacatcaacttattaattaattctggggttttaacttgatgggagcacttatgtggagtgcatt

SEQ ID NO: 16705 - DNA, 524 bp, Gossypium hirsutum
  unsure (1)..(524): unsure at all n locations
  Clone ID: uC-gsflnu33B101b08b1
aattaaccctctaactatatcgtatttatcacttaggtgcctaagatttttttttttgcaaaaatgatatttaaacggttaattttatcttattttaccaaatatagcatcatgttttattggcatcgtacacttttttagataaaatttaacgaaagtaatagtttaagcatatttttgaccaaaaaaattatgtacttaaattgagaaaattgacatagtttagacagtaattttgcagttaaacctttttctatttatttgatgcatatgaagattttcccatttattgatgttttatatttatatttatttatttatatcagtagtgaatattatttattaagtgttgtatttagttgataggggtggtactgaggtgctcatgagtcaggtcgagttcagattgagtctaagcgtgatattaacatatattatgcttgtccaaatccggccatcatgataaacaattntaatctttttttattattttaatatcttacatattntatgngntattatta

SEQ ID NO: 16706 - DNA, 519 bp, Gossypium hirsutum
  Clone ID: uC-gsflnu33B101b09b1
cgtagattttcacaccgagagctaaaagtacttcatcattacctggtacaccgattgcacattcaaaccccgagtccacgcacggggggcagaaaggagggatcaccggaccacccattcatcgttcgcattcagtgcctacacttaacaaagatggaagcataacgcaattggattcttttggcggtgtatttcgtgtaattcctacaactccacgagtagtcaaaggaacagttgtaacaacatcaaacatagttatcaaaagtgatatggatggaaacggtgatgatggtgaagatattcccgaagaagaagctgtttgtcgaatttgcttgatcgaactcggagaaggagccgagacccttaagatggaatgtagctgcaaaggtgaacttgcccttgcgcaccaagaatgtgccatacaatggtttagcatcaaaggtaacaaaatgtgtgacgtgtgcaagcaagaggttcaaaacttacccgtcactcttttacggattaaaacgctcagct

SEQ ID NO: 16707 - DNA, 402 bp, Gossypium hirsutum
  Clone ID: uC-gsflnu33B101b10b1
atctgggaaaaagcaaacgcagccgtaatgagcggatccactaccgcagcgtgtttagctagaagagcagttcacacagagagtgattaggattatctaccggcgagccctcaaagataccgtcaattggaccgaccatcgccacctcttctattaagatgcctttgatctttggggaacatgcgaaacccaccagccttgtgaaggatcttggcacaatggacataatgatagctgcaggccaagcaacctataataagtggcggcatcctgagccttatattgctccatgggctcctggcggttgcaagtgcactcacaacccttgtcctgcatttgagattgggattttatatgaatatggtagaggaggaaatgattaaacatgatctttctacccca

SEQ ID NO: 16708 - DNA, 417 bp, Gossypium hirsutum
  Clone ID: uC-gsflnu33B101b12b1
tttatcaatgctgtgggcttcaagggcggcttcttacctcaggatctctgtctcccacagaggcttttccactgttctaaaggatctgacctatgcggattctcatgagtgggtgaaggttgagggtgactctgccactattggtattactgatcatgctcaagatcattaaggtgatgtggtgtatgatgaattaccccaagtgggagctgctgtaaagcaaggtgaaagttttggagcacttgaaagtgtcaaggctacaagtgatgttaattctcctgtttcaggaaaagtgggtgaagttaatgatgagctcaccggctctcctgctaaggttaactcaagtccatatgaggatggatggatataaaggctgagatgaaagatgctgtggagttgaagaacttgatggactca

SEQ ID NO: 16709 - DNA, 526 bp, Gossypium hirsutum
  unsure (1)..(526): unsure at all n locations
  Clone ID: uC-gsflnu33B101c02b1
cctactcgtccgcccacgcgtccggaaaaggagaagcttccgagaagcccaccgtcaggtccgagtggtgggctaacgaaaaggttgccggaaaggaagctaggccaggtaacaattggactttcttccctatgttacagccggaggtcagttgattttgtaactatgcaacttagtttcacctccatgcataaaagtcataaaacttgtttaataggtttgcaacactaaaccctgtagcgtttcagttgttttatctgaagttcgtactttctctcaatagtctttggtataattagatggtgaagtgaactaaaagactagttttcagaggtcgaaagagtctttattccttatgacctaaaaggtgattccagtgagggaatatttcatagggatcaaactatgttggtactgatagagcattcttttaatattcatttacctaatgttataccatataaaaaaaaccagtatttacatgtagnngttgattattattttcttcttttaaatatgtaatagt

SEQ ID NO: 16710 - DNA, 485 bp, Gossypium hirsutum
  Clone ID: uC-gsflnu33B101c03b1
cccacgcgtccgggagcctccttcaccatcgactgtgcgaagccggttgaggataagatcatggacatcgcttctttggagaagttccttcaggaaaggatcaaggctggtggcaaagctggtgctctaggtgactccgtcactgtcacccgcgacaagacccgtatcacggttacctctgactccaacttctctaagcggtaccttaaatacttgactaagaagtacttgaagaagcacaatgtccgggattggcttcgggtgattgcttccaacaaggaccgtaatgtttatgaactccgctacttcaatattgctgagaatgacagggaagaggaagaatgagcaatcagttcagttacttttctctgttacctatctggtttattagttctgaggaaacttgtttgtgtcaaatcgttggacttgtttgggtttgctttttgacccttggctttattttcaatgaagttttggttgctgat

SEQ ID NO: 16711 - DNA, 539 bp, Gossypium hirsutum
  Clone ID: uC-gsflnu33B101c04b1
atttccagtacttctccagcatttgttgtcttttaccctaccgagaaatggcaaaatccatttttgcattaccaattttgcttggattatgctatctggctactgatgtgagtgccttcacggcttctgggtggaccaaagcacatgctacattttatggaggcagtgatgcctcaggaactatggggggagcttgtggatatgggaacttgtattcaactgggtatggaaccaggactgctgctttaagcacagccttgttcaatgatggagcttcatgtggacaatgctacaagatcatgtgtgattaccaagctgaccctaaatggtgcataaaaggaacatccgtcaccatcacagccacaaacttttgccctcctaactttgctcttcccaacaatgccggagggttggtgcaaccctcctctccagcactttgatatggctcagcctgcctgggaaaagattggtatctacagaggtggcattgtgcctgttttggttcaaaggtaagtaccatccccatggaccccatcaca

SEQ ID NO: 16712 - DNA, 259 bp, Gossypium hirsutum
  Clone ID: uC-gsflnu33B101c08b1
tttctttcccttaagctgccgtcattattgagggagcaacttgcattggagatgagggcaagggcacacggttttaaggaaaggactcatgagcataggcactgcggtgaagaggtagctggtactggaggtgactacgccactgtcacaagtgaccagaccggtcttacgggttcctcagactcccagttacataagcgaatccgtgtatgctgatgtccacaggactggcaaaatcgcagttgcacttatcggctgg

SEQ ID NO: 16713 - DNA, 526 bp, Gossypium hirsutum
  Clone ID: uC-gsflnu33B101c11b1
aaacagggaaaaaaaaacaccttcttgggggaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgcttgaaagtgcgcttaatggaaagaaattctttggtggagaaaccattggaatggtagatattgctgctagctcttgtgggtatctcattagggtcactc

SEQ ID NO: 16714 - DNA, 496 bp, Gossypium hirsutum
  Clone ID: uC-gsflnu33B101c12b1
cccacgcgtccggacaatatgaaggttacagggacgacccaacagttcccaaccactcaaacactcccacatttgcaactgttattctccgtatacataatgaaagatgggaaggtgtcccgtttattctaaaggcagggaaagcattgaattcaagaaaagcagagatacgtgttcaatttaaggatgttcctggtgatatatttaaatgtcaaaagcaagggagaaacgagtttgtcatacgcctgcaaccttctgaagccatgtacatgaagctaaccgtgaagcagcctggtctcgagatgtcaacagtgcaaagtgaactagatttgtcatacaggcaacgctatcaaggtgttacgatcccagaggcttatgaacgtcttatactcgacacgatagaggtgatcagcagcattttgttcgccgggacgagttaaaggcggcatgggagatattcacgcctcttctacacagaatcgacaacggtgaaatg

SEQ ID NO: 16715 - DNA, 522 bp, Gossypium hirsutum
  Clone ID: uC-gsflnu33B101d01b1
gtttttctctcttcattatattttctatctcgcagatctattcatcccaacatttgtttgattttgcatgttattaaaatactaaactatggaaatattctatctttaagaggaagggcttggagggattagtttgggtgtttttttattgaagaaaaatggcgagctccaacccgtttgatttattgggtgatgatgatactggggagctctcattgctgatcgccgctcagaaaaaggccgctgccaccgccccctccggcgtccctaagaaagggcaggctcaatctcagacgaagccgcaggctaagcttccctccaagcctctccctcctgctcaggctggtaagcttcccctaaaaaaggaagttaccattccagctttattgcttcaatgttgtagcagaaggatttccataattttatatgcaaaaattgaatcttctgggtctttagtttaatttgttgtgcaatattaaagctaccctttttaatgggtctcaatggatctatcttaatata

SEQ ID NO: 16716 - DNA, 281 bp, Gossypium hirsutum
  Clone ID: uC-gsflnu33B101d02b1
tttgatcactctctgggatatgaggggcgatgatgaggatcagctagcctgatgctgatgagatgtctactttcttgaagcgtggtagagagatgatgttgacatcaaaatcgaattagggtttggaaactcgtgttctttatcgaaggctttcaaaatttgaactgatcaagtcactgctttgttagtccaataatttcgatcagtttatttaaataaattatcaaaatcaaggtaagaaaaactcaatgaaccttctacagcatataaattgcaacaag

SEQ ID NO: 16717 - DNA, 441 bp, Gossypium hirsutum
  Clone ID: uC-gsflnu33B101d03b1
ggtctctacctttgttcatgcatgtgaaggtgatgcagtgacaaagcttaccaatgagaaaataccttactttaatgctaatatttatctgcagaacaagacccaaatagggaaagttgatgaaatctttggtcccatcaacgaatcctatttttcaatcaaaatgttagaaggttgagggagcaaactgagagttgagctgctgctgactacgttatgttcacaactttggtatgatgttcgtgtatgtgttggctacaaaccagttgagtcattttgttgacaattatggcgcttagttcttaattttatatcttaactctggtgttggagctttatttaagttcaaatatttgagtattcttgtttcatgaatgtcttgttactttgcatcaaattaagttggtctttgtcggcgttctataatgctgcatatttagc

SEQ ID NO: 16718 - DNA, 513 bp, Gossypium hirsutum
  unsure (1)..(513): unsure at all n locations
  Clone ID: uC-gsflnu33B101d04b1
gttcgtctcaatcctgctatttctataagaatagtttgggttttcgttttttgagtcaaactatcagtttacttcctctatcatcgcaaattctgaaagaaaagggatccgatctgatctgctgcaaatgggggagaagtgggtgttgatgaaaacggctcagacgcctaccaacattgcagtgattaagtattgggggaagggggatgagacccttattttgcccgtcaacgatagcatcagcgttactcttgatcctgctcatctctgcaccacaaccaccgtcgctgttagccctgctttccagcaagatcgtatgtggctcaatggcaaggaaatatccctttccggaggaaggtaccagaactgtttgagggaaatcagaaaacgggctaggaagctgaggataaagagaggggaataaagatagagaagaaagattgggagaaactgcatcttcatattgcatcttataacaatntccctacagctgcaggattggcttcctctgct

SEQ ID NO: 16719 - DNA, 424 bp, Gossypium hirsutum
  Clone ID: uC-gsflnu33B101d05b1
cccactcgtccgtctaccaggtgattttagctttgtgtgagttcctttaagcaattagccaagatgcagaacgaagagggtcaaaacatggatctttacatgcccaggaagtgttccgccactaacaggctcatcacctctaaggatcacgcttccgtccaaatcaacgtgggacacttggatgagcttggcagatacactggcacattctccacttttgctctttgtggatttgtccgtgcccagggtgatgctgacagtgctctcgacaggctttggcagaagaagaaagctgaagtccgacagcagtagttggatacctttttaccctagtctatctccgagcttgggcatgaaaaatctaatggcagtgactattatgttctaggtcttttcagggtaaactatgtcaaattatattttt

SEQ ID NO: 16720 - DNA, 511 bp, Gossypium hirsutum
  Clone ID: uC-gsflnu33B101d06b1
cctactcgtccggggagacagaaaaaatgctgaagaatggatgttagattatgcacttcaacaagtggttgctaaactaactccagaaaggaagaggcgagtagggctgcttgtcgaagcatttgagaccgtcattccggctataagttgaaatcatcaaaagtgctgatatacctcctccagcaacaaccagtcaaactggtgtcagtttacaaggtaagaccaaaagaagtggccatttcatgcggccaatctgaatgaaacagaagcatcaattcgttcgggtgaaacatcacagtaggaaaagaacagaaattaggaggtagcccttaagagtctgagaagttgcaagttccatattttttctgaaacctcaaagcatattttgagcatgcttatgatgggaaaaaaaataagaataccatatgtgtacttgtatcagtatggtgttgttagtcctttctgaaaactagagcaattgttctgataaatggttatggatgtcagagat

SEQ ID NO: 16721 - DNA, 514 bp, Gossypium hirsutum
  Clone ID: uC-gsflnu33B101d08b1
cccacgcgtccgcccacgcgtccggttacaaccagtttctggattattatcggctttactagtaaaacaggttacagaggtttcacaaacaggttacagaggttacagaggttacaaccattgctgtacctttgagattattgggttttgagggacgataatggggaagttagaaggaagatatcagcagtgtcaaccagagctcacaccagaaaatctcatcaaagttcttcttttaagctttctccaggtgaggaaagaaaaattaggagacagaattacagcacttcaccagcttgtttcaccatttgggaaggttcatggagactatgcgagttttgggtgatgagatctgctatcgtgctaaagactatcttagtatccacaagttatttgctactcgtgctgatctttagcgaactgtgtacacccactctaaagtgaagttgtgtaggcttcttatatgaaatggtgaggtctgatttcatttttattcaggatccttgtgagtact

SEQ ID NO: 16722 - DNA, 457 bp, Gossypium hirsutum
  Clone ID: uC-gsflnu33B101d11b1
cttacgcgtccgctttccttctctctctttttccctttcaaatctctccccaaaagaaaaaaaaaacatcatggctatcgacaagaaaccaaacagattgcctcaaacagctgttatcaaacaaatcctcaagagatgttcaagtttgggtaagaaacaacaatgctacgatgatcaacaacaacaaggagggctgccattggatgtcccaaaaggtcatttcgttgtgtatgtcggtcaaaacaggagtagatacattgtccctatctctttcttgacccgacccgaattccagaagttgctccatcaagctgaagaagaattcgggtttgagcatgatatgggtctcactattccttgtgaagaagttgtgttccagtccctaacatccatgctcagatgatttttaaatggttagggcttttaatgaaaatgaagatgaagctgctccatttgc

SEQ ID NO: 16723 - DNA, 420 bp, Gossypium hirsutum
  Clone ID: uC-gsflnu33B101e01b1
gtttgttcaccagttgttgctagggagaaatcaaaatggggccaggtggaccaggaggacctccgggatggggcggtcctcctcccggaccgggtttttccggtggcatttgtgacttcattggttcttgtttgagctttctgtgttgctgctggctgcttggagactgttttggtggtccaatgggtccaccagggccacctggaccacctggatttggacctccaccaccctagttatatgtctaccatcttcatattccaacacaaaaattggaggcttttctagcttctatctgggtttcaacttagctatctaaaatacatatttatgtaataattgtttgcatttttagtagaatttatgtttattgaaattaatctcaataaattgatctttcaatcttttttctttgctcaa

SEQ ID NO: 16724 - DNA, 528 bp, Gossypium hirsutum
  Clone ID: uC-gsflnu33B101e04b1
atttccttcagttcaagcccgaagaaattaatgccatcatgaatgactttaatgaaccgggtacgctcgctcccaccgggttgcacctcggtggcacgaaatacatggagatccaaggcgaaccgggagctgttatccgagggaagaagggacccggaggtgttactgctaagaagaccaatatggccttgatcatcggaatctatgatgaaccaatgacacccggccaatgcaacatgatcgtcgagaggctcggagattatctcctcgatcagggttattgattctcttcggtgtgtgtccttatttgaatgcataccttattgggtttttttctatacgaaaaaaagaaacatgcatcgaagcgtctccgtattactcgtatttacatggaaaaagaccgcaatggttatgttttatgatctctttgctttggttctatgtattctgtttgatggatactatgaaggctgtggagtgaggaactttggttgttcttcttctgcattacagtgataattctactgg

SEQ ID NO: 16725 - DNA, 498 bp, Gossypium hirsutum
  Clone ID: uC-gsflnu33B101e05b1
aatcatccacttcttctcttctttgaactcaaagtcccagctaatattagaatcatgggtgttgtcacttatgactatgagaatacctccccagtcgcccctgccaggcttttcaaggcctttactgttgaagctccgaaagtttggcccacggctgcaccaaatgcagtcaagagcattgaggttgaagctaatcctagctctggaagtatagtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaagtttgaggcagctgcaggtggaggaagtatttgcaagagctcaatgaaactctacactgttggcgataatgttatcactgaagacgaaatcaaggctctcattaagggagtgagggagttacaagcctgttgaagc

SEQ ID NO: 16726 - DNA, 404 bp, Gossypium hirsutum
  Clone ID: uC-gsflnu33B101e09b1
tttgaaatgtcctttaacagatgcttgggctgacatacttgtgctgtttgctagagacggaatcaatgtaatgataggcccttactttaactgtcaaaactgaaacaagagacggcacaatgagcatggcacatgccggggcggagactattgcgtccacaatgtgaccatcattggcatactcgacaggatggccgtcatgggtattgacaccattggagtcgatgacctactaggagctcacacagtgagcatatctcactgggcgaagctgaagcttgggttgaactcagaggaggtcactgcattcagggcagaccatggaacacacatgctgcataaatgccctgatgaaatcccagaccgcaaggccgttcagtgtgtgagaaacgatcgtggtacac

SEQ ID NO: 16727 - DNA, 413 bp, Gossypium hirsutum
  Clone ID: uC-gsflnu33B101e11b1
taccctccttccgtttctgttttcagcatcaattactttttatttttttcagagccttcttcaccaaactccgctctgttcagcccgtgatcttttgatctttctctatggctaccatttgcaagctctataaccgcaacccagtcgcttctctttcatcatcttccaaacccagatctgcttcatcgcttaaatgcttcgttgggttccctaccaggcctggtttctgctctaagctggcattcatcttgtagcttgtcctcgatgaacacccaccctttcaggggctccttggctgtcacgtgctctcttgctgatggacatctgtgtgcagtgaagaggactactatgcatgatctgtatgaaacagaagggcagagtccatggtatgacaacctttgcaggccagtgac

SEQ ID NO: 16728 - DNA, 346 bp, Gossypium hirsutum
  Clone ID: uC-gsflnu33B101e12b1
tttttgtaatcatccgaaaaagaatggtgaccgaggaagaagttcgtaaggctgaacgtgcccaaggccctgccaccgtgttggccatcggcacatgaacccggcctaattgtgttgatcagagcacataccctgactactatttccgtatcacaaatagtgagcacaaaaccgtgttgaaagagatgttcaagcgcatgtgtgaaaagtcgatgatcaagaagcgatacatgtaccttacacaagagatttcgatagagaatccgaatgtatgagaatacatggctccttcactggacgctaggcaagatatggtgggagctatatgtgccaaagctatggctag

SEQ ID NO: 16729 - DNA, 323 bp, Gossypium hirsutum
  Clone ID: uC-gsflnu33B101f01b1
ggatagtttattttattcgtgttttttaattaatttgtaaaaaaaaatagagaatatgatatgcattcttttcatggagttacctcatacactatcatccttttggtggaagctctccatcgcatgggggactccatggattcatgcatcaactattgtatttcctttttttgtctttccttacattcataaagtgtaatgtgagggaagttaaatgttggtagagcactgctctcgtacacaagtatgtcattgttggttgtttgtattgtttattagggctttgtaacaaaaaaaaatattagttccgaatttttaaccct

SEQ ID NO: 16730 - DNA, 525 bp, Gossypium hirsutum
  Clone ID: uC-gsflnu33B101f03b1
ggtccctggactcgggatgagattggactgcagtaacctaaaccttcattatgctgccagatattcgaaagagatcccggatgcgtacgagaggcttctgctggatgcaattgaaggtgagagaagattgtttatccgaagtgacgagctcgatgcagcctggtcactcttcactcccgttttggcagagctggaagagaaaaaaataatgcccgaatactacccttatggaagccgtggccctgtcggggctcattatcttgcggccagatacaatgttcggtgggggtgatcttggcttagaccaatcggcctaagactacactttgacattgctgtcatcgtcaatatagatttatcgacacggaaagctttgtacagatctttgtaagaagggctggaaatatttttaatctttacaaggtttgcttaagaaaatttaggttttgtttatcaacatggtggcctaatttggtaagagcatgcactttgtgtagaaacaaattaatgaacataagaagagct

SEQ ID NO: 16731 - DNA, 449 bp, Gossypium hirsutum
  unsure (1)..(449): unsure at all n locations
  Clone ID: uC-gsflnu33B101f05b1
gagcttcctcttaagttttcattcaacatatatatatcttttagttccaaattttgatttttgatccatttttttggctttgtaaaggaagataaattctgggttttgtttgttctgattccaagtttcaatctttcattaagttttttttagcaaaatctgcttgttttcctagcagatttcaagggtttaaggtttgactgtggtgagggcttctggctattgatgaaatgaaaaagaacccattttgtgcttgtgatgatgctgaagatatatggtgttgcaagaacaatttgtcagggttcttggtagctctgctatgtgtttcattgacttgcagctctgttattattatgctgtgctaactactttgtttatgttcatcaattgccaagcttccagaaaaccagactgtagatagactnttaagactctatgaatttgatata

SEQ ID NO: 16732 - DNA, 524 bp, Gossypium hirsutum
  Clone ID: uC-gsflnu33B101f07b1
tttgtttaattattcaaaggctatgatatggaaatacacaatcagattctacacaacattgtgttcttgcgttctcagcttgacaggtcttatattccagggacatttactgctagctgtagattttgtttatcgccacaatgattgttttcttgatattgtattactctcaaccgtagcaacagccagtcaatttttcatttcttacacgattcgcacatttggtgctctcacatttgctgccataatgaccacaagacagctggtgagcatcatgctgtcatgcatttggttcggccatccccttagctgggaacagcggattggggcgatcatcgtgtttggctccttgtactccagaaccttctggaagaaagtgtcaccagctcccactcctccacaacaaacagaaaatggatcttcgagtccttcgaaagggatcccttaacgaggtcaatttggcatcagtaaccgcaactggttctggtcgggtaagagcctgcctatgttaaagctgcattatg

SEQ ID NO: 16733 - DNA, 373 bp, Gossypium hirsutum
  Clone ID: uC-gsflnu33B101f12b1
atttggcagagtctgttgggatccacaaggaagccctatcttacggtatcactggctacacaagtgccttcaccggctacagcttcacatgtagcgactgcacgtacaccaatgccggttccaaccatgaatatgactgtgaatagaagttggcccttcatctcatcaatacatcattatgaacgcactagtggctaccattagtgcaaggatctgcatgcacaaggtgcactgccatacctttcgagattgctgagggagttcccagatggaatacatatatcgacacctgtatctgatggtgctcaagcgactgatcccaaaagcttgactaatggtgcagcaccattgattacttttgcaactgcctata

SEQ ID NO: 16734 - DNA, 324 bp, Gossypium hirsutum
  Clone ID: uC-gsflnu33B101g01b1
tctgttttatttacacagggaaagaaaagcatcggtgcgggtgattaaatgaccagcgttggatcctgggactgggtggtcaactacaggcaaaaggttcacttgtagaggcatggtgttctaaatcaacacatgagggaggagttccatcgccgcgcttcggtgaatccctttcctctcccttcgtatcataagaatgtatgtgaaaatcataactacaaaaaataaacttatggttaaataaatatatacgacactcactttaaaaccttaaaagctttgcttctctattccacattatccgtataacaaacataccgctcg

SEQ ID NO: 16735 - DNA, 138 bp, Gossypium hirsutum
  Clone ID: uC-gsflnu33B101g02b1
cccactcttccggaaaaaaaggatagcagcctgccatggtggcttgcagttttgtcatttctaattgtggcttagggaatgctgtgacaaagtatttacgcttttacatataacttagaaaaagctgtacagtttttt

SEQ ID NO: 16736 - DNA, 476 bp, Gossypium hirsutum
  Clone ID: uC-gsflnu33B101g03b1
accacttttccgattctctttccctttgtaaagaaagcacagtaaaaagaaccctcaaagccattaccaccattaggctagtgccaaaacttgagcaactctaccgccaccactgcgattagatggagactcacatgctcgcgcttcaactagagacttaactcaagacctatcgagttcagcccttagaaatctcatcccaaacttggattacagcgagggagacaagaattccactggcccattcacgacagtaaacacttgtcttcatatactagcctatatccgagccacatgcaagatccacagacagaaacacacgcatgagaaatggatcgagaatcacctttacaataattttgaagtcgactatggggaattcaataagtgtattccagtgtgcgtccccatataatgagaatgttgatggctttatagccagaaatatacaaggaaaaatacaagggatgtatttg

SEQ ID NO: 16737 - DNA, 526 bp, Gossypium hirsutum
  Clone ID: uC-gsflnu33B101g06b1
atcgcgagcgccgccctttttttttttttttttttttttttttttttttaaaaacaagtgtctctatagtacattaaaatagaaaatacctttgtttctagacatggcataaaccacccaatttattggtcgagaaaaagaaagaaattatctccaaaaaccatgtactaaaaagaaaaatcaccaagttggttccattgacacccttccctggtccatactctttatttctctacttcaactcatctccattcttccacataaaaaattaataacagtgtacagtttacccgaattccatggctctatagggcaagcactgagcatagaaccccataaaagtagcatactgcatggcataacataaacacgcatggtttttaaataattaagtcataaaccattgtcacgcgcaaggagatcaaccatgcatccatagatgctcaagtttagtaatttttccatgactgaactcggaatctggaagacgaatggagcatgttgagcaatttttacttttctaccc

SEQ ID NO: 16738 - DNA, 534 bp, Gossypium hirsutum
  Clone ID: uC-gsflnu33B101g07b1
tatttcattaaaacagggaaagaaaagcagcgtaatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaacagtgacgaatgaagcttgcgagtatctgaaaacgcttgaaagtgcgcttaatggaaagaaattctttggtggagaaaccattggaatggtagatattgttgctagctctgttggcatgtcataggggcactc

SEQ ID NO: 16739 - DNA, 537 bp, Gossypium hirsutum
  Clone ID: uC-gsflnu33B101g08b1
ctatggtcctcctggaactggcaagacacttcttgctagagctgttgcaaacagaactgatgcttgcttcattcgtgttattggaagtgagctggttcagaagtatgttggtgaaggagctagaatggttcgagagttgtttcagatggcacgttcaaaaaaagcgtgcattgtgttctttgatgaagttgatgccatcgggggtgcacgctttgatgatggtgtggggggagacaatgaggttcagcgtactatgcttgagattgtgaaccagcttgatggctttgatgctcgtggaaacatcaaagtcctgatggcaacaaacaggccagacacactagatcctgcattattacgtcctggacgtttggatcgcaaggtcgagtttggtcttcctgatttggagagtcggacacaaatattcaaaattcacacaagaacgatgaattgtgagcgtgacattagatttgagcttttagccaggctgtgtcctaattccactggagctgacataagagcgtgtgcacagaggctgaa

SEQ ID NO: 16740 - DNA, 500 bp, Gossypium hirsutum
  Clone ID: uC-gsflnu33B101g12b1
catacctcgattggtacaagggtcctactctccttgaggctcttgaccagatcaccgagcccaagaggccctcggataagccactccgtcttccacttcaggatgtctacaagattggtggtattggaactgtccctgttggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaaaaacgttgctgttaaggatcttaaacgtggttttgttgcttcaaactccaaggatgatccggccaaggaagctgccaacttcacctctcaggttatcatcatgaaccaccctggccaaattggaaatggttatgccccagtcctcgactgccacacctctcacattgctgtcaaattctccgaactgttgaccaagattgacagacgatctggc

SEQ ID NO: 16741 - DNA, 430 bp, Gossypium hirsutum
  Clone ID: uC-gsflnu33B101h01b1
atctaattttacttaaaaaatctaaagacgagagaaaagggagagggtaaaggaatcggaatcggagccggcgtcgtcggattgggaagctttctttaagagaatcctagttaactcgacgcgtttacccggaaagaggtgaagatgtcaactactgcatggaggactgtgccccttgagaattggtacaaatagggtgagccttctgcaggaattagtggtgcacctcaagataacagacattatgcttaaggaatgctgttatatttggacctgatgacaccccatgggatggaggtacgtttaagctgactcttcagtttacggaggattatccaaatgaaccaccaactgttggttttgtttccggcatggcccatgcaaagatttatgctgatggtagcatatgcatggacattctacaaaatca

SEQ ID NO: 16742 - DNA, 512 bp, Gossypium hirsutum
  Clone ID: uC-gsflnu33B101h04b1
ctttcgcgtgggaacaaaccactcccatattaaacattgttggtgaaacaatgacgtcttcagctctgacaggtaagcttgaggcagatgtagagattaaggcttctcctgagcagttccatgaaatgtttgcccacaaaccgcaccatgtgcaccatacttgctatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtaatgcactggactctggaatacgagaagctgcacggtgggattgagcatcctgagactctgctgcaattcgttcaagatgtctctaaagacattgacggccacctcacc

SEQ ID NO: 16743 - DNA, 527 bp, Gossypium hirsutum
  Clone ID: uC-gsflnu33B101h05b1
attatatactgcttcacaatggcctctacaaccgtggctctttcttccccatcattcgccggtaaggcagtgaagttctccccttccacccctgaaatccagggaactggccgcgtttccatgaggaaaaccaccaagcctgttccttctggtagcccatggtacggtcctgaccgagttttgtacttgggtccactttccggtgagccaccatcttacttgaccggtgagttccctggagactatggttgggacactgctggactctcagctgatcccgagacctttgctaggaaccgcgagctcgaagtcattcactgcagatgggccatgttgggagctcttgggtgtgttttccctgagctgttggctaggaacggtgtcaagttcggtgaagctgtatggttcaaggccgggtctcaaatcttcagtgagggtggacttgactacttgggtaacccaagcttgatccatgctcaaagcactttggccatctgggctcgccaagatatcttgatgggagccgt

SEQ ID NO: 16744 - DNA, 522 bp, Gossypium hirsutum
  Clone ID: uC-gsflnu33B101h06b1
gtttgaggcaaaccatgggtgccaaagttcttggggtctttgatttgctattactttgcagctgtctcggcatttgcacaggatgaggaagaccaaggtcttgctatgaacttctacaaggattcttgacctcaggctgaagacattatcaaggagcaaggtaagctactgtacaagcgacacaaaaacactggtttttcttggctgagaaacattttccatgactgtgctgcccagtcatgtgatgcttcactgctgctggactccacaagaaggagcttgtctgaaaaggagacagacaggagctttggcctaaggaatttcaggtacattgagaccatcaaagaagctgcagaaagggaatgtcctggagttgtttcttgtgctgatatcctagatctgtctgctagggaaggcatcgtttcgttgggaggcccttatattcctctcaaaactggaagaagagacggtcgaaggagcagagcacatgttgcggaggagtatcttgcagaccacaatgag

SEQ ID NO: 16745 - DNA, 466 bp, Gossypium hirsutum
  Clone ID: uC-gsflnu33B101h07b1
aatatatttccgtttgtttcctgagcaaatctcgggaaggaataccctttttttccccctgttgttaactcgttgtgattgtgaagctttctttaagagaatcctagttaactcgacgcgtttacccggaaagaggtgaagatgtcaactactgcatggaagactgtgccccttgagaattgatacaaatagggtgagccttctgcaggaattagtggtgcacctcaagataacaacattatgctttggaatgctgctatatttggacctgatgacaccccatgggatggaggtacgtttaagctgactcttcagtttacggaggattatccaaataaaccaccaactgttcgttttgtatcccgaatgttccatccaaatatttatgctgatggtagcatctgtttggacattctacaaaatcagtggagtccaatttatgatgtagcttgcatactgacatcta

SEQ ID NO: 16746 - DNA, 408 bp, Gossypium hirsutum
  Clone ID: uC-gsflnu33B101h11b1
tccacgcgtccgctccgctgtttattcgcttgagctcatcacttcccatagtctgtcctcctccctcaccaaatcaaaatgtctctggtggcgaacgaagactttcagcacattttgcgtgtgctgaacaccaacgttgatggaaagcagaagatcatgttcgctttgacctccatcaagggcattggaaggcgtttcgctaacattgcttgcaagaaggctgatgtcgacatgaacaagagggctggtgactcgactgcacaggagctggacaatctcatgaccattggtgcaaaccccaggcagtttaagatccctgactgggtcctgaataggcagaatgattacaaggatgggaagtattcccacgatgagcctaatgctctcgacatgaagttgagagatgac

SEQ ID NO: 16747 - DNA, 514 bp, Gossypium hirsutum
  unsure (1)..(514): unsure at all n locations
  Clone ID: uC-gsflnu33B107a01b1
tttcaatactatacttactaccatacaaaatgcgtacataaaaggcagtgaaggaagtgggtcagccattcctttattttgttgtaatattgttatctattgtttcagtagtttggaccacaggtaaaagcatagaagaagaaagaaaaaaaaaaggatcacacagtcaatgtgtagttgtaactccccttggaactgtaatttctttcccttatttttccagcagtgatggtttccctggaagaaacaaggaaaaaaaaccccccttatttagtttgttcaatttttttcctagccttgttagttcatgtttgttagggtgtaatcaaaatcctcttctgtacagagcatctgcactcaaaagaagggaaacaacactcgaagaggtagaaatagtaaaaacatgcatatatggtattgtagggggaagacatctatcgagggaatcatacatctcagttcaaagttgtaccttgatcatgatctacntgtatgagatagagaattcactagt

SEQ ID NO: 16748 - DNA, 552 bp, Gossypium hirsutum
  Clone ID: uC-gsflnu33B107a02b1
tttttgaattaccgaccagcttcacttcaatctccatttccatggcggaaagaaatccaagcctttcaaacgccggattctgttacgaaacgagaatttacagtagcttaaggcagcccgtccctctcccgccagctgatcagcctctttccgtcgcggaatattgtctctccatcttctcttccatttccaccagcggcgccacccctttcgccgtcaatgcaaccaccggccaaacgctgagttactctcaattcgtttctcaggtccagctcagtaaaccggttattgcctttgctacttcacaaacctctcataagattccatctctcaaacacgaaactatcctcttggactcgcccgagtttctatctttcttaactcagtccaatatcgacggtaacgtcattaaacgaatcaaggtaaatcagtccgattcggcagcgattttatattcttccggaaccaccgggcgggtaagggcgtgatgatgtctcaacgtaacttaatcgcaatgatggcggcgattcatcaccacaacactatcgaagc

SEQ ID NO: 16749 - DNA, 358 bp, Gossypium hirsutum
  Clone ID: uC-gsflnu33B107a10b1
tgtccagtcttagatctcaaaagatggtccgcgctaaatttaccgaccgtaagcagactcgcgggaaggctcattaggaagcaacttgctaccatagactctcgtctttgtgcctcaaccactggtggtgtgaaaaagccgtatcaataccgttctggaactgctggtctcctccaattacgaaagttccatcaagagcactgtgctatctataaagaaattgccatttcagaggctagctacggaaagcttgcaatatttcatgactgatttgccttgtcatgagccaaaccgttcttgttctacaagaaagtcgacaaacatactttttgacctctcttttaagacacctaacctg

SEQ ID NO: 16750 - DNA, 482 bp, Gossypium hirsutum
  Clone ID: uC-gsflnu33B107a12b1
tttgacgcgtgggtgcgataggaagaacagatcatcaaacgatgtccaatgtttgtcctatgtttcttcggatggtaacctatgttaccatgtggcatgtatgaaagaagcatgtcgcgataactggaataagggttattttcgacctggttctgaaactaatgagcagagtaaattccttgcactacacaatctagctccaaaagaagtactatcaagcgttgggcaaacttcgaaagtttcgttgatcacatttttaaagctggtcgttaatgctatactgggagagccatttgattaaatggccctttatattaactttcttaaaacctggttagataaggctggtggttatgttaagcctgggttggtaaaataaggcttgaacctgttattgaccaagtgaggccaatttcaagggggatttgttttgaaacacttggtttgttgccttcaaaaaaaaaaaaaaagggggccctttt

SEQ ID NO: 16751 - DNA, 367 bp, Gossypium hirsutum
  Clone ID: uC-gsflnu33B107b02b1
tgttctaaatcactccctagcttgtatatagcatatatgtatcctgaggttgggaaaactcatttaaaaatgtaaattaaatatggattttcgtctcttttcactctctcaagaagtgaagggatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccttttaggggtcccaggtttcttaccccggcttgccaaggaaaaactttttttttggggcccccaaattaaattcaccggcccggttttccaaccttggaaacgggaaaaccccggggtt

SEQ ID NO: 16752 - DNA, 74 bp, Gossypium hirsutum
  Clone ID: uC-gsflnu33B107b04b1
tccacgcgtccgcaaatcttgaacctacaaatcttcttcttcacgatccaattcacattcccatttttcttttt

SEQ ID NO: 16753 - DNA, 574 bp, Gossypium hirsutum
  Clone ID: uC-gsflnu33B107b05b1
tttcacgcgtccgctttgagcaaagcagcctcatttcatttctccaatatggctagagggttgaagaaacatttgaagaggctcaatgcccccaggcattggatgcttgacaagcttggtggtgcttttgcacccaagccatcgtctggtccccacaagtccagggaatgcttgccattgatccttattttgcgaaaccgattgaagtatgctctcacctatagagaagtcattgctattcttatgcagaggcatgttatggttgatgggaaggttaggacggataagacctatccagctggtttcatggatgttgtgtccattcctaaaacaaatgaggacttccgtctactttacgacaccaaagggcgatttcgtctccatgccatcactggcgatgaaaccaagttcaagctctgcaaggttcgatctgtccagtttggccagaacggtattccatacttgaatacatatgatggtcgtactatccgttaccctgatcctttgatcaaaggctatgacaccatcaagctagaccttgaaagcaacaaaattgtgatttcatcaagttgat

SEQ ID NO: 16754 - DNA, 107 bp, Gossypium hirsutum
  Clone ID: uC-gsflnu33B107b06b1
tctacgcgtccgcaagaagagatgcatcataaaaaaataaaaaaaaaaaaaaaaaaaaaaaaaaaaaaaaaaaaaaaaaaaataaaaaaaaagaagtattttatatg

SEQ ID NO: 16755 - DNA, 541 bp, Gossypium hirsutum
  unsure (1)..(541): unsure at all n locations
  Clone ID: uC-gsflnu33B107b08b1
ttccacgcgtccgctcttttggggtttccccgcttgttcttctcttaattgcgttctatattgaggatggcttgtactaagagaactctggctttccttttgatgctggcttttgtaggagtctctcttggtgcagttcacaaagtgggcgattccaccggctggactagtcttgggaatattgactacctcaagtgggcttccaccaagaatttccatgttggcgactctcttctttttcagtacaaccctcaattccacaacgtgatgcaagtgacccacgacgatttccagtcatgcaacggaacatctgccatcgcctcctacacctctggatccgactccgtaaccctcaaaaggcctggccacttttatttcctttgcggtgttccaggccactgccaagccggccagaaagtcgacgtattggtcaaatcatcgtccaaagccccaattgcaagtcctagcccatccactntaggttcatcgcctgcaaacccaccttcagaaatgttgggtgctcctggcccagctcagagca

SEQ ID NO: 16756 - DNA, 447 bp, Gossypium hirsutum
  Clone ID: uC-gsflnu33B107b09b1
tttcttgtttttatcccttcatttacccattttctgtcttttatttttcgattatataataaaatcacaatttattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccttttaaaaaaaccaaatttaactacccggggaatgaaacctaaaagtttttttaaggggaaaccaaaattaaataaatggcccggttttaaaaaacgcgggaatggaaaaaacctggggttacccaaataaaaaccttttgaaaaaaatccctttttcccaaaagggcaaaaaaaaaaaaaggccagaacgaataccctttcaaaaaatttgccaaccttaatggggaaagggaacccccttttaag

SEQ ID NO: 16757 - DNA, 541 bp, Gossypium hirsutum
  Clone ID: uC-gsflnu33B107b10b1
tctttgatgagaaagattttaactatgtaaaatccacagttccggtgggagtttcttcagaaatagtgagcaaaagtttccagccattgaagagaatacagccgaggttggaatgggcaaaaccccaacaaagtgcagtgccagctgagaaaaggtggccaagttctggatcgaatccttcagtttcttattccctggcatcacctttgcaggcctcacctccgctagcaaagacagaaagccgtaatgtggctgttggaagtgattataagaaacttcagccctcaattagggaaccagttatgatgatgcagcggcctcaatctgtaaatacaaagcaggttccagctacttgtataagctcatctcctcctggaacgaccccctttttgtatccaagcagtagtgttgaaattacaaagtctaatggctttatgccccatattgcaagtgctagaagccttagttccaacagcttgagttcaaatccgatgcatccccagctttactatccacagcagcaacagttcttaagcagcag

SEQ ID NO: 16758 - DNA, 67 bp, Gossypium hirsutum
  Clone ID: uC-gsflnu33B107c03b1
ctcatttgtcagttaatgcatcttgttggttatacccatgtgaggtatagacccacagtagttaatg

SEQ ID NO: 16759 - DNA, 582 bp, Gossypium hirsutum
  Clone ID: uC-gsflnu33B107c04b1
ttcttgatgaacgctgcgcagcaggtttcaccatgatggcattacccgttaaaaagttgttgaagcttttatatcctagcttgattcgaatcgatgaatatcttttgaagccatccgctcaagccgatgatttcaaaaacatcatgaagagattgcctttgctcgcagaaagcctagattcaagaggcctttatttgtatgatgatggcttacgctttgttatttggttcggtagaatgctttcacccgatatagcaaggaatttacttggaccagagtttgcagcagaattatcgagggttacgcttaccgagcatgataatgaaatgtcaagaaggctgatgaagatgttaaagagactaagagagagtgacccttcgtattatcaacttccttatcttgtaagacaaggtgaacagcctagggaaggtttcctgctgcttgtaaatcttcttgaggaccagatgggcggtactgttggttacgtggattggataatgcaaatacatcgacaagtccaacataatgcatgatatacgggagttcatcatcttacgtcataaaactcatctgttttgcccg

SEQ ID NO: 16760 - DNA, 544 bp, Gossypium hirsutum
  Clone ID: uC-gsflnu33B107c05b1
ttcacgcgtccgcccacgcgtccgaaaacacctttgttccagggttgattgatttggctattcaaaggaactgtctgattggaggagatgacttcaagagtggccagaccaagatgaaatctgtcctcgtggatttccttgttggggctggtatcaagccaacatcgatagtgagttacaaccatctgggaaataatgatggcatgaatctgtcagcaccccaaaccttccgttccaaggagatctcaaagagcaatgttgttgatgacatggtttcaagcaatggaatcctctatgagcctggtgaacatcctgatcatgttgtggtcatcaagtatgtgccgtatgtgggagacagcaagagagccatggatgagtacacatcagagatattcatgggaggcaagaacaccattgtgttgcacaacacatgtgaggattccctgttggctgctcccattatcctagatttggttctccttgctgaacttagcaccaggatccagttcaaggctgatggagagggcaagttccacactttcca

SEQ ID NO: 16761 - DNA, 593 bp, Gossypium hirsutum
  unsure (1)..(593): unsure at all n locations
  Clone ID: uC-gsflnu33B107c07b1
tctcacgctctcatcattttccttctgctaccttctctcaacccaaacacatatttcccaggaaaaagaaaaagcttgagcgaacaagaaaatggccgatcagcttaccgacgatcagatctctgaattcaaggaggcctttagcctgttcgacaaggatggagatggttgcattactaccaaggagttgggaactgtgatgcgatcacttgggcagaaccccactgaggcagaactgcaagatatgattaatgaagtcgatgctgatggaaatgggaccattgattttcctgaattccttaacctgatggcaagaaaaatgaaggatacagactctgaggaggagcttaaagaggcattcagggtgtttgacaaggatcagaatgggttcatttctgcagccgagctgcgccatgtcatgacaaaccttggtgaaaagcttacagatgaggaagtcgacgagatgatccgcgaagccgatgttgatggtgatgggcagatcaactacgaggagttcgtaaagtcatgatggccaagtaaaggacctctccaactataaccanggattaaaaatggngtttaaaaaaagggag

SEQ ID NO: 16762 - DNA, 555 bp, Gossypium hirsutum
  Clone ID: uC-gsflnu33B107c11b1
gttaaaagtgcacatcacagaatggcatcttcaccctttcaattctccactccagttctcactctcctattatcatcgccgtcgttacgaaaatccccttgtcttcctttccatccttcattattctcgccgccccttacccagaagaccctcactttctcgactgggactagagccgtttcggggtccggaaaatcccctggtcttcctttccgtccttcattattctcgccgccccttactcagaagaccctcactttctcgactgggactagagccgtttcggggtccgggaagttctgttggagagccaaggcgtcgatgtccgggaccaccatggagaaagggaaagggaaagtcgaagttattgattccaaggagaatctttcggtttcgctcgctaaatacaccgccgatctagcagctaagttctccaaagagaaaggcagtttcaccgtggttttgtctggcggctccctcatcaagtctctcaggaaactagtggaacccccatatgttgatgcgattgattggtcaacatggcatgttttctgg

SEQ ID NO: 16763 - DNA, 209 bp, Gossypium hirsutum
  Clone ID: uC-gsflnu33B107d01b1
ttctcacgcgtccgggcacgcctgcgctttatgttcactgcaacctatgttacgacgtgctataaaaatctcacattatgtgtatgcgaacattaccatccgaggtcatgaatgctgcccagattaagaagtatgtcaacttgacatatattagtgatgacacttatcttgatagttgtgtgttacaaagaaagaagacattggctagt

SEQ ID NO: 16764 - DNA, 555 bp, Gossypium hirsutum
  unsure (1)..(555): unsure at all n locations
  Clone ID: uC-gsflnu33B107d03b1
tttaagttcaaagaaatggctaatcctgtgatcactcgcgtccacagtctccgtgagcgtttagatgagacccttcttgcccacaggaacgagattttggccttgctctcaaggatcgagggcaaaggaaaaggaattctgcaacaccatcaaattattctagagtttgaagctatccctgaagagaacagaaagaagctcgctgatggtgcattttttgaagtattgaaggctagtcaggaagcgatcgtgttgcctccatgggttgcacttgctgttcgtccaaggcctggtgtttgggagtacattagagtgaatgttcacgcccttgttgttgaggaacttactgttgctgagtatctccacttcaaggaagagcttgttgatggaagttcaaatggaaactttgttttggaattggattttgagcccttcaactcatcattcccccgcccaactcttttaaaatccgttggtaatggtgtggagttcctaaatcgtcacctttcggcanaattgttccatgacatggagagcatgcaccctttgctcgaa

SEQ ID NO: 16765 - DNA, 565 bp, Gossypium hirsutum
  Clone ID: uC-gsflnu33B107d05b1
tttctgcacaaaaaaaatttctctctcgtctttagggagggaaaagaaagtcaatattttttactaaatccctgtaaattcgccaaaaagacttaaaaatccataattcgttgtcttcccgtaatggattttagtcagcctcctgttgaaaattatgccaaccccaagacttgtttctttcatgttctcttcaaggctgcagcattggctttttacatcctttcagctctctttttcaacagctttgtgatcatatttgtggtgactgttcttctttccgcccttgatttttgggtggttaagaatgttagtgggcgcatattagtcggtttgaggtggtggaatgaaattaacgatctcggcgagagtgtatggagatttgaatgtcttgaccaagagtcgttggctcggatgaacaagaaagattcatggctattttggtggaccctttacctttcagcggttgcgtggattgtgcttggaatattctctctcataaggtttcaagctgattatctccttgtcattgggagttgtttgactctcaacattgccaatatcgtcg

SEQ ID NO: 16766 - DNA, 530 bp, Gossypium hirsutum
  Clone ID: uC-gsflnu33B107d06b1
tttcatttccttactccttacaacaaccctgatcatcgccgtgttggccgccgaatcaagtggtgtgcatcacttgagctgggtgccgactacggtgaacaagtccggtggctgcaaggactcaacggcggagtgcatggctaacgtggacgaggatgagttcgacatagggtccgagatcaagaggcgcatattgcaaaccaccacttacataagctacaaagcacttcagagggacaccgtgccgtgttctcgaaggggcgcttcgtattataactgtcggccaggagccgaagctaacccttacacccgaggttgcagcaccattactcgctgccgtctttaaggttgttcgccgacgtccttttttttaaaaaaaaaatttgtaagatataggtatgtagcagcaataagtggacgtgttagaattatgtagcttcccctctggcgtgatgaatatatatgtatatatatgtatgtatgtgtatatatgttgctgaagaaattatccagatatgttgtcgttggtt

SEQ ID NO: 16767 - DNA, 551 bp, Gossypium hirsutum
  Clone ID: uC-gsflnu33B107d07b1
ttttagaaacttgaggggacgaatcttgctctaccttgcttttctctcgcaaaaaattctcaaacttgtttttaacgttagctgaatactatcgctcatttcttcccgcagaaccctaatcgataactgaagccatttaatcatgtttgggcgtgttccaaaaaaatctgataacaccaagttttatgaagtacttggggttcccaaaagtgcaagtcaggatgaattaaagaaggcttataagaaagctgcaattaagaatcatccagataaaggtggagaccccgagaagtttaaggaactggctcatgcttatgaagttcttagtgacccagagaagagagacatatatgatcaatatggtgaagatgctcttaaagagggaatgggaggaggcggttcttctcacaacccatttgacatatttgagtcattttttggtgggggaagccttggtggcggtggtagctcgagaggaagaaggcagaagcgaggtgaagatgtggtgcatgctcttaaagttctctggaagattgtacaatgggacagca

SEQ ID NO: 16768 - DNA, 421 bp, Gossypium hirsutum
  Clone ID: uC-gsflnu33B107d09b1
tctataaaaaaaaaaacccaagtttttttccttttcccctataaatctcctatatcttctctttttgttcaatcttacctaaaacagttgatctaaacaatattgaaagctgagcaaccatgggtggttgtgctaccaagcccaaggttttgaagggtgacgaaccggagatccctgctccagcaccgtcgaaagaggcggttcccgaaccaaaggaggctgctcttgctgttgctgctgatggtgaaaagaaggtggaagctgatgaggttgctaaggataaagatgttatcgatgatgatgccattgatgatcaatcaaacaagagacgatctcttagtaacttgttccaagagaaagaaaaggggacagctgagagtgaaaccacaccatcagagccaacgaaaaatgaaacaccgga

SEQ ID NO: 16769 - DNA, 464 bp, Gossypium hirsutum
  Clone ID: uC-gsflnu33B107d10b1
ttccacgcgtccgcccacgcgtccgcccacgcgtccgattcataacacaactcaatggtaaatggagcgacccaaattgaaaaatgacaaatagagggggccaaaaacaattgctacacaaccaaaccatgatccaaacttaaaaataggacaatcctacactcaaccataccactgaaattacactactaaatgaatcaacccagatcccagagaggaaaatacggacttagtttgtaccttagaaatcgagaatggaacgggaattcgactgtggcttgatttatgtgaggtgggaagtcattgtttgatgatgaaggttattgttgttattgtaacagtgtgtttatgtgattgtttttagatgggaaattgaaaacccagatttgttgttgtttgatccattgtatgttgctgatgttttcagatgttgtgctgttaatgttgtggtagtgggctgcttt

SEQ ID NO: 16770 - DNA, 234 bp, Gossypium hirsutum
  Clone ID: uC-gsflnu33B107d11b1
tgtcaatttaataaacttgtggaagtcatacaattgttaaagtagtagctgatgaaaatacacattagtttttgtttgctttgtaatcagctacaatcactggtttgtggctgttgtgggtgttgttcaatgtgttgattttgttgtggtttaaccctagtagctaaccttgtctgttgtatgcattgcatgatatgttgtaaccttgtatgtttaacttggacattcttgatt

SEQ ID NO: 16771 - DNA, 567 bp, Gossypium hirsutum
  Clone ID: uC-gsflnu33B107e02b1
ttctctcaccagccacaaggaagaacttttgttccctgttggaagctggttatagttgtatcgtagtgcctggtggagtgcaagagacatttctcatgcagcatgattctgaggttgcattccttaagtcacgaagaggatttgttcgtatagccatggaaatggggtgtccactggtcccagttttcgcctttggtcagtcacatgcgtacaagtggtggaaaccaggtggcaagctcatccttcaactttcaagagctatcaaattcgttcctatgctattttggggagcttttggaacacctataccgtatcaacatccgatgcatgtggtggtgggaaaacctatttacttgaagaaaaatccccaacctactgccgaagaggttctggaagtgcatgaccaatttgttaaagcacttgaagatctcttcgagagacacaaagctcgggttggatacgatgaccttcatttaaagattatttagtttcagcttattttaagcgaacagtgtttctttatttcccaatttcttgttcaatagcgatgcctcaaggaactacttg

SEQ ID NO: 16772 - DNA, 283 bp, Gossypium hirsutum
  Clone ID: uC-gsflnu33B107e03b1
tgaataccgcaacccgttgctgcttagatgaattgaatttggaagcaaacctcgaaacactatttatctccatcgcgtaatctggaccttgtgaagtctcttgtgtccagatttttgttcaataaaaaccatgtggagaccctgtttcatagtcatgaaacttgcctccttgttactaggatgcccattaaggcatccaccattgattccattaagccatttaagcgtaagggcaaattgtactatatatataaatatattacgttattgtcttctaatgagg

SEQ ID NO: 16773 - DNA, 539 bp, Gossypium hirsutum
  unsure (1)..(539): unsure at all n locations
  Clone ID: uC-gsflnu33B107e04b1
ttttcgaagaagttccatcgatttcagtttagcattcataatgtcaggaagaggaaagggaggcaaggggttgggcaagggaggagcaaagcgtcaccgtaaggtcctccgtgataatatccagggaattacaaagccggctattcggcgtttggctcgtaggggaggcgtcaagcgcatcagcggcttgatctacgaagaaacccgtggtgttctcaagatcttcttggagaacgtgattcgtgacgctgtcacctataccgagcacgcgaggagaaagactgtgactgctatggatgtggtttatgcgctcaagaggcagggcaggactttgtatggattcggtggttaaatgtgatttagggtttaggttttagaatggtggtgtcttaggggggatttgaagtcttgctgtcaagaatgtttgagctttgggttagggattgtaattagggggtgtttacccgtttgtttgttntgtgggttgtgtaattcgtgcttcgaattgcagatttcattgaattttaacttcatttgtt

SEQ ID NO: 16774 - DNA, 576 bp, Gossypium hirsutum
  Clone ID: uC-gsflnu33B107e05b1
ttttggctctcacctctgcgagaaattaatgtcggaaacgccgcacaaggttctcgccttggacgtttacaatgacaagattaagcacctcctcgagcctgactctctcccttgggctggccgtatccagtttcaccgacttaacatcaagcacgattctaggcttgaaggcctcatcaagatgacagatctcacgataaatcttgcggcgatctgtactccggcagattataatacacgcccgctcgatacgatttacagcaattttattgatgcacttcctgtggtgaaatactgttcagagaacaacaagcgtctcattcatttctcgacttgtgaagtgtatggtaaaaccatccaaagctttctgcctaaagattctcctctccgtcaggatcctgcctactatgttcttaaggaagatgtctcaccctgcatttttggctctattgagaagcagaagtggtcgtatgcatgtgcgaagcagttgattgagaggctcatttatgctgagggagcagagaatggcctcgagttcaccattgtgaggcctttaactggattgaccaaggatgg

SEQ ID NO: 16775 - DNA, 573 bp, Gossypium hirsutum
  unsure (1)..(573): unsure at all n locations
  Clone ID: uC-gsflnu33B107e07b1
tcttccaatttcatggtcatgggaatggctacggtagccacatgagcaacgggatggctcacactcaagcatatggctctaaccatcacaacagccctggaaaacaccatggctctgggtatggtagtggctttgggggctaccctcccaaaaaccatggaatgccgcatagcccaccgcaccacggcggcaaactgtcaggccaaggcaacgggttcctgaagccccaagcatacggtcctggcagaaacatggcctacggaatgaccgaaaccgaaagttgccagtaccgcagtgaagtatactattccaacgagtcacactacaacgacggcggccgtggacaccaccacgctggcaaaggtgaccaccctgtcaagggtctgctaaggaaaataaagggtggcatttcacgtaataaaagctgcagcgacagcgacagtggcagcgacagcgatgatgatggttacgggaagaagacggtcttcgtgagcaaggcaatatgatgaagacatatatgataataaaaataaatatggtgaagatgtnggctatataaatgcgatntaatat

SEQ ID NO: 16776 - DNA, 588 bp, Gossypium hirsutum
  unsure (1)..(588): unsure at all n locations
  Clone ID: uC-gsflnu33B107e08b1
tctacaatgtgaaggcaaagatccaagacaaggagggtatccccccagaccagcaaaggctcatctttgctggcaagcagctcgaagatggtaggacattggccgactacaatatccaaaaggagtctacccttcacttggtgttgcggctgcgtggtgggatgcagatctttgttaagactcttactggaaagactatcactctagaggttgaaagttcagacaccattgacaatgttaaggcaaagattcaagacaaggaagggatcccaccagaccagcaaaggctcatatttgctggcaagcaacttgaagatggcaggacattggctgattataatatccaaaaggagtctactctgcatcttgtccttcgccttcgcggtggtttctaagtaaggattgtttgccgttgttggtggcctttttttggcttaaataatgtgtgtggaagcttatttgggattattattagctatgtggttttcgaactttcatgggttactgcnntatagatctttgtttaaatatttaaagttgtctttggacgctattatgattcgtcaacttcgatgttcatatgcctaa

SEQ ID NO: 16777 - DNA, 475 bp, Gossypium hirsutum
  Clone ID: uC-gsflnu33B107e09b1
tgtccaccagtacgatcacgcgcgcgtcttgagggttctctaatgatgcctcctatgcccccctatggttctgaatcaacctaagccgattaacactttctggctgacgacagtggatcaacattgctggctgccaacgatgctactgttgccgctgttgataccttgagaaggaaacacggtcaggaggaagcttctgcaacgccgctcatgagacggacaaacaggatgcataaggccctggtaaactcaatgtaaatgggcctccagcgcaaaggaaaccactgatgcatccggatcatgaaatggatgctagagtcgagaaaggcgaaaactgatgttgttgctccatgagctgcttactgtcaggacactttatactcatgcatagttggcgagtgtattgcgaagattctgcaaacaacttgtatgacattgacggcaagaaccatgaaagaactttaggcgtgtgcat

SEQ ID NO: 16778 - DNA, 548 bp, Gossypium hirsutum
  unsure (1)..(548): unsure at all n locations
  Clone ID: uC-gsflnu33B107e10b1
ttttgcactagcagcagcagcgccacactcttcacagtgctgatcaaccatggcggagcagaccgagaaggcatttctaaagcaacccaaagtgtttttaagctccaagaaatctgggaaagggaagagaccaggaaagggaggaaaccgcttctggaagagcattggtttgggcttcaaaacccctcgtgaagctactgaaggaacctacatcgacaagaaatgcccattcaccggcactgtttccatcaggggtcgcattttagccggtacttgccatagtgccaagatgataaggacaatcattgttcgacggaattacctacattatatcaagaaataccaaaggtacgagaagagacattcaaatatccctgcacatatttctccatgcttccgtgtgaaggaaggagatcatgtcattatcgggcaatgcaggccgttgtcaaagactgtgaggttcaatgttttgaaagtgattcctgctggatcttctggtggagggaagaagcttttactggaatgtaaggngtactgttttcaatcat

SEQ ID NO: 16779 - DNA, 77 bp, Gossypium hirsutum
  Clone ID: uC-gsflnu33B107f01b1
ttttgttccttggccactcctcttccaaggcagcttcattgcagatcggcgtatcccttaccagggacacaacgcag

SEQ ID NO: 16780 - DNA, 90 bp, Gossypium hirsutum
  Clone ID: uC-gsflnu33B107f02b1
ctcacgcgtccggtgatattagcctccttttggttaaaaaaaaaaaaaaaaaaaaaaaaaaaaaaaaaaaaaaaaaaaaaaataaagggg

SEQ ID NO: 16781 - DNA, 538 bp, Gossypium hirsutum
  unsure (1)..(538): unsure at all n locations
  Clone ID: uC-gsflnu33B107f03b1
tttctacgcgtccggaaggaagaaaacaaagatgacaaccgtcaggagcctcacttccccatctattgttaaagctccaaccccaaaccgatttacaagtcccatcgtcagggccccaacatctcttggatctgttaaaaccatctctagatctttcggcttgaaatgttcctcaaatcaacgaacatcaatggcaatgtacaagattaagctcgtaggaccaaacggtgaagagaatgagtttgaagtccccgataaccagtacatcttagaggcagctgaggcagcaggagtagagctgccttattgttgcagagctggagcttgctctatatgtaccgcanaggtcgtttcaggtacggtacatcaaccagaagccatctacctcgaggacgatcaaattaaggatgggtatatgttgacttgtgtttcaaagccaacctcagattgtgagattcacactcacaaagaacttgatctttactctccattaaaatgaaaagtaaatatttgttcagtaatttggggtccagaaaac

SEQ ID NO: 16782 - DNA, 507 bp, Gossypium hirsutum
  Clone ID: uC-gsflnu33B107f05b1
tctgtgggatatatgtgaaagtgagcatggacggggctccttatcttagaaagatagattcgaaggtgtttaaagggtacccagaattgcttaaggccttggaagagatgtttaagttcaaagctggtgaatattcagagagggaaggatataatggatcataatttgtatccacttatgaagataaagatggtgattggatgttggtcggagatgtaccatgggagatgttcaccaattcttgcaaaaagctgaagatcatgaaaggatcagaagcaagaggcttgggttgtgtttgaaaaaaaatagcccttcagcttagggtatacaaagaagaaattacgatcccatttttttttcttctttgttgattaagcaacaaagaagattaatcttaagatgttgtccaaggcataacccattaaatatatattttcatgtatagttttggcatgtttctaatttccttgtggaatttgtacataggaaaacatattaagttcataa

SEQ ID NO: 16783 - DNA, 555 bp, Gossypium hirsutum
  Clone ID: uC-gsflnu33B107f06b1
tttcacgcgtccgggagctttggcctaaggaatttcaggtacattgagaccatcaaagaagctgtagaaagggaatgtcctggagttgtttcttgtgctgatatccttgttctgtctgctagggaaggcatcgtttcgttgggaggcccttatattcctctcaaaactggaagaagagacggtagaaggagcagagcagatgttgtggaggagtatcttccggaccacaatgagaccatctctggcgttcttgacaggtttgccgccatgggtattgacacccctggagtcgttgccctcctaggagctcacagtgtcggcagaactcactgtgtgaagctggtgcatcgtttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatacttgacaacaagggtttgttgattgtggatcaccaactggcgtacgac

SEQ ID NO: 16784 - DNA, 216 bp, Gossypium hirsutum
  Clone ID: uC-gsflnu33B107f08b1
tctccggctcggtgtctaggattaggattatgtttagaatcaatcttatccagatctgactgtcagatatgagtatgtattctaaggatgccactctttatgtgcaacttctatgtttatttgcttcatcatcatgagtaagtctattagatgatgtaaattacaacttaatgcgtgccctcattatgggcagtaaatgcatgtgatttgtgtcaa

SEQ ID NO: 16785 - DNA, 379 bp, Gossypium hirsutum
  Clone ID: uC-gsflnu33B107f09b1
tcttggacgcgtgggttcctctctttctctcctacctttaatttgtgttgtggatctgaatgggaaaggaaaaaaaaaggtacgtggagacgtgaagagggcgttcatgggcgtggacgcgcgaaccagggggtcgtgctcggtgtgccgacgcacgtggtggagggaagcagcaactgtttccttttggggctgtttgggctctagggttaggttcatttttgagcttataattggatttgatgtttttgtaatttttggatttttttgtaatttttagacttttttggatttttatgtgagttttatttattggttttttgtatgtgtatgggctcgggccaaaaattgagtctataataatgatattagttagtcc

SEQ ID NO: 16786 - DNA, 580 bp, Gossypium hirsutum
  unsure (1)..(580): unsure at all n locations
  Clone ID: uC-gsflnu33B107f11b1
ttttgaaaacccacgacattaacttctcgtacaggccagccatggaagttcccagggtctacacctacgatttcaccaacatcgcctttgcaccctacgggaactactggagataccttcgcaaactgtgcaacacggagctgttgaccgcctcgagggtccagtcctttcggtctataagagaagcagaggttttaaatctggtgaaaacgatacatgagagcaagggggaggcggtgaaccttagcgacatgattttctcaatgacatatgggatagttgccagagcggcctttgggaaaaaatgcaaggatcaacagacttacattgacagcataaccgaactcacaaagttgctttctggcttcagtttgtctgatttttatccttccattaaaccgcttcagctttttagtggtatgaagaccaaagttgagaagatgcataaggagaatgataagatcatcgcgaacatcattgcggaacatagagagagaagggtcagagaaaagagcggacaagcagaagctgaacaagaagatctcgttgatgtgctcttaaggattcangaggagaatga

SEQ ID NO: 16787 - DNA, 456 bp, Gossypium hirsutum
  unsure (1)..(456): unsure at all n locations
  Clone ID: uC-gsflnu33B107f12b1
cgnctgaataaaaacaaaagaaaagaaaaacaaaaaaagagaaaaatatataagagaaaagaaccaaatacaacacaaccaaaaaaacaagtcacgcgccgatttctccgggttggggctgctgggtactccttcacttactgtccgttactgggggggggcccgtttgggggcccccggttccctcccccggtcggggcggtgtacgtttttttttgggggcccccgaggccttttcctggggcggcgttttcccaccgtttgggcggggaaccccggggggtccccggtttttgtgccttggggggccttccccttttccccggtggggctattgcctaaggggccccccctgtcccccttccccacaggttctccacccgatggggcatggggtccccccccttttctggcccttttgcgcgggggtggggggggtccccccagggtggccct

SEQ ID NO: 16788 - DNA, 178 bp, Gossypium hirsutum
  Clone ID: uC-gsflnu33B107g01b1
ttctacgcgtccgcccacgcgtccgttttattttttctgcaacctatgttttgatgtctcgaaaaatctggtttatttttgggaacattaccattttaggtaatgaatgctccccgtcttaagaattatatcaacttctttatattaatgtttagttttatcttcatcattgtgtttt

SEQ ID NO: 16789 - DNA, 570 bp, Gossypium hirsutum
  Clone ID: uC-gsflnu33B107g03b1
tttccgcgtccgcccacgcgtccgaaaaaaaaataataaaaaaaaaaaaaaaaaaaataaaaaaaaaaaaaaaaataaaaaaaaaaaatatattattatatatttattataaaaaattatttagggggcggccttttttgaggttccaggttttcttccccttgcttgcgacgttttattttttttttagtgtcccctaattttatttccttggccttctttttacacctttttgcttgtgaaacccctggggttccccactttattttctttgcagcccttcccctttttccctgttggcttattagcaaattggccctccccgttcccctttcccaacattttcccatcttatttttcaatttggtacccccctctttccgtccctttaaccccggtggttttggtttttccccccagttttccctgttcttttgccagttcctttgcgccctttttttggtttttttcctttcttttttcccccttttcttggttttccctttagcttttattggggcttcctttaggttcctttatttctttcggcccttgccccaaaaccttttt

SEQ ID NO: 16790 - DNA, 468 bp, Gossypium hirsutum
  Clone ID: uC-gsflnu33B107g04b1
tttacgcgtccgctccaaacccttgagcgccgtcggtcagccttatacgcacggcctccgtcgatgcccggtctccaatcgcgacggagagggcaccaactcggcgatttcagcgaaaaggtatgaaggttgctgaggggtgccgcgcatgtggaggcgcaactctcgcggaggaggcctctagctccgagttgtgcgccgatcgggactgctggaggcggcggctactgctagggtttctcaacccttccattttccattagtttcgggcctggattgggaattagctattgggcccgtttattgggcttgtattttttctttgggtttattcgttaataggccaggccaaaattggtattacacataatatgtttgtattatattgttttacttgtagtttgaattgttatgtaattattgttttttggcaaaaaaaataaaaacaaacaaatcgttgagctagct

SEQ ID NO: 16791 - DNA, 513 bp, Gossypium hirsutum
  Clone ID: uC-gsflnu33B107g05b1
cttaagcgtgcggtttacgatcagtacggggaagaagggttaaaaggccagatgccgcctccgggtgcgggagggtttcctggaggggcggacgggggttctggcccgacgatgttccggttcaatcctcggaaccccgaagatattttctcggagtttttcgggttttcgagtccgtttggagggatgggtgatatgggcgggtcacgtgctgggatgtcggggttccccaggggcatgtttagggaagacatattcgggtcgtttaggggtggagctggggagggttctacaactatgctctgtaaaggacccgctattgaacaaccattaccttgcagcttggaggatctatataaagggacgaccaagaaaatgaagatttctagggatgttaccgatgctagcgggagacctagtacggaggaggaaattcttactattcagattaagccaggatggaaaaaaggtacataaataacatttccagaaaagggaaacgagcaacgaggt

SEQ ID NO: 16792 - DNA, 562 bp, Gossypium hirsutum
  Clone ID: uC-gsflnu33B107g06b1
ttttacgcgtccgcccacgcgtccgcccacgcgtccggttggctcttcacgccgtcaacgaatattaccggctgccgtggaagccatcggtcaccaccaatcttctcggcgccaacactctgatttatctcaggccttcgttcctagattttttcctctcttttgttgatgaggtttggttcaatcctcatatttttctcaaggtatcttaggcacttgaatattccaaagttttccttgttcatctgctgattttggattctcatcgttaaattcaaaaaaaaaaaaaaagaaaaaaaagagagaaagggtaaaatgaaaatggcgtcggctcaggccttgccttcttcacggaaacaagagcatctagaagctgggaagcaccgggtacatctttttgttcttaattttttccctttatcgattaatttgatgttttctttctgttttgaaatatgattttcaatctagtaaatggtttgggtactatataatcagctattttggatattgatttcggaataggactagaattggcagtctatttggtattttcatattg

SEQ ID NO: 16793 - DNA, 301 bp, Gossypium hirsutum
  Clone ID: uC-gsflnu33B107g07b1
tctctggtttttaggttgaggatcaatgcgccattaaatcgatacattaggaagacattttatacgcaagaccctgttgtggggtacacggactatcccttcctggtagtacaatcacgactttgatgtgcaatggctgtgctgttgaatatatgttaaaattatgtgtgaaataggagagtctaatttgatatcaaacctgtgtcttggtttttgtacacaattctgggactaccctaagctcacctgctcagatgtaacgaaacaaaattattataaaatccatggaatgtagtggaag

SEQ ID NO: 16794 - DNA, 515 bp, Gossypium hirsutum
  Clone ID: uC-gsflnu33B107g12b1
tcttaaaaatgggctccacccaatccgttcaagcagtcgaagaagaacacgaagaaagcccagacgatgacgaagacgacgacgaagacgaagaagaagacaataaccaaggaggacccaacatgaggcaactcgaaaacaaccacttggtgaagaaagtactggaacaggagccggaaatgttaccctgttacgcttcagcaacccctctctctccacaactatcttccctgggtactcctaggatgggtccttctatcaaagtgtgggacccatataatgttttagctccacctcctccgctgcctccgcctcctgttttctccccttctttctctttccaccatgatcgattgctgctcgaggtttatttcatttgccatggcgagtctgatttgaatttgaggcctgatattgtcggtggaagatgcgacggtgccgccttgacctctaatggcaagcgccaagccagggctttggctgtcttcctaaattctcaaggggtcacctttaat

SEQ ID NO: 16795 - DNA, 540 bp, Gossypium hirsutum
  Clone ID: uC-gsflnu33B107h02b1
tttgtttctttggggttctcactttttcactcgctcaagccattattctatttttctcccatctataccgcagaaatgagagacaaaatggaaaagcttgttattcttcccttctcggttggttgtgtctctgattcaagcgtggctgttgcagcacagcggcaccaccaccaccaccagcctaggagatcaaagcctcctcctgctgctgctgacaccaattcaaatgcaaaaaaaaaggaagacgaagacagtttatcgagtgaaaacatgaagtactcattgaagttactgcctcttccaaagcctgacatatcaactgggtttaataggctcgtcaccaagagtttcaagacattatctcagttatttgcctacaaagacgagatagtagagtcggaaaatgaaatggaaatcggattcccgacagatgtaaagcatgtgacacacataggattggatggatcggcatctaccagccccagcaatggcagctgggacaatcgtctctctctcatgacttgtcactttcccagcata

SEQ ID NO: 16796 - DNA, 590 bp, Gossypium hirsutum
  Clone ID: uC-gsflnu33B107h03b1
tgctacagatgaagagctcgtcgggttttaccttcgacgaaaagtcgacaacaaacccctcacaatcgaactcatcaaagagatcgatatctacaaatacgatccttccgatctcccgaaaactggcatggtgggagagaatgaattgtatttcttttgtagacgaggaaggaagtaccggaacagcgtaagaccgaaccgggtgacagagtcggggttctggaaagcaacgggcatcgacaagcctgttttttcggttgaaggtggtgaagccatcgggcttaagaaaacgttagtgtactaccgtggaagtgggggcaaaggaactaaaaccgattggatgatgcatgaatttcgcctccccaatcccacaatgacggcacatgatgctgaagtatggacgatatgtcgatgtttcaagcggcatagaaaaatcaaacaagattggagacaaggtgctgctaaaccagctttaactggcaattggcaatgtgtacaaggctatgaaagtggcagtgtgtgatccagcagccatgaaaattacattacattggggtctcagaatgtttgaaactttgatgatgatgatg

SEQ ID NO: 16797 - DNA, 342 bp, Gossypium hirsutum
  Clone ID: uC-gsflnu33B107h06b1
tccacgcgtccgcccacgcgtccgcccacgcgtccgcttacgcgtggtcggacgcatgggccgtacgttgcgtggtgtccggtgcgcccaaggcggcccttgaaaatcctgaggaccgagtgccgatcgcgccaggaagtactgataaccggatcaaggctggactgtgcactaccatgtgctatgggaccaaaacatgcatgggaagtctgcgatacggatctctaaacctcggcataaggatcgcgtatgaggggtgcacacgctgggtctatgctgtaactcctgcctagacggcgcactgttaaagctgctcacgttgggagagcctatcgccagata

SEQ ID NO: 16798 - DNA, 562 bp, Gossypium hirsutum
  unsure (1)..(562): unsure at all n locations
  Clone ID: uC-gsflnu33B107h11b1
ttttccacgcgtccggtttgtttgctcataatcacagggaccgaagcagcacggacaagagtggaaacattttgcctggcactgtcgttgattcgaaaatctgtcatccatcggaatttgacttctatctttgcagccatgccggtattcagggaacaagtcggcctgcacactaccatgttctttgggacgaaaacaattttactgcggatggaatacagtctctaacaaacaacctttgttacacgtatgcaaggtgcacgcgctcggtctctgttgttcctcctgcctattatgcacatttagctgcattccgagcacggttctacctagaaccagagatgcaagacaataatagctcaacgggtgctggttcaggtcaagcaaaaggtggtggtacaaaggcagcaggagaatccggggtgcggccgttgccggccttgaaagagaatgtgaagagagtgatgttctactgctagaaccgtagcanaagctaggcggagatgcagcaaccatgaacgaccttcggttcacaatgttgtttgacaagtgcttatgatac

SEQ ID NO: 16799 - DNA, 561 bp, Gossypium hirsutum
  Clone ID: uC-gsflnu33B107h12b1
ttctcaaagctttctcagctttttatatattcctacttattttctataaaaatcaaaatggcttctttccttactcaaagtgtcctcaaacttttccttgtcatctctttgtttcaaatctctttggccgttaggaagctgagtgaagtggtgcaagaccagcctcagctcttgacataccacaatgatccccttctttctggcaaaattactatcaatttgatttggtatggcaagttcaagccttccgagagggctattgtctctgattttgtcacctccctttcctccacggctccatcgcaaagcaaccggccttcggttgcccaatggtggaaaaccactgagaaatactaccacctcacctccaagaaatcttccctttccctgtctttgggaaagcagattcttgacgacaagtattcgcttggcaaatcactcaaaaacaaacaaatcgttgagctagcttcaatgggtgaccaaaagaatgctatcaacgttgttttaacagcatctgatgttgctgttgaaggttctgcatgagccgctgtgggactcatg

SEQ ID NO: 16800 - DNA, 379 bp, Gossypium hirsutum
  Clone ID: uC-gsflnu33B108a01b1
tttacgcgtccgcccacgcgtccggaggaaaaaatgttttctgctagggtttttaatcccagcccccactgccgccgttctcaaacgaaccaacctccggcgttcgaaggcgcttcgggtctcagcccttcgccaggctcccgatttggagcgatgcgagtgtaggtttcaacggggaagcttcaaagtccgcgattgcaggagttcgtggagtgtacgacgcgaggaaaaggggtggttccgcaacgtgcgccgatcagatctgctggagcgcgtcgtatgggctgttgcggcgctgaggcgaatgcatctagggtttcggtgttttggggttttgggtaattgggcctaggctagtagctttgctgtattgggccat

SEQ ID NO: 16801 - DNA, 380 bp, Gossypium hirsutum
  unsure (1)..(380): unsure at all n locations
  Clone ID: uC-gsflnu33B108a02b1
gttaaatctgtatatttcatccatttgctatggaaggacagtttcttgaagtttattatttggaagaaggtaacctccagttacaagtaaaactcgaaacatattggtatcttaaatcgagcttgaactttaaaaatcgaacttatctgagttgtatttttgagcttcgaatttcgattcaatatcaaagctttttatagtctatatttttagtgttaaatgaaatttaatggctaagtttgtcgcttttttcatttaatacggtatttgtattattttttatcaaatgtgatacttgtatttgataaaaattatacattttgatnaanaaaaaaaaaaaaaaaataaaaaaaaaaaaaaaaaaaaaaaaataaaaaata

SEQ ID NO: 16802 - DNA, 508 bp, Gossypium hirsutum
  Clone ID: uC-gsflnu33B108a03b1
ttacgcgtccgcccacgcgtccgaaaaaacagagagaaggctttcaaatctctttcccttttcgaccaaagccaccttcatcggagatccggcgcgcccagactaccaacgacgggaaaaaaaacttaaaatcacctttaacgagttcatgggtgtgcatgtctctaacgtggcgtggtggagcggcgcacgttgtcgggaggtggcttttggtgcgtgaggtaggcgtgcggcgactgagacctttaggtagattagcgttttttcaaaaatgttaaggtgttgggctagaactttgggctagggttaggtatttggattgggtttcagggtttgggcctattgtaattgggtttggagtgtatttatttttgcttgtgtgttaaggttttttttaatggggttgggccgggcaattttgggccataacagaacgctatcgggcgttgagcaaaattccagaacattcaacgcatttgctcatatgagtgagaagattttttttcta

SEQ ID NO: 16803 - DNA, 508 bp, Gossypium hirsutum
  Clone ID: uC-gsflnu33B108a04b1
tccaaacagtccacaacatcctcggactcaggccgagtgccgcctctctgttccgattacgctccgtacccgaaattagaccccaagcacgtcgcttctacaccggagaattggactaacgattccatgggttcccagtcgcagcctaatcaagggccggcgacgttctctggcagcgctgctaccaccatgccggctgagtcgaatccttacgtttctcctgctccggttcgatcatctttcgtcaagacagataagatgggagcagtgaaagaggtgttagggaaattgggaaagaaagcggcggaggatactaagaaggcaaaagagatagctgggaacatgtcgcaacatttgaaaactgggccaagttttgctgatgctgctgtaggaagaattgctcagggtaccaaagttcttgcagaaggtggttatgacaagattttccgaacaacatttgagactgttcctgaggaacagtttcttgagacttatgcatgttacttgt

SEQ ID NO: 16804 - DNA, 187 bp, Gossypium hirsutum
  unsure (1)..(187): unsure at all n locations
  Clone ID: uC-gsflnu33B108a10b1
gcgttctcgcgtccgctttggaacttttgtttatttgagttagagatgagaaattggaagaagtaataacttttaaattttatgtttcttgaattatatttaacgccattactattctacgtgcaaaanataaggataccatgttcaatctaattaagggtcatagaatttaattttcaaatgaatg

SEQ ID NO: 16805 - DNA, 401 bp, Gossypium hirsutum
  Clone ID: uC-gsflnu33B108b01b1
tttacgcgtccgcccacgcgtccgcctttggaaccctccgatgagacttgctacccttccgctacaccctccgatggcgactttgattacgcacgtcccgatttcttttccggttacgcgcacttagcttatgccgacgaagccctcgaaactgaatacagtagctatcttaaacccaagccccgacctggacgattcgaacctgcacctgcttttggtgactatggaaggaaacctgaatatgagcaattcgaatctggtcatggacgcaaaccggagttcggacgacccggctccgaatttgaatctgattttggccgaagacctgaattcgagcagcctcctgaggagtttggatctgggcatggccggaggccggcatatgagcattcacatcaacc

SEQ ID NO: 16806 - DNA, 507 bp, Gossypium hirsutum
  unsure (1)..(507): unsure at all n locations
  Clone ID: uC-gsflnu33B108b03b1
tttgtaaattggagtcttgttactaaaggagtaacagatgagcagaaaaagatgaatgctacctacataattagtattgcgaggaagcttggatgctcaatatttttgcttcctgaagacataactgaggtaaaccaaaagatgatcctcacattgactgcaagtatcatgtactggttcttgaaacaacctgttgaagagaaaccatctgcaacatcagatagtgaaaacggaagccaagtggaaacgatctctaattcaacaaccgacgactcagcatccgagtcatcagtagagtagaataagaatgtataagtaagtgctgaaaacattgttttccttttcttttctttttttatgttttctcttcatagcacttcccgtatggattcgaatttgattgcaaagattgttgtatgacattacagaatcgggngtgttcatgcanatcttgcaaaaaaaaaaaaaatgcanatgcctatgtgaataagcgaatttcccttcttt

SEQ ID NO: 16807 - DNA, 505 bp, Gossypium hirsutum
  Clone ID: uC-gsflnu33B108b04b1
ttcacgcgtccgcccacgcgtccgaaatgcctcaagaaagtggtgaggactttcgaaacacattgtggatcactagcccaatacgggatgaaacacatgcgatcccttgcaaacatctgcaatgccaggattcagacagaacagatggctgaggcatcggcacaagcttgtgtcagcgttcctactggtcgttggagctctcttcagaaagggttcagtgcataaaaataccactggaatcggcaaatattatcggccaaagcttggattatgtttggatttactgtgttttcttatatcccgaatagttcgaatggtgctgcattttgatgattattcatgcggtttcttatttctgaagttatgtcggagcaactctaataccagactgctaaatttatgtaaatatgcttaggaagtgttctataatacacgacgatgtttgtttataaatgatctatgattgaactatcataaatgaaaagaaatgcttgttttaattaac

SEQ ID NO: 16808 - DNA, 486 bp, Gossypium hirsutum
  Clone ID: uC-gsflnu33B108b07b1
tttctcctcgacctaaaagaaagccagtacatccatatccccgcaaatctgtcgatttggtcaaaggaaaatcaccatcatctcaaccagagagatctccatcccccaaccaatttttcagagaacaagataacaaatcaccaacgtcagttttatctgatgcagtggggtcttctgccttggagcaacagaaaggatgttcttccccaacatcttgtactacaaatttgcagtcaatcaatacatcccctgttgaaaaggaaactgactatgcaacctctaacttagctgctgaggaagagaaaccctctttgtcatctgtgaaaatatttggtcaatcagatgcggagaacattctgtccatgaacctcaatacagatttaaggacttttgttttggtgagggcatgcagcacctgttataccttccactagttttaagcttttcgggaaaacagttcaggtgaaaagattccctaaccctttc

SEQ ID NO: 16809 - DNA, 439 bp, Gossypium hirsutum
  Clone ID: uC-gsflnu33B108b08b1
tcggtggctctaagaacgataaggaccttagagccggtgtggctttgtgcgcccgggctgcttttcttggccacatcgatgctttgcgtgagctcggtcactgcctgcaggacgggtacggcgtccgacaaaacatcaccgagggtcgtcggtttctcgtccaagccaacgcccgagagcttgcggcgggtttatcatcagcatctgtttcaaacatcgctacgtgctcttggctcacctggagcccccacccgatcccccacccgaccaaccgtcatccgaacgtgccgggatgcccgttgctgagtgattttggatgcaatgtaccggcgccggaggctcacccggcgaacaagttcttaacggattggttcggctctcgggacgggattcccggcccgggtttgaggctatgctcgcacgttggttgtgggaggcc

SEQ ID NO: 16810 - DNA, 384 bp, Gossypium hirsutum
  Clone ID: uC-gsflnu33B108b10b1
ttcacgcgtccgccttcatcttggctgctctgctacttacagcttcactaactgcagcagctaggccagactcattagaagctttatcatctgaggaaaaggggcaacaaaggcagcggcaaaccaggcaaccaaaacaacaaaggtagtggtggaaacactggtgggatgggcggcttcttcggtccagggcctgggtttggattgccagggtttgaaaaagggtggggacatgggatcgtaggcggtggctatggagctggcttcggaggtcctaccggagggtactcaaaaggtggtgttattagaactacggttgtttgcaaagaaaaaggtccttgatttaacatgaagctaacctgccctgctaagtgcttcacctat

SEQ ID NO: 16811 - DNA, 444 bp, Gossypium hirsutum
  Clone ID: uC-gsflnu33B108b11b1
ttagtctggagaggaagatgccatggatgctggcaaggagaatgctgcaaatgaagctgaggagaaagagccagaaaacaaggagatgactctggaagaatatgagaagattgttgaggagaagaggaaagctttgcttgcccttaagactgaagaaagaaaagttgataccaaagagtttgagtccatgcaacaactttcaagtaagaagagcaacgatgacatttttatcaaactgggttctgaaaaggacaagcgcaaggatgctgataaagaagaaagagtcaaaaagtctgttagcatcaatgagtttctgaagccagctgaaggggagaggtactacggactcgggcgtggtcgaggccgtggcccgtggtcctagaggtggatatggaggcaatacagtagcagtgtgttagctccctcatcgaagatcctgggcac

SEQ ID NO: 16812 - DNA, 489 bp, Gossypium hirsutum
  unsure (1)..(489): unsure at all n locations
  Clone ID: uC-gsflnu33B108c02b1
tgtgtccgtgttaggaggggtggtcgcaagaggcctgttcccaagggtatcgtgtatggtaagcccacaaaccagggtgtcacccaattgaagttccagcgcagcaaacggtctgttgctgaggagcgtgctggccgaaagttgggaggtctcagagttgttaactcgtactggatcaatgaggattctacttacaagtactttgaggttatcctggtggatgttgcacacaatgctatccgcaatgacccaagaattaactggatctgcaatccggttcacaagcacagggaacttcgaggacttacatctgctggtaagaaaaacaggggtctccatggaaaggggtcatttgcaccacaagaaccgtccttctcgcagggcaacctggaagagaaacaacactctcttccttcgccgctaccgctgagttacctgtgttcaactttttattccttgntgattttagaagtcatcgttttgagtttg

SEQ ID NO: 16813 - DNA, 508 bp, Gossypium hirsutum
  Clone ID: uC-gsflnu33B108c04b1
ttcaaaactagtggttgttgaacttaaaacactgttctgttctccccctttcctcttggtgtccggtttcagttccatctatttgtccatggatcttacacctcagcaacttatccagttcaacggctccgacccatccaagcccatctacgttgcaatcaatggtcgcatctacgatgtcaccgccggcaaatccttctacggtcctggtggtgcctacgccatgttcgccggcaaagatgccagcagagctcttgcaaagatgagcaagaacgaagaagatgtctgtcccaaccttgacggcctctctgaaaaggagatggatgtccttaacgattgggtcaagaaatttgaagctaagtaccctgttgtcggccgcgttgtctcttgaaaatttgcacctttcctctatgttgggtgtaatttggttgggtttttaaagtgtctttagactctggttattacttatctataatttcgtttgggtgttttgcttacctcaaacaat

SEQ ID NO: 16814 - DNA, 168 bp, Gossypium hirsutum
  Clone ID: uC-gsflnu33B108c05b1
ttttttctcctttttggtggtagcaaaagaggcattttttggctgctaatatactagagactagagaaagggtagtctaagggtttcatgaatatttgtatttttattatttcctttccatttccgaattgatctgagtatatatatgaaatgatacacttccatgtc

SEQ ID NO: 16815 - DNA, 364 bp, Gossypium hirsutum
  Clone ID: uC-gsflnu33B108c06b1
atttcgaataccatttataagaaaagtttaaattttatttaataaaacaaaatccagatgtttttatatataaattttcatgggggagttaaaatagagagggggaagggagagagagagagagagagagagagagagaggtgatcttttaaagatatttggcggtaaagccccctggctgtgatttgcagagagaatcatatggacatataggcggcgcatggtatgtataaaaaaacccaatgatctgcttaccctatgaaacatcaacaatactcttatcgcgtgattgggattgctcttgagcttgaatactgtgtcgtcatttttacccaaaatgaataccaaaattcattcccaattt

SEQ ID NO: 16816 - DNA, 233 bp, Gossypium hirsutum
  Clone ID: uC-gsflnu33B108c11b1
tttttctataagttctttaacctgtgctcatatataaagacatatatatagcttgtttaagtttttcattcgaaaaatttgtgaaaaaccagaactgctgctgtttttagtgacttgttcttttcttttcttttcttttttggggaatttaattacttgcattaaatgtttctttgtatcaagacgttgattacagcaaaatgaaatgaatatataagatactgtttctactc

SEQ ID NO: 16817 - DNA, 52 bp, Gossypium hirsutum
  Clone ID: uC-gsflnu33B108c12b1
tttccacgcgtccgcccacgcgtccgcccacgcgtccggttctagatcgcga

SEQ ID NO: 16818 - DNA, 522 bp, Gossypium hirsutum
  unsure (1)..(522): unsure at all n locations
  Clone ID: uC-gsflnu33B108d01b1
ctcacgcgtccgcccacgcgtccgntttttttttttttttttttttttttgaagaagacaggagaaggagaagataaagctataaaagatggttcaaagcaagnaaaaacccaatgaaaatttagggcatattgggtttattaaagtcaatatggatggcattcgaataggaaggaaagtggatttgaatgctcattcttcttatcatagtttggcttcagcactcgaaaatatgttcgtcagatccgccggtgcagagaagcaacaattaacaatgccatctaagcttttggatggatcctctgaatttgttttgacttatgaagacaaagagggagattggatgcttgtaggagatgttccatggatgatgtttctcacctcagttcgaaggctccgaatcatgaagacctccgaggttaatggacttgctccgagattccacgaaaggaaccgaactcaaagaagtaaactgatataacattatcgaccgacattacaattcgccatttaattttccgt

SEQ ID NO: 16819 - DNA, 451 bp, Gossypium hirsutum
  Clone ID: uC-gsflnu33B108d03b1
ttcacgcgtccgcccacgcgtccgcccacgcgtccggtggatattccggttacccaaattacatggcgaatactgaatcatcccgggctaagtatcgatcccagagtgctccaaggcagaggctggagttagacaaatatggttcaacccgaagaacttatcaggggttgtgggattcaggtaccaactcagaaagagattttcctcatcatgttgattttaggtacagggcacatccgacttccgattgcttgaattggcctagtagtgctaaccgaggggaatgatcgacgatcctcccttcgcctctcctattttccttttcttgtgtgtgatagcaaccttgtctgctggagttgtaattagtttaccatgatgtgaaaaactttgatcctgcttgatcaaatttagcattattaatattgaaaaaagaaaatctagtatgattgcc

SEQ ID NO: 16820 - DNA, 490 bp, Gossypium hirsutum
  unsure (1)..(490): unsure at all n locations
  Clone ID: uC-gsflnu33B108d04b1
tttgatgatggtttatgtcggccaaatttgtatttaagtatatacgatcaacgtggcggccgtgccccgacgacaaactagcagccaagtgggaaactatactgcaattcatttcaccccccactctctgtttatggttttggtcttttgggaggattccggccatggaaggtgactgttgttcttcatcgacgtcgagttcaacgagcggtgagaagccgaaggcggaaaggacacaacaaaaggagaaaccatatagagggataaggatgaaggaagtgggggaaatgnggttggcttgaaataaggggaacctaacaagaggtctaggatttggctcgggtcgtataccacccccgttgccgccgcccgtgcctacgataccgncgtgttctacttacgagggtccgtccgcgaggcttaactntcctgaccttatagaaaaggataataagcttaaggatatctctgccacttccatacggaagaa

SEQ ID NO: 16821 - DNA, 470 bp, Gossypium hirsutum
  Clone ID: uC-gsflnu33B108d05b1
ttttactgcctccaaagccaccagtccaccccagtccaccaatagtgaacccaccaacaccgccgattctaccaccaccatcaccacctattgtgaagccaccaacgcctcctatcgtgaagccaccttcaccggaaacaccgtgtcctccaccaccacctccggcacaacaaacatgccccatagacactctcaagctaggtgcatgtgtggacgtgttgggtggcttagtacacatcggcataggtagcagcgccaaagacacttgctgccctgtactacaagggctgttggatttagacgccgccatttgtctctgtactacgatcaaggccaaacttttgaatatcaatattataatccccatagcttttcaagtcctcatcgactgtggcaaaactccacctccagggttccaatgtccagcacaatgatgaaaaacataaaaaccccctgttttttttctttcg

SEQ ID NO: 16822 - DNA, 363 bp, Gossypium hirsutum
  unsure (1)..(363): unsure at all n locations
  Clone ID: uC-gsflnu33B108d08b1
tgctttatttaaaacataagtttctatacttggagtaataaaaaaaaaaaaaagaaaaaaaaaaaaaaaaaaaaaaaaaaaaaaaaaaaaaaatagggcggnccgttttggggggtccttgttttggtccccgtgtttgcgccgcgggagctcttttttttggtctccttttttggattccttggccgacgttttgcgccgtgttttttggggaaaccctgtgggtaccccccttggttgccttgtttaacatcctcctttcgcctcctgtttttttcgcgggggggcccgcgccgggggccctttccaacagtttttccccctgtttggcgaatgggtcgcgccctgtgccgccccttttgc

SEQ ID NO: 16823 - DNA, 519 bp, Gossypium hirsutum
  Clone ID: uC-gsflnu33B108d09b1
tgtacgcgtggggttaaagattttttatgaactaaagctaaagaagactaatacaaagaggagcaatttgatctgtcaatcgccgcaacccattccacttcctctagtgcatcctcaatccaaaattttccttcaaaaaattggcctccctttttagccaaggtatgagctgcgttgtttgcttctctcctaatatgatgaaaagtgatttgtttaaagaaccccaacttatgtttgatatctgctaagatcaggctgaggactgatctatcatttgtatttgcatacaacttttttatcaccgtcaataagtttccttaaatctggacgcaatgaaagccaatctcctaagcaaaccaaatcacctacttgcacgctcgggcttctgcaacaaagtgtcgacaatattaaaatgaaggtaagtacacaccaccatgatcagtctattttcatttctttttataacacctaagatagatttcttttcttgtaaattaaaagctgagtcaaaattaattt

SEQ ID NO: 16824 - DNA, 423 bp, Gossypium hirsutum
  Clone ID: uC-gsflnu33B108d10b1
ttccacgcgtccgcccacgcgtccgcccacgcgtccgcccacgcgtccgcctcctttcacttttacactcttctaattccactatattttcccctctcagtttctcagtaaccaaacagagcacaaaataccaggaaaccgcaataaaaatgactgacgcttccgaggaagctaagcaaatcgagaagctctacgaatttggcgaacgcctcaacgaggctaaggataagtctcagaatgtgaaagactacgaaggaatcatcgatgccacgaaaacaagcataaaggcgaagcaattggctgcgcagctaattcctcgcttcttcaagttcttccctaaccctctcagccgtgctcttaatgctcatttcgatttgattgaagaagaagatttggcggttcgggtgcaagcaattcgggggc

SEQ ID NO: 16825 - DNA, 359 bp, Gossypium hirsutum
  Clone ID: uC-gsflnu33B108d12b1
tctgtttgaacttctcctatctaaggcacctccaggtaagcaagaggaattgaggagcctgattgacatttgtgttcagaggggtttaaccaacaagtctatcgatccactagaggatccctctcagttctgtgctgccacgctcagccgtctgtctactattggatatgatgtttgtgatctttgtggggccaaattttccgctctctctgctcctggatgcatcatctgtggcatgggaagtattaaaagatcagatgcactggggggggcaggaccagttccttttcaattggcttgaatcacaatttaccatttctttaatcttgcaagctcttctgggtaaggtggcttttttc

SEQ ID NO: 16826 - DNA, 492 bp, Gossypium hirsutum
  unsure (1)..(492): unsure at all n locations
  Clone ID: uC-gsflnu33B108e01b1
tttaaatctttccagtttctattttctaaaaacaaaactgaaaatgtcttgctgcggaggaaactgtggctgcagctctggttgcaagtgtggcaatggctgtggaggatgcaagatgttccctgacataatagagaagactacaactgagactattgttcttggtgtgacaactcagaaaatgcactttgagggatctgagatgggagttggggttgagaatggatgcaagtgtggagacaactgcacttgcaacccttgcaattgtaaataagagggggnggaaaatgaacaacanagagaagcagagaggcctttgtctttttaactaaataaattctattactttagtatgtatcagcaaatcttcatgaggattttggttcttaatnatgtgtaatgtgggcttttctgctatgtcngaatgtattatgatatttaagaaaggtttgttttcaattgaaaagatggcaagttcctttctctttgact

SEQ ID NO: 16827 - DNA, 394 bp, Gossypium hirsutum
  Clone ID: uC-gsflnu33B108e04b1
ttcctgcgtctggtctctacgaatcagttgaactttaatttgttcttatgttatcatcgcagatctaacccaccgtcgggtgagctgggtttatgcggatctgacccgaatcccgtgtcgacacggataccgaaccccaaattgaccagcacggggaacgaagcctaaatcttaaggaggtcaggcggacccttcattagaaattgtgtagcgtgacgaaactgcaagcttgggactatcaccataagtgaatacagcacttagctaagagggggacactagtagtaccttacgctatactgcttgcctcacttacccgaagcttccatcctgaactacaatctcagactgaacatattagcgctcgcatttacgtatgtgatcaatacccgtg

SEQ ID NO: 16828 - DNA, 497 bp, Gossypium hirsutum
  unsure (1)..(497): unsure at all n locations
  Clone ID: uC-gsflnu33B108e05b1
ttcacgcgtccgttggaaaacagggttttctcttcttcttttccttctatttaattgattaattttctgtttgaaagatctttagatttggtttgtgaaagtattgttgaatgctcagactgctcacagtagttctctttcaccttagtattggattataccatcacattcttagctttttaattacttaaagtagttcaccttctccttaattgctattatactgttgaagatctgtgttttgtcttcattagcatagattacttgttacatatgtaagttgttagatgttttctatggtcattctgtgcaaagaatgctattgcagaaaagatatttgtgttatatatttgataatagagaaaaactatttgcttgggttgtgtgnntggttttcttaattgttatcaacaggctgtctaaagaggtctttgagagaaggcccctaagaaacctgcctcaaaagctactgaaaagaaaggggaaactgttgaagt

SEQ ID NO: 16829 - DNA, 191 bp, Gossypium hirsutum
  Clone ID: uC-gsflnu33B108e06b1
ctcacgcgtccgctgaattccatgattttggtcatggttagtccaaaaataaagtctctgtattcctttttttttttactttgttttataaacccaaagtaaattctacaatggttgtggttgtggaacttagagcacaatatttgaatggcacaatttatatatgtcagtacatgtgcagtttatggcac

SEQ ID NO: 16830 - DNA, 451 bp, Gossypium hirsutum
  unsure (1)..(451): unsure at all n locations
  Clone ID: uC-gsflnu33B108e08b1
tccagctactatggaattaacacatttctggggtactgaaaacgaccctgagttcaaaggataccacgatgggaattcagaacctactggcttcgggcacattggcatcaccgtggatgacatgtataaggcatgtgagagatttgagagtcttggagtagagtttgtcaaaaaaccaggcgatggttatgcattcatcaaggatcccgatggttactggattgaaatctttgatttgaatggaattagagcaatagttaacaatttagcttaagctagtgcttcaccaagttcaggaaacaaggatatggcatatgtagtaggtttccgttcgttgtcatgattctagtgttataatgtctgctctcgtacattaattcctttgctttctagaacttatcgaaagancaaattcggtgaaatcttaattgaagcacatttcatttttaaa

SEQ ID NO: 16831 - DNA, 462 bp, Gossypium hirsutum
  Clone ID: uC-gsflnu33B108e10b1
ttccacgcgtccgcccacgcgtccgctcaacgtcaccattggtacccctcctgttcaaccctgctgctctctcatccaaggtcttgctgatcttgaagctgccgtttgcctttgcacggcaatcaaagcaaatattttgggcatcaaccttaatgtcccactttccctcagtttgcttcttaatgtctgctcaaagaaagtaccctctggcttccaatgtcgctaaatcagttctctaaattctttctcttcttagtgctgcgtggttttgatgttcttaaggtccagtttgaagtgatcaatgttttctcggtaactgggtcgtttaatctacgatgttgtagtggttgtttccttttggattgattctgaataaatgtaacaccatataaaaaagaagatgtttaatttctttggaattatgtatcttcatggggaatgaaatattagtataattcagct

SEQ ID NO: 16832 - DNA, 384 bp, Gossypium hirsutum
  Clone ID: uC-gsflnu33B108e11b1
tctcccttgaccactcttagcatcacagtaaccgaatcagggccttcttctccgtccggttccaagtcgtccggtgactctatgatcccatcatgggtcgatggggcgacacgtgggcctagaacaatcgggacgacgcaaacaacagcccaagtacatcctcaattattcacaagaactctgctaaacacagccgtcgagaaatatggtgttgaggtggtgattgggaaactggagcagctacgtgttgaggaggggagagttgtatctggttgtactcgaagggggacgaggtattgagtcggactcggtcgttctatcactggggcctaggactggaaagttcgagatgttagctacaatgttcagagtttctgggcttag

SEQ ID NO: 16833 - DNA, 520 bp, Gossypium hirsutum
  Clone ID: uC-gsflnu33B108f03b1
ttttgcatatgcagcaatttggctggatgatgatggatttgttgctgaagggcctagtatgaatgtggctttcattacaaaggaaaaggagatgctgatgccccaaaatcgacaaaattttgaatggttgcacggctaagagagttttgactcttgcggagggactggtgagagaggggaagcttcgcagaataagagtggataacgtgagcgtcgatgaagggaaaagcgcagacgaaatgatgcttattggcagtggggtccttgttcgccctgtaatacagcgggatgaacaggtcattggcgacggcaaggaaggtccaataactaaaactctcttgaattttatcctggaggacatgaaatccggtccttcatcagtccgagtacctgttccttattgaagcaaaagctttgattcattctcttgctctcagaggctctgtcaaagaatctgcttctcgcttgttggctctgcatatagacataactctgtaatatcttataatgcaaagcacta

SEQ ID NO: 16834 - DNA, 500 bp, Gossypium hirsutum
  unsure (1)..(500): unsure at all n locations
  Clone ID: uC-gsflnu33B108f06b1
tgttcgcaactccgtaccgcgtaacttgggattattattttttgtctcgagagcatacgctcgaaatcaaggaatggcaagataaagctgagtatgaatatgtgaaaaacagggggatttcaatttttctgatgcaagcagggatgcttggaacacttcaggctctatgggatgtgtttcccttgtttacaaataccggatggggtgagaattctaatattgggtttcttgagaaacatatgggggctacttttgaagaacgacctcagccgtggtttactaacatcagtgtcgatgatgtacactcgggagatttccttgctatatctaaaattcgtgggcaggggggtggtttcgagactctcgagaaagggttagtggtgcttatgctggtcatctgctgnttgttaaaggattccgagggaagctatgattggtgaataggacatgaaatgagaaggagagatatattgcgatcgtccatgggatgaatgtggatt

SEQ ID NO: 16835 - DNA, 67 bp, Gossypium hirsutum
  Clone ID: uC-gsflnu33B108f07b1
tttccacgcgtccgcccacgcgtccgcccacgcgtccgcccacgcgtccgctagttctagatcgcga

SEQ ID NO: 16836 - DNA, 434 bp, Gossypium hirsutum
  Clone ID: uC-gsflnu33B108f09b1
tttgaattctttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctctggcttgggtaatagaagctttgtttgtggggaaataatggat

SEQ ID NO: 16837 - DNA, 246 bp, Gossypium hirsutum
  Clone ID: uC-gsflnu33B108g01b1
tttatgcttccgaggcagcctggactgaaggggagctgttatgcgctactacgcgactgccagacaacagaaatggtgcttacgctggctgagattttaacacaaagtgcatgacgatcaggtaaggctcttaggaaggaacgaaagccattgaaaagatgtgactcaggtataactaacacgatgcttactatgccgatggctatggacaccttctcataggacccaccattgagatggttatca

SEQ ID NO: 16838 - DNA, 437 bp, Gossypium hirsutum
  unsure (1)..(437): unsure at all n locations
  Clone ID: uC-gsflnu33B108g04b1
ttctcagacaacaacgaaaggaaaacccgatccaaaactctctccgaaaaaggggaaaaaggtaaaccgcaaaaaatatgttgcagagacccgctcgacgctgtgaaggcaccgctatgggcgccatcgttctcgacctccgtcccggtcttggcgtcggaccgttcactctcgggatgcctatatgtgaagcttttgctcaaattgaacaacagcctaaaatttacgatgttgttcatgtgaagtattatgatgaggagccattaaagcttgatattgttataagttttccagatcatggcttcattttccgatttgacccttggctcaagagattgcgcctatcgaaatttttgatataaacgtcttaaatgcgctatgcacttccttgatggaggaccatctactctgctacgttgnagctgtctagccttttt

SEQ ID NO: 16839 - DNA, 518 bp, Gossypium hirsutum
  Clone ID: uC-gsflnu33B108g05b1
ctctcgcgtccgattaaaacagggaaagaaaagcagcgtaatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgcttgaaagtgcgcttaatggaaagaaattctttggtggagaaaccattggaatggtagatattgttgctagctttg

SEQ ID NO: 16840 - DNA, 270 bp, Gossypium hirsutum
  Clone ID: uC-gsflnu33B108g06b1
ttcacgcgtccgcttcatcatctcctctttctcccattctcctctctctgtttctagtattcatttgtggggtgtcagctcaaacggctcccgcccctgccccctctggccccttgaatttcactggaatccttgacaaaaatggccaatacacctacttccttcagcttttggcacagactcaagttgggagccaagcacaaactcaactcaaaaccaccactgaaggctttaccgactctgctcccacagataatgcctttaacaacc

SEQ ID NO: 16841 - DNA, 363 bp, Gossypium hirsutum
  Clone ID: uC-gsflnu33B108g09b1
ttttgaatgctactcttcactatgcagacaaaaaaaacaagcatccaggttgcgattgcgggacgacttgcaacagccgatctggctaaatgagcgaaaagaaaccggtaaatgaaccgaaacatgagatactcgagaacgacaaccagcactaacacaatcacatgctgagcaggaccggactagatgaccttggagggacctcagatggacactactgagtcaggacaagcatgcatatgaagatccagctagaaaagtagaccatggacctggaaacaagctagatgaaagccaaactttatggcaaaagtagtgcttataacaacacccatgcgttatgacagagtttcaaagagggat

SEQ ID NO: 16842 - DNA, 511 bp, Gossypium hirsutum
  Clone ID: uC-gsflnu33B108g10b1
ttttgtttctcgtcctcttaacgatatcctctgtttgcagttaagaaaagcaaatcatggctgctaccacggtcccagccgccgcaaggcagctatctcctaaagaagccgatatccagatgatgttggctgccgaggtccatctcggtaccaagaactgtgatttccaaatggagcgttacgtcttcaagcgtcgcaatgacggaatttacatcttcaaccttggcaagacctgggagaagcttcagcttgctgctcgtgtaattgtcgctatagagaaccctcaagatatcattgtccaatctgcaagaccctatggtcagagggctgtcttgaaatttgctcagacactggttgtcatgccattgctggaaggcacactcctggtacattcactaaccaactccagacatctttcagtgagccacgccttcttatcctcacagatcctaggaccgaccaccagcctatcaaggaagcagctcttggaaatattcctaccatgcttttt

SEQ ID NO: 16843 - DNA, 293 bp, Gossypium hirsutum
  Clone ID: uC-gsflnu33B108h01b1
ttcttgcttccaagggctccgggccctagaggcaggtgttttgcgctcaaacgggactgactgaccacgacaatggtgctctttctggcagacccactcacgcgaaagtgccacaagagcagttacggttttgaggaacgatacactaccatcgatgagatgtgtgacaactatgactaaaacgatgttttctatggagatggggaaggacatcttcagttaccacctgccaatgggatgctgtgcatatcctggtcacccgccattgccaggaaaatctgctgcccaacagg

SEQ ID NO: 16844 - DNA, 467 bp, Gossypium hirsutum
  Clone ID: uC-gsflnu33B108h03b1
ctcatcgcgtccggtccctaattgctttcaggtggcatgtgagtatgccgaaaataatagagaagtctatctccatcctgtcagatgctggactaggaatggccatgtttagcttaggtctgtttatggcactgcaacccaagatcatcgcttgtgggaactctgtagctacatttgccatggccgttaggttcttaactggtccggctgtcatggctgccgcttcgattgcagtagggttgcgcggcacactcctccgtgtcgccatcgttcaggcggctctgccacaaggaattgtaccatttgtgttcgccaaggaatacaatgtccaccctgcgattcttagcactggggttatctttgggatgttgatagcattaccaataacgcttggtgtactatattcttctaggattgggagggtactttcataggtagccagagatatgacgggaggtttccagggg

SEQ ID NO: 16845 - DNA, 513 bp, Gossypium hirsutum
  Clone ID: uC-gsflnu33B108h04b1
tttttcttttctttgtttatcgttatggcgacaaacaagggtgaaggggctaaagctgtagataaaacagagacaaaccctatagaggaaaaggctttggggtgttccattgggaacctcagcgacaacaaggacgtgtttacaagagctgataagatagattttaagagctgggatttgcaactggataagcacttgagcaaggcttggtctagggacaaagatgtttcgcttgtgactaagaaggacgagtgggaaatcgatttggctaagcttgatataagacatgttatagctcatggaacttatggcatagtctaccgaggtgtttatgataaccaggatgttgcagtgaaagtattggattggggggaagatggggattgctacagctgctgaagctgcagctcttcgggcatctttccggcaagaggttgctgtttggcataagcttgaccacccaaatgttacaaaggttattggagcttcaatgggaacttccaaccttaagat

SEQ ID NO: 16846 - DNA, 509 bp, Gossypium hirsutum
  Clone ID: uC-gsflnu33B108h07b1
ttttctttgacaagggcaatattctacatggtgatgcagtgcttgggagctatatgtggggctggtgtggttaaagggttcatggggaagacaaggtatggtgctttgggtggtggagctaactctgtgaatcatggctacaccaagggagatgggcttggtgctgaaattgttggtacctttgttcttgtttacactgtgttctcagccactgacgccaagcgcagtgccagagactctcacgtccctattttggcaccattgccaattgggttcgcagtgttcttggtacacttagccaccatcccaatcacaggaactggtattaacccagctcgtagccttggtgcggccatcattttcaacaaggacaagggctgggatgaccattggattttctgggtgggtccattcattggtgcagcactagcagcactttaccacgttgttgtgatcagagccattcctttcaaatcaaaatgatctacatcaatggtcatgatcatatg

SEQ ID NO: 16847 - DNA, 432 bp, Gossypium hirsutum
  Clone ID: uC-gsflnu33B108h08b1
ttttcgtctccttttccaaacaatcaaaagattcagaacccactcttttcgaccatggcagtatcaacattctcttttgctttgagccttgccattttctcaatctgggccgttgatgcagctcaccaccatgcgacagcgccgtccccttcttcttcttcttcatcctcctcttcctccactgtggactgctcgactctgatactgaacatggcggattgtttgtcgttcgtgtcaagtgggagcgaggtgtcgaaaccggaaggaagttgctgttctggattgaaaaccgtgttgaaaacgggccctgagtgtttatgtgaggcatttaagagcagtgcttaatgggtgtttcattgaatgtcactaaggcctccactttgcctgctgcttgtaaaggttctgctccttcttctactaactgcgctgcat

SEQ ID NO: 16848 - DNA, 463 bp, Gossypium hirsutum
  unsure (1)..(463): unsure at all n locations
  Clone ID: uC-gsflnu33B108h10b1
tttttccatttttgttctctttgttttgatttttggaaatgtaattcaagcccaaaattcaccttctccatctcctaaatccactccaaccacatctcctccctccaaatctccttcatcatcgtcccctgcgagttctccaacaacatcatcgcctcccgcgagttctccaacaacatcatcgtcgcctgcaaaatctccgactactactcctcctccacagatccaaccaccggctgcgactccgccttcttcttctagcccatcgatttctcccccaactgcttctcctccggcgtcgactccttcaagttctccgccttcattgactccaactagttcacctccatcaatgactccggccggggctccacctgtttcggctgatattcctttcgagttcaaaaaccgccgcggaaagtcccgggattntcccgtcgagcagtagcccatcgagtcctac

SEQ ID NO: 16849 - DNA, 522 bp, Gossypium hirsutum
  unsure (1)..(522): unsure at all n locations
  Clone ID: uC-gsflnu33B109a02b1
ttctattaaaaatgatcctcaaaaggtacttgtcatggaaaaatatcctccccaattgcatcaaaccccaggtgccatcctcagggcaaaaagttcatccttccaaacgaagtcctagccaaaggctatctctctctgatattagccactttggctctccgttgtcactaaacgatctgtcgaattctcttataagccttcatgtgtttaccctcaaggagctggaactggtaactcacaagttctccaagagtaattttctgggtgagggtgggtttggacctgtttacaaggggttcattgatgacaatcttaggcctggcttgaaggctcaatctgttgctgtgaaggtccttgatttggatggcacacagggacacaaagaatggctggctgaagttattctcctggggcaattaaagcatccncacctggtgaacttaattggatattgctatgaagatgaccacaggcttctggtatatgaatacatggaacgtggcagcttggaaaaccaactat

SEQ ID NO: 16850 - DNA, 359 bp, Gossypium hirsutum
  Clone ID: uC-gsflnu33B109a05b1
tttttaattcaagctgtctaaatgatctgtcattgcctcgtaaaagaatttcaaacaagaattccagagttaatcctatgggtagtctttaagtatagttacccttgttttctatggagccaaacatcatcatccattaaaaaggcccaaacctgttcgtgttctcggtgagttgttgctcttgtaagatcattgttaattctttcggcactcctgtaagactcttaaaaattattgtgattcttcttatggagaaaagaaaagttggactgaaagtacaaaggagccgaaccaaaaaaaaaaaaaaaaccactgcttgacatggtgaacacacactatacaagcccatttatccgcct

SEQ ID NO: 16851 - DNA, 503 bp, Gossypium hirsutum
  unsure (1)..(503): unsure at all n locations
  Clone ID: uC-gsflnu33B109a06b1
ttttatctctggtgaaggctctgatgagatctttggtggatacctgtacttccacaaggcaccagataaggatgaattccaccgggagacatgccgcaggatcaaggcccttcaccaatatgattgcctgagagctaacaaagcaacatcagcatggggattagaggcacgagtccccttcttagacaaagaatttatcaatgttgccatgtctatagaccctgaagcgaatatgatcaaaaaagatgaaggacgcatcgagaagtgggttctaagaagggccttcgatgatgaagagcatccctatctgccaaagcatatcctctacagacaaaaagaacagttcagtgatggtgttggttatagttggatcgatggtctcaaggcccatgctgtccgacatgtgaccgataagatgatgttcaatgcttctttcatatttnctcacaacacaccaactacaaaagaggcatattactacaggatgattttgagaggttttt

SEQ ID NO: 16852 - DNA, 411 bp, Gossypium hirsutum
  Clone ID: uC-gsflnu33B109a07b1
tcttccacgcgtccgcccacgcgtccggtaaagatgacctttgagggaccagagatgagcactactgaatcaggacatggatgcggctgtggatcaaactgcaaatgtaatccatgcaactgctgaaaagcttgatgaaagccatagattatgaaaaaagaaagcagcaaaataacaggcctctgtaatgatttattttcaaggatggatgcgtgcaaggtctataattatgtctctgtctgtcttgtgtaatagaagctttgtttgtggtaaaaataatgtataagccatttggttgggagcaaattttccttttgtccaaaggattttagctgctcattcatggtgacttggtctatggttttatctgctgttgtcaaaatcttataaaaatatatatcggctgctgct

SEQ ID NO: 16853 - DNA, 526 bp, Gossypium hirsutum
  unsure (1)..(526): unsure at all n locations
  Clone ID: uC-gsflnu33B109a08b1
tttctcgtaagcccgtatatgggacagattgtatgtgaaaagaaaagtttttaactatttgagatttcatggccctatttagtatgaaagtgttagtaaaagtcaggtaccacctcgaaccccgtcccggcgtcggatgcaggcgaggggtgttacaaaagaagctcgaccagatctaaaaggacttggtaagtacttttccccctttcttctttatttgaaaagcaactcaaatctcatgttattttcttaaaaaaaacaagaagaaattcataaaatacaaagactttcaacattgcttggcctctcgccctcacatccgcatagcaggagtatttggggctctcatcggctttcaatcgcgtaaagaaaatgagcaaactaagaaaatcaatttagaacagtaaaagaaaagcaaaaaaaagtgaaatcacctctattaatnttctattgcttttcttctattctttgtaagtgtgcacaaatacagtatgcatagagtgtgcgtaatctcttcgtgaaaaat

SEQ ID NO: 16854 - DNA, 372 bp, Gossypium hirsutum
  Clone ID: uC-gsflnu33B109a10b1
tttttcacgcctctgactgtgcagctggtgagtagactgatgaactcatgggcattacttgtgcatcagcggaagatagcagaacctttatgcagctgatgcaagaggtcgctggatgacagataccaagggcggccatcaaggtggcatctgttgctgtgggccagcttgagaagttgggctcccaagatacagtctgcgtgagggcatgcgctaagaaggcagtgacggaatcaaaggctgttacggacctggctcgttcggtgcacctggattgtgcgtcggcttcctaaactagaagggggtccgggtcggaccttcatgccataggctagggacgaatgtgctgagattagtcacttgatcaacctc

SEQ ID NO: 16855 - DNA, 518 bp, Gossypium hirsutum
  Clone ID: uC-gsflnu33B109a12b1
tttgagagaagtgagactgatggaggaagcaaaaggagtagtgaagcacatattgttggcaaagttcaaagatgaaatcccacctgagaagattgaggaactcataaaaggctatgccaatcttgttaatctcattcaccccatgaaagctttccactgggggaaggatgttagtattgagaacctgcatcaagggttcactcatgtgtttgaatccacatttgaaagcacagaggggattgctgagtatatagctcatcctgctcacgtggagtttgcaaatctgtttctccccagcttggacaaggtcattgtatttgactacaaacccaccgttgtacgttgctaagttacaagcatagttctgtcttaatgtagcttttgtcctgctcatgtctgttgttattttgaataaagattgatgtcttgtactatgaaatgcgcccatccctagtggtcaaggcaaaagttggttggttttatcttctaataggtttacatacaataattccttgttg

SEQ ID NO: 16856 - DNA, 438 bp, Gossypium hirsutum
  Clone ID: uC-gsflnu33B109b02b1
tttatactctttccttttttcagacagtgattgctgtttaaaaagaatgggtgaaattcgtttgttctggttattgtttgtttgggtgttgggaattgagaggggtgtatctggtttggcctgcaactgggggttgcaatcgactcatccattgccgtctaacatagtggtgaagctacttaaagacaatggattcgataaagtgaagctgtttgaagctgatccaggtgcacttaaggcacttgggaaatcaggaattcaggttatggtggggataccgaatgatatgttggcatcgcttgctggaagtgctggaaatgctgaagcttgggttcaacaaaatgtttctaattatgtttccaaatatggaactgatataagggttgtagccattggcaatgaaccttttcttattcttacaagatatgttcaccaaac

SEQ ID NO: 16857 - DNA, 407 bp, Gossypium hirsutum
  Clone ID: uC-gsflnu33B109b04b1
tctgtttccggcgatgcgccccggtcggatgtggaacggctagtgttatatccatgggtacctaatggaacagattttagccactagccgtatctctctgaggaagcaagagagtaggttggcaattgtagtcttatcttcctgaggtagcaagaaagtacactgaagattgaagatttatttccctaagtagttgtggagcatcgaggctggcgaatcttatcttcatgtattggcaatggaacagatttaagtcaccaagcctatttccctaaagttacagtcgagattcagcataaccgggcaaaattggccctatttgaagtctttgctctattcttgttgcacgacaatgagcaaagaggggcaactgtaataggcccattctgcccgggcccgttagaaaa

SEQ ID NO: 16858 - DNA, 500 bp, Gossypium hirsutum
  Clone ID: uC-gsflnu33B109b06b1
tttttccgcagctgccgccgtcgccatggtggagtttcttaaaccaaacaaggcagttatcgtcctccagggccgatacgctggccgcaaagccgtcattgtcagatctttcgacgatggcacacgtgaccgcgcctatggccattgtttggttgcagggataaagaagtatccaagcatggttatccgcaaggacttcgtgaagaaaaccgtcaagaagtcacgcgtcaagtgcttcatcaagctcgtcaattaccagcacctgatgcccacgcgctacacccttgatgaggacttgaaagacttggttaccgtcgatgctctttcagaccaaggacaagaaagtggccgcttgtaaggcaactaaggagaggattgtagagaggttcatgactgggaaaaacaggtgggtctttactaagctcatgttttaagtgttttattggaacatgttaatggtttatgagctttatcgaacatttcgatataatgacgggttt

SEQ ID NO: 16859 - DNA, 517 bp, Gossypium hirsutum
  Clone ID: uC-gsflnu33B109b07b1
ttcttgaaatgaagaaaatgtttgagctgatcgacaagtacaacttgaacggccaattcagatggatatcatctcaaatgaacagaatccgaaatggtgaactttaccgatacatttgcgacacgaaaggtgcctttgtacagcctgcattgtatgaagcctttggattgactgttgtggaggcaatgacttgcggtttgccaacattcgcaacctgtaacggtggaccagccgagattattgtccatgggaaatctggtttcaacattgatccttaccatggtgatcaagctgctgacatactcgtcgatttctttgaaaagtgtaagaaagatccatctcactgggataagatctcccaaggaggcttgaaacgaatagaggagaagtatacatggaagatttactcggagagactattgaccctgacaggagtgtatggattctggaagcatgtttccaaccttgaacgccgtgagagtcgtcgttaccttgagatgttttatgctcttaagta

SEQ ID NO: 16860 - DNA, 501 bp, Gossypium hirsutum
  Clone ID: uC-gsflnu33B109b08b1
ttctctggtgtaactgcttgaattctggcattgggcctccatcgacttgggaagactgatgttccggcatatgatggatcttggactgaatggggtgcggtatctgacacacctgtggacacttgatcttaaatcttaatgcaaagctgtcaaaaagtgccgaagagtcaagcttgcaatcgaccagtttcagttctcagatatggagacatgaagggtttgtatctagaaaagcctcaggtgtcattcatcaattggttgcgttccaatatggacctgtatgtgacgctacacattttcagaaactgtgtttgacaacaaaaccgatgaatactgaagtgtattatggtgttcttgaaacatgtatgctgattcacatgaagaggcaacagggatggtcacttgttttgcagaaaaaaactgtagaaagtgaagggtgatgatgattgagtcctgataataacaatttatggcagacaagtggtggtaatttaactaaag

SEQ ID NO: 16861 - DNA, 528 bp, Gossypium hirsutum
  Clone ID: uC-gsflnu33B109b10b1
tcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggtggtgtcctccctggcatcaaggttgacaagggtacggttgagcttaatggaacccatggcgaaactttcacccagggtctagatggccttgcacagcgatgccagaagtactatgaagctggtgcccgctttgctaaatggcgtgctgtccttaagattagtgctaatgaaccaaccgagcttgcaatccaagacaatgccaacgggctagctatgtatgctgccatctgccagcaatgtggccttgtccccattggtgagcctgaaattcttgttgacggatcacat

SEQ ID NO: 16862 - DNA, 257 bp, Gossypium hirsutum
  Clone ID: uC-gsflnu33B109b12b1
atacaccctgatagaacccaggacgagaacagctgagatcgcctcgaagaaacatgtgatctttcaacaggcttgaaaacgtgaggaagcatgccaaaattggatcaacatttgaacccatgccacaactgagaggaggatggtgcatacgctcaaggccaaaccttatttcgaataaagtgctgtgaacacgctgactggcccaatgatgttggacagaacaacaggtcacaaggtttctttttggtaattggttt

SEQ ID NO: 16863 - DNA, 514 bp, Gossypium hirsutum
  Clone ID: uC-gsflnu33B109c01b1
tttcacgcgtccgaagaccttgaaatctactcgatcaggtacaatgccaagcacgagaccgtgaatgtcccaggtactggttccctctggccactttctgcccaatctcccattgggaagtgtggagagcctaacagatgcgctccacaccttgagtggaatcctgacttggactgctcctgcagggatggcgagaagtgtgcccaccattctcatcacttctccttggacatcgatgtgggatgtactgacctgaatgaggacctcggagtctgggtcatcttcaagatcaagacccaagacggacacgcaagacttggcaaccttgagtttctcgaagagaaaccattggtcggtgaagctctcgctcgtgtgaagagagcagagaagaagtggagggacaaacgtgagaaactcgaatgggaaactaacatcgtttacaaggaggccaaagagtccgtggatgctttgttcgtgaactcccaatatgatcagttgcaagccgacaccaaca

SEQ ID NO: 16864 - DNA, 502 bp, Gossypium hirsutum
  Clone ID: uC-gsflnu33B109c04b1
caaagataaaaaagaaaccattttctccttcccctcctcgcataaataagtactgcaatattccttggctcaaaagcatctgaaattcgactagatcccttaatgaagttgtaaagtaagttcaaagatcgagagctaggtatttgatatccaaatcattctctgtaaatccaaaaggggggttggattctgtttcgtcggaagtatgtcgtcttgctcggaatctacggctatgaaaccggctaggtcaccggagaagccaagttttgcccaaacttgtaatttgttgagccagtacttgaaggagaaaggtagctttggggatctatctctgggaatgacatgcaacgttgaagctaatgggacaccagtggtgccgcctccgaccatgaatctgttccctctcaatgacaagttcgatgatgtttgtggccgaaacggtgggaatcctaagaacttgacatccatggatttgttcctccaacaagctggtttggctttc

SEQ ID NO: 16865 - DNA, 484 bp, Gossypium hirsutum
  Clone ID: uC-gsflnu33B109c05b1
cgaagccttattctctgtggtttaaggcgaattgctaacctttttctgtttgaaggtggctttatgattctgatgactaagggtagaggtaaaagttcctttcgttacatatcctgttcttttagattatggaagaaggctctctgccacgcactaggaagtttttggcttttttgttggtcttaaaatttagagaggaagaaaaacccttgcttcttttgatctctgatgtggaaaacattggcctttcaactgagagcaattaatcgcttcattctttgactttttttttatcctaagattttttgtgtttctgatttgggcattcttagttatttcatcttcgatggttttggcttccaaaaagtgctccttgatagaataaagcatcttgttttgagaaattgatggaaattgggaaatgatgacagcttaattggtggattgcatctgagcaaagctttgaagattttttttttccctt

SEQ ID NO: 16866 - DNA, 492 bp, Gossypium hirsutum
  Clone ID: uC-gsflnu33B109c06b1
tgtttgggcccctttgatagcccaccgggacgtgaaatcgaacaatattctcctcaactcagattttgaagctcacgttgctgattttggccttgctaaattcctgcaagattcaggcacttcggaatgcatgtccgccatagccggttcatacggatacattgctccagaatatgcctacacgctgaaggtagacgagaagagtgatgtgtatagctttggtgtagtcctgatagaactcgtctgtggcagaaaaccagtaggtgagttcggtgacggtgtcgacattgttcaatgggttcgaaagatgacagattcaaacatagaaggcgtcctcaaagtcctcgatcccagactcccatcggttcctctccacgaagtgatgcatgttttctacgttgcgatgctctgtgttgaagaacaggccgtacagagaccgactatgagggaagtggttcaaattctaactgaacttccaaaccaccaaactta

SEQ ID NO: 16867 - DNA, 474 bp, Gossypium hirsutum
  Clone ID: uC-gsflnu33B109c07b1
ttttgcagaccaaacttgaagggactgaagggcggacaggagtgaaactcggcatagataagattcaaaatggggactggtagtttagcaaacatgatgactagaacaactgatttgctattagattacacgacaggcttcgtcttgagcataaatacatactaatgagcagcggcgctaccgtgagcggtaaggatggtgacgatgcctgcgtatgtcaggatgctggtggaacttatgactctacacgcaactggattgaactagagtttgtgcctttgacacatagatacctcgtatgaattggctgaccaaagccattctgcaacagcgagaaatgcggacgttgttgctcttagagattcagacgaagagaatgaaacatggatatgtccctcgagctatgtatacaggttatgcacaaccaaaatgatggtggtggactgggtggtccggttgtacctcctggaattt

SEQ ID NO: 16868 - DNA, 522 bp, Gossypium hirsutum
  Clone ID: uC-gsflnu33B109c08b1
tcgcccacgcgtccgcttttccatccatttcttactcactctgtctctcccaactttgggccatgctagatctgccccttctttcaatatttgaaaaccaagaaactaattttaatttgaatcatgttgcggtacgactccacctcgtcatcagcgggaagtagcagtggcagcttatcatcctcctcctcctcgtccaagccaccgcagcaagatattgatggactactcgccggtgctggttataaagtccggtcgtcggagttacgacaagtagctcaacgactggaacgactcgaaaccgccatgggtaattcgcctgcagatttctctcaacttgcctccgatgctatactctataacccttctgatctggcctgctgggtcgactcgctgctaactgagttcgctgagcctcctcccacttgctcctccgacttcatcgtggatcccgtaaacaatcaaacggtggtaaacagcgcgtggaccaccgccgaacctcatacaccgcaggtgcaccag

SEQ ID NO: 16869 - DNA, 527 bp, Gossypium hirsutum
  Clone ID: uC-gsflnu33B109c10b1
tctattttctctccttttccttcttccctccccactaggaagaaaatggctacagctttctcaccttccaagtttgccgcccaaccattccctctcaacaccacttctcaaaacaaccctcttacaatccccactaccgcctcacccttcctcggatctacccgcaaactcatccgcctcagttcttcttccaatttgaatattcgccgtcgatctgggaccgtcgtcgccgtctccgatgtcgtcaaggaaaacaaatccaaatctaccctcaatctgttaattacaaaagaggaagggttggaattatacgaagatatggtattaggaagagcgtttgaagatatgtgtgctcagatgtattacagaggcaaaatgtttggtttcgttcatctttacaatggccaagaagctatttcaactggtttcattaagctcttaaagcaccaagatttcgtcgtcagtacttaccgtgatcacgtgcacgccttaagcaaaggcggtttttgcacgtgctgtcatgagtg

SEQ ID NO: 16870 - DNA, 512 bp, Gossypium hirsutum
  unsure (1)..(512): unsure at all n locations
  Clone ID: uC-gsflnu33B109c11b1
tatggatcgtagaagtgcatttgcagttgttttgatttgttttgtggtgaccgctgtcggtggtcaatctccggcagcctcacctactaaagctccgccggccgcgactactcctgctactgctactgctcccgctactgcccctgttagcaaacctaaatcaccggctccaactgctgcccctaccacttccccaccaacttcttcaccaccggttgcggctccggagaagtctgcggcggttccagccccatctaaatctgctccgtcttctcctccggctgctgcgccggtgagttctccaccggctccagtacctgtgagctctcctccagccagatcgcctcccgttgctgcaccgacgactccaccagagagctcggcctctcctccggctcctgttacggcaccaactactgctgaggttccggccccagctccaagcangagcatgagcaaaagcaagaaatccaagaaacaccatgctccggctccttcacctgatatgcttg

SEQ ID NO: 16871 - DNA, 255 bp, Gossypium hirsutum
  Clone ID: uC-gsflnu33B109c12b1
tcttaattaacaatcaattggctaattgcccgtcagtcactgcgtcctgaatcgatcattatatgtatgctggtttctttgttcttccgaatcgaaaaaaggaatatgaattgctgtatgttgtcctcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaacataaaaaataaataaaaataaataaaacataaaa

SEQ ID NO: 16872 - DNA, 425 bp, Gossypium hirsutum
  Clone ID: uC-gsflnu33B109d01b1
ttttacgcgttcgaagagaggggacaagagaggtagagaaatagtgtgatggcatccgggtggggaatcaacggtaacaaaggcaggtgctacgatttctgggtcgacttcagcgagtgcatgtcccgttgcagagaacccaaggactgtggtcttctccgtgaagattatctcgagtgcctccaccattctaaagagtttcaacgaaggaatcgaatttataaggaggagcaacgtaaattaagagctgccgcacgaaaagacaaggaaggcgaaaatggtgttcatcatcatgcatagtcataatttgtgatcctttaatttgccaataataataatgcgtggagattgttgtatttatgtggggattggtattttaactcttgctaaattaccttttggtttccctttcgttggaatggaca

SEQ ID NO: 16873 - DNA, 444 bp, Gossypium hirsutum
  Clone ID: uC-gsflnu33B109d03b1
atgggctgttggatttagacgctgccatttgtctctgtactacgatcaaagccaaccttttgaatatcaatattataatccccatagctcttcaggtcctcatcgactgtggcaaaactccacctccagggttccaatgtccagcacaatgatgaaaaacataaaaaccccatgtttttttttttctttcgaagtaacaaatattttcatgtcttattatatgtttcttttaataatttatggtgttttgctggttcatgaagatcataaagacgtgtctgaggttagattattttaatagatgtcgatgaatccacgaacgaatcaatgtagtacgatgttgtgattttagttagttcataggatcatattaattgtgcgtgtgtgtgttatttttcttatttcaaagctaagcttgttttgaatgaactttgctttattttt

SEQ ID NO: 16874 - DNA, 445 bp, Gossypium hirsutum
  Clone ID: uC-gsflnu33B109d04b1
gttattataagggagcatattccgattagcaacctctttacttgtctttggttcaacgaagttgaccgttttacttcccgagaccaaattagtttttcaaccgtaagggataagattgcggcaaagacgaattggactgtcaatatgttcttggactgcgaaaggcgcaactttgtcattcagaaataccataaggatgttttagccctattggctcaaagggctcctccggtcatttattcttcacaaaggaaggtcccaccaagacgtagaagagataggaagtcaggcgctagacatcatcgtaaagttagtaaggaaatagtttaatgttataaccagttgtctaaaaatcaaaatttaccattctttttccttccccacttttttggaacattcatggcggggcttggaatatcattcaagagtgttgtaatttttgctc

SEQ ID NO: 16875 - DNA, 500 bp, Gossypium hirsutum
  Clone ID: uC-gsflnu33B109d08b1
ggggcctgtgctgtagctgccataggcacgccatgattaccaaaacttctgcgatattctctggtctacctaccaaaaacatatatccgttaccttcaatggtatcactcatgtctaatctatacacaccctcgtaaaacaatgtgtgctggctccggcgatgggcgttaggtcgaaggctcaggatctatggcggaccacccaccacctaagctgacggagccacttccgtgcccttggcgcgactacagcaacaccaagctctgctactacaacagctacaacctttatcagactagctacatctgcacggcatgccgccactactggactcaaggaggaactatgcatcacgtgtccgtaggtggcgggacccggaaggctttcaagcgctcagcctgtagttctggctcgtgtatgacgtggcaggtgcttgttactcgagctcgacgcatgaagctggaaccctactgctgttaaccctgtccagttatgcctgg

SEQ ID NO: 16876 - DNA, 399 bp, Gossypium hirsutum
  Clone ID: uC-gsflnu33B109d10b1
ttttccacgcgtccgatcggttttggagaagggccacattggatgcatacgagaaggctaacgaggacggaccaaggagcccttgtccttctccttacgacgtgtgagatatgagttctgtcccatatttggcgacaaacaaaattgaatatgactcgtggcttacgaggaaggtaattaaaatggagaagttatacgaatttggctgaacgccttaactaggctaatgataagtgttataaggtgaaagactactagggaatcattggtgccactaaaacaagcataaaggcgaagcatttggttgcccagctaattcctcgctttttcaagttctttcttaacctatccagccgtgcttttaatgctcattttgatttgattgaagaataacatttg

SEQ ID NO: 16877 - DNA, 527 bp, Gossypium hirsutum
  Clone ID: uC-gsflnu33B109d11b1
tcttccacgcgtccgctttcctcctagccaaaaaaaaaaaaaaaaagcctctttcctgtctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggtggtgtcctccctggcatcaaggttgacaagggtacggttgagcttaatggaacccatggcgaaactttcacccagggtctagatggccttgcacagcgatgccagaagtactatgaagctggtgcccgctatgctaaatggcgtgctgtccttat

SEQ ID NO: 16878 - DNA, 526 bp, Gossypium hirsutum
  Clone ID: uC-gsflnu33B109d12b1
ttattttttttcagagatttgttttttttcgcttctttcgatatggggaagatcaagatcggaatcaacggatttggaaggatcgggcgtttggttgccagagttgctctccaaagtgaagatgttgagctcgttgctgttaacgatcctttcatcaccaccgattacatgacctacatgtttaagtatgacagtgttcacggtcaatggaagcaccatgagcttaaggtgaaggactcaaaaacccttctctttggtgaaaagcctgtcactgttttcggcatcagaaaccctgaagaaatcccttggggtgagactggagctgattatgtcgttgagtctactggtgttttcactgacaaggacaaagctgctgcccatttgaagggtggtgcaaagaaggtaatcatctctgctcccagtaaggatgcttccatgtttgttgtgggtgtcaatgagaaggaatacaagcctgaccttcacattgtatccaatgctagctgcactaccaactgccttgctccat

SEQ ID NO: 16879 - DNA, 377 bp, Gossypium hirsutum
  Clone ID: uC-gsflnu33B109e01b1
tttacgcgtccgctttcttgcattggtacacaggagaaggcatggatgagatggagtttactgaggcagagagcaacatgaatgatctggtctcggagtatcagcaataccaagatgcaacagctgatgaagatgagtatgaggaagaggaagcggagtacgaggattaggaaggaaaaactttatgccagttgggcaaattctaatctcaacttccagttgctgaaagaaatagtcattatgctgtgactgttgttgcatttatgtttctaagtgaacttttttcttgagcttttcatgctcaatacttagcaaagcatgcgcagtttatgtactttactcctttcaagtttctaagtaactttttttgtttcaaa

SEQ ID NO: 16880 - DNA, 516 bp, Gossypium hirsutum
  Clone ID: uC-gsflnu33B109e02b1
ttggaaagctctcaatctatggagaaacctttgctgatgaaaacttcaccttgaaacactccggcccgggcctcctctccatggcaaacagcggccccaacacgaacggctgtcagtttttcatcacttgcaatgcgtgtgagtggcttgactcaaaacacgttgtttttgggagggtgctggaggggctgaagattgttcgaatgatcgaaaacgtgcccgtcgtcaatggcaaaccaaaaatcgaagtgaaaatcaccgaatgcggcgaactgtaaatacactctccatcagcaccattaccaatatctgtcatcaccatcatcatccatcatccatcatcaccattattcattaataacaattcttcatttatttcaatgattccgttccattccatgtatcatctattctttacatatttgacacctctcttcctctatataataatcaagtgatgatatcccacagcccctttccctcaccctctatataaaaagattgtttgatatcata

SEQ ID NO: 16881 - DNA, 430 bp, Gossypium hirsutum
  Clone ID: uC-gsflnu33B109e04b1
tttttaagtgcatgcattggctaccgctgcttcaggtggtgtaggttaatatgccgttcaactcctaaagctcgctaatgcacacattacagccacttgtggggctcgtaacatagatttagtcaggagcctgggggctgatgaggttcttgactacaaaactcctgatggggtggctctcaagagcccttctggtcgaaaatacgatgtaatcatccactgtgcacacaacattccttggtctacctttgaggctaacttgacttcaaaagggaaggtagtagataccactcctggtttcggcactctgatgagtgttgctttcaaaaagataacattcggaaagaggcaactcataccattgtttacctcacctaagaaagagaaccttgaatttcttgttaagttggtgaaagaaggaaagcttaag

SEQ ID NO: 16882 - DNA, 210 bp, Gossypium hirsutum
  Clone ID: uC-gsflnu33B109e08b1
tccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaggggatcaaactttctttccccgggtttgcgacgaattaatttttttataggggaaccaaaattaaataaatgggcggc

SEQ ID NO: 16883 - DNA, 440 bp, Gossypium hirsutum
  Clone ID: uC-gsflnu33B109e09b1
ttttgatttgcatgttagtagatagtcggaaatgttgctgctcggaggaattatattacgtgatgtgatgtctcatccccagcccagttttgtgccttgtaatccagaaaaccttaggacctagacaaccatggcagtgtggtgaccgcggaaacagtgatagaagaaagcaagaaagttgaaacttttattattatataaactaagtagagatggatatatatgaattgtgagtttgattggagcaatatttcctttgcgtgaactggattgggctggagtgagatgtaaggttatggatggttttaagtggtgatggtggtaagacttattttgcttgtacaaatatgagttcactgtaatatgctatgaatcgaaggtatcaacattcatatgatggatggatgctaattgcttattagtaaatcaatgtgatggat

SEQ ID NO: 16884 - DNA, 488 bp, Gossypium hirsutum
  Clone ID: uC-gsflnu33B109e10b1
tctcccacgcgtccgcccacgcgtccgaaaacatgtttccatggctctttcgcgttcttcgtggctgaattcaccaccacggatgcagcaagaacgttatcagaaaagatagcgtaatggtaaagcttcggatcctcgaattccggaggcattggtttccatgtggtgacggacaagatgaatcttggggcaatgcaggttatgttcaaattgaaagattataatggagctcatattgaagtgaaggcggtagaggattataagtttttgaattcatcctatgttccagtgttaagacagttagaatcggctaatctgcagaagttttattttgagaacacgctggagaatgccacgaaagatacgactaacatgaagtttaggaaccccaagtatttatcaatcttgaatcatttgaggttttatttaccggagatgtaccccaagttgcataggatattgttattggatgatgatattgtggtgca

SEQ ID NO: 16885 - DNA, 341 bp, Gossypium hirsutum
  Clone ID: uC-gsflnu33B109e11b1
tcttaaaaaaaaaaaaaaaaaaaaaaaaaaaaaaaaaaaaaaaaaaaaaaaaaaaaaaaaaaaaaaaaaaaaaaaaaaataaaaaaaaaaaaaaaggggcggagggtttggcggtttaaagtttccaagcttgggcacgcgagcttatagcttttttattgtgttatcgagatacaataaattggccgacggtccacagcttaacaactgggaaaccggggaagttccgcaatttactagcttatgcgccttgccccctttccccttttggcgaattggcgaaaaggccaaaagggtcggccctttccacctttcgaacattttgaatggctaatgggaca

SEQ ID NO: 16886 - DNA, 447 bp, Gossypium hirsutum
  Clone ID: uC-gsflnu33B109e12b1
tctgagaagctagctgtacaccaaatagagggagctagatagagagagtgatgggttcctttaagctccagaaacggatctcagggagcgttctaaagtgtggaacaggaaaggattggctcgatccaaatgaagtcagcgagagcttcatggccaactctcgccagaaaatatggaagctggataaagatggtttgatcattaggaagccaaccaccattcactctaggcctcgtgcactccgcatgaaggaagccaagagagaggggccttactctggttatggtcagcgcaatggaaccaagggaggcaaggatgcccacaaagatcttgagcatgaagaggaagcatgttctgagacacttgcttccaaagtataggcaaacaaaaaatattgacacgtacatgtaccatgacatgtacctgagactgaagggtaacgtgttc

SEQ ID NO: 16887 - DNA, 523 bp, Gossypium hirsutum
  unsure (1)..(523): unsure at all n locations
  Clone ID: uC-gsflnu33B109f02b1
tttacgcgtccggttcggtgaaaagtgacctccagctccttgaagacattgctgatcgtgccttgaaacaagaatccatttttgtagtggtttcaaaaagatcaactctcgataaatgtccccttcctgtcgggattagactgtttgtttcagccgcccattcagagtccgacctgcttaaggcatgtgaatcactcaagcgagtcgcagctgcgatgcttaggtgagtgatacccatcatatatatatatttgtgtatgtatggattagtatctactgtcagtatagttttttttaactttgtaagcggagttgaaaattcaacatgttcttatattatatttgaaaaaaaactttactagcggtggatatgataaattatccattcaagattttgttttaaactgcattggaagatttttctcgtggaactgttcacttttcttaaattttctctagcangaaaacaaaatgtaactacaatttaaacgttttactttattttttataatttaaaataatg

SEQ ID NO: 16888 - DNA, 453 bp, Gossypium hirsutum
  Clone ID: uC-gsflnu33B109f03b1
ttttacgcgtccggttcctgcagagtgaggaagctcccctgaaagcttcagttgaaaatgcctaagcaaattcatgagatcaaggacttccttctcactgctagaaggaaagatgctcgctctgtaaaaatcaagaaaagcagagatgttgtcaagttcaaggtccgctgctccaagtacttgtacaccctttgcgtgtctgatgctgagaaggctgacaagttgaagcagtctcttcctccaggtttgagcgtccaagacctgtgaaattaaaactgcccttagcttgtactaggcaatgaaaactagattttgacttttagtttattgcttgcatttcgaatcgttttgcaacgatcaaaagtttttataatggatttttatttggtgtttttttatggacgttagtaatgttattaaaaccctttatttattttagtattcgtgttctac

SEQ ID NO: 16889 - DNA, 471 bp, Gossypium hirsutum
  Clone ID: uC-gsflnu33B109f04b1
tttacgcgtccgcagcgatgaaaaccttttctaccactactcgtctgtcgcacaaagaattggggtttacactgcccgggactatgctgatatagttgaatatctggttgaccgatggaagttgaaggaactcattggactttcacccgagggccgtgaagctcaggaatttgtgtgtggacttgcaccgagaattagaaagctagaggagagagctcaattgaggaccaaggaatcacccagtgttccattcagttgggtttctggtagagaagtgaagctctaaattggctatcctccaagtgacttgtaatacaagaaagaaacaacagggcttagggaggagcatgatgaaaactgcaactctgtgtttagctggaatgcaataagtggaggaagtgtgtgtgtgctgttttcgtgttacttttcttaaaacaagtaatatcaacatcttcctcctatttgatgaaa

SEQ ID NO: 16890 - DNA, 515 bp, Gossypium hirsutum
  Clone ID: uC-gsflnu33B109f05b1
ttttaacccattttccgctgcttcttcagctgaggcaaaccgtagccactaagaatgcagatcttcgtgaaaaccctaacggggaagaccataaccctagaggtcgagtcttccgacaccatcgacaatgtcaaagccaagatccaagacaaagaaggcatccccccggaccaacaacgcctcatcttcgccggtaagcaactcgaagatggccgcaccctagccgactacaacatccaaaaggaatccactctccaccttgttctccgtctcaggggtggcgccaagaagaggaagaagaagacctacaccaagcctaagaagatcaagcacaagaagaagaaggtcaagctcgccgtgctccagttctacaaggtcgatgaatccggcaaggttcagaggctgaggaaagagtgccccaatgctgagtgtggggctggcactttcatggctaaccattttgataggcactattgcggtaagtgtggactcacttatgtttaccaaaggctggt

SEQ ID NO: 16891 - DNA, 513 bp, Gossypium hirsutum
  Clone ID: uC-gsflnu33B109f06b1
tttattttaaaaaaataaaagagaaaaaatctgagcaatgccggaggagacgaattccatagactacattatggagaaggcatcggggcctcacttctccggcctccgtagtccgacctccgcctcttcctcttcgtcctttttcgccgacgccaacgctcctcgtcagcccttcgtcatcggtgtttctggaggtacagcttcaggtaaaacgacagtctgtgacatgatcatccaacagctccacgatcaccgcgttgtacttgtcaatcaggattcgttttatcgtggtttaaatactgaagagttaaaacgcgtgcacgagtataattttgatcaccctgatgcttttgatactgagcagcttctggaatgtgttgagaagcttaaaagtgggcaatctgttcaggtcccgatctatgattttaagcaacatcgtcggtcttcggatagtttccgacaggttaatgcttctgatgtcataattttggaggaattcttgttttccatgac

SEQ ID NO: 16892 - DNA, 233 bp, Gossypium hirsutum
  Clone ID: uC-gsflnu33B109f07b1
ttttctacacatcccgaggggccagtgttgaggattttagtcttataactcgcagatccggcgctgtaacggtcgtactattgtgacctgacatcactgaagggcccgttgactgacatggccctgcctggtccaactatggctgtatccatcgtagacctcttggagggccttcctatttagggctcttgcgtcacaaaaaagagtcccatctgggatgctctttgccagca

SEQ ID NO: 16893 - DNA, 535 bp, Gossypium hirsutum
  Clone ID: uC-gsflnu33B109f09b1
ttccacgcgtccgcccacgcgtccgaaaatctggtagtggaaataaatatgcagctcttgcaagtgctctgggatctttaacatgggagaagcctttgtattctgaatttcaacaattggcaggggaaagtgaatatgctgcctggacccttgtcaatgggtatgcactcaatcatgtcactatttccacacatcggctgaaatctaatttgagaaatatcaaaagcctcaatgagttcatcaaaaagaatgggttcaagttgaattctgatggtggagttttaaaagtgagtccagatggccttctgctgcaaagttcaactgtggcggattcaatgcctttcagtttttctgacggtgttgttgagtctgttccctgttcgtacattgagtttgctgaacgccttgtgctgcctcaatacaaaaatctgtctgagagtgagatcaaagagttccacaggcgagatggatctgaggttggaaacgctgatataatctttgagagcacatcgaaagagcagcttacatggagagg

SEQ ID NO: 16894 - DNA, 403 bp, Gossypium hirsutum
  Clone ID: uC-gsflnu33B109f10b1
ttaacggcctgcctcaagaggctgcctctatcattggtccacatatggctgcgcttcatgccatgcgtcacggtctggaagtctgttcagagtcggcctggctcccacatttgtataaatctggtggactggatagcgggtcagacgaagggttcgatgcacgagagcagggccacctgaaaaggccagtaaccgttagaggtatcacgtacgaacagacgcgttaataccttttaccttataagattgcatgtttgcccgttatgctcattgtcaagcgtactctaaatgatcaatgctggggagctacatatctagaatggatgcatctactataggaagggtgtgattttgggtcattcgatattttaaccaatgatgagggacgacagggattgaaagt

SEQ ID NO: 16895 - DNA, 269 bp, Gossypium hirsutum
  Clone ID: uC-gsflnu33B109f11b1
ttaataactgtgtgttggaagtatttgttaggcgtatcatatgcccctcttttaggccaattgttttcctttttcttttttggttatttaccctctaaatttttgtattttcgggaatatatgaattgccttcaattactttgaaaggcacgaaatttggtagtgtaaaaaaaaaaaaaaaaaaaaaaaaaaaaaaaaaaaaaaaaaaaaaaaaaaaaaaaaaaaaaaaaaaaaaaaaaaaaaaaagaagaatgcgaagatgcaaaact

SEQ ID NO: 16896 - DNA, 499 bp, Gossypium hirsutum
  Clone ID: uC-gsflnu33B109f12b1
tttctttatttgactaatgatggtatttcagaagaagctgcacaagcagtttctgagctaattccttctaccgaaaagctgaaagttcttcagtttcacaataacatgacaggggatgaaggtgcaattgctatctctgatattgtgaaacgttctcatgcattggaggatttccggtgttcatctacaagagttggcacagatggtggtgtggctctagctgaagcactgaagacatgtacccgcttaaagaaacttgatctgcgtgacaacatgtttggcgtgggagctggagttgctttgagcaaagctctctctctgtttgcaggtcttactgaggtttacctcagttacttgaacctagaggatgatggggcggaagcacttgccaatgctctgaaagagtctgcacctttacttgaagttctggacatggctggaaatgacattacagccaaaggtacagcttctttagcagcctgcattgcatcaaaacaat

SEQ ID NO: 16897 - DNA, 363 bp, Gossypium hirsutum
  Clone ID: uC-gsflnu33B109g04b1
tgttaaggcaatgcaagaaagggtagcagttgcagtaaagcccttctctggcttaccaggtcaatggattttatggtagctttgtttcaaaaactggtgaaggatcctgggcagaacatggaacaagcagttgaagaatcctataatattactttgaagcctaggcatggatggatttcgacggctgcttttaaggtggcactaaaactggtaccagataacaaaacattcattagtcttctcatggcaaaagatcaaaattgcgacaaccttaaagaggaaatgcagacattgattacgttacttgtgccttttttagaacagatccatttcgtcatgaggctttaccggttggataggttg

SEQ ID NO: 16898 - DNA, 519 bp, Gossypium hirsutum
  Clone ID: uC-gsflnu33B109g07b1
ttttccacgcgtccgcccacgcgtccgatgtccaactatcactctttaggtttattgcatcaaataaatcatgaaatctttccttcctttctttgcattcctctcacttctcctgtatgtagacaccattgcagcagctaggaaagatgctggagagaactggggagctgaaatgaaagatcagcctatgcctgaggcactccaagagcttgttcggattgaggctgccgttgccaaccccgatgagaaaaccaagtgccatacattaggtaacattgagcttaaggaagagaagattattgttaatgaggagttcgaaccaaggccaaacatttcaacttacggtgatgacgctaatctaaaaggagataaattatcattcttttgcagaaaattatgaaccgagacccaacaaatcggcatacggggggcatgatgctggtcttaaggacagaagaatcatcactaaagattcgatccaagccaaaatctcgcttcaataactattaaagcgaaccc

SEQ ID NO: 16899 - DNA, 438 bp, Gossypium hirsutum
  Clone ID: uC-gsflnu33B109g08b1
ttctagaggctctctacccactgtgcctctctctgctcatttcggctagggcatgaacatccttgatggccgcctaaaccgtgctgccaccacaggcggcggtcggggagcaaaccggactttcaagcccatgtttcaggcgaactcaatagcgaaaactggctggaccaaagaggatccaaagatggaaccccctactacctataaagtgggaatccgacgacagaggagcgatctccgacgacggtcacttcgattggggtaagtcacccttctttgattttataccctttaagattttatagatttggagtgtaaataaaaagaatattaaagagatgaaagaaccaaatcaaaacatagaaaaaaaaataaatcagagatcaacctttaaattgtggtctgttctctgattcaaatgtgcgagtaccctggtta

SEQ ID NO: 16900 - DNA, 488 bp, Gossypium hirsutum
  Clone ID: uC-gsflnu33B109g11b1
tgaacctagagggctgtagctacccgcttcgagagagaccatgttggtttaccaggatctcatctccggtgacgagcttctgtctgactcattaccctacaaggaaatcgagaatgggatgctgtggtaagacgagggaaagtggattgtgcaaggagctattgatgttgacattggtgccaatccttcactcaaagatgctgatgaggatgaatgtgttgaggaccaatctgtgaaggttgttgacattgttgacactatcacgctttaggagcaaccctcttatgacaagaagcaggttgtcgtgttcatgaatacatttatcaagaacttgacaccgaaactggatgcggaaaagcaagagtccttcaagaaaaacattgagggagcaaccaagatcttgcttgcaaaaatgaaggaccttcaatttttcataggagagagcatgcacgatgatggatgcatggtatatgcttactacaaggatg

SEQ ID NO: 16901 - DNA, 490 bp, Gossypium hirsutum
  Clone ID: uC-gsflnu33B109h03b1
aatgcctgcaaagtctggaggtggcaagcaaaagaagaagaagtggagcaagggaaagcaaaaggagaaggtcaacaatatggtgctattcgaccaagctacttatgataagcttctctctgaagctcctaaatacaagctcatcactccctcgattctctctgatcgtatgaggatcaacggatcgcttgcgagaaaggctataagggaactgatggcaagagggtctattaggttggtttccgcccattcgagccagcagatttacactagggcaacaaacacctaggtctcatattgttacgttttttgcttaattagttatacatagtaatgctttttgctgagattgaacttgttcaaatggtttcgttttgttttattttaagacgtttcttcagctcaagaatgtttttgttatggtttaaagggatcagtttgggattttgttgacatgctctttagctttctcgtttttcgagatgagatc

SEQ ID NO: 16902 - DNA, 517 bp, Gossypium hirsutum
  unsure (1)..(517): unsure at all n locations
  Clone ID: uC-gsflnu33B109h05b1
tttacgcgtccgaacgcttctactcctattacaggcaaaatgagtccgcgcatttggttttactccattttgctcactcttcaatacggagcgcagcctcttatctccaagcgcttcaccagacgggaagtaattgtaacgtcgtcagtcttgatatgtgaaatagcaaaggttgcatgtgctataattctcatggcgaaagatggtagcataaagagactggcgaaggaatggactttgatgggttcacttactgcatcgggtcttcctgctgcaatttatgcacttcaaaatagcttgttgcaaatatcttacaggaacctggattcgcttactttctcaatgctgaaccagacaaaaatatttttcactgccttatttacatatatcatactgaggcaaaggcagtcaattcaacaaactggggctctgtttttgttgatcatggcagctgttcttctaagtatcggtgaaggttctagcanagcttctagcactggtgatcctgagcaaattc

SEQ ID NO: 16903 - DNA, 168 bp, Gossypium hirsutum
  Clone ID: uC-gsflnu33B109h08b1
ttcaaggacaaattatagcctcccataaatacaaatcttcctctttaaatactcactgcatagatcaaatcagttttcttcacttttcgttatcgaaatcatctgcttctcccttctccctttctctctcggtgacccctttctcttctgttttacttggggtcgcct

SEQ ID NO: 16904 - DNA, 443 bp, Gossypium hirsutum
  Clone ID: uC-gsflnu33B109h09b1
tgtgtgagcggaaacaggaggagcagaagtcagagtgagcaacgtgggaacagtcattatgatcgacttccaagtccagcaaaagagggaggcaaggcatccagtaatttggcgaagctgaaagatctgtacggtgatgtaagtgatacaaagggagatgatggggggtttgaaaggatagcaaagagggacaacagtggtaaagaggtgattagactaggtggttcttcttggaaataatagggtgggtgggtgcattgcagaacaccaaatcaaatcaaatcaaatcagacccaaaaacaaaacaaactttgtcaacattttcattctccctttctggacaatgctggattgctgatggatagatgcagtcgtggtcacgactggcataacgtgtatactaatgttccattatcttcttaattttaacttcagatgattcc

SEQ ID NO: 16905 - DNA, 526 bp, Gossypium hirsutum
  Clone ID: uC-gsflnu33B109h11b1
ttttatgcccctggacatcgtgactttatcaagaacatgattactggtacctcccaggccgattgtgctgtccttatcattgactctaccactggaggttttgaggcaggtatttccaaggatggacagacccgtgagcatgctctgcttgctttcactctcggtgtcaagcaaatgatttgctgctgcaacaagatggatgccacaacccccaaatactcaaaggctaggtatgatgaaattgtgaaggaagtgtcttcctacttgaagaaggttggttacaaccctgagaagattccttttgtccccatctctggttttgagggtgacaacatgattgaaaggtccaccaaccttgattggtacaagggtccaactcttctcgaggctcttgaccagatcaatgagcccaagagaccctctgacaagccactccgtcttccactttaggatgtgtacaagattggaggtattggaactgtcccagtgggtcgtgttgaaactggtatactcaagcctggtatgg

SEQ ID NO: 16906 - DNA, 399 bp, Gossypium hirsutum
  Clone ID: uC-gsflnu33B109h12b1
tttctgaatagagtatttcagccctcacagattccccctttctctcttatttcattgcagctccaaagagattaagaaggccagacattattaaaatgcagtgaacagtttcattttgtagcattaaacaatggttcacattatttttttgtttacctttttttttctttttctttttaatgaattacttgacaagccataaactggtcattgtgatctataggctattattcaattttttttctctaatttggtgttgttcaaagctactttagctgatggcaaataaccatatacacataatttgtaatgctgaacggcataatcattatgggttttaactactaagttcttccataaatgaatattcttcttatcaaacgcgacaggtaagcccgt

SEQ ID NO: 16907 - DNA, 511 bp, Gossypium hirsutum
  Clone ID: uC-gsflnu33B110a01b1
tttacgcgtccgcccacgcgtccggcagtttcagttcacctcaggaaaatggcgaacgatgagcacttgcacaaagcttttgccttctttgatctaaatcaaagtggtttcttagagatagaagatctgcgagattccttaaacgatgaagttgataccagtgaggaagttatcaatgccattatgcttgatgttgatactgacaaggatgggcgcataagttacgaggagtttgttgcaatgatgaaagctggtactgattggagaaaagcatccagacaatattcacgagaaagattcaacagtctaagcttgaagttgatgagagatggctcattgcaattaggcaattgagtacaagtctaatggaaatgaatgaatcaaagaacagtaagtacccttgctgtggaaggggggaaaaagagggaaaaacaaagattatccttgatttttgtttggttggatatcgggcaatttctttttaattttccaatttgttgtcaagtggaac

SEQ ID NO: 16908 - DNA, 77 bp, Gossypium hirsutum
  Clone ID: uC-gsflnu33B110a02b1
ctcacgcgtccgaaaaaaaaaaacaataaaggacataatgaaactcaaggggctgaaaatcaaaaccatccagccgc

SEQ ID NO: 16909 - DNA, 507 bp, Gossypium hirsutum
  Clone ID: uC-gsflnu33B110a04b1
ttttgtgtgcgagaacaatcactatggtatggggacagcagagtggagagccgcgaagagtccagcgtactacaaacgtggggattatgttcctggtttgaaggtggatggcatggatgcccttgctgtgaagcaagcttgcaagtttgccaaagagcatgccttgaagaatggaccaattattcttgaaatggacacatacaggtatcatggccactccatgtctgatcctggaagcacctatcgaacacgtgatgagattagtggtgttagacaggagcgtgatccaattgaaagaatcaggaagctgatattgtctcatgatctagctactgaaaaagagttgaaggatgttgaaaaggaagtgagaaaagaagtagatgatgcaattgctcaagctaaggaaagtccaatgcctgaaccttctgaactcttcacaaacgtgtatgcgaaaggtttgggtgttgagtcattttgagcagattggaaaggagaagagctacactt

SEQ ID NO: 16910 - DNA, 212 bp, Gossypium hirsutum
  Clone ID: uC-gsflnu33B110a05b1
tttacgcgtccgaacacccggacttccacgggggcagtataacggctaccagatacaaatcccaagcccagctaacgtggctgccaaggaccatgagcagaggaccattggagcagtgcccttcattaaggaccaggtggtaggtaagttacttcgcacgatatggcaaaacgttcacatctccagaaatggtacgccttcagggatgatgg

SEQ ID NO: 16911 - DNA, 177 bp, Gossypium hirsutum
  Clone ID: uC-gsflnu33B110a06b1
gtctcgcgtccgatgacccgaagtttcaggggggcgtcagaacggctactatctttaaacaccaagaccagctgacgtggctgccaagggccatgggcagatgacttttacagcactgagttacattaaggaccaggtggttggtaacataatacgcactatagtgcaaaacgttga

SEQ ID NO: 16912 - DNA, 501 bp, Gossypium hirsutum
  Clone ID: uC-gsflnu33B110a09b1
tatttgttggccgtgagggaaagtatgttactagcaggaacctacgagatcgactctattgcgagcttgagcgaaatttagcaatgagagtagaagacggtgaaactgccgatacatttattgttagtgggcgtggtactttacatataaccatattgatagaaaacatgcgaagagaagggtatgaatttatggtgggacctcccaaagttattaacaaaaaggttgctgacaagttgcttgaaccatacgagattgccacggtggaagtgcccgaagaacacatgggggctgtggttgaacttcttgggagaaggcgtggacagatgatagatatgcaaggagttggggccgaaggtacaacacttctgaaatataagatcccaacacgtggccttcttggattgcggaatgcaatcttgacagcttctcgtggaacggctatcttgaacacaatatttgatagttatggaccttgggctggtgatattgttacccggg

SEQ ID NO: 16913 - DNA, 355 bp, Gossypium hirsutum
  Clone ID: uC-gsflnu33B110a10b1
tttttgctttagcaattttaatttagaagagatgttatgagagaataaacgaattgtacggagcatatttttgtgtgaagaagggttgtttgagttttattacccaagtacttgaatgtttcaagtttcattgcagttgttcttctactttaatgcatatgttgagattatggtttctctacttaaatgaaataatggtgggacctaccaaagttattaacaaaaaggttgctgacaagttgcttgaaccatacaagaattgcacacggtggaagtgcccgggggccacatttttaatgggtccgaacttattgcgagaaggtgcggacagatgatttttatatagggagcccta

SEQ ID NO: 16914 - DNA, 490 bp, Gossypium hirsutum
  Clone ID: uC-gsflnu33B110b02b1
tttttccgggtttctgaaagaaactgccttggaactttctcctcttctcaaggatgcagaagttccatggcacctgattgcaatagcaatattcttcacattgatcaaactgccaggcccatattacccgtactgggggcggattttcattcctcacattgcaaatggagcattattcaggactctatggtttatgtttttgtggtatcgcagatccaaaatatcaggagctgagttgccaaatagtctggtaaatgtcagagattctgaagttgaataagcagtaatctcaacagcttgcattttgtgtctgagaaacgagccaggacaagctgcttgggaaaatatatcagaactggagaaggcttcgacaaacctaaccggctggtgcttgggattttcagcttgaaactttgagcacaaaaaatgccccaatcttttattttttctgtgtgtgtgtcttgtttcatttaaccttgcgttttgggag

SEQ ID NO: 16915 - DNA, 461 bp, Gossypium hirsutum
  Clone ID: uC-gsflnu33B110b04b1
tggtctcgcttaatgacgagaaagcattgaaaaaggcagtatcgaatcaaccggtgagcgttgccattgaggcatgaggaaggagtttccagctatatcaatcaggtatattcgatggaaaatgtggaacacaactagaccacggtgtaactgctgctggatatggcacagataaaggtaaagactattggattgtaaagaactcatggggaagcagttggggagaagcaggctatctcaggatggcaaggaatgtggccaataccgtaactggcaaatgtgggatcgtgatggaagcctcttatccgatcaaaacaggtgaaaatccccccaatcccggaccgacttcaccatctcctataaaacctccgaccgtgcgcgatagttattattccagtccctagagcaatacctgctgctgcatatacgaatactataactactgctttgcttggggattc

SEQ ID NO: 16916 - DNA, 385 bp, Gossypium hirsutum
  Clone ID: uC-gsflnu33B110b07b1
ttccactcgtccggtttctacaagcatacggtcaagccaggctcttatgcatggaaataccacaggccacctcctcgcagatccaatgttatagatatggactcaatttttgatgtcttcgagcacttaattgcagaagatgaaatgaatatttttgatgctgaagatttggaaaacgatgatatatctatggagatggccttatttttaatgcagctagattatgattcaagtgactcctcaagtgatgaggagaattttcactattaaattcctaaattaagttttgctcctttttgctcgaattatggaaatgttggagtgctttgggtgttcatgtaggctaccacctttttcgttttggagaatattgctttggagtgtg

SEQ ID NO: 16917 - DNA, 509 bp, Gossypium hirsutum
  Clone ID: uC-gsflnu33B110b08b1
ttccacgcgtccgcaagaacagggtgcacccgttggaggaattggaattcaaggacatatagataaccctgtaggaccagttgtgtgtactgctcttgataagttaggcattctcggccttcctatctggtttacggagctcgatgtgtcttcaatcaatgaacacgtgagaggggaagatttagaagttatgcttagagaagctttcgcacatccggccgtggagggtgtaatgctgggcggattttgggaactgttcatgagccgggataacgcacacttggtgaatgccgaaggcgaagttaatgaaaccggtaaaaggtttcttgctcttaaacacattggttgtctcatgctcgtggacaagtagatgtaaaaggacaattcaatttccgaggctttatggggaagtacgccatggaaatcgatactccctctaagaagatcgtgaaaacttttgtcgtcgacaagggtgatacgccctggttgttcccgttgaattataaatt

SEQ ID NO: 16918 - DNA, 514 bp, Gossypium hirsutum
  Clone ID: uC-gsflnu33B110b10b1
ttttccacgcgtccgaacaatggcgtcttcagctctgataagtaagcttgaggcagatgtagagattaaggcttctcctaagcagttccatgaaatgtttgcccacaaaccgcaccatgtgcaccatacttgttatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggactttggaatacgagaagctgcacggtgggattgcgcatcctgagactctgctgcaattcgttcaagatatctctaaagacattgacgcccacctcacccaagcaagctaaacagtatcacatgttgctatt

SEQ ID NO: 16919 - DNA, 448 bp, Gossypium hirsutum
  unsure (1)..(448): unsure at all n locations
  Clone ID: uC-gsflnu33B110b11b1
ttttacattcacttcaaccaaaaccacttctctctctctctctctcttcacatgactcgtccttttaggctccttggcgccgccaactcctcggccactactgagccgccacctgaacaatcggcaaccgtcgactccgacttcgtcgttatccttgcagccctcctatgtgcccttatttgcgtcctcggtctcattgctgtcgctcgttgcgcctggcttcgccgtctctccggtgcctttgctcccaatccctctgcttcatcccgtcccacccctcctgctaacaagggcctcaagaagaagatcctcaagtccctccctaaggctaccttctcacctgatttctccgccaaattctccgattgcgcgatttgcctcacggagttcgccgcaggggacgaaatccgggttcttccacagtgcggncatggctatcacgtcgtct

SEQ ID NO: 16920 - DNA, 178 bp, Gossypium hirsutum
  Clone ID: uC-gsflnu33B110c01b1
tgttgacgcgtgggcggacccttggggaaaggcgagcgttaaaatgggtatgcagcataccacggagtcaggctggtgctagtgactttgagcacagtttggcacagacttcgacagaggaatacatgcataggctacctgtagcgggaaacagttcaagcggaataaagtcttgggc

SEQ ID NO: 16921 - DNA, 368 bp, Gossypium hirsutum
  Clone ID: uC-gsflnu33B110c03b1
ttttgaaacaacggtggtcagccgaaccaggagagacagcttgttgctctcgtcttgccacgcggcataaattagaatacgccgggcagaaattcctttacaccatcgagagcgagatgaggtgttgtccgtacactgtaggtataggagagccatacttggacggcaaaccgagcctcgattacgacgccgtccgcaagccaaacgacatccacgcgcttaaaaggagaccggatgaccactgcattgagaaccaggagaacgcatctttttctacgacgcatcacaacctggacttggtgatccaaacgtagaaacaagtactgaatcgcatcgcttcgaggattgaggctgaaatgttcgaaacc

SEQ ID NO: 16922 - DNA, 289 bp, Gossypium hirsutum
  Clone ID: uC-gsflnu33B110c05b1
ggtgcgcccgctgggccgcgcgcatactctcgccgggacccacgcgtccgtgacgtcgtctgacgagaaagcatctagaggggcatttgggagtcaaccggagagcgacgccaatcagggaagaggagggatgctgcgagaatctcaatcagacatttttgctggagaccttgctacacgactagacctcagtggaactgctgtcgaatatggcgcaaaaaaaggtaaagaccatcgctttgttgtgaacccaggtggaagcagctgtggataagcaggatctcttagg

SEQ ID NO: 16923 - DNA, 511 bp, Gossypium hirsutum
  Clone ID: uC-gsflnu33B110c08b1
tgaaaactaaaaaaacctccagtcagatatagccaaagaccctaaatcatttcccaagcattctccgatggtctccatttccaaaagccgcagttttctaaaaaattaaccagttgctgcagtcatcatcgtaggtcgtttccctcaggctcagtccggttctcgtggccgacctcctcgtctgggatcagtggtggagcctgggacacctcccacctggtttcgttgtgccgctcactactgttgtctccttctccgctccaatcttcaactgtctccgtcccgccgctggtcaatctcatccaattccaattagcatcattaacattgagaataagttgagtaggcaactgccagaactgtatcttcatctatttgaaggtttaatcaattatgcaaaaaaaaaaagcagggacccagttttttcgaaatcaattatttctgaagatatatgaaaggtctcggatgggagctttagtaaatacatggtcaagcatccattttctccagc

SEQ ID NO: 16924 - DNA, 512 bp, Gossypium hirsutum
  Clone ID: uC-gsflnu33B110c11b1
cctaacatcttcatgctcaatcttctgttcttgatgtttgagattcatgtctccaattctcagtgaaatcttcttttctgggtttatgatcaattctacattcattcgaaggacccaactcgttcaatctttctcagttgttttcctttactggttgtactacgtttcatgattttctagccctttttttttctttcaagttttctatctctctatatataataaataaataaataaattcaactactataatattctactaatctgcatattattcatcttttatctacaactttccatggcttcctcaagtggtacatcatcaggttcatcaaccatggtcacaaactcaggctccgatgaagatttacaagcattaatgaacgaaaggaagaggaaaagaatgatatccaacagggaatcagcaaggcggtcaaggatgaggaaacaaaagcatttagatgatctcgtggcacaagtttcccagctacaaaatgaaaatcaccagattt

SEQ ID NO: 16925 - DNA, 484 bp, Gossypium hirsutum
  Clone ID: uC-gsflnu33B110c12b1
ttttccacgcgtccgcccacgcgtacggccaaagaggatttggcacccaatgttgatttggaaactattgcaaatatgactgatggatattctggaagtgacctgacgaacctttgcgtgactgctgcacattgtcccataagagaaattttggagaaggaaaagaaggagagagcttgagcagcagctgagaatagacctgcacccaccttgtatagcagtgcggacgttcgacctctgaagatggatgattttaaatatgcacatgagcaggtgtgtgcaagcctgtcatcagagtctacatatatgaatgagttgcttcaatggcacgagttatatggagaaggtggatcgagaaagaaaaaacctctgagctacttcatgttgaggagaggaggtatctttgtgtataggcgtagcttcatcattcctttttcatttcattcttcattggcgccattaaggtggccaagttgagagtgac

SEQ ID NO: 16926 - DNA, 70 bp, Gossypium hirsutum
  Clone ID: uC-gsflnu33B110d01b1
atcatacgtacgctgacaggtgacaaaagggggacgataaagaggttcttgcgaatccgacgggtaaaaa

SEQ ID NO: 16927 - DNA, 210 bp, Gossypium hirsutum
  Clone ID: uC-gsflnu33B110d02b1
tctgtctgacgcaccagctatgagcaccactgagggacgccataggggcatgtgcggaataaacagctcgtgaaatccaggcatccgtctcaagacgagacgaaagacgtagataatgaaaacagagagtccgacaagctacgggcacctacagggataaaatgacggggatgatcgcctgcaaggtgaatgactataataatgtgtctg

SEQ ID NO: 16928 - DNA, 324 bp, Gossypium hirsutum
  Clone ID: uC-gsflnu33B110d03b1
gtgtctacgcgtccgatccatgcaactgctgaaaagcttgatgaaagccatagattatgaaaaaagaaagcagcaaaataacaggcctctgtaatgatttattttcaaggatggatgcgtgcaaggtctataattatgtctctgtctgtcttgtgtaatagaagctttgtttgtggtaaaaataatgtataagccattaggatgggagcaaattttccttttgtccaaaggatttttgctgctcattcatggtgacttggttaatggtcttatctgcaaggtgctaagatcttataaaaatatatatcggttgctgcttttggt

SEQ ID NO: 16929 - DNA, 498 bp, Gossypium hirsutum
  unsure (1)..(498): unsure at all n locations
  Clone ID: uC-gsflnu33B110d04b1
tttttatgactaacgcttatctctatcctcattgctcatcatttcactttccctttttcttgcccttttcaaataacgaaattgttacaatggcagaaaggaactggagaaaaaaattcatgatgcaacaagatcaggtgtttcagcctcaattgataaccaagcgttatgtactttgcgggtagagccatctttgtatgattcctttagtaggtattgcttgatccttaaatctttgttctgaaaggagcggctcatgtactaaacttttcactttttggcatttgttggatctacaatggcactggaatgcctgaggatacggttaaaaccgcaaacatcatccttatctttcattttgtattgggattattcattagatacaatcagatatgatccacttttatgtggatgaaagtgcaaaanatacaaaataaaaccttccgctttctttaaaacttcttctaacaaaaaaggcttttcggtttctctttctta

SEQ ID NO: 16930 - DNA, 517 bp, Gossypium hirsutum
  Clone ID: uC-gsflnu33B110d05b1
tttcaaagctgtagaatactgtgggaattgaagcataatttgtatcaatttatttggccagttatcacattttttcagagaataaaatggaagagaagtatgaaactctgaagattcagcaagaatcgccaaattctggagtttttaacctaatcattaaccgcccatctgtcagtaatgcacttggactcaatttctttagtgaattccccaaagttcttaatgcgctcgaccaaaaccctatcgtcgccgtcatcgttctatccggatccggcaaccacttctgcggaggtatcgaccttaaaagcctcgcagctatcgccgatgataactcgggtgatcaaggccgcaccagggaacggttacggagaaaaatcaagctcatgcaagatgcgatcaccgctatcgagcggtgccggaagccggtaatcgcggcgatacacggcgcgtgtcttggcttggggatcaatatcgtgacggcctgtgacataaggtattggactaaggatgcattttt

SEQ ID NO: 16931 - DNA, 238 bp, Gossypium hirsutum
  Clone ID: uC-gsflnu33B110d06b1
ttcacacgtgcgatgacgcgaaggctcaggggggtgttatgagggcaactatgttcaaatccaaggccgatccaaaggcatcgggaaggagcacgagcagaagacaactggacttggggccatcactaaggaccgtgtggtaactgaaacacacggaaccatatggtacatcgaatggaaagaacagagagcttgtgtcacaggctaagatggcggtagatcgaaaccagctcaaagg

SEQ ID NO: 16932 - DNA, 189 bp, Gossypium hirsutum
  Clone ID: uC-gsflnu33B110d07b1
tgccacgcgtgcgaaaacgccaagggcgggggacgtaacaggagggctacgatatattcatccaaagcccagctcagttggcagtgagcgagcacgagcagatgactattggagcactgtgttacattaaggaccaggtggttgggaacttgctcggaacgagagggcaaatggttgacagcagaagaa

SEQ ID NO: 16933 - DNA, 513 bp, Gossypium hirsutum
  Clone ID: uC-gsflnu33B110d08b1
ttttccacgcgtccggatcatctttcagctaagctttcaatctagctttagttatagaaaaaaacagtggaattaagggtatggcatttgagaaagatctcaaccttgatgccaccgagctccggctaggcttaccgggaacctccgacgagtcagctaagaaccaaacgccggcaactcttcggagcaacaacaaaagagccttgcctgaagaatctatgtctagtaatgccacagcttccaaaaactgtgaccaagaaactgctccactccccaaggcacaagtgatagggtggccaccgatcagatcttacagaaaaaacaacttgcaacctaagaaaagtgagggtgaaattagtgggatatatgtgaaagtgagcatggatggggctccttatcttagaaagatagatttgaaggtgtttaaagggtaccaagaattgcttaaggccttggaagacatgttcaagttcaaagctggtgaatattcagagagggaaggatataatggat

SEQ ID NO: 16934 - DNA, 500 bp, Gossypium hirsutum
  Clone ID: uC-gsflnu33B110d10b1
ttttccacgcgtccgcccacgcgtccggaaacagatcggagcatatcctgatgttgaaaaggctaaggacagccaaggaatccgacccggaaaaggaaaaatgaggaatcggaggtacatttcccgtaaaggtcctttgattgtttacggaactgagggagctaagcttattaaagccttccgtaacattcctggagtggaggttgccaacgtggagaggcttaatctgttgaaactggcacctggtggtcaccttggaaggttcattatttggaccaaatcggcttacgagaagctggacacaatttacgggtcatttgataagccttctgagaagaagaaagggtacgtactgcctcgatctaagatggtgaacgctgatctgggtgcgattatcaactctgatgaggtgcagtcggttgtgaagcccattaagaaggatactcagagggcccctttgaagaaaaacccactcaagacttgaatgctttctgaagttg

SEQ ID NO: 16935 - DNA, 430 bp, Gossypium hirsutum
  Clone ID: uC-gsflnu33B110d11b1
ttttcaaaaccccatcacaaagaatctctctcctttcattcttccaaaaaagaaaatcccaaatttcaaaacaaatcctaatagtattagcgatggatcaagaggtggtcggacgccacgcgctgctcttcgacgacgacgccatggccgccttcgttaactctccggaggctctcgttgactggaactccctcgccatcgatcgctatgatgtgcgtcaccttctctctggacctcctccgcctcgaaagagacggcgccacctttcatctccttccgtaaccgccgatgataagttggagtccgatctcgatcgtgagcgttatctcgatttgcctcctccatctccgtcgctgcccgatcggcaagatggagaatataatgaggaacctgcggctgctgggtggtctctataatgctgttttctttt

SEQ ID NO: 16936 - DNA, 481 bp, Gossypium hirsutum
  Clone ID: uC-gsflnu33B110d12b1
ttccacgcgtccggtagcaaagacaaaagatggagtcttcaaggcatgactgcacttgtcaccggtggtaccaaaggcatcgggcatgcaatcgtggaggaattagctggacttggagccattgtgcatacatgttctcgaactgaaaccgagctcaacgattgcttactcgaatggaaagcaaagggttttcgagttacaggttcagtgtgtgatgtttcgaatcaagctcaaagggaaaatctattaagcactgtttcctctgtgttcaatggaaggcttaacatcctgataaataacgttggaacgaatatagggaaaatggtgacggattacacggcagaagatgtttcgtttttgacgagcaccaacttcgaatcggcttataaaattagtgtattggcacatccccttttgaaagcttccgccgctgcaagcgttgtgtttatttcttcaattgttggtgcattacctatatata

SEQ ID NO: 16937 - DNA, 256 bp, Gossypium hirsutum
  Clone ID: uC-gsflnu33B110e01b1
tgtttggcgtacccgctctgttcaatcctgagtgacgattgagggcatcatacagaaacctcagatgttgacctctgtatcactgttccaagaagacgagaacgatgtacataatgcttacctagcgccagacatgtatgggtgccgtcatggttaaaacaatggtaatgaacgcctgaatggggaagaatgctattacggtgtctgactgtatcttacattctataaaaaccgtcatgcgaggaaagtacgatta

SEQ ID NO: 16938 - DNA, 252 bp, Gossypium hirsutum
  Clone ID: uC-gsflnu33B110e02b1
tgtctggagcacccgctatgatgaagactaagtgatgatagagggacccatacagaaatctcagatggtggcctctggatctgcgtcccaagaagacgcgacacatgcaaatgatgcttacaaagcaccagccatgtttggggccggtcagggagaagaacacggtaatgtacgcccgaatggggaagaatgccattaaggggtagggctggatcttacagtctataaaaagcgagaggcgaataaaccatg

SEQ ID NO: 16939 - DNA, 336 bp, Gossypium hirsutum
  Clone ID: uC-gsflnu33B110e05b1
ttcacgcgtccgatttttttataacacaattacaaactgactttggttgttttcaaaaaaaaaaaaaaaaaaaaaaaaaaaaaaaaaaaaaaaaaagggcggaacatctaagaagaaccaaagcaaaaaaacaggggcggcccgattagaggacccaagtttgcgacgctacatcaatgactggcccttttatagcaccccctaaactgaaaaaactgggcggtttccaacaacaaggggactggaaaacccccggctttccccagcttaatcactaggcaaaagacccccatttatccagctgtgcaacaaaagaagaggccgaaagggaacggc

SEQ ID NO: 16940 - DNA, 504 bp, Gossypium hirsutum
  Clone ID: uC-gsflnu33B110e09b1
ttttcaagcgtatgtcgatgatcacttgatgtgtgatatcgagggcaaccatctctctgccgccgctatcattggccaagacggcagcgtttgggcccagagctccaattcccctcagttcaagccagaagaaatcactggcatcatgaatgactttgctgaacctggatcgcttgctccgactggattgtaccttggtggcacaaaatacatggtgatccaaggtgaacccggagctgctattcgagggaaaaagggccccggaggtgttactgttaaaaagaccaacctggccttgatcattgggatctatgacgagccaatgactccaggccagtgcaacatgattgtggaaaggctcggtgattatctcatagaccagggtctctgatcactttggtgtaaccttagatgacgcaacacttgctggcttcttctatacaaaagtgcatctaccaccacctcttgtaatggtcggctgcaattaaataatagtattactag

SEQ ID NO: 16941 - DNA, 505 bp, Gossypium hirsutum
  Clone ID: uC-gsflnu33B110e10b1
tcttagcaattcgagtctctacaagcaatgatgccatggtactcggtcggtcacccttccatgattcaaccagcggtgatgaggtacatcaaggaggtgtggggtttcaacaagaagcctctgctagtggtgttggaccctcaaggaagagttgtgaaccctaatgcgatgcctatgatgtttatttggggaagcatggctttccctttcaccaagctcagggaagaagctctttggaaggaagaaacatggaggattgaactattggcatattccattgacccctccataatcaattggttaacggataggaaattcatttgcttgtatggtggagaagatatgaattggatccggaaattcacaacaactgcaaaagccgttgcgaaaactgccaatatcgaattggagatgctttacgtgggaaaaagcaaccctagggagagagttcgaagaaacatgaccaacatcgagttagaaaatctcagccatacactgtcagaca

SEQ ID NO: 16942 - DNA, 519 bp, Gossypium hirsutum
  unsure (1)..(519): unsure at all n locations
  Clone ID: uC-gsflnu33B110e11b1
ttttccacgcgtccggtagcaaagacaaaagatggagtcttcaaggcatgactgcacttgtcaccggtggtaccaaaggcatcgggcatgcaatcgtggaggaattagctggacttggagccattgtgcatacatgttctcgaactgaaaccgagctcaacgattgcttactcgaatggaaagcaaagggttttcgagttacaggttcagtgtgtgatgtttcgaatcaagctcaaagggaaaatctattaagcactgtttcctctgtgttcaatggaaggcttaacatcctgataaataacgttggaacgaatatagggaaaatggtgacggattacacggcagaagatgtttcgtttttgacgagcaccaacttcgaatcggcttataaaattagtgtattggcacatccncttttgaaagcttccgccgctgcaagcgttgtgtttatttcttcaattgttggtgcattacctatatataccgcgcctatattaggagccaccaaagaggccatga

SEQ ID NO: 16943 - DNA, 60 bp, Gossypium hirsutum
  Clone ID: uC-gsflnu33B110f01b1
gtaacgcgcacgggcgagaccaggacaaggggggcggttaaaggcaccatccagtttcct

SEQ ID NO: 16944 - DNA, 262 bp, Gossypium hirsutum
  Clone ID: uC-gsflnu33B110f02b1
tttttcgcgtccgggcacgacgagggccacggtggcgataaagaggaccttgtgggaacctcagatgtccaactcagtttgaggggaccctgcacgagatgcaggatgaccggcgcgctgacatggaccgctacaaggaaaggtggtgtcatgcttaaaaccatggcaatgaaggtgtccgtggagcgcaaaacaatcacggggacaagcggtgacccttaggctgagaaacattatcccagcgagtccagaacgactatga

SEQ ID NO: 16945 - DNA, 463 bp, Gossypium hirsutum
  Clone ID: uC-gsflnu33B110f04b1
ttttgctacacggctttgaatgatcaccatgtcatgctagaaggtactcttttgaagcctaacatggtgacccctggttccgactccccagaggttgccccagaggctattgctgagtacactgtccgagccttgcagcgtaccgtccctgctgcagaccctgctattgtgctcttgtatggtgggcaaagtgaggaggaggctacccttaaccttaatgccatgaacaagctccagaccaagaaaccatggtcactctcattctcatctggacgtgcccttcagtagagcactctcaaggcctgggctggaaaggaggaaaacgtgaagaaagcacaagatgctttccttgttaggtgcaaggctaactcggaggccaccttgggtccatacaagggtgacgcaaagattagtgagggtgctgcagagagccttcatgttaaggactacaaatactaagaat

SEQ ID NO: 16946 - DNA, 182 bp, Gossypium hirsutum
  Clone ID: uC-gsflnu33B110f05b1
tctacgcgtgcgaaaacgcggaggttcagggatgcgataggtgggctactagatatacatacaaaggacatctcagttggtaggcagtgagcatgagttcaggagcacttgagcgctgcgtttcattaaggacctggtgttttagcagttgctacgagccatattgcagatggctggcatca

SEQ ID NO: 16947 - DNA, 251 bp, Gossypium hirsutum
  Clone ID: uC-gsflnu33B110f06b1
tgtcacgcgtgcgaaaacgcctagttccactgaggcaatatatgggctactaggttcacatacaaagcacagttaagtttgcatggagcgagcatgagctcaggacgactggagcaatgccttgcaccaaggacctggtgttccatgatttgattcgaacgataccacagaagacgggcagcacctctaagggtgtgtctttcacaaagatggcattagagtgtaggctgttattgaacagcggttaactg

SEQ ID NO: 16948 - DNA, 162 bp, Gossypium hirsutum
  Clone ID: uC-gsflnu33B110f07b1
tgccacgcgtgcgaaaacgccgaggtcgggggacatgacaggacggatacgagaaacaactccaaaggccagctaagttggacggccatgagcactgggtacaggagttcaggggcactgtcatctaccgaggaccgggtggttgataacaagcttggaacc

SEQ ID NO: 16949 - DNA, 517 bp, Gossypium hirsutum
  Clone ID: uC-gsflnu33B110f10b1
ttttggacgcgtccgcccacgcgtccgatgttttggtggttttggatatacgtcctgatgagtcattgtttgaagctggtgttgcacgtgaggtggttaatagaattcaaaaatcacgaaagaaagctggccttgagccgacagatatggtggaggtctactttgagtcattggatgaagacaagtcagtcatccagcaagttttaaactcacaggaaaactacattaaggatgcaattggatctccattgctttcctctgacattatgccgctccatgcagtggtgcttagcgaagagattttccatggcatctataacatgtcatttaaaataagcttggtcagaccagcccttgttttcaaggcaaattctattctcgccttatattcaggaaattctaaatttgcacaaggcctgcagatttaccttctgtcaagggaccattcctgtttgaagtcggagtttcagcttggacgtggcaagataaaggttgattgcattgagaacttgcccgc

SEQ ID NO: 16950 - DNA, 516 bp, Gossypium hirsutum
  Clone ID: uC-gsflnu33B110f12b1
tttgtgggtgtgggttagtcaaggcattccaaaagagttattacaacaagtatggtggaggagctaatagcttggctgatggatacagcactggcactggtttggctgctgaaattattggcacatttgtgcttgtttacactgtattctctgcaactgatcccaaaagaaacgcaagagattctcatgttcctgtgttggcaccacttcccattgggtttgctgtgtttatggttcatttggcaactattccgatcaccggaaccggaatcaaccctgctcgtagtttcggagctgttgttatgttcaaccaggacaagccatgggatgatcattgggtattctgggttggaccattcattggagctgccattgctgcaatttatcaccagtatatcctcagagcaggagctgctaaagctcttggatccttcagaagcagctcagccatgtaaaacaaaggggttgccattgaagaatggatcaagttctatctatgactgtgaagagaatttt

SEQ ID NO: 16951 - DNA, 190 bp, Gossypium hirsutum
  Clone ID: uC-gsflnu33B110g06b1
tccacgcgtgcggaaacgcggaggtacagggaggcgttagaagggatactaggtttacacccaaagcccatctaagttggctgcgaacgagaagtagcatatggagcctggagcaatgcgctatattaaggaccgggtggttgatcactagcttcgaaccatacggaataaggttggcagcaaccgaaat

SEQ ID NO: 16952 - DNA, 513 bp, Gossypium hirsutum
  Clone ID: uC-gsflnu33B110g08b1
ttttccacgcgtccgctagattcagctatgcttctctttggagggcattggtgttttctgatgctaatggaataaaggaacatagtgtgaaattgggtgctggggaggacctgtatgtgctatttgcagggattctaacgatgaggccctggaatcgggtcattgacccagctgtggatcatttggtcataaaaggcactgatagtgatcgttctgaactacagatgtatgcatctcaatatttccctcaaatatccgagcttctcagtcgactgccccgtgttattctattaatgttgaagacaaatgattgcttaagagcagtcaataactctctgttacagggttcttcactcgagacatttttgatcatcggaagagtttcttccgaagctgttgtcgaagcaaagatgatgcagatgaaatcattattttcccggattgatatctggttcgaggaattcctttttgaagctcgccttttagcactgcagatagctttttggcttttac

SEQ ID NO: 16953 - DNA, 379 bp, Gossypium hirsutum
  Clone ID: uC-gsflnu33B110g09b1
tttccacgcgtccggtcagagatcaagatagggatcagctcaacaactccagcaacggtgccagttatagactgataaacacaaaacctgacagcgctcagcactgatgggaagctagagagatgctaggctccagaagaatgggcggggctcagaaggatacagacatgatctgagccctaccggaagctaggaacggcgagaccaggagctaagctggagaccgggaacgtgccgtaacagaccaaggaactgagagccttcgacaagccgctaggggagtaattcaatccttgataggcaccgatatacagcttgacgctggaagatgctccgatagctggaaccaatgaacagtggctgacgagcactttacgga

SEQ ID NO: 16954 - DNA, 446 bp, Gossypium hirsutum
  Clone ID: uC-gsflnu33B110g10b1
ttttggaagagtataagagctttgtaatcacgattcaagtttcgcccaagagcgagggtagtggcagcttagtgcactggactttggaatacgagaagctgcacgatgggattgcgcatcccgagactctgctgcaattcgttcaagatgtctctaaagacattgacgcccacctcacccaagcaagctaaacagtatcacatgttgctattgttaccgctacttcaagcactattcatctatttaatgaataaagtgacaacttcctttctcatgtattttgatctgaatatgtatgtttagatcaatatgcagtcaaggggagggagctttgtattttcttgcatgtttgtctttttagttctgtatgaattcaatgtatcctatgcttttatttgtgttcacatgaatatatgtaagtaaaattttcgaatctatttccactc

SEQ ID NO: 16955 - DNA, 518 bp, Gossypium hirsutum
  Clone ID: uC-gsflnu33B110g11b1
ttctaaaaagaatagtgagagcagaagaagacaatgggacgccctgatacagaccctgaacaaatacaagccgaatacgagcttcgccctcaagaatacgacccgacccatgaaccaactccgaatgtggccgatgaatatccaccgccaccaccttatgaaaacagaaatcaacaaggccaacaacaacctcaattcccgccgcaacaaccaccgcaatacccaccacctgctcagcaacagccaccgcaatacccactacctgctcaacagcagcctccgcagtacccaccaccatcacaacaacctaaccaagcctatcctccaccgcagcggcccgcgccgtacccaccgcaacaaaacatgcaatacaatccagcgtacccgaacgggacaaaccagcagccagcggcggcggcgtatccgccacagccagtacagtatccgcaaaaagtccagcggcgaatcagatgtacgcaaatgtaggaccacaagcgacgcagcctcagaccgtttac

SEQ ID NO: 16956 - DNA, 388 bp, Gossypium hirsutum
  Clone ID: uC-gsflnu33B110h02b1
ttctttgcgtccgtttacaacgagtcacactacaacgactgccgtggataccaccacgctggcaaaagtgaccaccctgtcaagggtctgctaaggaaaataaagggtggcatttcacgtaataaaagctgtagtgatagcgacagtggcagcaacagtgatgatgatggttacgggaagaagacggtcttcgtgagcaaggcaatatgatgaagacatatatgataataataatgataaatatggtgaaagatgttggctatataaatgccatacataatataataaaattaaagatccctctatgttgatgttttcgtatcatatgtacctttatgaattaaggtatgatataacctcttgctctggaggagttgggtttgtcaac

SEQ ID NO: 16957 - DNA, 406 bp, Gossypium hirsutum
  Clone ID: uC-gsflnu33B110h03b1
tttttaccacgcgtccggacattttttaataacggtccttgaatctccaaatataccacatgcatggaggctcaatgaaatccctaatcttactacttctaatccggcatatgcctccgccgcaaacggtgaggcaacatttgagtgaatgaccaactttaacgccaaaatttcccctcgcctatctctaaccaccagccctgtggcagatttggaagaatactggtcaaaagcccgattgaagtgaatgcttacgtttggcccttggtcattgggataatgaagtctggctgatcacagatacatagtttttcctttaacccaagccccttttgagtattagcttataattggtctgaaaaggctctggtggttgggaattttattttataaaaaaaaattggtt

SEQ ID NO: 16958 - DNA, 458 bp, Gossypium hirsutum
  Clone ID: uC-gsflnu33B110h04b1
tttacttcccatagtctctcctcctccctcaccaaattataatgtctctggtggcgaacgaagactttcagcacattttgcgtgtgctgaacaccaacgttgatggaaagcagaagatcatgtttgctttgacctccatcaagggtattggaaggcgtttcgctaacattgtttgcaagaaggctgatgtcgacatgaacaagagggctggtgaattgactgcacaggagctggacaatctcatgaccattgttgcaaaccccaggcagtttaagatccctgactggtttttgaataggcagaaggattacaaggatgggaagtattcccaagttgtgtctaatgctctcgacatgaagttgagagatgactaggagcgattgaagaagatcaggaaccaccgtgggctgaggcactattggggtctttgtgtccgtggtcagtacaccaagaccact

SEQ ID NO: 16959 - DNA, 122 bp, Gossypium hirsutum
  Clone ID: uC-gsflnu33B110h05b1
tttatcacgtgagaataccacgaggaatggcaccagaatttgtggcacccatgttatgtgcacgggtgacagttctcagcccattgagtcactatggtttcatggggactggggcgaggcga

SEQ ID NO: 16960 - DNA, 180 bp, Gossypium hirsutum
  Clone ID: uC-gsflnu33B110h07b1
ttctacgcgtccgataacgccgagggtgggggatattataggagggatactagatattaatataaagtccaactcaggtggatgtgtgtgagcactgtgtgatgaggtctggtgcgatgtgattcacctaggacctggtggttgagcataagcttggaaccattttgctgaacgtgggca

SEQ ID NO: 16961 - DNA, 469 bp, Gossypium hirsutum
  Clone ID: uC-gsflnu33B110h08b1
tctttcatattcgaaatcttcgaaatctctctctaacatcttaacatacgattttggttgtgtgggagagagagatggacgcccttgacaacgtggtagatcctttgagagacttcgccaaggacagcgtccgcctcgtcaagcgttgccacaagcctgatcgtaaagagttcacgaaggtggctttccgtacagcgatcggtttcgtagtgatgggattcgtcggattcttcgtcaagctcatctttattcctattaacaacatcatcgttggctccgcttaggaattgcaggctcgtagaaattggtggggggatatgaccagttggcgtagttgcagattctcatagaaaatgaatgttagaatgcagcagttgggggccaactgctgtccctctttccttttcattttacattttattagttgaaccaaatagttttgaatttaaactaaactccttttgatatt

SEQ ID NO: 16962 - DNA, 506 bp, Gossypium hirsutum
  Clone ID: uC-gsflnu33B110h10b1
tatcggttcatctcactactgttcaagcgaagttacttaaagaaaggaaaacccatggctcctagatcaaaacccagcccgattagcccgaatcccgacccgagttctaaggagatccgctaccgcggcgttaggaagcgcccatggggccgttacgcagccgagatccgagatccgaggaaaaagactcgagtctggctcggcaccttcgacaccgccgaggaagcagcgcgtgcttacgatgcgaaggcccgagagttccgcggcgctaaggcgaaaacaaatttcgccgacaacaacgtcaacgacttcacgcgcagccctagccagagcagcaccgtggagtcttcttctccgccgccacttgaccttactctggctagcgcgtgttcttccctccctgtgacggcgcagcgtccggtttacttcttcgatgccttcgcttctggcggttcgggttgccccgcatccggcttcgctcaaagcgactccgattcgtcgtcgtc

SEQ ID NO: 16963 - DNA, 512 bp, Gossypium hirsutum
  Clone ID: uC-gsflnu33B110h11b1
ttccacgcgtccgtgaaatgcgaagaataaagcaggaccaaggtttagatatgatttcagaaggtttggatactttaaagaacatggctcatgatatgaatgaggaattggataggcaagttcctttgatggatgaaattgaaaccaaggtggataaggcagctggtgacctaaagaataccaatgtcagacttaaacacactgtcactcagctgagatccagccgaaatttctgcatcgatattgtcttattatgcatagttttgggaattgctgcctatttatacaatgttttgaagaaatgaagcgataaaaggataagtcgatccgttcccttatgttctgtcatcttttcttgcattgtcttccatcttgagggcttgctaaggtggtcgatctcgtatttgatttgtttcttttgtgggaatcattggtcacactggcataatgtgagtttatctatatattatgtgatttacagagatggattatcacattattttaaaatgata

SEQ ID NO: 16964 - DNA, 253 bp, Gossypium hirsutum
  Clone ID: uC-gsflnu33B110h12b1
taccacgcgttcgtgaaaagctaataatggggctttttcaaggttcagatccgaaatcccacggaatggatacttaaaagaacatgtgcatcattgatctgaatgtggaactgtataggctaagttctatttgctggatgaaattgaaactcaatgtgataccgcagctgatgacctaacgaaaaccacagtctgacttaaacacactgtcacttaggtgttactcactcacatattcttgcatcgaatttgt

SEQ ID NO: 16965 - DNA, 518 bp, Gossypium hirsutum
  unsure (1)..(518): unsure at all n locations
  Clone ID: uC-gsflnu33B111a01b1
gttgtccctcgccatggtcgctacctgacagcgtcagccatgttccgaggcatgatgagcaccaaagaggttgatgaacagatgatgaatgtccagaacaagaattcatcttacttcgtggagtggattcccaataatgtgaaatccagtgtttgtgatatcccaccaaggggtctgaagatgtcctctactttcatagggaactccacgtcaatccaggagatgtttaggagggtaagcgagcaattcacagcgatgttccgtcgcaaggcctttttgcattggtatactggtgagggaatggatgagatggagttcacagaagcagagagcaacatgaatgacttggctgcagagtatcaacaatatcaggacgcaactgtggaagatgaggaagagtacgaggnggtagagggtcttgatgagaactatgagacctaaaatgcgttggcaattaccatatatcaaaacctgcgtgaagctcgagaatagcagcaacttttgcctagttatatact

SEQ ID NO: 16966 - DNA, 511 bp, Gossypium hirsutum
  Clone ID: uC-gsflnu33B111a03b1
tcctttttctttcatctttttagcccaaaaattaaaggaaaaaaatagagatagaagattatgccttcatttccacagcctggctctgttaccatctgcgaaattaaccgagatttggttacagccgatgccctttctgatagtaaagctaaggatacttatggaaagcttcttggaatggtgttcaatccagttccgtttcagtccttagaggatcccacgcaacctccaccagcttcaaatgctgccgtctctcaacccaaaggatttggaatgataacttcctccctcaaacacatttttctacccaatgatattgatttgttaccagaagttgctctccaaggtgtgagctggcatcagcacaaacatatactggcatttatatccggttctaatcaggttacggttcgtgattatgatgattcagggaaggagccttgcattttaacaagtgagtcacaaagagatgttaaagttctagagtggaggccaaatggtggaaagtcac

SEQ ID NO: 16967 - DNA, 395 bp, Gossypium hirsutum
  Clone ID: uC-gsflnu33B111a04b1
cttattcgtccgaaaacagggaaagaaaagcagcgtgatgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattggagagtctcttgttatacttgaatacattgaggaaacttggaagcataatccctatttgccacaagatccttatgacaaagctaccgatcgattgtggatcaagttcatcgactaaaagtgctttcctaccctttggctagctgcatggagcgccaagaatg

SEQ ID NO: 16968 - DNA, 333 bp, Gossypium hirsutum
  Clone ID: uC-gsflnu33B111a05b1
gtttcttcattcgtttaaagacgttactgatatggtgaggggactagaacaataagacatgtgtttggaccgtttctcacatcttccacgatgttcttggatggattcggtctgcaagggacagatgtcgggcatagctacgcgagataccgggtattgggagtgggggagtcgaactattgagggggcgatacagatatatggccttctttggtccatgggcgctcagcacctatggagattgagtatccaccgctgtgtgagctccagaccgaggctggggtgcgtggcttgcagagaggcgtacttgtgatcatagctgacgatggcgtg

SEQ ID NO: 16969 - DNA, 493 bp, Gossypium hirsutum
  Clone ID: uC-gsflnu33B111a06b1
gcgctttttcgtccgcccacgcgtgcggccacgcgtgcggcagcaggaaccttaactttggatactcggagaagacaaccagcactcagaccatcatgtgcggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcacaataacaggcctctgtaatgatttattttcagggatgaatgcctgcaaggtctatgactataattatgtctctgtctgtgtcttgtgtaatagaagctttgtttgtggcgaaaataatgtataagccagttggttgggagcaaattttccttttgtccaaaggattttttgctgctcattcatggtgacttggtttatggctttatctggtgttataatcttataaaaatatatatc

SEQ ID NO: 16970 - DNA, 539 bp, Gossypium hirsutum
  Clone ID: uC-gsflnu33B111a07b1
ttcacgcgtccgcccacgcgtccgctggtctgaccactgaagttaagtctgttgagatgcaccatgaatccctcccggaagctttccctggtgacaatgttgggttcaacgttaaaaacgttgctgttaaggatcttaaacgtggttttgttgcttcaaactccaaggatgatccggccaaggaagctgccaacttcacctctcaggttatcatcatgaaccaccctggccaaattggaaatggttatgccccagtcctcgactgccacacctctcacattgctgtcaaattttccgaactgttgaccaagattgacagacgatctggcaaggaactcgagaaggaacccaagttcttgaagaacggtgatgcaggtatggtaaagatgattcccaccaaacccatggttgttgagactttctctgaatacccaccacttggacgttttgctgtccgtgacatgcgccagactgttgccgtcggtgtcatcaagagtgttgagaagaaggacccaactggtgctaaggtcaccaaatct

SEQ ID NO: 16971 - DNA, 524 bp, Gossypium hirsutum
  Clone ID: uC-gsflnu33B111a09b1
tttcacgcgtccgggaaatacaaaggacttcgctgctattctcaatttcaatttttatcctaaaacgcttagaaaaaaaaaaacaactaaaaagatggcgaggagaccggacgaggaatacgattacttgtttaaggtagtactaatcggcgattctggcgttggaaaatctaatttgctttctcgatttactcggaacgagttttgcttagaatctaaatctaccatcggcgtcgaattcgccacccgcactctccaagttgaagggaggactgtgaaagctcagatatgggacactgctggtcaggaacggtacagagcaataaccagtgcttactatagaggtgctcttggagctcttctggtgtacgatgttaccaagccaacgacttttgaaaatgtgagccgatggctgaaagaactcagggaccatgcggattctaacattgtaattatgatgattgggaacaagactgatctgaagcatcttcgagcagttgccacagaggatggtcaaagctatg

SEQ ID NO: 16972 - DNA, 351 bp, Gossypium hirsutum
  Clone ID: uC-gsflnu33B111a10b1
tttttcgcgtccgtcggtttctactctccaaaacatcatgcctcagggaaagcttcaagttgtccttgttagtgccaaaggtctcgagaacacagattttctctgtaacatggatccttacgtgcttcttacttgccgaacccaggagcagaaaagcagtgttgcatcaggaaaaggatcagaaccagaatggaacgaggatttcatattcaacatctccgaaggtgcttcggaactcgcactgaaaataatggacagtgatgctggttctcaggatgatttcgtgggagaagtagctataccactggagcctgtatttatcgaaagaaacattcccctgacttcatatac

SEQ ID NO: 16973 - DNA, 375 bp, Gossypium hirsutum
  Clone ID: uC-gsflnu33B111a11b1
tccatccctaaagaaatcctaaaatttcactggaaatttcttctctttttttccccattttatttttcccaaaccatttctcccctaccccgattccctttatttttcccccaatttcctcaaatcagtagccctctgcatctccgtcggtagcccgctgttgtatctctgtcgacatctgctgtcgagaaagagaaatggctggaagtaatgaaatcaacctcaacgagtgcaagctattggtttcaattagatgaggctaacatatccatcaccagtgtatagaggtatctttgccacgttcctcgcaggttcaagacaggtttcaggaaaggtactgaagcagcaccaagacagaaggttgcagcagtttct

SEQ ID NO: 16974 - DNA, 90 bp, Gossypium hirsutum
  Clone ID: uC-gsflnu33B111a12b1
gacgacacgacgcgcgctttttcgcgtgcggagaaagcaagcgaggcaaaagggaaggaaaatcaagcaaaagcatcgtgtaggagcggt

SEQ ID NO: 16975 - DNA, 487 bp, Gossypium hirsutum
  Clone ID: uC-gsflnu33B111b01b1
tttgtccagcttcacgacgctgtattcgccacagctgaagagctgttccagctcccaaccgaggtaaaaatgcggaacacaagcgacatgcctttcttcggttatttcggacaatacaaaactgttccactctacgagtccttggcaatcgaccacccaacatctcttgatggaactcaaaggttcaccaatctcatgtggcctgctggaaacgatcgctttcgcgaaagtgctcaaaggtactcagaggttgtggcagaacttcatcgaaccgtgatgagaatgttgtttgaaagctatggtgttggaaattgctacgattattacatcaaaatcacccgctaccttctacgatacttgagatacagtgagcctaagatgggggagagtaatgctggtttattgcctcatacagacaaaactttcttgtctatactttatcaaggtgatatcagcggtttgcagatgcaattgaaagatggtcaat

SEQ ID NO: 16976 - DNA, 524 bp, Gossypium hirsutum
  Clone ID: uC-gsflnu33B111b02b1
cttatactggtttttgcgccttttgttgtcggagaaagtgggtgaaaagggattgggctatcgcaaccgtcgcaatcaccgtcatcatcgccgccgtcatcaccgtcatcctcttttacactgtcttctccgattctcgtaaccgcaaaacttcctcgcctacttttgctcctccttccgccggcgatttcgttccgttgactttgcttcaaagtgccaaagctacaggcgccttttgcttagatggaagtttacctggatatcatttccagaaaggctttggatctggttctagcaattggcttctccacattgagggtggaggttggtgtaattcaatagaatcatgtaatagtcgaaaaggaacatctttaggttcatcaaattacatggaacatcaagttcaattttctgggattttaagccaagacccttctcaaaatccagatttttataattggaacaaagttaagctacgttattgtgatggtgcatcttttgccggccaccctgaaagtgagttc

SEQ ID NO: 16977 - DNA, 330 bp, Gossypium hirsutum
  Clone ID: uC-gsflnu33B111b04b1
cgcgtttttatcagcataagacaactgaaaaaaaccaggggaatagatataacagatgcgaagagttggagtaacgggaaacgggaaaaaacggtctttgttggggcaaggcacattattgggggccttatctcatcaatggggctggctgagccaagatttcaaggagtttactccggcggggcagggcaaaatgcacatgtgaccttttccggaggatgtgatgcctctgggaccatggggggagcttgtggttatggaaacctgtactgccaaggtgacggagtaaacgcgggagccctgagcacagcattgttgaacaatgggtta

SEQ ID NO: 16978 - DNA, 421 bp, Gossypium hirsutum
  Clone ID: uC-gsflnu33B111b05b1
ctttttctggtttttgcgccttttgttgtcggagaaagtgggtgaaaagggattgggctatcgcaaccgtcgcaatcaccgtcatcatcgccgccgtcatcaccgtcatcctcttttacactgtcttctccgattctcgtaaccgcaaaacttcctcgcctacttttgctcctccttccgccggcgatttcgttccgttgactttgcttcaaagtgccaaagctacaggcgccttttgcttagatggaagtttacctggatatcatttccagaaaggctttggatctggttctagcaattggcttctccacattgagggtggaggttggtgtaattcaatagaatcatgtaatagtcgaaaaggaacatctttaggttcatcaaattacatgggacatcaagttcaattttctgggatttt

SEQ ID NO: 16979 - DNA, 362 bp, Gossypium hirsutum
  Clone ID: uC-gsflnu33B111b06b1
cttacgcgtccgcttcacagatccaaaccctttaaaccaacagatccgttgttgaatttcaaagttgtttgttacaggaaatggctggtggaacagctccccctagaggaagtgcagcagcagccgcaagcatgcgtaggcggagaaccacaagtggtgcagcctcaggaggggctgctgggaccatgcttcaattttacacggatgatgcaccaggtctcaagatctcgccgaatgttgtgcttgtcatgagcatcggtttcattgcttttgttgccgttctacatgttatgggcaagctgtattttgttcgtagagaggctcgaaagggaatttgcggccagaaaaagaaaatattcacc

SEQ ID NO: 16980 - DNA, 522 bp, Gossypium hirsutum
  Clone ID: uC-gsflnu33B111b07b1
tttattttgtgtaattatattgaccaaaggaatagcctttgataaggataattgggaattagggtttttgattggtgttcaatttgtgtaattttattgaccaaaggaatagcatttgataaggatagactttaaaggcttcaacttgatataacctttttttttcttatactcaatgttttgtttattttattggttttttttttacaattttttgtattttacaaaaaaaacccttaatttttttaaaattcttttttgattatttgattggtttttcatgttgtttttgagctgtcatacatggaaacattcaaaggaaatatgaaattgagccatgttttacccaaaagtgttttttgttcatttttttcttattacaggtagcaaaagcacttggtggtctaattcctttacccgaacccggtccgagtgacccgagaagaaaagaattaatcgagttggagcaacataaagccgtgatcgatacgaaagctgattccttggtccgtcgtgaacttt

SEQ ID NO: 16981 - DNA, 541 bp, Gossypium hirsutum
  unsure (1)..(541): unsure at all n locations
  Clone ID: uC-gsflnu33B111b09b1
gctcaaggtcgcttagatgtcttagccaaccggaatggcctttggtttgaatatgcgccacttatcccttctctttaccaggaaggtttctcacctccttcaatagaagaaataactgggatcactggggttgaacaaaatacactgatagttgcttcccagcgttatcatcctgttaaacaaattcatggagtactaatcgggacttgaaattagaaggtaacgcctgaggttaggaagaaagatttcaagcaatggaagtttccttatgtggcacttaatctctaaacaaggttattgcataattgtggtatacattgcatattaattcaaattctcttggagaggtttgatgacactagatcaaaggattttcatactggttctttgtgtctttgtattgatcatggctttggagttgggatgtttttctctacagcactttgaaaaacagagaagcacgtgtttaaatgagagtaggaagcattgatggatcaatattgttggnngggctgtttatcatattgcatattcaaatata

SEQ ID NO: 16982 - DNA, 489 bp, Gossypium hirsutum
  Clone ID: uC-gsflnu33B111b10b1
gtaatctggacaggagtctggagaagaatccgaacatgaaactgaacaaaagcgcaagggaactcaaggtgttattgaggtcaacaatccgaatttggtgaagccaaagaacttgaaagctagggatctcgatgctggtaaaactactgaactgtcaaggcgtgaaagggaggaactagaaaagcagagagcccatgaacgatacatgaggctgcaagagcaagggaaaacagaacaagcaagaaaagatttggaacgactagctcttattcgtcaacagagagaagaagctgctaaaaaacgagaagaagaaaaagctgcgagggagcagaagaaggttgaagctcgaaaatgacattccttcatacaaagcttcatatacatcaaatgtttttctttcatagaaggatatttgtggtgttttctccatttaagcaaaatagatagtttaaattcaaagttttttttattaattaatttttcgttaaa

SEQ ID NO: 16983 - DNA, 89 bp, Gossypium hirsutum
  Clone ID: uC-gsflnu33B111b12b1
ttgttccgtatgattgttaaattgtgcccatcatttgcctaagggctttttatgctatcaatgaagtaatatttatagttgtgtttgtc

SEQ ID NO: 16984 - DNA, 542 bp, Gossypium hirsutum
  Clone ID: uC-gsflnu33B111c01b1
ttttcgcgtgggcggacgcgtgggcccacatgtgctactccaacttcaatgatatcatccactcgatcattgacatggatgccgatgtcataaccattgagaactcacgttcagatgagaagctcctgtcagtcttccgtgaaggagtgaagtacggtgctggaattggacccggtgtctatgacatccactctcccagaataccatcaaccgaagagattgctgacagaattaacaagatgcttgccgtgctcgagaccaacatcttgtgggttaaccctgactgtgggctcaagactcgcaagtacgctgaggtgaaaccagccctgagcaacatggttgctgctgccaagctgctccgcacccaactcgccagcgccaagtgataggctcccgagatattggaaatccgaatcccataccattccagagagattaaaaagaaaaatggcaaaaaagtttcttctatcttatcatttgaataactctgttgctgatgaaatatttgttacatgcccttggcgttcctttgattccttatt

SEQ ID NO: 16985 - DNA, 108 bp, Gossypium hirsutum
  Clone ID: uC-gsflnu33B111c02b1
cccacgcgtccgcccacgcgtccgcccacgcgtccgcccacgcgttcgtccacgcgttcgtccacgcgtccgcccacgcgtccgtgaaataataaattattattttct

SEQ ID NO: 16986 - DNA, 549 bp, Gossypium hirsutum
  unsure (1)..(549): unsure at all n locations
  Clone ID: uC-gsflnu33B111c06b1
gtgtttttaggggccaacatgttggtggaagaggacacaagatgcagaagtcagaacccaaatttattcaggtgttattgctcttggtccaacatggagcgaatggtctaaatctgttagaggcacagcatgttattcttgtcgaaccactactaaatcctgcagtagaagcacaagcaatcagcagggtacatcgaatcgggcaggataagaggacactttttcatcgttttatagttaaaaacaccgtcgaagagagcatatataaactcaacagaagcaggaactcaagtggctttgttgggaacaccaagaatcaagaccagcctgttttgacacttaaagatgttgaatccctcttcgccacagcaccatccagagcacagaaaaccgatgaagataaggccgaaagtgaaaatctgagatacctgcctccttccatggctgctgctatagctgctgagaggagactcanggaaaatctaactgcatgacattcatgctggttgacgatacgtataanaaaatccatagtgcaattgtagttag

SEQ ID NO: 16987 - DNA, 532 bp, Gossypium hirsutum
  unsure (1)..(532): unsure at all n locations
  Clone ID: uC-gsflnu33B111c07b1
ttcacgcgtccgattgttagtgaaacaatggcgtcttcagctctgataagtaagcttgaggcagatgtagagattaaggcttctcctaagcagttccatgaaatgtttgcccacaaaccgcaccatgtgcaccatacttgttatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggactttggaatacgagaagctgcacggtgggattgcgcatcctgagactctngctgcattcgttcaagatatctctaaagacattgacgcccacctcacccaagcaggctaaacagtatcacatgttgctattgttgccgcta

SEQ ID NO: 16988 - DNA, 539 bp, Gossypium hirsutum
  unsure (1)..(539): unsure at all n locations
  Clone ID: uC-gsflnu33B111c08b1
caagatagactcgttgtctaaagtgaaccacaagaatttcgtgaaccttattggctattgtgaagaaaatacgcccttcacaagaatgatggtttttgagtatgttcctaatggatcactctttgagcatctacatatacaagaagctgagcacttggactggggaatgcgcctaaggatagccatgggaatagcgtactgccttgagcatatgcatcagcttactccccctatagcccatagaaacttgcagtcttgctctgtgtatctgactgaagactatgctgcaaaaatatctgatttcagcttcttgaataatgctaccgcagccaaggtgggatcggctaccatggagctcttagaatctccatcagcagatgcagagagcaatgtttacagcttcggggtgatattgtttgaaatgataactggtaggatcccgtattcgatagacaatggctcccttgcagactgngcctcagactacttgaaaagggaccaacccttgaaagatacngnggatccaactcttaaatttt

SEQ ID NO: 16989 - DNA, 542 bp, Gossypium hirsutum
  Clone ID: uC-gsflnu33B111c09b1
gttttaaccggatcaataaagtttcagctacctggagtaacaagcaatgctgaagttgatgcaggggaaactagttctgatactagtgaagcacagactgatgaagtaaaggcagagaaacctgatgacacatcaaagaatcgaccctcaaagaaaagcaagaagaaggaaagggagcttgcggaaaatcctcctgccaaagccacagccaaagccaaagccaaagctgagaagaagaggcttcttgctttacctttggaggcatctgtgatttcacttctcttactggttgtgctgggcgccttctatgtggttcattctgtttgggctgcagcagaagcttattcagctccttcaatagttttaaccactcgttcacgtgatggtctacatgtttttgatgattttagagaggcttatgcatggttgagccataatacagatgtcaatgataaagttgcatcatggtgggactatggttaccaaaccactgccatggctaatcgcactgttattggcgacaataatacctggaacaatac

SEQ ID NO: 16990 - DNA, 545 bp, Gossypium hirsutum
  Clone ID: uC-gsflnu33B111c10b1
ctctgttatggttgcagagagagccaaactgaatcaatctctaggcatttgcttctccaattccaatcttctttttcttttcttttttactaataagtcgtgagaaatgccagcaaaaccagggaatgatgatcagcagatagaccgtggggctcaaagtgtgttgcagtcaactgcctactctgaaccctggtggaaaggagttgggactaacccctttggtgaagctgcctcgaagtcgccttctgtagaacaactaaatggttcagtggcaaatggagatgtgcattcacaggctcatggggacttgggcaatgaagatgggagaaacagacaagatcgccaacatctcaaacacgttccttccacaacaccccttactttgggtgaacaccatgaaccaaattcccaaatggaactagttggtcactcgattgtcttgacatcttatccttattcagatcctcagtatggtggaatgctgacttcatatgggccacacatgatggtgtcaccacatctatatggaatgcatcacgctagaa

SEQ ID NO: 16991 - DNA, 537 bp, Gossypium hirsutum
  Clone ID: uC-gsflnu33B111c11b1
tttccctgtgcaaacccatggaaaatgggcgacatgatgggaaaagcaggttcataagagttgaggttgtcacagcatctctcagcttcctaactaatttcgaggacgtctataaattgtgggctttcgtggcaaagttccttaacccgtcattcatcagagagggtacacttccaaccgtggccgaagaagaaccagagacataatgaatcaagcaattcaaaagccagtcgtgaaacaatccaggagtctgactggaagaatcagaaagaccttgaagaggattttgcaggtgcactagtatatgcatgggcttgtctttcctcaagactcttcgatgcaagtggggtgaattggttaattaatgttggtggtggctggaaatgtcccattctcttttggaggttcttgtagagttgttttagaaaaaaaaggtaccattttgggaagcgccatgaccctcaagcagaaactatatggacaactggtaccacttaaaagcatttctgctttggtaacattccatttttttcttgt

SEQ ID NO: 16992 - DNA, 488 bp, Gossypium hirsutum
  Clone ID: uC-gsflnu33B111c12b1
tgctgagttaaagcatatctcggtggacgagttgagggagtgatttatggacagaataggggatgagcggagcacgttagaggatggtgccggctggatagtgcgcgtccgattgaacgaactatagatttgactgttttgaggtcttctgcacaatgatggagctgcagcagtaaacatatgatgatgggagagtatccgttggtgttcagatggtaatgtgatgagagatgcacttgatttgaggacatacagacttgtgagttggacttgcttttcttcaagagcaacaaagatcaaggcgatgataacctcaccgctggttacgcctccgccgacgatgccgttcctcactcctctggaaatcgagagcgcaaaaggggggggccgtgtacggaggacgagctcacgctgcttctggtaggactgcataaagtttggaaaggagatcggagagggatttctagaaacttcgtgaaaactcgaac

SEQ ID NO: 16993 - DNA, 218 bp, Gossypium hirsutum
  Clone ID: uC-gsflnu33B111d01b1
tttttacatgagtctcccaagaaaccaccatatggtcactatccaggacaccctccactggggaagcctcaatagagagatcccatcggctagccatcccaagaactgagctactatggctatatggataaattagtatctatacaataaaagttgcttcctactcatgttctatgttcttgtatgttcttgtatgttatgtaggaatgttttctttt

SEQ ID NO: 16994 - DNA, 537 bp, Gossypium hirsutum
  Clone ID: uC-gsflnu33B111d02b1
ctgaacagcctttaggtgaagcaatatcagatgctcttcgtctagggttaatcaaatccagagacgaactctttatcacttccaagctctggtgtagcgatgcacaccatgattgtgttctcccagcactcaaaaaaaacactcaaaaatttgaagttggaatatcttgatctgtatctgattcactggccagtgagcgtgaagcctggggaatatgagttgcctgttaagaagaaggaccttgttcctattgatctaaaatctgtgtgggaagcaatggaggagtgtcaagctcttggcctaacaaaatctataggagtaagcaatttctcctgcaagaaactcgaaactatcctttccactgccaaaatcccacctgcagtgaaccaagtggagatgaacccaatgtggcagcaaaagaaactgaggaagttttgcgatgagaagggcatacttatcgagtcttactctcctttgggggcaaaaggaacgctgtggggaacatatcgggtgatggaatgtgagctactcaaagaa

SEQ ID NO: 16995 - DNA, 544 bp, Gossypium hirsutum
  Clone ID: uC-gsflnu33B111d03b1
tgtgaaccagctgcttatcgagaaataatgaaaaaggccaaggaatttgagaagcactttaagcaacaatatgtcagacaagcaccagcacagaggaaagagacctcttctctagaaactgctgctgttttttttttcatccttttaactcagtccctgaaaattgagccgttaacgtcaacccgattcaggcggaaccgtttcctcactcaaaatcctcgcacaaactcagcagttaattaaacacttcataaagttgagtcgctttattagcacagttgccgttatagtgataatcaaaggtgttgattctgtaggaagaaggaaaaaagtaatggagaaatctgtttttgttaaagatgtacaacaactcaatggaaatctccaccattctttttcctctgtttctcaaagagatgtaacttacagctgtggttcttgtgggtatgagctaaacctaagttcctctagtagaaacaccgcaacaatcggctctaaatatggaaaattgattaagcgagggatgatatcattcttcaatata

SEQ ID NO: 16996 - DNA, 536 bp, Gossypium hirsutum
  Clone ID: uC-gsflnu33B111d05b1
cttttcagcctttaggtgaagcaatatcagatgctcttcgtctagggttaatcaaatccagagacgaactctttatcacttccaagctctggtgtagcgatgcacaccatgattgtgttctcccagcactcaaaaaaaacactcaaaaatttgaagttggaatatcttgatctgtatctgattcactggccagtgagcgtgaagcctggggaatatgagttgcctgttaagaagaaggaccttgctcctattgatctaaaatctgtgtgggaagcaatggaggagtgtcaagctcttggcctaacaaaatctataggagtaagcaatttctcctgcaagaaactcgaaactatcctttccactgccaaaatcccacctgcagtgaaccaagtggagatgaacccaatgtggcagcaaaagaaactgaggaagttttgcgatgagaagggcatacttatcgagtcttactctcctttgggggcaaaaggaacgctgtggggaacaaatcgggtgatggaatgtgagctactcaaaga

SEQ ID NO: 16997 - DNA, 492 bp, Gossypium hirsutum
  unsure (1)..(492): unsure at all n locations
  Clone ID: uC-gsflnu33B111d06b1
tccacgcgtccggtataatcaatgggtttgctttgccattgaaggaagaacataagctctttcttgtccgtgcactgataccgcttcataaaccaaagtgtatacccatgtaccaccagcagttatcttactgcattactcaattcgtggagaaggactgcaagcttgccgataccgttatacgggggttgctaaagtattggccaatcacaaatagctcgaaagaagtcatgttcttaggtgaactggaggaagttttagaagccacacaacctgccgagtttcaacgctgcatggtaccattgtgccgtcagataggccgttgcttgagtagttcccattttcaggtggcagagagggctttgttcttatggaacaatgatcatattgagagcctaataagacagaaccggaaagttatacttccaattattttcccatccttggagaagaacgcangaaaccactggaaccaggcagtgcagagtttga

SEQ ID NO: 16998 - DNA, 543 bp, Gossypium hirsutum
  unsure (1)..(543): unsure at all n locations
  Clone ID: uC-gsflnu33B111d07b1
ttcacgcgtccgatttacaattaccttctaaagatgcaaaccctttaggattgcctcaagaacttgcttcaacaaatcctaccattcaacaaccagatcgccattgtgaagacatctccaaagattctggcctggaacagcatgaaacaacacctaaaaatttggttaagaattctggccaacgcaagggtggaaaaacttccaaacaagtacagaaaaaaaaatctaagagctttgagaagcagtgacagggttttgcgctcaaaatcagaagagaaatctaaagctaccgagtcgagcaagaaatctactgctactgagtcgagcaagaaatctactgctactgagttgagcaagaaatctactgctactgagtcgagcaagaaatctactgctactgagtcgagcaagaaatctactgctactgagtcgagcaagaaatctactgctactgagtcgagaaagaaatctagtgctactgagtcgagcaagaaatctactgctactgagtcgagcangaaacctactgctactgagtcaagc

SEQ ID NO: 16999 - DNA, 515 bp, Gossypium hirsutum
  Clone ID: uC-gsflnu33B111d10b1
ttcagttcagctaaaattaccccatattcttcccaaaatcctcatccagcttatcagtttgtaggacagagtggtcataacttaggcgacttctctgggaacacatcaagaccaaacccgagatacactcatgatccttggtttgaagcgccacaactaaaagtacaaacaacaggcacctcgccaagaacaagacctatttgagattattgtaaatagaagtaggatagagtatcatcaatgttccactccctattttggtaaatctggcaaattacattttaacttaaaaggattctcggaatggtgaatatatggggaacagtgggacttttgttgcatgggaaaagatgaagctggtagaatgtattttatattgtaacaacatatatattgttgattatttttggttgtatatggaaggtgatgactttcatttgtaacgttgacgatgttgtatactactagttcatcaaagtagtcaaataccattaccagtcaaaaaaaaaaataaa

SEQ ID NO: 17000 - DNA, 442 bp, Gossypium hirsutum
  Clone ID: uC-gsflnu33B111d11b1
ttttcttcatttatcatatttcataatattttgctaatttgtgcagtattctttttgtgactgtttgagtgaaaggcatttgacaatttcaagaaataacatgccggaaaagaggaggtaatttatctaattgctttacacttttaaatcaaaataatctcataattaatgcttatttggtgactgtttgaccctttgttaaacttgcaatcagaaagcatagacaatggacttgaggttggccaccatttgtgcacagaatatgaagtcctgccctgtgaaagtaattgtttctacataaataaaaagtgtcgataggaatagtaataatgcggctgatttgttgtgtaatattgctaatagcaatttgctattaataaaaagtgtaatgtgtgctttaatatggattgcccagtggaaacccatgatgtaatcattcatg

SEQ ID NO: 17001 - DNA, 526 bp, Gossypium hirsutum
  Clone ID: uC-gsflnu33B111d12b1
ctttcgtgtttgtctattgaattctttccttcactttctcgagaaaaaaaaaatgtcttcaggttgcacttgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctctgtcttgagtaataaaagcattgtttgtggtgaaaataatgtataagccattcggctgggagcagattttccttgtgtacaaaggattctagctgctcattcatggtgactgggtttatg

SEQ ID NO: 17002 - DNA, 529 bp, Gossypium hirsutum
  Clone ID: uC-gsflnu33B111e01b1
ctttgggatatccggaaaatgtcctccgatacctcttgcaatttagggtatcggaatttcgaatgggattacagatggatggactaccctccacaggctagagatttgaaacacccaagtgatggatcagtggctacttataaaggtcactcagtgttgcgcactcttattcgctgttatttttcacccgaatacagcacgggccaaaagtacatttacaccggatctcatgattctcgggtttatatttatgatgtggtcaccggagcccaagttgcggtactgaagcaccatacatcaccagtaagagactgtagttggcacccgcattaccctgtgttggtcagctcctcttgggacggggacgtggttaagtgggaattccctggtaacggagaagcgccggtccttgcgaacgagaggagagtcaggaggcagtattacgattggaggcggcgatccgtaagctataatcatactacgtataccgtatttgataactgtatctacatgtttttttaagtagcag

SEQ ID NO: 17003 - DNA, 522 bp, Gossypium hirsutum
  Clone ID: uC-gsflnu33B111e02b1
atctttcgtgtttgtctattgaattctttccctcactttcttgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtttaagccatttggttgggagcatattgcccttttctccaaaggatctttgctgctcattcatggggacctggcttatggttt

SEQ ID NO: 17004 - DNA, 483 bp, Gossypium hirsutum
  Clone ID: uC-gsflnu33B111e03b1
gtatctattagcctccccccttttgctgtccagttaacccccagaatgctcccttcgtcatttatgcgccaccatgaacggcgatctgcgcattcgaactccaaaggagtgatttttcagccttgagaccccatttggacttcgatttcaacgaagcgaaggggaaacgatggctaacttacaaggtacggggcgtgtgctggcactaggcgtgagggtggcgtacggtgctgtcgacgtacaggcacgagcggcgttggggttgagacgttggcatcgtatggaggcattgtccggttgcggcgcatgcattaggctagagttttttgcttgctttaaattttgggccacttaggcctattgcatttgggctcgggcttatttgtaaatgggttgatttgggcttgtatagggtattagtttgggtcaaaaccggtcaatggactgttataggatttaagttttatttgggttttatattta

SEQ ID NO: 17005 - DNA, 546 bp, Gossypium hirsutum
  unsure (1)..(546): unsure at all n locations
  Clone ID: uC-gsflnu33B111e08b1
ttcacgcgtccgcccacgcgtccgggatcttcagcttgactatgttgatttataccttatccattggcccgttcggatgaagaaaggatcagctggctttaagcctgaaaactttattcagccggacataccttgcacgtggcgagcaatggaagcactctatgactctggtaaagctcgggctcttggtgttagtaatttctcttcaaacaaattgggggatctgcttgctgtggcacgtgttcctcctgctgtcaaccaggttgagtgtcatccttcatggcagcaggctaagctacgtgaattttgcaaatccaagggagttcacttatcgggttattctcccctgggttctccgggcacaacatggctcaagagtgatgttcttaagcacccaattctaaatatggttgcacagaaattaggcaaaactcctgcacaagttgcactgcgctggggcctgcaaatgggtcatagtgtgcttccaaagagcacacatgatgagaggatcanggagaactttaatgtctttgattggtctattcc

SEQ ID NO: 17006 - DNA, 424 bp, Gossypium hirsutum
  Clone ID: uC-gsflnu33B111e09b1
tttcacgcgtccgcattactctcctctctgagaacaatcctctcactggtagcaagggtgagatcaggaagcaatgcaatcttgcaaacaagcttcactaaaatgcctcgccaaagagaaagccgagtgtggccgaataaaatgtttgtttactcagtttcttttccaagagacgagtttgttaatgtgcaggtgagtaatggtgcaatggtactggtttgtaacgatcgatccattgcatttttcttttagcataagccaggttgccttctcttgatgttggtcatgggcttggtggatgtagggatggatgtaatatatgtatgtaagggatggtgttgactgtgtatgatgcatgaatttcaatgatttaaaagctatgatgattcatgcaaaataatgaatccataattgttgtatctct

SEQ ID NO: 17007 - DNA, 449 bp, Gossypium hirsutum
  Clone ID: uC-gsflnu33B111e10b1
ttcgtcgttgctctattatgtttaaccatggctgaaagttggatttgctactttgttttataatcagtgatcaaagatacttattaaaaaaaaaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaaaaaaaaaaaaaaaaaaaaaaaaaaaaaaaaaaaaaaaaaaaaaaagggggggcccttttaagaaaaaaaaattttaatcccgggggaagaaaaaaaaaaattttttaaaaggggaaaaaaaaaaaaaaaaaagggccggttttaaaaaaaagggaaggggaaaaaaaccgggggtaaaaaaaaaaaaaagtgttgaaaaaaaacccctttttcaaaggggggataaaaaaaaaaaagcccacaaaaaatgcttttaaaaa

SEQ ID NO: 17008 - DNA, 530 bp, Gossypium hirsutum
  Clone ID: uC-gsflnu33B111e11b1
gttccttcgaaatttgagtttatgactaggcgtaaaggtcatcataaggttattgaatccattaatgcggccattgatgttggatacaaccctgtaaaagttaactgtgttgttatgcgtggattcaatgatgatgaaatttgtgattttgtcaatctcactgttgataaaccaattaatgttcgattcattgagttcatgccttttgatgggaatgtatggaatgtgaagaaactcattccgtattcggagatgttggatacagtggtaaggcaaagaaatttccgaccttaaagaggttgtgtgatcatccgacagagactgcaaagaatttccagattgatggccatgtgggtactgtatctttcgttacttcgatgacaaaacatttttgtgctggttgtaatagattgagacttttggctgatggcaacttaaaagtatgtctctttggtccttctgaggttagcttaagagatcctcttcgttccggtgctggtgacgaggaacttagagaaataattggaaca

SEQ ID NO: 17009 - DNA, 519 bp, Gossypium hirsutum
  unsure (1)..(519): unsure at all n locations
  Clone ID: uC-gsflnu33B111f02b1
cggtacgcgtgggcggacgcgtgggcggacgcgtgggcggacgcgtgggtttgtcagcgtttcacactttctaaaactccaatatcccaaaacaatgggttcaaccggtgaaacccaaatgactcccacccaagtctcggatgaggaagccaacttattcgccatgcaactcaccagtgcctcagtccttcccatggtcctcaagtcggccatagaacttgacctgctggagatcatggccaaagctggcccaggtgctttcctctccccaaaagaattggcttcccagctccccaccagcaaccccgatgcacctgtcatgctagaccgcatcttgcgcctcctggctacctactccatcctcacttgctccttgcgcactcttcctgatggcaaagtggagagactctatggtcttggccctgtctgcaaattcttgaccaagaatgaagatggcgtcactctttccgccctcagtctcatgaatcaagacanggtccttatggagagctggtacta

SEQ ID NO: 17010 - DNA, 357 bp, Gossypium hirsutum
  Clone ID: uC-gsflnu33B111f03b1
cccacgcgtccgcccacgcgtccgcccacgcgtccgcccacgcgtccgtgcatggacacttcagtctgtttgtagggctataatagctttgatggctcatccggaacctgatagcccacttaactgtgattcaggcaatcttttaaggtctggtgatctcagaggataccagtctatggcaagaatgtacaccagacttgctgccatgcccagaaaagggtgaacatttatggtgctatgaaccgccttaaaactgtaagagtcaattatcgtcagcaatttacttttgccttttaaacttcattgtagaaattcaagaatatctcttacttttctgatccaaaaatatcagttccc

SEQ ID NO: 17011 - DNA, 188 bp, Gossypium hirsutum
  Clone ID: uC-gsflnu33B111f07b1
tttcacgcgtccggttgaatttagccattttcaaagctttcttattttacactatttacatttggatgacaccaggcaatagggatatatttataggttcctttgaattatgatgtggttgatgtacgccatggctaaacttgggctacaccccttgatatgataatataagaattgttttggatggt

SEQ ID NO: 17012 - DNA, 539 bp, Gossypium hirsutum
  Clone ID: uC-gsflnu33B111f08b1
ttaaagagttaagccagagactgaacggcccctcttctcacaccctgtctccgaccttgcgatagccgagcgatcaccaccaacccccctcccagaatgttgcgtcgagcatcgatgctattggcctgtcgatccattttggcagcaagggctcgacccttctccactgatctgccagcggcaccctctgcggatgccacattcacggaggcgtggactaaagtgatccccaacatggaccctcctaaaactcctctctctttcatgcaacctcgtcctcccactccttcctccattccttccaagcttactgtcaatttcgtccttccttatgcttctgagttggccaccaaagaggttgacatggttatagtaccagccacaactgggcagatgggtgttcttccaggacatgtagcaacaattgcagaactgaaacctggagtgttatcagtgcacgaaggaagtgaaatgacaaagtatttcgtcagtagcggctttgtttttatccctgccaactctttgcagatataatagct

SEQ ID NO: 17013 - DNA, 539 bp, Gossypium hirsutum
  unsure (1)..(539): unsure at all n locations
  Clone ID: uC-gsflnu33B111f10b1
ttgcataaagtctaccgagaaatgcgcaaaccatgaaaagcaaatagaagctagctttgttgaagcctctatgcctcctagaattccttctgctagtcttcaaaaggggatccttaaaagaaacccacgtggatgcagaggtatttgtacttgtctgaactgttcttcatttcggcttcatgcagagaggtcatttgaattctcaagaaatcagatgcaagatgctgaagaagtgggtttagatttgattaaagagttatcttacctacggaatatgttggaaaaatctgctttcgttgccaaagatcagaccaacatttgcatcgatcaggtcaaggaagcttggaagaaagcctctgatgctgaagaacttgccaaaacccgactcagtgaaatgaactatcatctaaacattcactgcagaatcccatgtgagcagcgaccaagcgtgagatttgccgattatgttgaagaacacgtcatccatccaatagcagactcatcgaacaaatagtttcaacataagagtntgtctttct

SEQ ID NO: 17014 - DNA, 146 bp, Gossypium hirsutum
  Clone ID: uC-gsflnu33B111g01b1
acccacgtccgccctctcgtcgctgcggagaaatacacaaaaaacccatcgaaaacgaagttcaagctcggtggtctggttctcgaaggaagcgtggttcaacccagttcttctaaagaaatggagttcgtcatttccgatttgat

SEQ ID NO: 17015 - DNA, 527 bp, Gossypium hirsutum
  Clone ID: uC-gsflnu33B111g02b1
cccacacgtccgacggcattccaattcactttcgagaaccacttgagggatgacgtggcttctatggctcgtcaatatgtacgtggtgttggggcatctgcacatagggttgccatggctattgctccatcccgtattagccctggcttgggaccaaaaagcctccctggttctcctgaggctcttactttggcgcgttggatttgccgaagctacaggattcataccggtggagaactcctacgagctgattcacaatccggtgatactttgctggagcaactgtggaaccattcagatgcgataatgtgttgttcattgaaaacaaatgcgtctccagttttcacctttgcaaaccaggctgggcttgatatgctagaaactacattggtagcccttcaagacataatgctggacaagattctcgatgaagccggccgaaagagcctatgcaccgagttctcaaagatcatgcaacaggggtttgcacatctaccagcagggatatgcgtatcgagtatgggaag

SEQ ID NO: 17016 - DNA, 490 bp, Gossypium hirsutum
  unsure (1)..(490): unsure at all n locations
  Clone ID: uC-gsflnu33B111g03b1
cccatgcgtccgatgatgcaacaacttttatctaaggagattcttcatgaacctatgaaggaaattggagaaagatacccacaatggctagaagagcacaaagctaatttgagtaaagaagaatatgaacgttactcccgccaatatgagctgataaaggagcttaatggagtttatgaaaatgatcctaataactttaccaagattgttgacctgatgcaaaaaatgcaagagtgcggtcagccaccaaatgatattgtgcaagagcttgctcctgaatttgatttatccaatcttggccagctatccccagagattctcaattcacagcagaactgttgtataatgtgaggcaatatcctgttgcagactatgtttctttctatttaatagatattctttctaagtttttgggaaataaagtatctttccttcaactttntaagttaattgatccttcaagaaatgacatgctcaatatttttatcct

SEQ ID NO: 17017 - DNA, 400 bp, Gossypium hirsutum
  Clone ID: uC-gsflnu33B111g04b1
cttttctcggatattaaaatctcttcccccattgccctttccgctctccaaaactcttacccgtcttctgccggatctttccgacccgaacttattgaacccgtttttaaacccatgttgaatttcctccgccaaaccgggtctttccttatggtcaatgcttatcctttctttgcttatgagtcaaacacggacgtcatctccttggactacgctttgtttagagagaatccgggtgtggtggatgcgggtaacgggttgaggtattttagtcttttcgacgctcaaatcgatgccgttttcgcggcaatgtctgctttgaaatatgatgatattcgattggttgtgacggaaacgggttggccctcaaagggggatgagaatgagatcggtgcttgtg

SEQ ID NO: 17018 - DNA, 516 bp, Gossypium hirsutum
  Clone ID: uC-gsflnu33B111g05b1
ctttttcgtccgattgcattccaattcactttcgagaaccacttgagggatgacgtggcttctatggctcgtcaatatgtacgtagtgttgtgggatctgttcaaagggttgccatggctattgctccatcccgtattagccctggcttgggaccaaaaagcctccctggttctcctgaggctcttactttggcgcgttggatttgccgaagctacaggattcataccggtggagaactcctacgagctgattcacaatccggtgatactttgctggagcaactgtggaaccattcagatgcgataatgtgttgttcattgaaaacaaatgcgtctccagttttcacctttgcaaaccaggctgggcttgatatgctagaaactacattggtagcccttcaagacataatgctggacacgattcttgatgaagccggccgaaagagcctatgcaccgagttctcaagatcatgcacaggggtttgcacatctaccagcagggatatgcgtatcgag

SEQ ID NO: 17019 - DNA, 533 bp, Gossypium hirsutum
  Clone ID: uC-gsflnu33B111g06b1
gttgtccgatttagcaacaaagatgtcaccgcacaaatagtttctgctaatattgctggtgatatggttcttgcttctgcttactcacatgagcttccacgatatgggcttgaagtgggtcttacaaactatgctgcagcttattgcactggtttgctgttggggcgccgtgtgcttaagatgctcgaaatggatgatgagtatcagggcaatgtagaggctactggagaggatttctcagttgagccaactgagacaaggagacctttccgtgctctccttgatgtagggctgatcaggacaaccactggcaatcgtgtttttggtgctctaaagggagccttggatgctggtttggatattcctcatagcgacaagaggtttgctgggttctccaaggacaacaagcagcttgatgctgagtttcatagcaagtacatatatggtggccatgttgctgcatatatgaggactttgatggaagatgaacctgagaagtatcagtctcacttcagcgagtatattaagagggg

SEQ ID NO: 17020 - DNA, 381 bp, Gossypium hirsutum
  Clone ID: uC-gsflnu33B111g08b1
cctcacgcgtccgggcaactgtgactgcgctgaccgcagccaatgcacgaagggaaacagcaacaccatgatcattgagactgagaagagctacatcaacactgctgtgatggatgctccagctgagaacgatggcaagtgcaagtgcggtactggctgcagctgcacagactgcacctgtggccactaagccaacatacaatggtcatgcttcaggtcatggcatatatagggatctaaataatgaatttaaggttgaataatttgtctgttgtagtttgtgtggtgacttatatctgtcagttaacctttgtatcctttactatgatgtaatggctatgcttatggccttatctggttaatgaagtatccttactatat

SEQ ID NO: 17021 - DNA, 583 bp, Gossypium hirsutum
  Clone ID: uC-gsflnu33B111g09b1
gtagcgctgcacccctggggcccctccccaattctcgcgtcgcgacaccacgcgccctttttaagagtcttaaggaaaatgcagatcttggtgaaaaccctaactgggaagaccataaccctagaggttgaatccagcgacactatcgacaatgttaaggctaagatccaggacaaggaaggtatcccgccggaccagcagaggttgatcttcgccggaaagcagtttgaggatggtcgtacacttgccgactacaatatccagaaagaatcaacattgcatctggttctgaggcttcgtggtggcattatcgagccatctttgatggcattggctaggaaatacaaccaggacaagatgatctgccgcaagtgctatgctcgtctacacccacgtgccgtgaactgcaggaaaaagaagtgtgggcatagcaatcagctgaggccaaagaagaagatcaagtagattggatatcttgatggaagtttaaagtcattcaatttcagatgttctgtttggaatttgaatggtgtagtgcttattacagatcttaattaacctttaaggtgcctttgatttcttt

SEQ ID NO: 17022 - DNA, 530 bp, Gossypium hirsutum
  Clone ID: uC-gsflnu33B111h01b1
attatctgatgctggctctgatctgtctatattcgtaggagatttggctgccgatgtaactgatacggtgttgcatgaaaccttttctagtaaatttcaatcggtcaaaggagcaaaagttgttatcgattcgaataccggtcgttcgaaaggttatggtttcgttcgattcggtgatgaaaatgaaaggtcgagggccatgactgaaatgaatggagtgtattgctcgagtagaccaatgaggattagtgttgccactcccaagaaagcatttggatatcagcaacagtattactcacaaggtagacaagcatcgaatggtgctgtggaacaaggtcttcattctcataatgactcgaacaatgctactatttttgttggaggacttgactcggatgttagtgatgatgatcttagacaacccttttccagtttggtgagatcatctctgtgaaaataccgtctggaaaaggatgtgggtttgtgctatttgcaacaggaaggacgctgaggagcaatccagagcttga

SEQ ID NO: 17023 - DNA, 256 bp, Gossypium hirsutum
  Clone ID: uC-gsflnu33B111h05b1
ctcctctcgtccggaatttgtaaattccatagttggttgtttaaaaaaaaaaaaaaagaaaaatcaaaaaaaaaaaaaaggggctactaagctttgtggtatctcagtgctccctgggtccgctgctggggggtcccgccttgtcgtgccgtctcgttccgtctgccttgcgcgtcctacttggccacggtgtgcggcgtcccgtccctcgtttgctgcgcgggtgcctccgctttggccttgcgctcctcgtcgc

SEQ ID NO: 17024 - DNA, 531 bp, Gossypium hirsutum
  Clone ID: uC-gsflnu33B111h06b1
ttttatggcatcggcaccagcgctgaatgtgatcgccaatatgcagcagcagaaccatagggtggttttcgatgtgccaaattcgaggatgggggtcgcccgtgagcgatgttcgtaaaaagtgtggggtctttttcttctaacttttgggaaacagtgttggtgttgattaaaagcagaatatatctgattaataatgaaagtaaaatttttgtagttatatattactttgtactggaggctggtcctagtcacgggctttcccttacttttattatgtcttgtttttaggttttaatatccaaattttcgaattctgtttctattattaaaaaaaaaaaaaaaaaaaaaaataaaagtaaaaaattaataaaataaacataataaaaaagtagaataaaaactataaaaactatatacttaattgcaagtatggtcatataactattaaaaaactccattgattaacggggggggctcttttagggatccaatttattccccgggtggggataaatttttttttttggg

SEQ ID NO: 17025 - DNA, 543 bp, Gossypium hirsutum
  Clone ID: uC-gsflnu33B111h11b1
ttcacgcgtccgcccacgcgtccgcttttttacagtagaacaatgatgggttcgagaatcaaaatctcagctctgggtgttactatgcttctgctgttgattgccccaacttccaacgctgccatttcgtgcagtgttgtgataaaggacctgaggccttgcgtgaactatcttacgaaggggagcggaaaaccaccgtccgcttgttgtgcgggagcctccgctctggcatccgccacctcgtcgtctgccgacaataaggctgcttgtgaatgcatcaaatcagcgtctaagaatattaaacccaataaccagttagctcaggctcttccttctaattgtggaatcactttgcccgtcaccatttcaccaaatgtcgattgttccaaggttggttgagagcttggaagctgaaactgggagtgcttggatgggcatgaagtaattaaaaaactccattgtagaagctcaattgttttgcttatcaataaactggaatcctcctgtcttgggttttggattccttgggctgataaaagttta

SEQ ID NO: 17026 - DNA, 174 bp, Gossypium hirsutum
  Clone ID: uC-gsflnu33B112a05b1
agcggtgtcataccgatcgtggtggaatgtggggcggaatgttaatgggtaacgaacgaaagccgtaaaaacaggctactgtatatagttgatctttacggtatgtgaaagaattttatgttaaatgaaggaagattgaaaccaaaggacaaaacgtttcagggtcgtggggtt

SEQ ID NO: 17027 - DNA, 391 bp, Gossypium hirsutum
  Clone ID: uC-gsflnu33B112a06b1
gttatgcatccggagaatttgactgagagaatcatatcggatttaaactcttttgctacaatatgcacttgaagtgatggataccggatcaaaggtaatgaacggagccggaggaaggagaggcggcggtcaaaagaagaaaccggaatttcgttgactgaaagccgaattacagtttcccgtcggtcgaattggccggtacttgaagaaagggcgatactctcaacgagtgggaacggttgctcgagattgccacgctgctggtcttgaatacctaactgctgaggctgttgagttagctggcaatgctgcacgagacaactgcgaagaatatgatcattccatggtatgttatattggctgtgtggaacgatgaataactcgggaagct

SEQ ID NO: 17028 - DNA, 470 bp, Gossypium hirsutum
  Clone ID: uC-gsflnu33B112a07b1
atctgaatacctacgatggacgcacaatacgctacccagaccctttgatcaaagccaacgacaccatcaagcttgacttagagagcaacaaaattgttgatttcattaagtttgatgttgggaatgttgtcatggtcactggtggaaggaacaggggacgtgttggagtgattaagaacagggagaagcacaagggtagcttcgagacaatccatgtacaagatgctgctggacacgagtttgcaactcgtctaggcaatgtcttcacaatcggtaaaggaacaaagccatgggtttcgcttcccaagggcaagggtatcaagttgtcgatcattgaggaagcgaggaagaggcttgctgctcaggctgctgcttaaacctatcatatctggagttttttttttgtcaaagacttgttggatgaatgctggctggtcctgtcctagcttttgtagggattatggatttgc

SEQ ID NO: 17029 - DNA, 296 bp, Gossypium hirsutum
  Clone ID: uC-gsflnu33B112a08b1
gctgtatttcacggctgttgagagtgccattgggcatgtttttaccttttgccccgttgctttcccctcaaatatatatatttctgcttgaactgtgctttgctagtgcttctgctctatagtgagcatagatgaaagggatttccaagtatttaatgatgttctatgttttgatttagttaaagctttgcccaaagtagttttagcgacattgcatattgcataagcggaaatggaagtcatgactgttttgaatgttcttaaatgatttgatgcaagttttaacaccttaatta

SEQ ID NO: 17030 - DNA, 471 bp, Gossypium hirsutum
  Clone ID: uC-gsflnu33B112a09b1
gcgccgattagggattccattcccgtttcttattttctattccagtttctgccctcatcaacttcatcttctcagacatttccctttcatattgcaagcctgacaagtcgttacatcactcttttagcagctcgcactcttcccctgtttattttacaggttcaaattaaaccttctggacaaactgattcatgcatggttacaagaagtaatttaaagaacctatattggatagtgactcaacaagtagcacaccacacaatcaatggttgcaacctgaggccaggcgatctccttagaactgggaccattagatgggaatttgaatcatgtggatgtttgctggaactaacatggaatggacaaaaacaatttccattaaatgggacaactcagaaaattcttagaagatggagatgaagtaatcttctctagttgctgcagggagatggttacattgtggttttggac

SEQ ID NO: 17031 - DNA, 398 bp, Gossypium hirsutum
  Clone ID: uC-gsflnu33B112a10b1
tcgtttacgcgtacggtttccctttgctcccttcttccagaagccaaaagtttgagttaagaacaatggcttttgctgcaatgaagccgacaaaacctggtttggaggagtcccaggagcagattcacaagatcaggatcactctctcctccaagaatgtgaaaaaccttgagaaagtttgtgctgatttggttcgtggtgccaaggataagagactgagggttaaggggccagtgagaatgcccaccaaggttcttcacatcacaacatggaagtctccctgtggtgaaggaacaaacacatgggatagatttgagctccgtgttcacaagcgagttattgatctttacagctaccctgatgtggtcaagcagatcacatctatcaccattgaacct

SEQ ID NO: 17032 - DNA, 469 bp, Gossypium hirsutum
  Clone ID: uC-gsflnu33B112a11b1
aggcactccaagagcttgttcggattgaggctgccgttgtcagccccgatgagaaaaccaagtgccatacatcaggtaatattgagcttaaggaagagaagattattgttaatgaggagttcgaaccaaggccaaacgtttcagcttatggtgatgacgctaatctaaaaggagataaatcatcatcttttgctgaagattttgaaccgagacctaacgtttcggcttacgggggcgatgatgctggtcttaaaggacagaaagaatcattcactaaagatttcgatccagagccaaatgtctcccgttacaataactaattaaaagcgagactcaagtaccagtggcttagacccacatcttccaataatttcgtcatcagattgtgtgttgtactcttgcgtgtgaagctttatgttttatatttgtgaaaaaaaataaggtggttggtatgaatatatatgattat

SEQ ID NO: 17033 - DNA, 479 bp, Gossypium hirsutum
  Clone ID: uC-gsflnu33B112b01b1
agcattatgaaatctcccgaactgatagagttgggtttgggcttggaggcctcgaacaagccattcatttggatcttaagaggaaataatgacgcatcgaaccaggtgacgaagtggattgaggaggatggatttgaggaaagaataaaaggaagaggatttgtcgttgtgggatgggctccccaagtgctcattttatcacatcctgcaataggagggttcctaactcactgtggatggaattcaacaatcgaaggcatttctgctggcgttccattattaacattgccactttttgcagaccagtttaccaatgagagacttgtagtacaaatactaaaaaccggagtgagcgttggggccgatgaacctacggcctggggagaggaaaagtctgggttcaagttgacgaaagaacatgttaaaaacgcaatagaccaattgatgaatgaaggaaataaaggaatagacagaagaaa

SEQ ID NO: 17034 - DNA, 305 bp, Gossypium hirsutum
  Clone ID: uC-gsflnu33B112b02b1
gccatttttagcgaaagcatgcatcatttatatgtttaatcaaagcgaaggacaagcagtggaaatcaaagtcatgcgaatgattaggcctttgttatagtgaatctttgtatctcattagaatcacaaaaattgttctttgtagatatagagggttaagcatcataggattcatttcatgctcggttgcatgtatcagaggtattttttgttttaatgcactattcttcacactatttatttacgtatttttggttggataaatgttgaatataaataaatcaaatagaccacttattattctc

SEQ ID NO: 17035 - DNA, 477 bp, Gossypium hirsutum
  Clone ID: uC-gsflnu33B112b03b1
acgtatcatattctcgaaaaaggggatgaaggggaaatccgttagcgggatgaactactacgcatgtctatctttgttgtctctcttaattcttacacctttcgccgttgccgtagagggaccacagatgtgggctgcaggatggcaaaaggccttatcggaaataggaccacagtttatctggtgggtagcagcgcaaagtatcttctatcatctctacaatcaagtctcgtacatgtcccttgatgagatctctcccttgacatttagcgtcgggaacaccatgaaacgtatatctgttatagtctcctcaatcatcatcttccaacgccggtccagcccatcaatgctctcggagctgcaatcgccatcctgggaaccttgttgtattcccaggctaaagcgtgaggaaaatcggggttttgagaagttagattcgtcatgtaccatagatgatgaaaaaaagagcaaatatca

SEQ ID NO: 17036 - DNA, 456 bp, Gossypium hirsutum
  Clone ID: uC-gsflnu33B112b04b1
gcgtccacgcgtgcgctggacttaagccgggactccatggcttccatgttcatgcccttggggacacaactaacgggtgcatgtcaactggaccccattttaattctgctggcaaagagcatggtgctctagaagatgagaaccgccatgctggtgatctagggaatgtcactgttggtgatgatggctgtgcaagcttgttcatcaccgacaaacatattcctgtcacaggcccaaactccattatcggaagagctgtagttgtccatgcaaatcccgatgaccttggcaagggcgggcatgagctcagcaaaagcacaggaaatgctggcggcagagtagcttgcggtattattggtctgcaaggctaaaatctgagccaagatgcggttgaaggatgcaatgggctttgagaactctttatgtgaagtagaaagaacttggttataataataa

SEQ ID NO: 17037 - DNA, 395 bp, Gossypium hirsutum
  Clone ID: uC-gsflnu33B112b05b1
cttacgcgtccgcccacgcgtccggtcgaatatctgcttgaacagctattttgtgcgaagaatatacatttaagggagggggaaacttttaagggagtagtagaaaatcatttggttattgaagagtccttacatgagcacattgatgggctctatcaaatctgtggagatctcactgtaaatggggccaacagtagctactttctaaaaattgtggaattgtatggatccacgcttgggatgtagccaagcacaagaaaaaaggaacgaggggaagaatcgactgggaatccatgacacatgaaagattgcttttgcggtagcagcacctctgctgaaaagggctgtcgattgcagagagcaagtttacgagcacgtgcatgcgacgtggtagc

SEQ ID NO: 17038 - DNA, 481 bp, Gossypium hirsutum
  unsure (1)..(481): unsure at all n locations
  Clone ID: uC-gsflnu33B112b07b1
gataatgaagggtctgcaggcacttatattggcaatggtaatggttatggcgatcgctacaactgatgctcaaagcatttgcaacatgccagcttcaggtttgatggcatgcaaaccagcagtgaccccccctaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttttcctttatttctttatatgagntgagtttcgattggtatcttatagtcgtgtgatttctcaccaataatcatatattagtat

SEQ ID NO: 17039 - DNA, 477 bp, Gossypium hirsutum
  Clone ID: uC-gsflnu33B112b09b1
gtgtttttgaagacaatccacagctgagcttcatttatcttcctctcctctaatcaaacggcaagattataatagcaaccaactttggcgcaatggtgattgcttctagattgccagcaaattgttcaggtttgctttatcctagttatcataagctatctgttcagcttaacaggtaccaaagaactagatttgattgttataatcctaatcaacaattttatggaaaggggcttaagatctttgtttgtgtttctggttgagcaacctagtcaactgaaatacatagaatggccgagctttgaagcacgctgaagactgctattttaactcttgttcttgtagccgggctcattgttgcactgtcatcagttgactccatcctctgctatattttagctttgttgcttaggaaaactccatcataattgaactacaccctgaaaagaacaccttagatgtatatatatatgcata

SEQ ID NO: 17040 - DNA, 476 bp, Gossypium hirsutum
  Clone ID: uC-gsflnu33B112b10b1
cccacgcgtccgatttttcggatttttgcttaaggtggaagctccctctgcctatgtctgtgctgatagcaagatatacgatgctactgaatggtatatttgtcagggaatgagatgtccacctaacacacataagccaagttttcatgtgaacactagtgtgacatccaagcatgctactggcaagggatcaagttcaggacagagaggtggcacaatgccaactcctcctaatctggaagaaacgatgaccgaagaagaattcttagcgtggttacagaatgcagtacaaggaggcatgtttgacaactttaacggtagcagcacctctgctgaaaatccatctacgaaagcagaaagcagctcgaagagcagcagcagcggtagtggaagcaagagaaagaaaaagggtaagaaacaatggtaagctgcagtcatcatgatttgtgtaggcccggattgtcgagagagaaagc

SEQ ID NO: 17041 - DNA, 450 bp, Gossypium hirsutum
  Clone ID: uC-gsflnu33B112b12b1
ttggttcctggagctgcagctactgaaattgagttggctagaagattgaaagagttctccttcaaggaaacaggattggatcagtatgccattgccaagtttgctgaaagttttgaaatggtaccaagaaccctagcagagaatgctggtctcaatccaatggatatcatatctaagctgtatgaaaaacatgcatacggaaataccaaagtgggtattgacttggggggaggtgactctgaggatggtgtttgcaaagatgtgtcaatcctgaatatttgggatctttatgtcaccaagtttttcgctctcaaatatgctgctgatgctgcctgcactgttctacgggttgatcagattataatggcaaaaccagctggaggttctggaaggagagagcagcctgcagggatggatgaggactaagtcttctgatctgcaacagtatat

SEQ ID NO: 17042 - DNA, 484 bp, Gossypium hirsutum
  Clone ID: uC-gsflnu33B112c01b1
cttttatctacccccaaatatcctcacattatgtctctggtggccaacgaagattttcagcacattttacgtgtgctgaacaccaacgttgatgggaagcagaagattatgtttgcattgacctccatcaagggtatcggaaggcgattcgctaacatcgtttgcaagaaggctgatgtcgacatgaacaagagggctggtgaattgactgcacaggagttggacaatctcatgaccattgttgcaaaccccaggcagtttaaaatccctgactggtttttaaataggcagaaggattacaaggacgggaagtattcccaagtcgtgtctaatgctcttgacatgaagttgagggatgatttggagcgtttgaagaagatcaggaaccaccgtggtctgaggcactactggggccttcgtgtccgtggtcagcacaccaagactactggtcgcagagggaagactgtcggtgtgtctaagaagc

SEQ ID NO: 17043 - DNA, 405 bp, Gossypium hirsutum
  Clone ID: uC-gsflnu33B112c02b1
cataagttgatgctgtgatggctttatccaatctctcaacgtacaccgataatctcactgtcattattgaaaccgatcccgtcccttccgtggtcactttactgaaatcttcaaagagatcatcaaaaacggctgaaaaatgttgttccgtcatagaatccatggtggggttcgatgaaggaagaacagctttagcagctgaagatggtgggatactagcagttggtgaagtgctcgaaaacggcactcgtcaagctagggaacatgctgttggggctttattgacgatatgcgagagtgaccgatgtaaatatagggaactgattcttaaagaaggtgtaatccctggattacttgaacttaaaggacaaggaacaccgaaatcttagacgaaagctcaaacac

SEQ ID NO: 17044 - DNA, 431 bp, Gossypium hirsutum
  Clone ID: uC-gsflnu33B112c03b1
atttttataaaaaaaaaaagaaaaaaaaaaaaaaagagaaaaaataaaaaaaaaagagaaacttgattagaataaaaagaagggaatgtctcgctgaacatagcgaaaggcgtgcattttgtccctatacggggggggccctttttgggggtcccattttttggtcccggggtttgcaaagtatgtttttttttttggggcccccaaatttaattgtttggggggtgttttcacacgggtggggggggaaaaccctggggttcccccacttaaatgcttttgggggcctcccctttttccccggtgggggtaaaacagaagggcccggcccggattgtttttccaaacatggggcccccttagtggggagggggaccccccctttaggggccctttagggcgggggtgggggggggtttccccccgggggg

SEQ ID NO: 17045 - DNA, 209 bp, Gossypium hirsutum
  Clone ID: uC-gsflnu33B112c04b1
cccactcgtccgctccaatgtgtgccttctagaaatggtttctcttagtatttcttggaacttgatttgaattcttgatgagtcttgatctcagctcaatattgcttaatggatccattctgtctctctcctcatcaaacaagccaaggctagttatcaaccctctacttcaactcccacagctaacacacagagctcggggggaccca

SEQ ID NO: 17046 - DNA, 482 bp, Gossypium hirsutum
  Clone ID: uC-gsflnu33B112c05b1
ctttttcaagaagtcatctgctttagctatcacttgccgtttcacttccttcccttcaaaccctttcaatccgggtttcttggccatcttcctcctgcatccagagtttctctcgtctcttccaccaggtaacttccctccccttttcttagtgcctcctttgccaggtcatgcgctctaacattctctgctctttgtatgtatcgaaaagcaattctttgaaatcgggttttattgatctgaatatcgactatcatcgcacctagaaccgattcatctctgactcccattttgcactttttgattattgcttctgagtcccccattaccgtgactgagctcacacccatactgatgcctaagttggttgcttctcaacatgctaatgcttctgctacatatggagaggcaacgtttgagtgaatagtagacttggaggctgcagatttcccattctgacccctgactaccattcctgatgc

SEQ ID NO: 17047 - DNA, 85 bp, Gossypium hirsutum
  Clone ID: uC-gsflnu33B112c06b1
gtcacatttgaggtgaacagtgtttgaataatcaaagctatttgagtgtttgacatatatatgttttctttgcttttacaatgcc

SEQ ID NO: 17048 - DNA, 430 bp, Gossypium hirsutum
  Clone ID: uC-gsflnu33B112c07b1
ataatgtgttcgattttggtaaattcagagatgcatttgacaaggcagcattgagtgtacctgaggtctatcaatggccatgaactatatatgagtatgcttgaaatttataaggattcaacgacagctctaatccttgaagggaaatgatgctgagttgtctgtaaatatttgcactcctgcactggaagatatgtttttagaagacgcaaacattatagtgcatagattttaatgaatggctaccatctattgtaatataaaatggtctccgattatattttggcgaccaacaactcttgcaccaaaactataaccaaaaccaataccaaagatatgaacgcccgcatcataatcgtggtttccagctccactgattttctatgtataacatctgatgaattgtctacccaaatcaaacgactgagag

SEQ ID NO: 17049 - DNA, 365 bp, Gossypium hirsutum
  Clone ID: uC-gsflnu33B112c08b1
attacgcgtacggttataactgatgatgaaaccaagactaagctttgcaaggttctatctgtccaatttggccagaagggcattacatacgtgagcacataccacgggcatactatgcgctaccaagacccgtagaacaaggcacatgacaccattaacctgaaccttgggagcaacaagaatgacggttaaatgaggaaagacgttgcgaatgttgatatgggcaccgggcgagggaatagaggtcatgtggcagtggttgaaaacagggcgaagcatactggtaggtatgagaccattcatgatcaagatgctggtgagcacgaataagcaactcagatcggtgatgtcactacaaacggaaa

SEQ ID NO: 17050 - DNA, 399 bp, Gossypium hirsutum
  Clone ID: uC-gsflnu33B112c10b1
ctctcttctccttcatctcctccgccggagcttaattgcttcgccggtttttatcttctcgcagaacatttcccatgggggccggcttatccgctgccgtaccccttaaaactttccgatcatttcatccctcacccaagccaaggctaggtttcaaccctctacttcgcctcccacagctaacacacggtgctcgaaaggagacaaggctttccatttgattcgtgttggaggaacaaaaacatgttgaacccctgaccgtagagaatctcgtagaataaggatctggttccgaggattatgggaacaaacagatcttaatacctccacatgtggcggagaaatagctagaagaaaatccgaacggctcacttacttgctcgctgctgtcatgtctag

SEQ ID NO: 17051 - DNA, 321 bp, Gossypium hirsutum
  Clone ID: uC-gsflnu33B112d02b1
caaagattaagccatgcatgtgtaagtatgaacaaatacaataatgtagaatgcgctttacctagagcttcttcctaaaaaaaaaaaaaaaaaaaaaaaaaaaaaaaaaaaaaaaaaaaaaaaaaagagaaaaataaaaaaaaaaaaaaaaccggcgaaaaaaaaaaaaaaaaaaagaaaaaaaaatgaaaaaacccaaaaaaaaaaacatgaaaaaaaaaaacaaaaatgcaattttgagaaaaaccaaaaagaaccgcaccgatcgcaaaaccaacaagttctaaatttaaatgcaaaataaaaaaagccccgtatcgt

SEQ ID NO: 17052 - DNA, 481 bp, Gossypium hirsutum
  unsure (1)..(481): unsure at all n locations
  Clone ID: uC-gsflnu33B112d03b1
gctgttgagtcatcggcgtcggtggcgtggaaggagggagggaagaaagaggagaagaaaggggttccggtttacgtgatgatgccgttggatagcgtgacgaacgggaatacggtgaatagaaagaaggcgatgaatgcgagtctccacgcgctgaaaagcgcgggagtggaggggataatgattgacgtttggtggggtctggtggagagggaagcgacgggtgcttacaattggggtggctacgccgagcttctcgagatggctaagaagcatggccttaaagtccaggctgtcatgtcattccatcagtgtgggggcaacgtcggtgactcttgcattattcctttgcccaaatgggttacagangaagatcgagaaggacccagacctcgcatacactgatcaatggggaagaaggaactacgaatacctttcacttggttgcgataaccttcctgtcttgaaggccgtacgcctg

SEQ ID NO: 17053 - DNA, 320 bp, Gossypium hirsutum
  Clone ID: uC-gsflnu33B112d04b1
cttaattctaattggtatatcacaatctacagttctttggatccatatcatagtgaagttacaagtaatggttgtttattctttgttgttctttaagttaattgcagaatgctcaattggagttgcttaaccactacaaatctagtattagaaaagaaaaaagaaaagaaaaacaccaacttgggcgatgaccaacaatacaggcggcacagttccatatattcaacaattggtatggtcattttggaggttctagggtccaagtaatcccaaattttttgtgggttttcaaactagtcatcacctttttgaaggggggg

SEQ ID NO: 17054 - DNA, 481 bp, Gossypium hirsutum
  unsure (1)..(481): unsure at all n locations
  Clone ID: uC-gsflnu33B112d05b1
cttacttgtccggaagtgtgatgttgatatcaggaaggatctctatggtaacattgtgctcagtggtggttcaactatgttccctggtattgctgaccgaatgagcaaggagatcactgcccttgctcctagcagcatgaagattaaggtagttgcaccaccagagagaaagtacagtgtctggattggaggatctatcttggcatcactcagcaccttccagcagatgtggatttccaagggcgagtatgatgagtccggtccatccattgtccacaggaagtgcttctaagttttataagttctttgatggtgagttacatttgcatttacttggctttatcgtgacctgtgtcaaaattgaaatcaaggtccggattacatggagaaagtgttgaacgagggatcactgaaggaggatgtactttgatcttgatgtactattatggctntcatttgcttccacaaccattgagatgat

SEQ ID NO: 17055 - DNA, 473 bp, Gossypium hirsutum
  Clone ID: uC-gsflnu33B112d06b1
gatgcatatcagataaccctactggtggagggatataccttgacacttcggttatgaattcggactataggtctttcattgagattgtgtttcagaatgatgaggatattgtccagagctggcatctcgacggctactctttcttcgttgttggtatggacggagggcaatggacggctgctagtcggaacggatacaacctccgtgatgccgtttcacggtgtaccactcaggtgtaccccaagtcatggactgccatttatgtggcgcttgacaatgttggaatgtggaacttaaggtccgagtattgggcgagacagtacctgggacaacagttttatttgcgtgtcttccaacgtcaacttcactaagggatgaatacccgatccccaagaacgcactactctgcggcagagcaagcggcagaagaacccgtcctctttaaagccacccatacaataaatgatccgtag

SEQ ID NO: 17056 - DNA, 196 bp, Gossypium hirsutum
  Clone ID: uC-gsflnu33B112d08b1
tttttaaaaaaaaaaaaaaaaaaaaaaaaaaaaaaaaaaaaaaaaaaaaaaaaaaaaaaaaaaaaaaaagggaaaaacaatttaaaggatggggggtcgtttttggggtgggtggcttatttacgcgttcctgtcgtgccccctctttttttttcgtggcccctattttctttggcggtggcctccggtttcccct

SEQ ID NO: 17057 - DNA, 239 bp, Gossypium hirsutum
  Clone ID: uC-gsflnu33B112d10b1
cttaatggtccagaaaaacaaaaaaagagaaaaagggccttggtgtccctgggttgaacttgatccaactgttgactgccaaagccaaaacaaaaaaagagaaaaagggccttggtgtccctgggttgaacttgatccaactgttgactgccaaagccagcttttggatctgatcaatatataaaaacttcgtctttcagttttatcagtcaatgagacaaagatgtcaatttcacttt

SEQ ID NO: 17058 - DNA, 374 bp, Gossypium hirsutum
  Clone ID: uC-gsflnu33B112d11b1
gttaagccagaggctattgtatctgttgcatgggaaggagtataccatacattgactacgcttttaagagattttagggatggactgagctattatgtaagcggggggccctatttgtgaatggggtttaattaacgaatgttttgagcttgaactgaagggctggggatgtagaccaaatgtgcgagtagcaagtagcagaccataaaaaaactttttgttgccactccacaaccgaagatggtctccgtcgacgggctttcgagaccggtactggtgaagtcaactggtattggaaggtgggcctatcttatggggtgcaaaactggtcgtgcttctggcgctgagtgcgcttcaaatgcacgaggagacat

SEQ ID NO: 17059 - DNA, 472 bp, Gossypium hirsutum
  unsure (1)..(472): unsure at all n locations
  Clone ID: uC-gsflnu33B112e02b1
attgatagtcccctgggtttggttaatgacccttcggtggtggagccacttggaaactgcggtcgtcaggttttgctctggtggcttcgagttgaagctcgtgctgatagcgaatttactgccagatggataattgacccacctctggagatcacggtcccatcaaaacgcactccatggccagatgctcccccggaactccctgctaatgaaaaaccagctgtgggcattcaagatccaatagtgaagcatagcacaaagaggacatccagatcaaaacatcgaagtaaaagaaagcatgaaccaaaaactgacacacaggtttcgacaaggcattctgaacaaaactaaaatctttaccccaccacctatggaactgctgcaccatgagattggaccaaatagggggcaaatgtagatggtgttaccagtnaatatggagaagcacctctcacaacaatccaagttttac

SEQ ID NO: 17060 - DNA, 181 bp, Gossypium hirsutum
  Clone ID: uC-gsflnu33B112e04b1
cctattcgtccgggaggtttcacttggtgatgggaaaattgttgaagttactgcgattaaggatatgggaaggactactactgttttgattcgtggttcaaatcagttagttatcgatgaaccctataggagtttacatgaagctttgtgcgtggttaggggttggcgtacaaagacgttt

SEQ ID NO: 17061 - DNA, 372 bp, Gossypium hirsutum
  Clone ID: uC-gsflnu33B112e05b1
cctattcgtccgctccaacttatcgccagaaattgtcgtaatttggtatctgtgaaaattagtgattgtgaaattttagatctcgtcggtttctttcatgctgctgctgttttagaagaatccaacggcggacctttctacgaccaacctgatgggtatgctgctgtaacattcccctcgaggttatgccgtttgggtttaacctacatggggaagaatgaaatgccaattgtgtttccttttgcacccgttgtttaaagaattggatctcctttatgcattactcgacacagaagatcactgcttgataatacaaacatgcccaactgcggaagttctcaagacactgaatgttatcggagatcgaggcta

SEQ ID NO: 17062 - DNA, 464 bp, Gossypium hirsutum
  Clone ID: uC-gsflnu33B112e06b1
cctttttccaagaaagctgcagctcctcggaaaccacgggctgctcctactcatccaccttacgaagagatgatcaaagatgcgatcgttactttgaaagagaggacaggttcaagtcagtacgccattgctaagttcattgaagagaaacagaagaatcttcctgggaatttcaagaagcttcttcttgtccatttgaagaagcttgtggctgctgggaagttggtcaaagttaaggcttcgtataaacttccatcggctagatcttcgaagacggctactgctgcttctgctcctgcaaaaaagaaaacggctactactaagtcgaagtctaagcctgcctcaaagcctaaggaagggaagagtacaaaagctactcctaaagcgaaagccaagacaaaaactactttcgaggccaagagtaagcctgctgctaagtcaaaggctacttctaaggcgaggct

SEQ ID NO: 17063 - DNA, 469 bp, Gossypium hirsutum
  unsure (1)..(469): unsure at all n locations
  Clone ID: uC-gsflnu33B112e07b1
tttacgcgtccgaccaggcgtacggactactggctcatcgtctaatgtatgcgttcaaactgaacctgatgtagagggatcgaatcatgacggctctgccattgcggttacctccgttgcaaagtcgcttgtgccgactcggcgacggctcacactcgatccatgctcatgagcgatattttccatatgaacctggcaaacaggagatcgagcgcattcacgatcaaaaacacaagctggtcatatgcagctatcaagtttcaaacaactgaaccagagagctgcaacatgcgccctccgngagccattctagcacccgacgagagcatcatagcaaccgtctatacgttcgaggagccttctgaggacaatgaagaacggatggatctgaagagcaggggtaagtgtaagatatgagtcttaacgagaaagcggcaatggactacataccagagctgcttgatgagca

SEQ ID NO: 17064 - DNA, 479 bp, Gossypium hirsutum
  Clone ID: uC-gsflnu33B112e08b1
aatcttaacattccagtttcccttagcttgctcctcaacgtttgctcaaagaatgttccttccaacttccaatgctaagtcttcactgttcccaacattctttctagttttccttattgtgtttggttattgaaagttacggtttccgacatttgcagtaaatcagtggtttttcatttgtaactttattatttcaatttccttgtgagggatggatactgaataaatttaatacttctcttcaagtgtttttcttttggggttttttgtatctccaaaagacatgaaaaagacttgtattattcccttgcttttgtttctctatccatttactaatggattttgtatgtgaaccaatctagtttgaacgaataataaatctttattcgtatttttattcttaaaaaaaaaaaaaaaaataaaaaaaaaaaaaaaaaaaaaaaaaaaaaattaaaaaaaaaaaaaaaaaagggggcggc

SEQ ID NO: 17065 - DNA, 391 bp, Gossypium hirsutum
  Clone ID: uC-gsflnu33B112e10b1
tttgaggctcggagtcttgaggagaagcttgggggagccaccatggtaaacgtctgttctgttacaaggcgggagatatgacgcctggagttgaaaggagtataacgctgataacatgatggacactttacgcatctttcttaagatgggatccgaacagttgtgtggcggtcaaatgcgtgatatcaagggggtaagaatgactgcacaatgggcgaacactgcatcctactcataatatgaaaaaaatggagacgaagctgccagtgttcacaggagataatgatgacggacatggctgcaatgaaaagaataggaaccgtgatccccaacagaatgagatagagcttactgtaaatgcagaggtacttcgaatattatgagagctttt

SEQ ID NO: 17066 - DNA, 152 bp, Gossypium hirsutum
  Clone ID: uC-gsflnu33B112e11b1
ttacctagtagtttccatatatagtttattttttataaaaaattttactttgcatgttttgcatgtttggttcttgttcttatattaaagattgtcatgaacatttccacaaatatatatatattgacaaagcataaactagctcttctttt

SEQ ID NO: 17067 - DNA, 553 bp, Gossypium hirsutum
  Clone ID: uC-gsflnu33B112e12b1
aacactactattggggggctgctcgcctcctgagcggccgggccggactggctggacccacccacgcgtgcggttataattggtttatgacgatttatcacaccaggtattacaatgggttcaatcggtcaaactcagatgacacccacccaagtctcagatgatgaagccagcttattcgctatgcaacttgccagtgcatcagtcctccccatggtcctcaaatcagccattgaacttgacttgctctagatcatggctcaagctggcccaggggctttcttgtccccaaaagaagtgggtttcgagcttcccaccaccaaccctgatgcacccgtcatgctggaccgtatcttgcgtctcctggctagctacaacgtcctcagtggctgctttgcgtaccttccctggtggcaaagtggaaagactctatggccttggccctgtctgcaaattcttgaccaagaacgaagatggtgtcactctttccgcccttagtctcatgaatcaagacaaggtccttatggagagctggtactacttgaaagatgct

SEQ ID NO: 17068 - DNA, 312 bp, Gossypium hirsutum
  Clone ID: uC-gsflnu33B112f01b1
catttttcaaacttctattactacatgacagtaccgaaagacatgtgataaatcttcttccccagatctacatcgagaacaaacagcagtgtcgactactcgtttagatcgcaaattaactagagtaggcatatagttccatgatgctcttcaaactgtaatagtaatctttgagggtaactgtaaattccagagctttttgtagaaattttttaaatcggtatgtaataataagttgttaggattcgagctagtgctttgtaatagtttgtaggcacttctgaccgaaaatcaactccttggagttccgct

SEQ ID NO: 17069 - DNA, 489 bp, Gossypium hirsutum
  Clone ID: uC-gsflnu33B112f02b1
ttcgatttttggaaggagagatattggtccttataagcatttgtttccaattgatgctggctcaatcaatctgaatcgaacttcaaattctttatttcttctgcgaaggctcaaactactccttggaagacttgccaccaccaacttgcagaacctaaatcatcaggagaagcttgccttttggataaatatctacaattcctgcatgatgaatgcattcttagaacatggagtacctgagagtccggagatggttgtggaattgatgagaaaggcaactataaatgttgggcgacgcctgctaaatgcaataactattgaacatttcattctcagattgccttaccactccaaatttaccttttaaagggtgccaagaacgatgaaatgactgccaggagcatgttcggattggaactatctgaaccattggtgacatttgccctctcatgtggaagctggtcctctctgctgtgcgagtatatactg

SEQ ID NO: 17070 - DNA, 491 bp, Gossypium hirsutum
  Clone ID: uC-gsflnu33B112f03b1
ctctttgtcagcgtttcacactttctaaaactccaatatcccaaaacaatgggttcaaccggtgaaacccaaatgactcccacccaagtctcggatgaggaagccaacttattcgccatgcaactcaccagtgcctcagtccttcccatggtcctcaagtcggccatagaacttgacctgctggagatcatggccaaagctggcccaggtgctttcctctccccaaaagaattggcttcccagctccccaccagcaaccccgatgcacctgtcatgctagaccgcatcttgcgcctcctggctacctactccatcctcacttgctccttgcgcactcttcctgatggcaaagtggagagactctatggtcttggccctgtctgcaaattcttgaccaagaatgaagatggcgtcactctttccgccctcagtctcatgaatcaagacaaggtccttatggagagctggtactacttgaaagatgccgtgct

SEQ ID NO: 17071 - DNA, 491 bp, Gossypium hirsutum
  Clone ID: uC-gsflnu33B112f07b1
gtttttcatgttttgggctctcattgtaactactctcacccttcaactagccattacgagtgcacaaacaccagctgcctcaccttccagtacgccaaccaccaccaccaccactccaccttcaacttcgtcaccacctacaacttccgcaccacctccttcaacaacccctccacctacaacttcagcaccacctccttcaacagcaacgcctccaccttccaccacgcccatcgcgccagctcaaccacctgcaacaactccccctcccactgttgcaccagctacaagcccaaccgtgccaccgccacaaactccaccacctcaaccacctcaaactcctccaaccacagctccagctcaaccgccagcattgccaccaccatcaccaccaccagtatctcctgcaccagcaccagctcagaaaccaccagctcctgcaccagtaaagctgcccccagcacctgcacccattactgtgccaccggctc

SEQ ID NO: 17072 - DNA, 392 bp, Gossypium hirsutum
  Clone ID: uC-gsflnu33B112f09b1
tttacgcgtccgctgaaactgagcttgggcttgcagagcatcagggaaagtacatggctggtgtggtcaagaggctttgtcaagcttgacattccccacacttgagggtcgcatactttgttgattgttcattaggtgaattgtgtttgaatttgtccttggtcttgccatttctcagcatgagagatgtcacttatattggtatttatttcaccatttctttttgtcaattccattcagttgagaaagatgtacatgatttgatcttcttgtgtcttgtcttatcaaataagatgtatcatatgtggccatggattttttgcgtttgtataatttccattgggtaattcaccacaagctttgatttaataaaagaaatttcatttgtctgt

SEQ ID NO: 17073 - DNA, 414 bp, Gossypium hirsutum
  Clone ID: uC-gsflnu33B112f11b1
attaattggaatgtattatgtgctaaacccttattccccacccaaaaaccctgcaaaagaataggcgctctccgtttccatcaggtctaaaattgcaatccatttaaaccctccttaaaacccttgaaatcatggcctttgcagagacccaaaaccccttacgagttcatagaatcctgcaatccaggtacatctactccgcccgctggctttcaccggttgctgcctccgacagatacgcagacatctgctatatcgacgctgataccaactctgcctccatcgaaatcgcatacgttgacccaaaccctaaaggctcggctccaaccttaacccctcaatcctgatggacctcaccttctcgcatttcgtccctcaaaaccgaccactctacccctgagcctctgctagctg

SEQ ID NO: 17074 - DNA, 210 bp, Gossypium hirsutum
  Clone ID: uC-gsflnu33B112f12b1
ttttttgtactttttgggtaaaccaacaagttctatgctttactccttggacaaaattttcttgaataaggaaataaaagttacccaaaactacgctacttgtaataagattgtattgtcgatcatctcatttaatgcttttgatgtgtactttctttaccagtaccacttatatcgttttgaaagattaaacgatgtcaatttcattcc

SEQ ID NO: 17075 - DNA, 425 bp, Gossypium hirsutum
  Clone ID: uC-gsflnu33B112g02b1
ggtgaaaatggttaaggggcatgtagggtacgaaaccaagggcccgtaaatatgtttctaactgtgcaccggcaatggcgcgcggcaaagtggtaaaggaaactgagggagctacccatagccagccattgagagaatgacgatggatacgtacgcaggaggtggaagctggactaccatcttaagcgggccacccaacagtaacgcatcgactacatcaaatcaagaccctacataccaatatactacaccttcaccatcacaacaagaactgcagctggatcaacatgatcagccactaccttctcactttgacctcttacacgatttcctttaataaaaaccataaccttatcactgtatatacgtacatttagttatgggtcagttggagagcagcagctggtcgagaatttgggtgatgc

SEQ ID NO: 17076 - DNA, 487 bp, Gossypium hirsutum
  Clone ID: uC-gsflnu33B112g03b1
cccactcgtccgcccacgcgtccggacgaaatggaaggaggaaaagagcaaggaatgttggtggtaacagggttgatggctcaccaaaacccactggagcaattgcaagccaagttcaaggaagttgagaacgggttcaaggcttggctagacaaacagtccatgccagtcgaggcggccgtggtaaccgccacaggcgccgttcagggtgctgctattggtgctttaatgggcaccctcaccaaagatgtttcctcttcttttccgactcctcctcaggcttccctcaatcatcaggcaatggcttctctcaagcaagcccaggctctatcaggagctccctgggtacaagctcgtaattttgctgtgatgactggtgtcaatgctggcctggcttgtgttatgaaaagattgagagggaagggggaatgttcaatctagcatggtggcggcttttggttctggggccatgttttcttagtgagtg

SEQ ID NO: 17077 - DNA, 475 bp, Gossypium hirsutum
  Clone ID: uC-gsflnu33B112g04b1
ctttcttctctctaaatctaatactcagatccgcgagtaatttttgtcacagctcattagaatggagacctttctattcacatctgaatcagtgaatgagggtcaccccgacaagctctgcgaccagatctctgatgctgagctggatgcttgccttgcccaggaccccgacagcaaggttgcctgtgaaacatgcaccaagaccaacatggtcatggtctttggagagattaccaccaaagccaatgtagactatgagaagattgttcgtgacacatgccgctctatcggatttgcttctgatgatgtgggtcttgatgctgacaactgcaaggtcctggtcaatattgagcaacagagccctgatattgccagggtgtccatggccacttcaccaagcgcccagaagaaattggagctggtgaccagggccatatgtttgggtatgccactgatgagacctcagaactcatgc

SEQ ID NO: 17078 - DNA, 478 bp, Gossypium hirsutum
  Clone ID: uC-gsflnu33B112g05b1
ggttattcagctgtcaaatggaattatcattgaagagttagaaatggggaaaccagatgggaaaatagcttctcttggtaaaaaggttcgtgtccattacactggaaaattgaaggagagtgggcaagtatttgattcaagtgttggcagagcacacttaaagtttcgtctaggtgggaaaaaagttcaagaactatggaatgtcggccttgatggcatgcgaattggtggcaaacgtagactcattgtccctccttcagtgagttatacaaatgaaggaacaagtgagaatattccaccaaactcctggctggtttttgatgttgaattgattaaagtcaagtaatttcatttttgatcgaaaagtcaggtacttggttggcatcatgcaccagttttgtttaggcatacttgccttaattcttcaaagaattacaagtgcaatagtaaatgaggttggactttgtctctggacttg

SEQ ID NO: 17079 - DNA, 489 bp, Gossypium hirsutum
  Clone ID: uC-gsflnu33B112g07b1
ggtaaaaataattctgatgattcttactatatgtctttaaacttttgaacatttcaagaatttgtactcaaagataaacaatgatcgtttcagcatttttaaatacccagactatcttcacagtatcaatatcagatcttcttatggcatgcggttcttctaggaaacatacacttcttaattagactattcatctttttacccgtgaagaaataaaatcttattctcaagcattaacatttcattatattctaaacacatattccatacagattgaacaatcaagtcgaccttattcatctgtaattgatatttcaagaaattctctcttctagtcaacagaacgattcaacatgcatcattctaaattcactcatcatgccaattgaagaccataacatatgcattagcataagtaatattgatacctcatctgagtacattaactctgattaacttacttgagaaaggaaatccaccatacacatt

SEQ ID NO: 17080 - DNA, 459 bp, Gossypium hirsutum
  Clone ID: uC-gsflnu33B112g08b1
cttacgcgtccggaaacggtcttttcaagaaagctaatgaacttacagttctttgcgatgctagagtttcgatcatcatgttttccactactggtaaactccatgagtttatcagcccttccaccacaacgaagcaagtaattgatcagtaccagaaaaccttggggatcgatatctggaacacccactatgagaaaatgcaagagcagttgaagcagctgaaagaggttaacaggaacctgcgcaaagagattaggagaaggatgggcgactgtttgaatgatttgagcattgaagatcttggtgctttggaacaagagatggagagctctgtcactcttattcgtgatagaaagattcgtgttctctccaccagatcgatacttcaggaaaaaggtgaggaatgggggagagatacacaaaaatctcttacatgaactggaatccctgaaagaagat

SEQ ID NO: 17081 - DNA, 465 bp, Gossypium hirsutum
  unsure (1)..(465): unsure at all n locations
  Clone ID: uC-gsflnu33B112g09b1
cgtctctgccctgctgccctgctgctattatttttttttggcaactgctttgttgcttcacgtctctgctctgttgttattttttttccagcaactactttgctgcttcaattactctacttcacatctctgccctactgttattttttttccagcaactgctttgctgctgatttgctttggtttctatattctctaataaaaattctatcttcacgtctttgccctgctgctattaatttttttcggcaactgctttactgcttcacgtctctgccctactgttatttttttccagcaactgcttcacaactgatttgctttggtttttcggcgtggctgctgcaatttattttacatngtttgtcttaacatttgcactgngagctagtcctggtctaggtctcttcttacttgaaagtttcccaaatcgaatctgcgcanaagctatggcattctgtatgt

SEQ ID NO: 17082 - DNA, 546 bp, Gossypium hirsutum
  Clone ID: uC-gsflnu33B112h02b1
gcggcaatgtacactcggcgtgcggatcgcaccgcagtgccggctttacttcgtagcggcgtagagcggccaccactagcgtgatccatgcctcggctactccagcttgcgaaactacccccaccggtatagtcgacctccggctaccccaccagctgcgtgttccacaactgctactactggtacagctaccccatcaccagattcaatggctttgcctcatgtcacggtttcagctgctggcgttataaagaccaaagctaaacctacagcactatcacataggggctccagcccaacggctacatgaaatgagcgcctgtactcccagtctaggcgcttcttcaccaggccctgctggaaccgatacgagtggagtagagaaaacatggtgcataagaaagatggtgtggagcttggtgattggatggcgtatccctagtttaatgctaaaaaccaagaagtcttttcttcaccatttgtgtcttagctatggttttttgtttcagtgtttaaattccattatatattgatactggcttaagg

SEQ ID NO: 17083 - DNA, 502 bp, Gossypium hirsutum
  Clone ID: uC-gsflnu33B112h03b1
cttatttgttcgtcacatctcaagcatgggacttcttctccgacccaactgttgagataaactcattctatttaggaggtggtattaatggtgttattacagatttcccgaagacatctaatagatattggaggaaccgatgcttgaacagaggcaatcaaattcctggctacatgagtcccgtgcaacccggaagcctttatcaactaatcacagctccttacttgccaccagatgaagccccaaatcggttcctgaccgaagcagatgtcaacgagccccctttgccttctgtcgctgcaaaagccccaagtacttctccaaatggtactgcacttgccccaacatcaccaaatggacaacctaaagttgctgcatccgccatcatgcagctattgactgtttttcttgccatttctctactgttttgaaaccgtcgaaaacctggccttgccctaacacgttttacctgcttgtcgtcgtatcttattgcttccgtact

SEQ ID NO: 17084 - DNA, 221 bp, Gossypium hirsutum
  Clone ID: uC-gsflnu33B112h04b1
aatttatatgccgggggaaatgtgttggattgagagggcatgtgattggtataattatgaacacttccttctaaatgcatttttttgtttccttttaaatgcctgataaacccctaattgaatgatatatacaggcttaaattcaccactgtttattttacaggttcaaattaaaccttatggaacaaaactgattaatgcatggaaacaagaagaaaatg

SEQ ID NO: 17085 - DNA, 490 bp, Gossypium hirsutum
  Clone ID: uC-gsflnu33B112h09b1
cccacgcgtccgcgactctgtctcctccatcgctctttttcatcgatcagatctcttcaaacccatctgtcaaaacaaccctccactcattccatccatgacgcttggctcaggaggatccagtgttgtggtgcctcggaacttcagattgctggaggagcttgagcgtggagaaaaaggtattggagatggtactgtcagctatggaatggatgacggagatgacatttacatgcgctcttggactggcaccattattggtcctcataatactgtacatgaaggtcgaatctatcagctgaagctgttctgtgataaagattatccagagaagccaccaagcgtccgttttcattcaagaatcaacatgacttgtgttaaccacgaactggagtggtggaaccaagaagtttggacttcttgcaattggcaagggagtatacctggaggatttactgacacagctgaaaaggagatggagcacccatac

SEQ ID NO: 17086 - DNA, 316 bp, Gossypium hirsutum
  Clone ID: uC-gsflnu33B112h10b1
tggtcaaggcctggtgtccacagaagcttgagtgacacacaggttgggttggctccaccaacatttaaggatctcagttagatctgtgagccttagaggggatgaatttatttaggctatatattttatggtataggtgatgtttttttttttttttgaactttcacaaaacagagattcaaagtaatagtatttatgtcgaggaagcagcagtttatgctctagagactgctttccgcatgttcatattagattgcttatgttttattggaaataattttcaattttttgaaaaatgttatattttctggtgttt

SEQ ID NO: 17087 - DNA, 423 bp, Gossypium hirsutum
  Clone ID: uC-gsflnu33B112h11b1
ttttaatcgccgccggcaacgatgggattaggttccatggtcggcgatttgggggtcctattcctctttcacgcagcttattccacaattcagtatagggggctgcagaagattatggacgaggagacttctggaccgaccatgaacgttgatttagagttgcttatacggtttgctttgtgaattttagctgccctaaccgggcccgggaattatgctctccatacatactgattctgaggagaatatgattgttgtctatatcagcaaacttggactttatgatcttcaatcacagatcgaaagcacttgctttagaaactgatatgaagctgacgcattaagatcaatgaagcttcatagtcctttgattaatgagattaccactgctggcacgtcatgtgaacgtaagagtagagagcc

SEQ ID NO: 17088 - DNA, 478 bp, Gossypium hirsutum
  Clone ID: uC-gsflnu33B112h12b1
tttataaaacactctccctcctcaaatactgaattcaacttccaatggcgtctcagcccctaaccttcctattcttactcctcgtcaccacctccgttctcgaatcttcggcttcttttgaacccaatatccgcctcccgacaacggcaacgagcgttcctcgatccaacattgacgacgacctttactgtgccagctggcagttagccgtcgagaccaataacgcaggaagttgggccgcaatcccctcccgctgcgttcctttcgtcagagcttatatgaccggtcaacgctacgcttccgactgcgaggtcgtcgctaattactccctcgcttacgcttccaccgtccagatcgcatccgacggcaaagacgtctgggtctttgacgtcgacgagactttgttgaccaatttaccctactatcgggatcgcgggttcggatcagaaatttttaacgagagctgttgggatgaatg

SEQ ID NO: 17089 - DNA, 473 bp, Gossypium hirsutum
  Clone ID: uC-gsflnu33B113a02b1
ctcatctttgccggaaaacaactcgaagacggccgtaccttggccgactacaacatccagaaggagtcaactctccaccttgtccttcgtttgcgcggcgggatgcaaatcttcgttaagacgcttaccggaaagacgatcactctcgaggacgagagctctgacacgatcgacaacgtgaaagccaaaatccaagacaaggaaggcatcccgccagaccagcaacgtctcatcttcgccggaaagcaactctaggacgggcggactttagccgattacaatatccagaaggaatcgactcttcatctggttctacgtcttctaggtgggatgcagatcttcgtcaagactttgaccggtaagaccattactttaaaagtggagagctcggatacgattgataacgtgaaagcgaagattcatgacaaagaaggaattccaccagatcagcaaaggttgatttttgctgggaa

SEQ ID NO: 17090 - DNA, 426 bp, Gossypium hirsutum
  Clone ID: uC-gsflnu33B113a04b1
cccactcgtacgcccacgcgtccgcccacgcgtgcgcccacgcgtacgctcagggaaggggcagtgcaagtcaagcgaccatgtgcgcaattgcattgctattgtgcttaatggttagcctggaaaccattgatgcagctacttacactgtcggtggctctaatggttggacttttaacacggctacttggccaaaagggaagcggttcagggccggcgacgtgctagtgttcaactacaatgggactatccacaatgtggtagcagtgaacagaggagggtacactagttgtaccgcacctgcaggtgcaaaagtgtacaactcagggaaagataagataaaactggccaagggactcaacttctttatgtgcaacactgctggtcactgtgagtctggaatgaagattgcaataatgcagtgtg

SEQ ID NO: 17091 - DNA, 386 bp, Gossypium hirsutum
  Clone ID: uC-gsflnu33B113a06b1
tttcacatttgtttgcaggagcaaaggcggcgagtggtctgccaagcagttggagggagagattgagagctctgctgcttccacttacgagctccagcggaaacttgtccaggccgccaccgcctgcgactcctctggtggtgtcacctcctctttctctgtcgttacccctaattctgccgttttccaggtggatattggaggtgctgcatgcggagccttcatcgggggtggaggagctgctgccgctccggctggaggcgctgccgctgccgctgaagctcctgcagctgaggagaaaaaggaagagaaagaggcgagcgatgactatgtgggattctctctctttgattaagctcctttactgccttactgcctgtttagat

SEQ ID NO: 17092 - DNA, 282 bp, Gossypium hirsutum
  Clone ID: uC-gsflnu33B113a10b1
ctgccatattggttcaaagctgtttttctctttgaatttcctatctacaaccgttatttaaacagaaaccgtacaaagcaaggataaaacagaagttgagtttgtgcttccttatctttggattcacgagttcgtagacgaggttttgaaactttgctggcgcgtttctgatggaggcaaataggatcttaaaggtaatgcagttgtggtaatggtcccattgttgctatgttttgaactttgtatttgttactttttctgtgcaaatacgcatgcatattc

SEQ ID NO: 17093 - DNA, 449 bp, Gossypium hirsutum
  Clone ID: uC-gsflnu33B113a11b1
gtgttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagaaaaacattgagggagcaaccaagtttttgctttcaaaattgaaggaccttcaatttttcgtaggagagagcatgcatgatgatggatgcttggtgtttgcttactacaaggatggtgctgttgacccaacatttttgtactttgcatatgcattgaaggaggtcaagtgctgaggtttgaagcaaagaaaaaaaaagtggctgctgaaagatttagtc

SEQ ID NO: 17094 - DNA, 483 bp, Gossypium hirsutum
  Clone ID: uC-gsflnu33B113b01b1
cccactcgtccgcccacgcgtccgatctcctcctgccccatactactacaaatctcccccaccaccagcccactctccctcaccaccatactactacaaatctccacctcctccatctccctcaccacctcctccatactactaccactcacctcccccacctgtgaaatcacctccacctccagtctacatctacgcttctcctccaccaccaacaccctactagatctaaaaagatcgaccacacaccgttcatgttgtagtttcgccagcaaaataaaggaaggtgccaaggaggaagggagatttggacatcaaagcagttccttttcaagtccatggaataagggtctaagcattacattggagagatacaattttgataattcaggcctacatataacttccacttctttggtagccatgttacacatgctctttatttattgtagtggcataagaaggaagtgagtgttttttcta

SEQ ID NO: 17095 - DNA, 461 bp, Gossypium hirsutum
  Clone ID: uC-gsflnu33B113b02b1
gatccccttaggcgtagctctcgatccacatcataaaaaaagtaaaggagaaaatgaagggtctgcaggcacttatattggcaatggtaacggttatggcgatcgctacaactgatgctcaaagcatttgcagcatgccagcttcaggtttgatggcatgcaaaccagcagtgacccctcccaaccctccgccgcccacgtcaacttgctgctccgccctctcccacgctgacatgcgttgcctttgctcatataagaactccaagctgttgccttcccttggtattgacccaaaccttgccatgaaattgcctagcttgtgcaagcttcctcatcctgcaaattgttagttcctggctctccatatttgatctcaaatgtgagggaaaatcatgcttattataagcctctacttcacattattgtactgagcttcgggttttctttttcctttatttctt

SEQ ID NO: 17096 - DNA, 481 bp, Gossypium hirsutum
  Clone ID: uC-gsflnu33B113b03b1
cttctgatcaatttggtaaggttcctctctattggggaatcaccgccgacggatatgtggcctttgctgataatgctgaattgctgaaaggtgcctgtggcaaatctcttgcttctttccctcaaggctgtttctactccacagcagtaggaggattaagaagctatgagaatcctaagaacaagatcactgcagtgcctgctgaagaagaggagatatggggtgctaaattcaaggtggaagggccagctgttgttgctgccacagagtagtcctttgctttctccttctaaatctatggatccatggaattataggagctgcaaatgcatagcatatggatcagtctccatatgaaagtacttgtagagtgggaaatgaaaagaagaaaaagaactgtttggttatgagaaatggtagtaactttctgtttaggtagctttatgttaaaactagcttttattcctgtttcgtcctttgt

SEQ ID NO: 17097 - DNA, 463 bp, Gossypium hirsutum
  unsure (1)..(463): unsure at all n locations
  Clone ID: uC-gsflnu33B113b04b1
cggacttttgggttgntcacgagtccgtattgggggggtcttatgataagaatggtgggtgcaacattagtattatgtaaacgcattcgagaatgcggccagcaccatggagacgggtgcggttgcagctgagaatgtagcaaggctcatattgtctagatattttggtgaagcatccctgcagtcatcaaacttgcagaggttttagacacgatgcatacgtatgacactttgacctgtaacttacggcgaatgtattattggcttgtaaatttggtgtcttaataatgtgaaatggtagaatatacaaacgacaacagaaggttttcaaagctttgggatttggaggtaattgggcgtgatgaaatatgacttggtaataatttcttctgatatatatgggaaattttgaccggcttatatgttctaggaaaaaaaaaaaaaattttttatcaaagagtta

SEQ ID NO: 17098 - DNA, 489 bp, Gossypium hirsutum
  Clone ID: uC-gsflnu33B113b06b1
atgatcatggctcggatttgtattgaggcagaatcttcccttgactatggagcaatcttcaaagaaatgatccgatcgactccacttccaatgagtccactggagagtcttgcatcctcagctgtacgaacagctaacaaggccaaagctaaactcatcgttgtcttaacccgtggtggaacgacagccaaattggtcgccaagtacagaccagctgttcctatcctatccgtggttgtcccagtcttgacaaccgattcatttgattggacctgcagtgacgaaggtccagccagacacagtctgatatataggggcttggttcccatcctggcagaagggtcagccaaggcaactgatgccgaatccaccgaggtcatcttagaagcagcaatgaagtcagctacggagaaggggttgtgcaagcctggtgatgccatcgttgcactgcaccgtatcggggctgcttcggttattaagatctgcata

SEQ ID NO: 17099 - DNA, 482 bp, Gossypium hirsutum
  Clone ID: uC-gsflnu33B113b07b1
cccacgcgtccgcccacgcgtccgcccacgcgtccggttttgattcatcataatattctgaaatgatagtgttatccatacttctactgtaacagggcattctcgaaataaatggttcattgtttcagctatttctccacatcggggacaatttgtgttgactgctagcttcctgtgctgcatatttacctttgtaggcagataattccatgaaagcctccatattgtaagctttatttttgttggtagattcaggctctaaagttttttgtagaattttctgtagatggtttgtaaagcataagctctaggattttcatccgaactctgtaatagtttataggcacttcggaccgtgaattcacccgacatttcacctccccaaatgagaaaatctttatgaggtgttcgtgccagagggattcgaaggattcttacagcgtcttcttctgtgaaggaattatttctatgtattcatggag

SEQ ID NO: 17100 - DNA, 460 bp, Gossypium hirsutum
  Clone ID: uC-gsflnu33B113b09b1
gatcttgtttaccaactccctctcgctttgcttaacatctatgggttgttatactctaagccctggttcaacaccacctgcctcctctttggtgcctctatcgttgcctctacgacagctatggtgggagacattctcaattcccagaaggcatcagccaatttgatggccatgtattatccaccgtttcttccattaggggttctggctatagtgcgaggggtggttggacaatcgagcaaggctgctccatccattggcaatggaccttcgtcggctgtgaaaaagagggcttaaagttgatccccgatcagtttcaaacgtcttctttaagagaccatgctaatacaataataagggagggattctaatctgtttgatccgcagctaaataaggataaaaaaaaaatgaagtaggcaaattacaaatatattagccatctaataggatttggaatac

SEQ ID NO: 17101 - DNA, 440 bp, Gossypium hirsutum
  unsure (1)..(440): unsure at all n locations
  Clone ID: uC-gsflnu33B113b10b1
cctacgcgtccggcattataaagctccggaactgtttgcaccattcattttggatggtcaacatttgtattatgtaaacgcattcgagaatgcggccagcaccatggagacgggtgcggttgcagctgagaatgtagcaaggctcatattgtcaagatattttggtgaagcatccctgcagtcatcaaacttgcagagctttagtcccgatgcagacgtatcacacttcgacctgtaacttacggcgaatgtaatattggtgtgtaaatttggtgtctcaataatgtgaaatcgtagaatatacaaacgacaaaccagtgcttccaacgctttggtatttggaggtaattgtgcgtgatgaaatatgacttgtcatttttccttccgatatatattgtaaaatctggaccggctcatatgttctagtnnaaaaaaaataa

SEQ ID NO: 17102 - DNA, 482 bp, Gossypium hirsutum
  Clone ID: uC-gsflnu33B113b11b1
gttctcccaggacttcttggtggaagtgcagatcttgcttcttccaacatgaccttgctcaaaatgtttggggatttccagaaggacacccctgaggaacgcaatgttcggtttggtgttagggaacatggaatgggagccatctgcaatggcattgcccttcacagccctggcctgattccatactgcgctactttctttgtcttcactgactacatgagggccgccattaggatttctgccttgagtcaggctagagttatctacgttatgacccatgattccattggtcttggggaagatggaccaactcaccagccaattgagcacttggcaagcttccgtgcaatgcctaatgttttgatgctccgtccagctgatggaaatgaaacggctggagcatacaaggttgctgtcctcaagaggaaggcaccctcaattcttgccctttccagacaaaagctgccccagttagctggaac

SEQ ID NO: 17103 - DNA, 463 bp, Gossypium hirsutum
  Clone ID: uC-gsflnu33B113b12b1
cgccaatcaatatctacctcatttggtacggtcgttggtctgtttcccaaaaactcctcatcaaagacttcataaactcaatttccccttccgcgacgccgtcgtttccgccgtctccttccgtttccgactggtggaaaaccgtctctctttacactgaccagactggagccaacgtttcgcggaccgtcgtcattgctaaagaacactccgatacgggttactcccacggttctcacctcacgcgcctttcagtccaacaagttatcgccaccgccgtcgaagccgctcctttccccgtcgaccaccgtaatgggatctacttaatccttacctcccacgacgttaccgttgaagatttttgccgtgccgtttgtggcttccattacttcacgttcccatccatggtgggtcacactttgccctacgcttggatcggcaactcgggtaaacaatgccccga

SEQ ID NO: 17104 - DNA, 480 bp, Gossypium hirsutum
  Clone ID: uC-gsflnu33B113c01b1
ggcggacgcacgtggtggaaacgtgaaggtgcacgtgaggtggtattatcggccggaggagtcgatcggagggaggagacagttccatggttctaaggaggttttcttgtctgatcattacgatgtgcaaagcgctgatacgatcgaagcgaagtgtacggtccatagcttcaaaagctatacaaagcttgacgccgttggaaacgacgatttcttctgtcgtttcgaatacaattccgccaccggtgctttcaaccccgatcgcgtcgccgtttattgcaaatgtgagatgccttacaatcctgatgatcttatggttcagtgtgaaggttgcagtgactggtttcaccctgcttgtatagaaatgacagcagaagaggtgaaattactcgatcactatttttgtgaaacttgtttatccgaagatccgaaaaagttgcagaattcccttgcctcttccgtagacttggatacaaaggt

SEQ ID NO: 17105 - DNA, 480 bp, Gossypium hirsutum
  Clone ID: uC-gsflnu33B113c04b1
cccacgcgtccggtttgatgatatgggaatttgtggggatatggatttcttcagtgctccttttggggaaaaagatgcggccacggcaacgttggcggctttgcgtactgaaccagaggccacagtggaagatgattatagtgatgaagagattgatgtggatgaacttgagagaaggatgtggagggacaaaatgcgtctcaaacgacttaaagaacagaacaagagcaaggatggggtcgatattgtgaaacagagacagtctcaagaacaggcgaggaaaaagaagatgtcgagggcgcaagatgggatattgaagtacatgttgaagatgatggaagtgtgcaaggctcaaggttttgtttacggaataatcccggagaaaggaaagccggtaactggggcatctgataatcttcgggaatggtggaaggataaagtcaggttttgatcgtaatggtcctgccgctattgccaagt

SEQ ID NO: 17106 - DNA, 309 bp, Gossypium hirsutum
  Clone ID: uC-gsflnu33B113c05b1
ttattatctgatggagatctcggcactataacggtatttatgaacagttactagtatgtgtatcggtggtcatgatttggttccaaccatgacagtctccctggaaagctttttcaatccttccccatgtaccccgtcagtatacttgtcattatgatgcctccagtcagtaaagtaatagaaatgagcgtcgtcctaagtaattgtccatatattttcaacattctatctgtaataaacacttgatgtttctttctttaattagaagattaaaagaaatatatattatagcaaagacgttctgccttc

SEQ ID NO: 17107 - DNA, 484 bp, Gossypium hirsutum
  Clone ID: uC-gsflnu33B113c06b1
cccacgcgtccggggatctgtgtcgaggaagaagaggtggaagagtgtgggataggcggtggtgggggacaaatcttcggcggaggaagaggaggtggtggttcggacagtgaggataacgaatggggcttttgcgattcgaaaaacggaaatgatagtaccgatttgtattatcagaaaatgatcgaggctaatcctggaaatacacttctcctcggcaattacgctaaatttttaaaggaggtacgaggggacttcgtgaaagccgaggaatattgtgggagggcaatattgataaatccgaatgatgggaatattttgtctatgtacgccgagttaatatggcaaactcacaaagatgatcggagagctgaagcttacttcgatcaagctattaaatccgcccctgacgactgttttgtgctagcatcatatgcacgatttctttgggatgctgaagaagaagaagaagaagaagaagtga

SEQ ID NO: 17108 - DNA, 125 bp, Gossypium hirsutum
  Clone ID: uC-gsflnu33B113c07b1
tctttcatgcattttggttgggacttggactaagttttgagttggtgtgtttagttatggatatgggataatgaaattggaacattatcttctttttggttaataaatttgtggatttgctcttc

SEQ ID NO: 17109 - DNA, 479 bp, Gossypium hirsutum
  Clone ID: uC-gsflnu33B113c08b1
gtttgggagtacattagagtgaatgttcacgcccttgttgttgaggaactcactgttgctgagtatctccacttcaaggaagagcttgttgatggaagttcaaatggaaactttgttttggaattggattttgagcccttcaactcatcattcccccgcccaactctttcaaaatccattggtaatggtgtggagttcctaaatcgtcacctttcggcaaaattgttccatgacaaggagagcatgcaccctttgctcgaattcctcagagtccattgtcacaagggcaagaacatgatgttgaatgacagaattcagaacttgaatgctcttcaacatgttttgaggaaagcagaggagtatcttggtaccctacctcctgagacaccatgtgccgaattcgaacaccggttccaggaaatcggtttggaaagaggttggggtgacaccgcagaacgcgtgctcgagatgatccaact

SEQ ID NO: 17110 - DNA, 482 bp, Gossypium hirsutum
  Clone ID: uC-gsflnu33B113c09b1
ttccagaactatatgcacatgatatcaaatatgccatacaatttcaagtttaaacaaaatatattctaccttaccgccacacaccacattgggagtttccaagaactctaaccaccaacataccaaattgtggattaaccattaatagtttacagttttactactgataactgtgaacacacaacaatacatcgcaaatggaatctactatggttgtgggtgcacgacaaagtattgcaggtgaaatttgtcaatggctgtggaaacacaacatgctcataaatgataactatcagagggttgtgattgcacaacaaaacatcataagtgaaatctgctatggttgtgggtacacacaagaccatcgcaattgaactctactatggttatgggtacacaacaaaaataaatgcagatatactaccgattcttccttcgatcatatcgtcccaatcccatgcaatatgcaatatgaatgacaa

SEQ ID NO: 17111 - DNA, 344 bp, Gossypium hirsutum
  Clone ID: uC-gsflnu33B113c10b1
cattcatggcctaattagcatcctcccatgctagaaagagagaggccttgttttaaagtggtagttcttttcttcttcttttttttttctccattagtaatttgctagctcagtttcattaaatattaccattatggaacatacactgtttcaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccctttttaagggtcccaatttttcttccccgtctttgcaactaaaaattttttttttggggccccc

SEQ ID NO: 17112 - DNA, 477 bp, Gossypium hirsutum
  Clone ID: uC-gsflnu33B113c11b1
cccacgcgtccgcttgggttgagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttggttcttgtgctgatatccttgttctgtctgctagggaaggcatcgtttcgttgggaggcccttatattcctctc

SEQ ID NO: 17113 - DNA, 482 bp, Gossypium hirsutum
  Clone ID: uC-gsflnu33B113c12b1
cctacgcgtccgtaaaaagaagagagcaggcaattaaagcaggggaagagagcaatgaggacttgttggacatacttgtggaatccaatatcagagaaatggaagcaaagaaaaaggggatgagcattgaggatgtgattgaggaatgcaagctgttttactttgctggccaggagaccacttcggtcttactggtgtggactatggttttattagcaaggtatcccgattggcaaagtaaagcaagagaggaggttttgcatgttttgggtgacagtaaacctgatgccgatggccttaatcgcctcaaagttgtaacaatgatattgtacgaggttctaaggctgtacccatcagcgactgagctaggacgttccgttccaaaagaaataaaactgggaaatttgttgttaccagcaggaacagaaatttcggttccgatcctgctgatccaccatgacaaagatctttggggcgatgac

SEQ ID NO: 17114 - DNA, 132 bp, Gossypium hirsutum
  Clone ID: uC-gsflnu33B113d01b1
ttttatgtgctcaacaaaaatctgtcaactttattcatgtagtatttgagtatttgaatgatgatagttcatatcatatactcgaatatatgtcaaatgcagctattagatacctctaaaaaaatagtgtct

SEQ ID NO: 17115 - DNA, 482 bp, Gossypium hirsutum
  Clone ID: uC-gsflnu33B113d03b1
gttgatataggcacaattaggagttccttagttgtgttgtaggagccaaagataaaaaaatggtgaagatagcttttggtagcattggtgattcttttagtgttgggtctctcaaggcttatttggctgaattcattgctactttgctttttgtgtttgctggtgttggatcagctattgcttatgggaagctaacgtcggatgcagcactagacccaccaggcttggtggccatagcggtagctcatgcacttgcgttgtttgttggggtagccattgcagccaacatctcaggtggtcatttgaacccagccgtcacctttggtttggccatcggaggaaacatcaccatcttgaccggccttttctactgggttgcccaatgccttggctcaattgttgcttgccttcttctccagtttgttaccaacggattgagtgtaccaacccacagcgttgcttcaggaatgaatgccgtcgga

SEQ ID NO: 17116 - DNA, 480 bp, Gossypium hirsutum
  unsure (1)..(480): unsure at all n locations
  Clone ID: uC-gsflnu33B113d04b1
aactatcactctttaggtttattgcattaaataaatcatgaaatctttccttcctttctttgcattcctctcacttctcctgtttgtagacaccattgcagcagctaggaaagatgctggagagtactggggagctgtaatgaaagatcagcctatgcctgaggcactccaagagcttgttcggattgaggctgccgttgccaaccccgatgagaaaaccaagtgccatacatcaggtaacattgagcttaaggaagagaagattattgttaatgaggagttcgaaccaaggccaaacatttcagcttacggtgatgacgctaatctaaaaggagataaatcatcatcttttgcagaagattttgaaccgagacctaacatttcggcttacggnggcgatgatgctggtcttaaaggacagaaagaatcattcactaaagatttcgatccacagccaaatatctccgcttacaataacta

SEQ ID NO: 17117 - DNA, 456 bp, Gossypium hirsutum
  Clone ID: uC-gsflnu33B113d05b1
gaagaacaaatccttctatcaatacagggatgatgcaaaggcagcaaatgatttggctttgaaaggggacaaagaggcacttcaaaatctgtgtgttaaccaggtggagaaatttatggaattgtggaacaacaatgatgaattctgtaaagagtacatccgatgcaataccagaagcacattaaggaggctgaggacattagatggccgtgcacttggtcctgatgaggagccacctgtaattcctgcaattcctaaagttgtaaacgaacaagtggccaaggatcaaacagtttccagctcaactttggaagagcgaactcaagagaagactgcacctgcaaaagctgaaatagctaaggctaaacctgcagcaaagtccatggaacaaaagaacctgactagtaaatcagaaaagcctgtgaaatctgtccctcctgaagtggttcaaccact

SEQ ID NO: 17118 - DNA, 178 bp, Gossypium hirsutum
  Clone ID: uC-gsflnu33B113d06b1
aaaaaaaaaaaaaaaagaaaacgaagaagaaatatggcatgagagaatgaaatatatttttgttggagtgaaaacatgttgaatattgagatgcatacttctaggacgaacttttgttattacgcagtcattttcatgttgttagctctaaaaacaataacatatgtctacattttgc

SEQ ID NO: 17119 - DNA, 479 bp, Gossypium hirsutum
  Clone ID: uC-gsflnu33B113d07b1
cttgaagctctcccttttcttttcacaaattttattttgctttcatcagaaatatctgcccatggagaacggagaaatcccagaaaacgccaatgaacattgtccgggtcctcaatcggagtcagctggtaaatccgatgcatgccaaggttgccctaatcaagaagtttgtgccaccgcccctaagggccctgacccggacttggttgcaattgcagagagaatggctactgttaagcataagatactggttttatcggggaagggaggggttggcaaaagcactttctctgcccaactctcatttgcactagcagctaaggatttccaggtgggtctactggacattgatatttgtggtccaagcattccgaaaatgcttggcctagaaggtcaagacattcaccaaagtaaccttggctggtctcctgtttatgttgagtccaaccttggggtaatgtcaattgggttcatgctcc

SEQ ID NO: 17120 - DNA, 469 bp, Gossypium hirsutum
  Clone ID: uC-gsflnu33B113d10b1
aaataatcgagtcactcgagtagatttaggtaattctaacctgtctggacatttggtacctgagcttgggaagcttgagcatttgcagtatctggagctttacaaaaataagatccagggaaccatcccaactgaacttgggaacttgaagagcctcattagtttggacctatataacaacaacatctcagggaccattcctccttcactagggaaattgaagtctcttgtatttttacggcttaatgacaacaaattaactggaccaatccctagggaacttgccggtatttcaagcctcaaagttgttgatgtctcaaacaatgacttgtgtggaacaattcctaccagtggaccatttgagcacattcctttgaacaactttgagaaaaaccctcgactggaaggtcctgagctgctggggcttgcaagctatgacacaaactgctcgtaaaggacatgttgacgc

SEQ ID NO: 17121 - DNA, 477 bp, Gossypium hirsutum
  Clone ID: uC-gsflnu33B113d11b1
tccaaacaccccctttccgtcgtcaaaaacatcctcagccttcacgttcttctggactactatgacccccaaaagctccacaaaatctctgatggcactaccctcaccaccacgctttaccaaactactggtaatgcccctggaaaccttggtttcgtcaacatcaccgacctccaaggtggcaaagtcggcttcggctccgcaattcctggctccaaactcgactcatcttacaccaagtctgttaagcagattccctacaatatctctatccttgagatcagcgctccgattatcgctccgggtatcttaacggctccggccccgtcgtcttctggcgtcaacattaccggtttgcttgaaaaagccggctgcaagacttttgctagtttgcttaccagcagtggcgtgcttaagacttacgagtcggcgcttgataagggttgaccgttttgctccgtccgatgaagcttttaa

SEQ ID NO: 17122 - DNA, 476 bp, Gossypium hirsutum
  unsure (1)..(476): unsure at all n locations
  Clone ID: uC-gsflnu33B113d12b1
gttattctcacacagcaaacctcaccactcccttgcacttaagctttaaataatccataaaaaataaataaaacccacggaaaattttgaatctttagatctgttgctttcgaagaaaccccataaaaaagatgcaagcttggttctcagggagcagtagtgtagatgatgggcagggaaaagaaggatcatcgcttttagctgattggaactcttatgccgcttcaagagaatcggaagatggctctgcgtttgggttcgatcttgagtctgctatgaggtctgccaatgatactgtctctggtaccttcaacgtcgtttcgaaaggtgtgagagatattcccggaaacttccaatctgccacgagtagtgttccttcaggaaaagcacttctctattttggnttattttctgcaagcggngtcttttttgttttcattgcttttaccatgtttctgncggtcatggtgatcatg

SEQ ID NO: 17123 - DNA, 486 bp, Gossypium hirsutum
  Clone ID: uC-gsflnu33B113e01b1
aaaaaaaatctccaagccaaaccatttctccggtggcatttgcttacaacaaaaaaaattcaaattgaagaatgcctgtatttgcttcaagagttgggttcaggagacacgactacaagaatagatcaaaggaacgaaacgatgaccgtaaagacaaattgtccgaagtgttcaagagctatgctgctaatgggctgctagacaaggaagggctgaaagacgcttttctacatctagatgctgccatgccgtaccggcaagccgaagacgccctccgtgtcgtcggcaaaacctataacattaacgtcgaggaggaaaccgagcttaacgcccttatcgactatgcttacaataagggttacgggtcttcaatttgattagctaatttataagctaaatttctttttctttttcacttttaatcatctaatatgtttttttatatatatttaagtttcgtcccaaagacgttattatagaataaag

SEQ ID NO: 17124 - DNA, 482 bp, Gossypium hirsutum
  Clone ID: uC-gsflnu33B113e03b1
aagtgtatgagcttaaatgggatgtcattgtggttgatggcccaatcggggactcgcccgaagcaccgggcaggatgtcgactatctacaccgctagcatgttagcgagagccacagccaggaatatgactgatgtcatggtgcacgacgttcatcggacaatcgagaaatggttttcttgggagttcttgtgcgaagagaatttggtttctgccaaaggaaaattatggaactttaggatctcctccgatcaatccaattctacacagttttgctcttccgagactgttcatatacggtaatatccttattttgttttgcggcaaaagaacaaaaacatttcctgcatcgttaatgctggaaattagggcttcaacaaaggcatatgatatattaattttcagcgttagagagtgccatgtaactaaacttgtccatacaggtcgagtcggattgcaattttattttattttgtcataatg

SEQ ID NO: 17125 - DNA, 473 bp, Gossypium hirsutum
  unsure (1)..(473): unsure at all n locations
  Clone ID: uC-gsflnu33B113e05b1
ccgccgtcttcttctccgaaaccagctcccaagatctctccgaccaccgctcccaccgtttctccaacagcttctccgccttcaaccgcctctcctcctgctcctcccacctctcccactggttctcccggcgctacttctcctacaacctccataagtcagcctccggcttcgtctccaactgcgccaagtgcggcggccctgaaaacagtcactctcgccgggtctgcatttgcagtcgttttagcagccgccgctttgttgatctagatctgaatttgaggagaattttagatttgatgatttttaaatttttaggcccttttttaaattcttatttttagtatagtagtagtattttatttcttctttatttgatgtttagttaattttatttatttattggtaatttttatttacaagtgtccggcggtnnanaaaaaatnnaaaataaaaatatatatttaacaaac

SEQ ID NO: 17126 - DNA, 469 bp, Gossypium hirsutum
  Clone ID: uC-gsflnu33B113e07b1
agtgttccctttcgtatttagatgaagaagttacaatgtcccctggtagtaccaccactcttatagttcctctcactctcattcaaggagctgcttctaaaggagctgtttgtttggatggaacgcttcctggttatcatcttcatcgtgggttcgggtcaggtgcaaacagttgggttatccatttagagggaggtggatggtgtaataccattcgaagttgtgtattccgcaaaactacaaggcgtggttcatcgaaatttatggagaagtccataaatttcactggaattttgagcaacaaagctgaagaaaatcctgatttctacaattggaatagagtcagggtacgttactgtgatggggcatcttttgctggtgagggccaaaatgaggctcacaagctttattttagaaggcacaggatctggttagctgccctggaagaattaatggccaaaggaatgca

SEQ ID NO: 17127 - DNA, 478 bp, Gossypium hirsutum
  Clone ID: uC-gsflnu33B113e08b1
tcgaacccaaccgccaaggcatttcgcgcatgccggatccttcgatcatcaaacaaataaaacgctgcgtattaatccccgttatggctcgttcccgggtcggccacttcgtcgaagcccagattctcgaacgagtaggagtcgattacatcgatgaaagcgaggttttagcaatagccgatgaagataatttcattaacaagcataatttcggatgccctttcgtttgcggctgcaagaacctaggggatgcgttaaggagagtgagggaaggagctgccatgattagaacgcagggggacttgttggggaccggtaacattgctgaaacggttaaaaacgtcaggtctgtgatgggtgaaatcaggattctaaataacatggatgaagatgaagttttcgcgttttcgaaggaaattgctgccccttatgatctggttgcccaaaccaagcaaatggggagactaccagtggtgca

SEQ ID NO: 17128 - DNA, 480 bp, Gossypium hirsutum
  Clone ID: uC-gsflnu33B113e09b1
tgatatgaaaaaaaatcgaatctaacaatgatgaacacccgaaaataaaacgaaaaattcacctttagtattcaaaagcctctttttttatttttcctcccccttgtacagtattcgtattggctttttatagccggaattacagaaaaaaatcaaaataaaaggcctccaaaatccaatctgttatcccccttttctcgtatttttgttgcctttttctgttgttgctgtttgtttgcagatttggaggccagcctggagcaacggacggaggtgcacacgcgcgtgaaggcgcaactcgcgcggaggaaactctggccgctgcggcgctaggggtcgtgcgctgctactagggtttctgaaggcttgttttgggtcacattgtatttgggctagggtctaatatttgggctgatgtaatttgggtcttttggacaaatgtaaatggactttggaattgttggccttcttttggtttat

SEQ ID NO: 17129 - DNA, 309 bp, Gossypium hirsutum
  Clone ID: uC-gsflnu33B113f01b1
ggtgtcttcatgtacctgtcgataatggcacagagaatggaaggacggcaacatcatcaaccactaacacttcagaacagctacagcgatgaacgttaacgtcgctcccaatacctaacttgtaagtcatggatgtaaaatttgtaggtggttgaccattttgtatgtgtctaatcatgtatttgaacaaatagggaaaaatgttgagatgaattgaacaaggaaaatatagaggtttgtatgaaaaaaactagtaataaaaaataagttggaggcgcaaataaacgataaatcaattaaattgagaac

SEQ ID NO: 17130 - DNA, 428 bp, Gossypium hirsutum
  Clone ID: uC-gsflnu33B113f02b1
ctttggtggcgaccaaattggcgtagctgaccttgtttttggaatggttattcatatgttggcacccatggaagaggtggtggggggagtaaagttcattaaagccgatagcttcccacgcctgcatgcctgggtcaggcatttcagcgaacaccctgtgatcaaagacaatgtccactattacactagagttgtggatttcttgaaaaaaagaatagaactttataggaaatctcaacatagtcactaaaaaattaagcactcttgatattgagaaataatgcataaggattgggattttcttttcgtacatttctatgttatctccatgcattgtaagttcgtaacactcactgtttgccaataattaatgtttagtgaggtggatgagctgaatgaatatggggaggtttccgagacaagctttg

SEQ ID NO: 17131 - DNA, 484 bp, Gossypium hirsutum
  unsure (1)..(484): unsure at all n locations
  Clone ID: uC-gsflnu33B113f03b1
gtgggtaggctccaaggaagcaacttgctaccaaggctgcccgtaaatctgccccaaccaccggtggtgtgaagaagcctcatcgctaccgtcctggaactgttgctcttcgtgaaattcgaaagtaccaaaagagtactgagcttcttatcaggaaattgcctttccagaggcttgttcgtgaaattgcccaggacttcaagactgatttgcgtttccagagccatgctgttctagctctccaggaagctgcagaggcataccttgtgggtctttttgaagacaccaacctttgtgcgatccacgccaagcgtgtcacaattatgcccaaggacatccagttggctcgtaggatcagaggagagcgtgcttaatttccatgtgtgtggatcagtcgcttagaaagaagaaactattgtttatttttaggcaaatgtattggttntttggtttttctaatcatcttttaggccatgatggtagt

SEQ ID NO: 17132 - DNA, 481 bp, Gossypium hirsutum
  Clone ID: uC-gsflnu33B113f04b1
aattgatctgtttaataatagaggaactaatttgattcggcgacttcccaggcgctttaaccaaagtaagtagtcattaaaagcacgtggcaaaatgaaaaccgctgatcgaaacgatctcatccattaccgccatattcgaaacgctactgaaatccaggccctcccagcagagccagggagccgagccgatccctctagaaaaacccctgaaagtaatggcattattacacttacgccacctaactcatcaatctcttctttcaacttccaaactccatcctcatttccgtttctctcctcttaaatcccctcgcttctcctgctcagcctctgcttcaaccacaatggctaaacaagttttggtgccgatcgccaacgggacggagccgatggaagcggtgattacgatcgacgtgattaggagatcgggagctgacgttacggtggcttccgtcgagaaagagcttcgcgttgacgc

SEQ ID NO: 17133 - DNA, 267 bp, Gossypium hirsutum
  Clone ID: uC-gsflnu33B113f05b1
aggaattcgatttcatggacttcttcctttatgccatttctgacccagcaaagcacatcgacagcggtgaactgctccacgcctatgcttctctttcaccaccggtttccaattaaatgcataccgatatcaacaagtaaaagcccaattttagtattaaattaatgttacaaataataaatggagtcctatacttgggatttccattcttgtaatgtattaccatgttgtagttttttttttctcattaaagaaaattttattaat

SEQ ID NO: 17134 - DNA, 454 bp, Gossypium hirsutum
  Clone ID: uC-gsflnu33B113f08b1
cacaaacccaaatctccaattgatctgtttcatttttcagcaaagctagaaaaacaatgactaaggatatcgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcatcgctggtatctctggagggcatatcaacccggctgtgacattcggtttgttcgtgggacgcaaggtgtcactcatccgagccctgatgtacat

SEQ ID NO: 17135 - DNA, 481 bp, Gossypium hirsutum
  Clone ID: uC-gsflnu33B113f09b1
gtgaacatgagttataggatgttcaacttttatcccaattgacatgcaataatcattgaaaacttgggatgtaaactcaccaacattagcaagatgaattattttaactgcataatcaaaatttaatcatttaaacaagcaatcttgcaaatgacaggttgcgagttgataacacatatgtgattattttctagatgcatctaccaaaatcttataatatcaaaactatccacatggtggatgaacgggcccatatttgtttcagaaatgcaagacattaaatctcaactttagctagcgagtttctaattgtaatgccctaaaatacttatttatgtttctgtaaaattgtgacacaaatgtgtatctgcttcactggttaagtgttctgggagtgtctgagaggtcttaagttcaagccctagctttagcaaatatttttatttttggaattaagcactatctctatcgacgtcacacg

SEQ ID NO: 17136 - DNA, 473 bp, Gossypium hirsutum
  Clone ID: uC-gsflnu33B113f10b1
cggacgcgtggggtctcagctacacaaccgcaaccgtcaaagccaaaccaagatagttccacatcttcaaagaagaaaaaaaaaagatttatgatggaagtgaacaaatttctacttcaattactggtgctgctatatttttggtgaaaaacatatgaactattggccttgaaattaagtaggagcattgcctctgagaaagtgattcaagaaagtgctcaaaaattatattcagccttttgtgaagtagaaggaataactgaggataagggctatcgtgtgttgagcaaaatctcaaaccatccaacgcaaatgctaatttttttcagtttactttcttctgtgcaattggaattggtgaaaagatttcttattgatcattaaaaattatggttgtgttggtaatattttgataactttttgtatatgtaatatttggatggtaagatgtcattagtagaatgttataaact

SEQ ID NO: 17137 - DNA, 485 bp, Gossypium hirsutum
  Clone ID: uC-gsflnu33B113f11b1
cccacgcgtccggaaaaccccagaacaggaaaggttggaaaggaggcgtcagatgccctaccatatgcacataaatcttgagcttctggaggctgtgcatttgatatgtgctatgcttcttgaggttcctaacatggcagccaactcccttgatgccaaacgcaaggtgataagtaagacattcaggcggttgcttgaggtgagtgagaggcagccatttacaggtcccccagaaaatgtgcgagaccatgtaatggctgcaacccgggccctctgcaagggagattcccagaaggccttcgacatcattaattctcttgatgtttggaagctccttaggaatagagagagtgtgcttgaaatgctgaaagctatagatcaaggggaagaggctctgaaggacttaccctttttacctactgttcttcctatgatacactaggcctggaccagctgaccagaatgtttgacctctcagatgccca

SEQ ID NO: 17138 - DNA, 483 bp, Gossypium hirsutum
  Clone ID: uC-gsflnu33B113f12b1
ccctacgcgtccgaagagatacccattattgatttgagttacctctttcattttctctgttgattttcttggcatccaagcaagggagactttagccctccactgctccttcattgatgccaccaccaccaccaccaccacaactcctttctcactttaatttcgacatttcccttcatttccgctctaaacccatatccaaatcatccccactatccatttttccgccgtcttcttcatttctcgccctccaatcccctctccccaaacaaagaaaccctgtacttttccttacccgtgccacttctcaaaacgacaatgaccaaccacctcaagggacaccttctcctcctccactgccgcaaggagctaaactcctccctttcctcatctgaatttcaataggcagtagcagcaggggaagaagaataagaacaacgagagagcaagaacttgaggcaaccctttggtgcttcaatagaa

SEQ ID NO: 17139 - DNA, 487 bp, Gossypium hirsutum
  unsure (1)..(487): unsure at all n locations
  Clone ID: uC-gsflnu33B113g01b1
attttagtaaaaatgagaagttaattaaattgggttgatattgttaaagcttgtagcaacttatatgcatgtagtttaacaattgatttgtgataaattagtaaaatttaactattttaattcatgtatttactaacaactgaactaacttgtcagtttttgtgaagtatgacaaccattgtagagattgatgcattagatgggtgaaaactgtctgttaaggatgttaattaactgggaaaactttgatgctgatctgtaattttaaaattttcttttatatggtttttggctgcaaattcagtgctaacatttggctactggctaaaaacacgcattaattatcaatctaacaaacaacaatccttcaactaaagattggttattttacagtgtgatccacaacagtatggtgcgtgtgactcaagggtaatggnggtctaatgacctctgctttcgagtacaccctgaaggttggaggacttga

SEQ ID NO: 17140 - DNA, 483 bp, Gossypium hirsutum
  Clone ID: uC-gsflnu33B113g02b1
gagctttcgcgtttgtctattgaattctttccttcactttctcgagaaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaattttccttttgt

SEQ ID NO: 17141 - DNA, 484 bp, Gossypium hirsutum
  Clone ID: uC-gsflnu33B113g05b1
gtaggtgccgactgctccgttctttgtagcaaagcaaagtttgtgaagcatggccgtcgggaagaacaagaggatttccaagggaaagaagggaggaaagaagaaggcagcggatccttttgctaagaaggattggtacgatatcaaggctccttcagttttcactaccagaaatgtggggaaaactctcgtctcccgtactcagggtaccaagattgcttctgaaggactcaaacaccgtgtgtttgaggttttccttgctgatcttcaaggtggtgatgaggatcatgcttacagaaagattcgtttgagagctgaagatgttcaaggaaaaaatgttttgaccaacttttggggaatgaattttacaactgacaggctgaggtctttggtccgtaaatggcaaaccctgattgaagctcatgttgatgtgaagacaactgacaattacactttgagattgttctgcattggattcactaag

SEQ ID NO: 17142 - DNA, 484 bp, Gossypium hirsutum
  Clone ID: uC-gsflnu33B113g07b1
gtccccactgtctccggtgtttctctagccgaagctcccggcttcctcaaagcccctggcggtgctccggctaacgtggccattgctgttgctagactcggaggcaaagcgtcatttgtcggaaaacttggagacgacgagtttggtcacatgctggccgatattctcaagcaaaacggtgtctccggtgacgggatcttgtttgaccaaggcgctagaactgctcttgccttcgttacgttacgcgccgacggagagcgtgagttcatgttctataggaatcctagcgccgatatgctgttgaagccggaggagttgaaccttgatcttatcagatcttccaaggtatttcactatggatcaataagtttgatcgtggagccatgcagatcagctcatttaaaggcaatggaagtagccaaaggagctggtgcattgctctcatatgatccaaaccttcgcttgccactttggccttcagctg

SEQ ID NO: 17143 - DNA, 102 bp, Gossypium hirsutum
  Clone ID: uC-gsflnu33B113g09b1
tctcacgcgtccggtttggataagatatttctgggttattatttttgttattttatggaacgtgatttgctcatttctataagaagtttaagcttttgaact

SEQ ID NO: 17144 - DNA, 477 bp, Gossypium hirsutum
  Clone ID: uC-gsflnu33B113g10b1
cctacgcgtccgaggggttctgctgctgtgaaggaactcacttggggagatgaccctgacaatgacttgattgaacttccacctgattatggttcagatgtgatctatagtgaaggagcagttgtggatttgttggactcccttacacagctatgcaggccacaaacaacggtgtttttgtctggggaacttcgaaatgatactgtccttgaatgctttctagaagctgcagtgaaggacttcgtggttgggcgcatcaatcagtcacagtggcatccagattatcgtagtccaagggttgtcatgtacatcctagtgaagaagtgaggtcagacgggaaaaaaatcactgcgaattgtgagcagataaagtcggatattcattcagccaaattttgaacatgtttgagtaacctatttcaatcttttggatacagaatcgaaagaccatattctggcgtgcttaatgatgcttgga

SEQ ID NO: 17145 - DNA, 468 bp, Gossypium hirsutum
  Clone ID: uC-gsflnu33B113g12b1
cccacgcgtccgaaaaaatctcagagaaaagaaaaaaaacattctgctcccttttccttggccgaacgaaccaccatcggccccgccgtgtgcagtggtcagaggctcccaacggtcggtttttcaaccccgtttcagggaccaactgaaggcccaactttcgtgggctcaggactatggagcggaaccccaaacgccaccctcctagtccgatttcggtgacccgaaggaggacttcggcgacggcattggcggggcgattcaggtgtttggtggcgggctacaaaggcagagggtatgggcggatgggacacgacgaacggtggtggcagatagggtctaggatgcggggtacggcgccagaaaccgtagggtttctggcattctgtaatgattcgggctatttggggctgattgggttttgggcttatttcattgggcttcagatttttggggttgtaatgggct

SEQ ID NO: 17146 - DNA, 407 bp, Gossypium hirsutum
  Clone ID: uC-gsflnu33B113h01b1
cttccacgtccctgtattggctccccttccaatggggttcgcagtgttcatggttcacttggctaccatccccatcaccggtactggtattaaccctgcaaggagtttcggtgctgctgtaatctacaacaacgacaaagcctgggatgaccactggattttctgggttggtccatttgttggagcacttgcagcagctatatatcatcagtacatccttagagcagcagctatcaaagctttgggatccttccgcagcaaccccaccaactaaaaaaaaatcaacccaaatagctttgtctccacttcactctttttctattttctccatttgttcgtttgtgtgtatgagaagattattattatgaatgatgatgatgaccctctccatgtatcacttgtttttc

SEQ ID NO: 17147 - DNA, 483 bp, Gossypium hirsutum
  Clone ID: uC-gsflnu33B113h03b1
catagttggagcgaaaagaatggcaagcgaggaagagagcgcggtgaaggagcctttggatttgataaggctcagcctcgacgagcgtatttacgtcaagctccgctctgaccgtgagctccgtggcaagctccatgcttatgatcagcatttgaatatgattctaggtgatgctgaagaggttgctacaacggttgaaatatatgatgaaacctatgaagagattgttcggactacaaagcgcacggtttcatttatctttgataggggagatggagttatattggtttctccacctgtacggactgcttgattatgagatcgaagtttatagtcactttttatgggaatgaatcacacgatgaatcctttcatgaaatatcctacactatgctgatgatgctcgagtatcattgatcctctaaaagatttttactacatattgatggaacagttgcacatttttagatcattgaaggaata

SEQ ID NO: 17148 - DNA, 485 bp, Gossypium hirsutum
  Clone ID: uC-gsflnu33B113h04b1
cccacgcgtccggctaaattgaaatttcagtgcctgacccaaagccagtcctctctcgccttcaggtttctgacagaccatgaaattaaatcaggccgattccactgcggatgatcttgagcctctgttcgattaccgccgtgttcagccgctgaacattgtttgcttagacgatgactgttcagatacttcaccagttccatcaccaaaacggaggaaatttgctaatcccgatgttgcggaagtagatttggataaagatgttgaagtgataaaagtggtgaatgttgaagaggaggattggttggctccccctcctgtggtttcaactaaagcttatagcaagattggcgaggattcaaccataaaggagttaaggcgaaggaaacaggaattgctttcgtttgcacaatctgcaaaaatcatgttgcaagaagtggaggaatctgcaaagcaagaaccgagtggttcctcgaaaccttctt

SEQ ID NO: 17149 - DNA, 370 bp, Gossypium hirsutum
  unsure (1)..(370): unsure at all n locations
  Clone ID: uC-gsflnu33B113h05b1
cccacgcgtccgccaagatcgacaaactttcatattttttttgtgcaatttcaaatatggtgtaaatttaatttggcatttataaacgcaatgcctatctaccattatcaaatcatattacattctaaaccaaanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttttaaggatccaaatttttcccccgggggttggcaaataaatatttttttttaggggccccaaaaaaaaatttcctgggccggtttttaaaaaagggggatg

SEQ ID NO: 17150 - DNA, 487 bp, Gossypium hirsutum
  Clone ID: uC-gsflnu33B113h08b1
tattaaaactagtatagtataagccagtgccgtgtggaaaaagagggaatttggaatcgcaaatcggtagttaaagagaagaaaaataggacaaaagcttcgaagaagaaacaatgggacggtggtggagtaagtatgcggtggcgttcatggcgttggccctcttctctatctccgccacagcgaggccctgcaagaccttcctcgtttcctcctattccatctctttccataaccctaatgacccttcctccgctgtctcctcccgatttgtcaccgtcttcactgagatcggtcaatggaaccccttatccatgcctgttgatcccaagccctcctacgccttcagctccctccgtgatcgtagtagggacattctcagcgtcgtcgtcgctctcctcttcggcgtcggctgtggctctctcactgccgccgccatctacttggtctggattatcttcacggccccgtgcgagtaccatgagga

SEQ ID NO: 17151 - DNA, 487 bp, Gossypium hirsutum
  Clone ID: uC-gsflnu33B113h09b1
tttgaaatacaaaaagtagagcaactaaattcttaaaaataaaattataagaactaaattctaaatttataaagagtacaaggacttataacatatttgtacctaatatttttagagacttttttttaataatttaattataggctttgattatatctgccttttttgacacaataccaaaaactaaatatgatctctcatcaacctataaataggagtacaattcatttttatttctaatactcgtattagaaagtgaagaaagtgaggtttttatagttgaaataaaatgagttgcatttttagttgttttgttaattctttcttaatcattttttttgttgattcaggaaaaagttgggtattggttcttgaaatattaatgatatatagaagaatatccatgtatatctttttaatgaaaaattttataaaaaaatagaatttccggattaatcgaatattcttgtttttactatttgcgaaa

SEQ ID NO: 17152 - DNA, 402 bp, Gossypium hirsutum
  Clone ID: uC-gsflnu33B113h10b1
tttacgcgtccgcccacgcgtccggaaaaagaaaaataagagagaaaaaatggaggaagaaaaataaaaggcaatgatggtaataacgggggcggcggtttgtaagtgtaaatgctttgagggtgggcggttttaaaggtttcatttttatattcccttccctgcaatgctataattttttttttgtttgccctgaattgatttccgtggccgttgttttacaaatttgattgtgtgaatgctttgccgttgcctagtttattggttttggaggatatacgtttttgcttatttgccttaatagcaattgggccgccttacttggccttttcaatcattttgattggctatttgggattgggtaccttccttgttgcgtcccattatccccgacgtttttgt

SEQ ID NO: 17153 - DNA, 475 bp, Gossypium hirsutum
  unsure (1)..(475): unsure at all n locations
  Clone ID: uC-gsflnu33B113h11b1
caaaaaacccttcttttttccctcatcaatccatcatgggaggaggaaatggccaaaaatccaagatggcccgtgagaagaacttggaaaagcaaaaagctgctgccaaaggaagccagcttgagtctaacaagaaggccatgtccatccagtgcaaggtgtgtatgcaaacattcatgtgcaccacaacggaagtgaaatgtcgggagcacgctgaggcgaagcatccaaagtccgacgtgtacacgtgttttcctcatcttaaaaaataaacatcaaaactctacagaaagaacgnggatgtcaagacagcttgtaatgcatatcatctatctatgttgtatcttggtactctacaatttatcttaaattctctttcacaagcctgtaaaaaactcactagcntgatttactcgtgcaaactaaatgtttgtgttcaatcatggatttgtatgataacagagctttgaaggag

SEQ ID NO: 17154 - DNA, 482 bp, Gossypium hirsutum
  Clone ID: uC-gsflnu33B113h12b1
cccacgcgtccggcagttaatcgctacgtacaacccgcaatcgcgcggtagctacgttaatggctatcgcattggggtcaaccgggccgacttagcccgtgctttgaatttatctgtgaagaaggataaggataaggatagcatccttgatattgaagagtcaaaggaatcggtaggctttcttgaggaatttgtgtcaaattgggtgcttttgcacgaggatacgtggatgatgccagcggaggtgttgaactggactaaaatgattaaagaaggccatttcgagaagatagattgggctggtttgatttggtttatggtggagaaagagctcacgtctgcccctaaattagggaattgttactatgcctcgcacatgcagtgtttgataaaataccagaaagaagagctgctgctggagaaaccagaaaaggatgcttatgaggccaaggaggaagaggaagagcataacgttcctgagg

SEQ ID NO: 17155 - DNA, 357 bp, Gossypium hirsutum
  Clone ID: uC-gsflnu33B114a01b1
cggcaaactgttcttcgcattctgggtcattcttcatctttacccattcctcaaaggtttgatggggagacaaaacaggacgcccaccattgttgtgctttggtccatacttttggcatcgattttctcactggtttgggtacggatcgatcccttcttgcccaaacaaacaggtccagttcttaaacaatgtggcgtggagtgctaaatggtgttttacaaacctttcttattattttattttccctttttgccactactgttgatttgctgtgattctaaaagggatttatcttgtttgtaaaaagtctcctatgattttgttggttcaatttaatttctatatggtaaaaacta

SEQ ID NO: 17156 - DNA, 272 bp, Gossypium hirsutum
  Clone ID: uC-gsflnu33B114a02b1
cccacgcgtgcggttgaacttctagggtctatttttacatcaatacaataataaggcccagtattcctctctaaacaaaagtatagagataagcacacgagggaggagaatattggccttggaatactctaacccttcgacgccagacaaaagatggtggattctagtggctcgcatgtgaaggtaaagccccttttttctttactttatttactctcgggtggtagggaaaaacacaagacaaggaacaagcacaagaaagggaacgcctg

SEQ ID NO: 17157 - DNA, 386 bp, Gossypium hirsutum
  Clone ID: uC-gsflnu33B114a03b1
cccacgcgtccgagtgaatcacagagtgatgatgagcggagacaaagatcgatattctatagcagcctttatcattccaaatgaaggtacaataattaaggcacccaaagaacttatagatgaaaaacatcctcagcttttcaaggaattcgatttcatggacttcttcctttatgccatttctgacccagcaaagcacatcgacagcggtgaactgctccacgcctatgcttctctttcaccacctgtttccaattaaatgcataccgatatcaacaagtaaaagcccaattttagtattaaattaatgttacaaataataaatggagtcctatacttgggatttccattcttggaatgtattaccatgttgtagtttttttttt

SEQ ID NO: 17158 - DNA, 505 bp, Gossypium hirsutum
  Clone ID: uC-gsflnu33B114a07b1
tttcgatttttccccccaaaattctcccaatctttctttttcttggcaataattctcagccccagtgatgaaaacaggatttcacatcaactgtaactaaggaattcgattttagtttcagccatgtgttatagcaaagccccaaaaatgaacaacaatgatgtaatgagtgatattttactgaggctaccattgaaggatttggtgggatgcaaatgtgtctgcaaatggtggaatactctcatctcggaccccattttcaagttgaattattcgctgcgaaaccctcagtacaatatctcagggttcttcctacagaaattcttgtaccttgagctgcattcgaaattgttgttctttccttgtgaaggacgagtagatgctgctcctaaaccatctctctctttcatagaagatgataaaggtgtttgtatacaacattcttgcaacgggcttctcatatgcagcagtttccgatgtggagaagaagatcgcaaatactaca

SEQ ID NO: 17159 - DNA, 461 bp, Gossypium hirsutum
  Clone ID: uC-gsflnu33B114a09b1
ctctaattgaaccagaggcgacggtggaggatgattatagtgatgaagaaattgatgtggatgaacttgagaggaggatatggagggacaaaatgcgtctcaaacggcttaaagagcagaataagtgcaaggaggggattgatattgctaaacagcgcctgtcacaagaacaggcgaggagaaagatgtgggggttctcacggcagaataagtgcaaggaggggattgatattgctaaacagcgccgatcacaagaacaggcgaggagaaagaagatgtgggggttcacacggctgtgatcaagcatatatgctcgttttctttagttttggaatgggtcagaagatttctttctgaccattttcaaattttttgatgttgtaaaactatataacatatggattatgatgtagaattttattttaaccttttcttaatataagttaattatgtttatgtag

SEQ ID NO: 17160 - DNA, 473 bp, Gossypium hirsutum
  Clone ID: uC-gsflnu33B114b01b1
ctttcaatgccctcttttctctttcggattttcttgctatacaatctcctcctcgactatttggtccccagaaagctcaaatctttcctctctccttcttgtactatcaccactccctttgtttctgtcggaggtgaaaccgaaaagaacccatctccggcagttgcattggcatcggtctcccctcgttgtcctctaaaaagaatggacgctgctgagttgaagagagtgttccaattgttcgacaagaacggagatgggtccatctccaagaaagagttgaacgattcgttggagaatatgggtatctgcatccctgatcctgaattaacccaaatgatcgaaaagattgatgtcaacggcgataagtgcatcgatatcgacgagttcagtgagctgtaccgatccattatggataataaggatgaagaagaagatatgaaggaagctttcaatgtttcgatcaaacggtg

SEQ ID NO: 17161 - DNA, 247 bp, Gossypium hirsutum
  Clone ID: uC-gsflnu33B114b02b1
cggttccccaaatcgggttcggtcgcggtggcggacccggaaggagattttaaggggtgggtatccatggatttgatgggttcttaaatcttaagtttgttatgcttatttttgatagtttttttctctataattttatgttccatttttgaaccattatagttgtttcaaccttaattggtactcaacttattaagctttatgtgaacttgtttatgaaggtatttgaagtgggtaattttcagtt

SEQ ID NO: 17162 - DNA, 489 bp, Gossypium hirsutum
  Clone ID: uC-gsflnu33B114b03b1
ttgtcactgtaacaggatggccttggcaaggtggacccaatgaacctgatgccactgttgaaaatgctgggaccttcattaattatttgattcggcgagtttccaatgattcaggccctcccagtcggccaaatattcccatcaacacatacatttacgaattgtttaatgaagacaagagacctgggcctgtctctgagaagaattggggggtgctttatacgaatggcactgctgtttttcctttgagtttgagtggttctagtcagattatgggaaatgctacgacagttttctgtgttgcaaaagacgatgccagtgaaggtaagttgcaagatgggcttaactgggcatgtgggcaaggccaggccaattgcagtgttatacaatcagggcagccatgttatctcccaaataacaccaagaaccatgcatcttatgcttacaatgactactatcaaagaatgcataccgttggtgcaacatgtg

SEQ ID NO: 17163 - DNA, 517 bp, Gossypium hirsutum
  Clone ID: uC-gsflnu33B114b04b1
gttaaacatgccagtttcaactcctgatgtggctttcacatcggattcagcagctagtacgagtcatgctgcatcaaggattactaaccaagttgagaaaagatcaatgtcggatatcactgctttatcgaggtttcaagacgatggtaggaggaacagaaaaagtgagtgttcattgcctgaaaggtacacagaggaggaaaggagaaggctgctttggttgccaatagctagaagaacagtgcaatggtttgccaatagagaaaggtgtgaacaacaaattcagggtccaacacaccatttagatgtttgattaatggactaatagttgcattttgtacataaattcactaggcaggcacagctacacatttccaaaaaaacattttccttcttaattcagtattttactaagattgttgtttgcttgttggcttttacttctagaaaaaaaaaaaagataaagagcctgcttgctaacctggttttctgaattaaacatgtaatttattaaaga

SEQ ID NO: 17164 - DNA, 415 bp, Gossypium hirsutum
  Clone ID: uC-gsflnu33B114b06b1
ctttttgtgtcttcttttattgcttgtttgcaggctttgaggggtgtcaaacgcgtggaggagaggggtatgcgtggggaggccagtggtggaagcgcgtgctcgtgggaggagcggcaactgaataggaggctagggtttgggtggctactgaaaaagttaatatagtgggctgatttgggctttagggtttcaggttattgggcttattctgtatttatttatttggcttattgggcttgcaactcggtaatgggtttacgaatcggtctatttggtttttgggccccggtcaatatttgggccttacacttgaatctagacaaaataattacaagagagaaagttgtaaaaacctttaaaagcttaaaccatagaagtgattgatcctgtatcaatagagaaagacatcaac

SEQ ID NO: 17165 - DNA, 415 bp, Gossypium hirsutum
  Clone ID: uC-gsflnu33B114b09b1
cccacgcgtccgcccacgcgtccgtttaggttttgttcgaagttatttaaattttaggaggtaaagttcgagaacaaggatctgaagcacctaggcttcgtaagggtggttgcgatccacgccttggtttgcgtgtcgaatctttacgagtacgctaaacagaactccggtccgttgagatccaccgtcgaaggcgccgttacgaccgttgttggtcccgtctacgagaaattcaaggatgttcctgatcatcttcttcaatttcttgataagaaggtagatgaggctttacacaaaattgatgatcaccttccagccaaagcttagcatgcaattaaccaagcccaatacttggttcacaagacagcccaacatgcttggaaactagtcgacgaggcacgtactaacggaccac

SEQ ID NO: 17166 - DNA, 429 bp, Gossypium hirsutum
  Clone ID: uC-gsflnu33B114b10b1
cttcaaccaaactaccaccttctctgttaacaagaagaaatcgaggtctataaagaaacactaaaaatgagaccaattagcagcgttaacacagtagaaacagcagctatgccctcaatgtcaccaccagcaatggtgcatccacgctctccatggcactctcccgtgccttacctctttggtggcctagcagcgatgctgggcctcattgcttttgctctcttgatcttagcttgttcctactggcggctttctggtcgtttggacaacaacagtgaaggaggtgatgtcgaaagggatgtcgaaagtggtgaaaatgagggcgactcaaccaagcaggtgaaggtttatgaggagaagattctggtgataatggccggtgaagagaaacccacgttcttggctacccctgtaattgtttgcactaaa

SEQ ID NO: 17167 - DNA, 511 bp, Gossypium hirsutum
  unsure (1)..(511): unsure at all n locations
  Clone ID: uC-gsflnu33B114b12b1
ttccactcacttgccaaagcgaacagataatgagataaaaaactactggaatactcatcttaagaaaaggttagccaaattggggattgatccgatcactcacaagccaaaatctgatgctttactctccattgattctcaatccaagagtgcagcaaaccttagccatatggctcagtgggaaagtgctaggcttgaagctgaagctagattggttcgagaatcaaagctacgttcacattcacattcatttcaacaccgcctgactcgtccaccaacagcagcttttgcttcttcagccggtgagcttgtgaataagacagcttggaacagtactgccgggtggagtaaatccagtgaagttaataatggtgttgtaaacaatggatttggtgacctcgaatctcccaaatcaacacttacttcctcagatnatggggttggattgagttcaatgggtatgccagattttgttggcactgcatcagcttcatctcagatcaaacaagag

SEQ ID NO: 17168 - DNA, 430 bp, Gossypium hirsutum
  Clone ID: uC-gsflnu33B114c02b1
gttgggaggcccttacattcctctcaaaactggaagaagagacggtagaaggagcagagcagatgttgtggaggagtatcttccggaccacaatgagaccatctctggcgttctcgacaggtttgccgccatgggtattgacacccctggagtcgttgccctcctaggagctcacagtgtcggcagaactcactgtgtgaagctggtgcatcggttgtacccagaggttgaccctgccctcagccccgaccatgttccacacatgctccatatatgccctgatcaaatcccagaccccaaggccgtccagtatgtgagaaacgatcgtgggacacccatggttttggacaacaactactacaggaacatactggacaacaagggtttgttgattgtggatcaccaactggcttacgacaaaaggaccaga

SEQ ID NO: 17169 - DNA, 411 bp, Gossypium hirsutum
  Clone ID: uC-gsflnu33B114c04b1
gcctaggattgtgtacatgctggctattcgtcaaacacggagccagggatgtgattgcggctatgcaagacaaacagtgccaatccctcaggcaagagctgggtgcggatagcaccagctatgtacactgtgatgtaccatgtgtatgcgatgtcggaaatgccgtatactgagccgtgtccatgtttggaaaactcgatatcatgttcaacaatgcaggcctcattggtgacggtgaagtcagagtgacagacgccagcactgacaacttcaagagagtgttcgatataagtgcctcgggtggtttcttgggagccaagtatgcagccaaggtcatggttccggccaagaaaggttgcattctcttctcatcgagtatttcttcaaaaatcagcatcggtctggcccatg

SEQ ID NO: 17170 - DNA, 523 bp, Gossypium hirsutum
  unsure (1)..(523): unsure at all n locations
  Clone ID: uC-gsflnu33B114c05b1
cccacgcgttcgtgataatggtaatgctagtgagcaccaatcaatactgtgcggcggacgcggttacgaagactaagagcatgagcagccgctggtgcgatgatccttcaaataaggagtgcctgcagctttcggacgacatagaaaccatggagttgttgatggattcagaaacaagcaaaatggtatttgaagtaagtgcagcaaccaacttcgccaacagtaaaaatccaactaccagggcccttgacccttctcaagctgtctgcggccgtaattcaggcaagtcttgcgaacctgctaggaatacaggcacaaaggtacctccaaattgtagttcactatacaacaaagattgccactgatttactactttntcttgctatgctggtatattgtgtttcaatttatcaagatatatatatatatatatatatatatatataaataaggatgatggagaaacatctctttaatatatgcataaatatttctggttcaataatctcttttatatttggag

SEQ ID NO: 17171 - DNA, 253 bp, Gossypium hirsutum
  Clone ID: uC-gsflnu33B114c06b1
aacaggcctttgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgctcttggtttgtatc

SEQ ID NO: 17172 - DNA, 315 bp, Gossypium hirsutum
  Clone ID: uC-gsflnu33B114c07b1
tcgcttacgcgtccgtccactcgtccgcagagtgctgccgtcggtgccatcaagagtgttgagaagaaggacccaactggtgctaaggccaccaaatctgctgccaagaagaattgagagatcattggagagagaattatatcaggtttcattacagctctggacaattatcttaaatctggactttagaatttacttgctgtgagactttgtgatttgctttgtaaacaaatcctagttttatatttcaatatagattaatgttcttagaagattccaatatagaagctagagatgagagtggcttcactaatg

SEQ ID NO: 17173 - DNA, 484 bp, Gossypium hirsutum
  unsure (1)..(484): unsure at all n locations
  Clone ID: uC-gsflnu33B114c09b1
cccacgcgtccgcccacgcgtccgagatcaatgagcccaagaggccttcagacaagccacttcggctcccacttcaggatgtctacaagattggtggcattggaactgtccctgttggtcgtgttgagactggtgtccttaagcctggaatggttgtgacctttggcccctctggtctgaccactgaagttaagtctgttgagatgcaccatgaagccctctctgaggctctccccggtgacaatgttggattcaacgtcaagaacgttgctgtaaggatctcaagcgtggtttcgttgcttcaaactctaaggatgatcctgcaaaggaggctgccagcttcacctctcaagtcatcatcatgaaccaccctgggcagattggaaacggatatgccccagtccttgactgccatacctnccacattgctgtgaaggtttctgaattgctgaccaagatcgacaggcgatctggaaaggagctt

SEQ ID NO: 17174 - DNA, 476 bp, Gossypium hirsutum
  Clone ID: uC-gsflnu33B114c10b1
cttgctggtatcgatgatgttgatggcaagaggggtgagatatgcaagaagattgttgaggcttgtgaggattggggtgtcttccaggttgtggatcatggtgttgatactaaactcgtgtccgaaatgacccgtcttgcgagagagttttttgctttgcctgctgaagagaagcttcggttcgatatgtctggtggcaagaaaggtggtttcatcgtctccagccaccttcagggagaagcagtgcaagattggcgagagattgtgacatacttttcatacccattgaggagcagggactattcaaggtggcctgataagccagagggttgggttgaagttacaaaggagtacagcgagaagttgatgggcctagcttgcaagcttcttgaggtgttgtcagaagccatgggtttagagaaggaggccttgactaatgcatgtgtggacatggatcaaaaagtggtggtaacttc

SEQ ID NO: 17175 - DNA, 374 bp, Gossypium hirsutum
  Clone ID: uC-gsflnu33B114c11b1
gtgattagtttgagtgtttttttattgaagaaaaatgtcgagctccaacccgtttgatttattgggtgatgatgatactggggagctctcattgctgatcgccgctcagaaaaaggctgctgccaccgccccctccagcgtccctaagaaagggcaggctcaatctcagacgaagccgcaggctaagcttccctccaagcctctccctcctgctcaggctgtgagggaggcgaagagtgaaggtattcgtggtggaggccgtggtgggcgtggatgtgtatgtgggcgtggtggcagtggtggatacagacgtgattttgccaatgatgagaattcattcagcaacagtgctgaactcggtcaaagtgcacctg

SEQ ID NO: 17176 - DNA, 479 bp, Gossypium hirsutum
  Clone ID: uC-gsflnu33B114c12b1
gtgtgatgctgcagctcctccagcacaaacccgtggtgctcctatcgatgtgtcggcccctgctgctactggctgggaatgagagggatttattatgattttgacaaaaaatgttttggtttgcttttaaaatatgagctatgtcgaacaatggaattgtgtgttctggcacgatttagttaaatagtttttttttatagacattatttagggatttttgttatttttgttttggaatcaaaagtgatgaatttattgttatatgcggcaatggtttcttgatatcagaaatatgctttgcgtttcttcctactgcataagttagtcttctcgtgggaattttttaaaaaattatagttatctgttttcgcaagtatattattttggtcaaatagagttaaatttaagtatttaatgtttaattgaatattgtttatgtactttcaattataaaagccaatgaaatggaatatagtccc

SEQ ID NO: 17177 - DNA, 422 bp, Gossypium hirsutum
  Clone ID: uC-gsflnu33B114d01b1
gtatatctttgatctatttggaaatcttcaaaacattcattggttgttataaataataaaaggggatttagagacattgtagataagagtgttttgaaaatttaatctcaggaatgaacgtagtaatgatgtggtaaatttttagcatctaatgcattatgcatctaacaataacaaagattgtttgacatttgctttacattcaaatgcatttccatggatgcataagatgtcatatggagtttggacattttactttaggatatatgttcataggttttgtcttgtgctggatgtccactatgttaattgtgtccttcattttttataaagtatagtgttcaatacttgtatttgatgcaatttttggatatggatattcggatatgatcatctaaaataggggaattttttctcttttc

SEQ ID NO: 17178 - DNA, 514 bp, Gossypium hirsutum
  Clone ID: uC-gsflnu33B114d02b1
acgcttggttctttgtggagaggaaacactgccaatgttattcgttatttccccactcaggccttgaactttgccttcaaggattacttcaagaggcttttcaacttcaagaaagacagagatggttactggaaatggttcgctgggaacttggcatctggtggtgcagctggtgcttcttcccttctctttgtctactccttggattatgctcgaactcgtcttgcaaatgatgcaaaggctgcaaagaagggaggagagagacaattcaacgggcttgttgatgtctacaggaaaaccctaaaatctgatggtattgccgggctttaccgtggtttcaacatttcatgtgttggaatcattgtttaccgtggtctatattttggaatgtacgactctctgaagccggtgcttttgactggaagcatgcaggatagtttcttcgctagctttgctcttggttggctcatcacaaatggtgctggccttgcatcttaccccaatgacactgttc

SEQ ID NO: 17179 - DNA, 525 bp, Gossypium hirsutum
  Clone ID: uC-gsflnu33B114d03b1
gattaacccacatgcatttccttcacgacaaacgccaggtcaactcttggaggctgccttgggaaaggggattgcctgtggtgggtcgaagaaacatgccacccctttctccactctctccatagatgccattacagaacagcttcacagggctgggttttcaagatggggaaatgagagagtttacaatggtcggactggtgagatggttcggtcactcatatttatgggtccaacattctaccagcgtcttgtccacatggctgaagacaaagtgaaatttcgtaacactggacctgtgcacccacttacaaggcagccagttgcagaccggaaacgttatggcgggatcaaatttggtgagatggagcgggactgccttattgctcatggtgcatcagccaacttgcatgagcgcctcttcactcttagcgattgctcacagatgcatgtatgtcagaattgcaaaaatgctgcaaatgttattgaaccgaccgtagcagctggtcggaagattaggggacc

SEQ ID NO: 17180 - DNA, 539 bp, Gossypium hirsutum
  Clone ID: uC-gsflnu33B114d05b1
cccacgcgttcgcagcagcctgctctctttctcttttgtagctaaccagcagagagcttcaaccatggccgtcgggaagaacacgaggatttccaagggagagaagggaggaaagaagaaggcagctgatccatttgctaagaaagattggtatgatatcaaggctccatcagtttttacttccagaaatgtggggaagactctcgttacccgtactcagggtaccaagattgcttcagaaggactcaaacaccgtgtgtttgaggtttcattggctgatcttcaaggcggtgatgaggatcatgcttacagaaagattcgtttgagagctgaagatgttcaaggaaagaatgttttgaccaacttctggggaatgaattttacaactgacaaactgaggtcattggttcggaaatggcaaacattaatcgaagctcacgtggatgtgaagacaactgataattacactttgagaatgttctgcattggtttcaccaagaggcgcccataccaggttaagaggacatgttatgcacaat

SEQ ID NO: 17181 - DNA, 405 bp, Gossypium hirsutum
  Clone ID: uC-gsflnu33B114d07b1
ttttgatttttcggtgggaggcccacataccgctgtaattctggtagaagagacggtagaaggagcatagcagacgttgtggaggagtatcttccggaccacaatgagaccatctctggcgttcttgacaggttggccgccatgggtattgacacccctggagtcgttgccctcctaggagctcacagtgtcggcagaactcactgtgtgaagctggtgcatcgcttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatactggacaacaagggtttgttgatt

SEQ ID NO: 17182 - DNA, 423 bp, Gossypium hirsutum
  Clone ID: uC-gsflnu33B114d08b1
attcgttcctcgtgctgttctcatggatcttgaacctggtaccatggacagcatctgatctggccctgtcggtcagatttttagaccagataacttcgtttttggtcaatctggtgctggtaacaactgggctaagggccattacacagaaggtgctgagttaatcgattccgtacttgatgttgttcgtaaagaggctgaaaactgcgattgccttcaagggtttcaggtttgtcattccctgggaggaggaactggatctggaatgggaacactgttgatatcgaagataagggaggaatacccagataggatgatgctgactttctcggtcttcccatctcctaaggtctctgatacggtcgtggagccctacaatgccactttgtctgttcaccaattggctgaaaatgctgatgagtg

SEQ ID NO: 17183 - DNA, 471 bp, Gossypium hirsutum
  Clone ID: uC-gsflnu33B114d09b1
cccacgcgtccgaaaaaaagtaaaggagaaaatgaagggtctgcaggcacttatattggcaatggtaacggttatggcgatcgctacaactgatgctcaaagcatttgcagcatgccagcttcaggtttgatggcatgcaaaccagcagtgacccctcccaaccctccgccgcccacgtcaacttgctgctccgccctctcccacgctgacatgcgttgcctttgctcatataagaactccaagctgttgccttcccttggtattgacccaaaccttgccatgaaattgcctagcttgtgcaagcttcctcatcctgcaaattgttagttcctggctctccatatttgatctcaaatgtgagggaaaatcatgcttattataagcctctacttcacattattgtactgagcttcgggttttctttttcctttatttctttttatgtgttgggtttcgattggcatcttata

SEQ ID NO: 17184 - DNA, 493 bp, Gossypium hirsutum
  Clone ID: uC-gsflnu33B114d10b1
cttaatttgagcataattcaacgccaaacacaagccaccattagacccatttttaaaccccagctcctcctttgttacagaagttgaacgaaaatgtcgcctttatccaaggttgttgcttcatggtgcaagaagcatgcagatggagatgatgatgacaatgattttgactatgctcccgcagcatgcatggaaggcaatggcgacgatgatgatggagactatgacgttgctccagcagcttctctcgagggcgatgatgatgacgatggcagctatgattatgctccagctgcatgattggagtgaggtttatgagtgccccttaccgtggggtttctaacccaaaactttttgcaattctactatggagtgaggtttatgagtgcaccccccccccggtgcggctttaaagcaccttgtgactttggggttgtaaggaatatttcaattaaatgatattcaagggaaacatgggatcggattctatgtc

SEQ ID NO: 17185 - DNA, 253 bp, Gossypium hirsutum
  Clone ID: uC-gsflnu33B114d11b1
aacaagaaaaccagatcgaaaaatgtcgggaatcatgcacaagatcgaagaaacccttcacatgggagggcacaagaaggaagaagagaagcacaagggagaagctcatcacgaaggcggccatggccatggttatggcgccgctgagcacaagggagaagttcatcacgaaggcggccatggctatggttatggcgccgctgagcacaagggagaagttcatcacgaaggcggccatggctatggcgccgct

SEQ ID NO: 17186 - DNA, 533 bp, Gossypium hirsutum
  Clone ID: uC-gsflnu33B114e01b1
ggggtttgggagagttcgtggagaagataggttttacaatccggccaaggcgagaaggtcgtaccagaaacagcaaaccgatcaactacggagggctcaaagcgattatacggtcagtcaatcgaatgtgacccgggattcagagaaggggcttggttcaactgaccctcctaagccagttttggttcccgtttcagaaccggttgtctctccattgagtaatttagagcggtttttggactctgtcattccttccgtccccgcactttacctctctaagaggacgatgagagggtggcggacgtatgacggagaatttcagccatattttgtgttgggcgatttatgggagtcattcaaagaatggagtgcttatggagcaggagtcccactgattttgaatgtctgtgattctgttgttcagtattatgtaccttatttgtccggtattcaaatatacgcggattccgtgaaattgtcttgcagtccaggcaaccagttcaggatagtgatagcgactttagggactcgag

SEQ ID NO: 17187 - DNA, 520 bp, Gossypium hirsutum
  unsure (1)..(520): unsure at all n locations
  Clone ID: uC-gsflnu33B114e03b1
acggttaggcatgcggtcaagcatctatgcggcgaccagtagccagctgagtgggtatgatgccggtctcgcgaacagatattgcaatagaggcagctgatatagttctgctgaagagtaacttagaggatgtgatcacagccatacacctttccaggaaaacattttctcgtattcgccttaactatatttgggcattggggtataatatacttgggattccaatagctgcaggggctctatttccatcaactggatttcgcttacctccatggattgctggagctgccatggctgcttcctctgttagtgttgtttgctgctcactcttgttaaagaattacgagagacccaagaagctggaaaaccttgagattggtggaatacagattgagtaatagatgatgggagttctatatatccacatatatatctaagcaggnttgntatatatgtatatgtataggctagggatgtgaaatttggcaaactaaataataaaagtatcatgaaaagactg

SEQ ID NO: 17188 - DNA, 336 bp, Gossypium hirsutum
  Clone ID: uC-gsflnu33B114e04b1
acctcctctttctgagaaataccaatacgacagcaattaccaacctccgcctgagaaaatcgccgaggcacacaaggctgctcggtttgcggttggggccttagcatttgatgaagtgtcgacggcagtcgagcacttaaagaaatcacttgaattgctgactaatccatcggccagtcattaagtgttacccatttctggtgttttgaattatatgggttgatttgtgaagggtttttatttatttaaatagagtttggagattatgaacaactgttacttgtcttgtaattttcattcgagaatcagatcatgtttcatcatgtttttttattt

SEQ ID NO: 17189 - DNA, 528 bp, Gossypium hirsutum
  Clone ID: uC-gsflnu33B114e05b1
tttcctttccttcgttgctttcgccttaagcggtcacaatatttcgggtttgtaggttaatatgggaaccacggtcaaaggggttgtgctgtcgctgttcatctcgtcccttttgtgttctgtagtacttgcatccaatgatgggctggttagaattgggctgaaaaagatgaaattggatccaaacaaccggcttgctgcgcagcttgactcaaaggatagagaggctctcagagcatctattgctaaaaagtatcgcttccgtaatgatctaggagactctgaggaaactgatattgttgcactgaagaattacatggatgctcagtactatggtgagattggtatcggaactccaccgcaaaagttcactgtgatatttgacacaggaagctcaaatctgtgggtaccatcaactaagtgctatttctcggttgcatgtttcttccattccaagtacaagtcaagtgagtcaagtacttataagaagaatgggaaatctgcttctattcaatatggtactggagc

SEQ ID NO: 17190 - DNA, 53 bp, Gossypium hirsutum
  Clone ID: uC-gsflnu33B114e07b1
tttttggtttgtaaacattggagaacttaagggaaaaactaaacacactgatg

SEQ ID NO: 17191 - DNA, 426 bp, Gossypium hirsutum
  Clone ID: uC-gsflnu33B114e09b1
agccagggcccctgcggttccggtttccgtattccttgcccggcccacgctttcgttttcgcgttcgggcaaacccccaagggagaactggaaagagctgaaggtcgaagatgccggtcttgccgctttggtcggaatggagtgctttgcatggtattgcgcaagtgagatagcgggaaggggttttactttcaccggttactatgtttaaggggagtttggatttttgttcgccattgcacgattgtattacggacacactgggtgtgcatttttgctgttttcagagattcttgaagctgagaaaccagtgaattaacactcgggataacctgaataagttgatatagttgaaagttgaaacggcctttgttgataataagcccttgctattgactcattatctttacagaatttaatgcaccc

SEQ ID NO: 17192 - DNA, 373 bp, Gossypium hirsutum
  Clone ID: uC-gsflnu33B114e10b1
cgaaggaaactacatatatgaataatttgatcatatgtctcgggcttaaataagaaactccaaataatcataataaacatgcatttaaatattttataatagctgattaagcattagcttagatggcatcgtttgctgagttcaaacgtacttatgaaagcacaagtatgtatgttattgtcatgaaaatttgtaacctttgctttgtgtatgaaagtacatgcttctcctatgttatatgataatttcgtggtaaacacaaaaataaataaaaatatgctctctttttttgtgaaaaaaaaaaaaaaaaagaaaagacaataaaataaaaagactataataaaaaaaagaaaacaaaaatataaaactatcg

SEQ ID NO: 17193 - DNA, 346 bp, Gossypium hirsutum
  Clone ID: uC-gsflnu33B114e11b1
gttgatatatcctggtctgacttctgtagcgagctcatttcaatatttcgttcctgcgttgaaggagtgtgccttgcctaccctatgactatgatgtttgaggacggccagcctcatctttggatcctgattgtatgatatgaactgtatatattaattgttgagctagatcaaatgagcttgcaaaggtgaagagttgaacaaagagggcggccattctgaatgttccactcttactttcacatacaggccactgaataagccttttatagggtcacctaagttatattgggtggcggatactttacaacatgttgactgggaataccccgacatttcccaactt

SEQ ID NO: 17194 - DNA, 132 bp, Gossypium hirsutum
  Clone ID: uC-gsflnu33B114f01b1
ttttcattgtattttgcaaaaaaaaaaaaaaaagggaaaaaggaaaaaattaaaaagaagaaaaaaaaacaaataacaaaaaaaaaagggggggcggcgcgctactaagaggtatccaatgcttacattgcg

SEQ ID NO: 17195 - DNA, 390 bp, Gossypium hirsutum
  Clone ID: uC-gsflnu33B114f02b1
tttttcctttctacgccctaaaccaaaagtcatggccaccccttcctcacgtgaggaaaacgtttacctggcgaaactcgccgagcaagccgagcgctacgaggaaatggtcaagttcatggagaacgtcgtctgcgccgtccctgcccccgacgaactcaccgtcgaggaacggaacctcctctctgtcgcctacaaaaacgtgatcggcgctcgccgtgcctcttggcggatcgtttcctccatcgagcagaaagaggaaagacgtggcaacgccgaccacgtctctgtcatccgtgagtacaggggcaagatcgaggcccatattgccgggatttgcgccggtattgtgaagcttctcgacgagaagctcgttccgggcgcccggac

SEQ ID NO: 17196 - DNA, 306 bp, Gossypium hirsutum
  Clone ID: uC-gsflnu33B114f04b1
cccacgctttcggccaattgaaagaaacctaccttagggccaccatgaggagaatatgtctaagggtctgtcttccgtattttgaaaactttaccaaccgtgtgcatgttctagataaataaaaccaagaaactcattcttgttatccagctgcttattcaagtgatgtttcctattaaaccctacgcaaggattctgcttataaaactacccatactaagggagacaatggatatgatgctttttgttttatataaattatggaatttttttttcaacttaaatcatcgtatgttttttaggatt

SEQ ID NO: 17197 - DNA, 533 bp, Gossypium hirsutum
  Clone ID: uC-gsflnu33B114f05b1
cccacgcgtccgatctgtatttgcataaatatatatatctatatttgtatctgctactgagactgtatctattctgttttgttctgtttgtttgggttgagttacacactaaggttgttagctcaccctttttcttttatcccttcgggtgatcagcaaacctaggattagacgacgtgtagaagctttggattctctgaaataaaatggttttaaaagtccttgtgattgttatagaatttgtggactgtaaattattttgggactttattctccatttttgagttactttaacggatttaaccactactatatttctaaactgtaaaattatttgttttataaatcaaaccaagattttcaaaactctataacttagaaaatttctgctacaaaatgagatggtcactcaagtatttttctgtaataaaataaatagttttatttggtaattttcttaaaaattggaaaacggtctatcaaagttaacattgttatatttcacaatttctctttcaaaatctggttttaaa

SEQ ID NO: 17198 - DNA, 423 bp, Gossypium hirsutum
  Clone ID: uC-gsflnu33B114f07b1
ttttcgtgacctctttattcgtgaaggcttccagttcgattatgtctttgattggaccattttgaagtatcagcactcacagttgaccaatcctcccgctcgagcccttggcctcggtgctggaacaagttctcccctgccacctgccattgcgaatgctgacagacacacagctatggaggacacacgagcagctggtttgtcatccatggattcttctcggcggagagcatcaggacccttgatgagttctggaaattatgcgaagcagaagagtccagttgcaaatgatcattttattgggcagtcaggtggatcatcttcaaggcaagttggtgtttctagcagtcgtgatgcatttgctggtagcgatgttgacccacaacgttcttgtacagtctacgctagccccggagcactgca

SEQ ID NO: 17199 - DNA, 418 bp, Gossypium hirsutum
  Clone ID: uC-gsflnu33B114f08b1
tcgttttcgcgtccgcccacgcgtccgctgaaatattagcaaaaaagaaaaaaaaatagtgtaaacatgcatgtgaagaagattgttctactttttgtcatggtttcagcttttcttttatcaacttcaatggcaggtgggttctttcttcaatgtctctttttttttttgtgctgcagctttaatctggtgcaaaagtcatgcacgctttgtccacgaaatctttgtatcgggttacttaatgatcaatcgatttcatcactttaaaactacaaaaaacaagagttgtttagggtttataatacataaacagtttgacgacaaaattttacaggtcgacgacccaagttcctgaacttgttggctgaggaaacggatgcaagctttgaggatagtggtgaagcaagtgcagtccatg

SEQ ID NO: 17200 - DNA, 425 bp, Gossypium hirsutum
  Clone ID: uC-gsflnu33B114f09b1
gtcttttccacttctaaaacctttagcttttctcagagatggcgcagggaaggggcagtgcaagtcaagcgaccatgtccgcaattgcattgctattgtgcttaatggtttgcctggaaaccattgatgcagctacttacactgtcggtggctctaatggttggacttttaacacggctacttggccaaaagggaagcggttcagggccggcgacgtgctagtgttcaactacgatgcgactatccacaatgtagtagcagtgaacagacgagggtacactaattgtaccacacctgcaggtgccaaagtgtacaactcacggaaagataagataaaactggccaagggactcaacttctttatgtgcagcactgctggtcactgtgagtctggaatgaagattgcaataaatgcagtgtgacac

SEQ ID NO: 17201 - DNA, 411 bp, Gossypium hirsutum
  Clone ID: uC-gsflnu33B114f10b1
gttccacataaaggttaaacaacaacagtatataaagttataaacaacatattcttattgagagctgttccagtaaggataacagagtttgaaataatgcgcaactgttgaagtggaatgcaaagatcggaagagctcaagggcaagctttaggcaacaagtgaaaaccaataggcatggggaattcaaggttcatttgcctttttcagtgagcaaacatgtgaagaaaatcgagggatgtgaagttaaactgattaaaagcagtgagccatattgtgcagtggcctcatctgctacttcctcttcactccatctcaagtcaatgaagcaaggaacccatgttttctcagctgggtttttcaccttcaagccagtcaaacaaccaaccttatgcagccaaaaaccaagtgt

SEQ ID NO: 17202 - DNA, 455 bp, Gossypium hirsutum
  Clone ID: uC-gsflnu33B114f12b1
ccttcgcgtgcgatctcctctcctctacaaggaaatggctttttcatcaacagcggcagccactgccgcttcttctaagcttagatacccacacgcctcccctttcccaactcactcctcaaccaccacctctgcctttttctcctcaattccctctaaactaacccctacccacctctcctcttccttcctccctcctttcctcactaccgtcgccaccacttccgtattccctcgccgtcgcggttctttcaccgtcaaagctgcccgtggcaaattcgaacgcaaaaagccccacgtcaacatcggcaccatcggccatgtcgaccacggcaaaaccaccttaactgccgctctaactatggccttagcctccatgggtaacagtgccccaaaaaagtacgacgaaattgatgccgcccctgatgagcgtgcccgtggtatcaccattaaca

SEQ ID NO: 17203 - DNA, 517 bp, Gossypium hirsutum
  Clone ID: uC-gsflnu33B114g05b1
cccacgcgtccgcggacgcgtccgcccacgcgtgcgccaaatttcagtttctttcttctgattttccatgttagggaagcgaggtcgacccatgatcggaaacttatctgaattactagttccaacacataaatccgggttatcggatccttcaaggagccccaaaagtccactagacttattcaagaccccatcatcatcatcaagaagagggtcgatgaagagatgctatgatgtttttggtgatggagtagggcttggaatcattgcttcaatggagaaatccactgttgatcatcatccttcttgtaagctacaacacaccatttgtagattcaaaggaagatttcaagaaaattcagaagaggattacacttttgttacaagacatggagaatcatctacaaaagtttattttaatggaggtgacgaagaagaagaacagagacttgttggaaaaattaaggaaattacatctttaaaacccagatttgtgcaagatttcaactacccaaca

SEQ ID NO: 17204 - DNA, 433 bp, Gossypium hirsutum
  Clone ID: uC-gsflnu33B114g08b1
gcttctggatgcaattagcaagttagaagtttatcttaatcgcaacctggagagggctatgaaggaaaatgacagggtttatcttatgagggttccttctcctagttccttacctcctctccctgcattttcgatggtgaagtcgatgcagatgaatgatgtgttggatgcaagcaaggagaagatgtttgcaagtcttgttcctgacagcagtgcaaaggctctttccaggtatactgaaatggttgatgatgtcatcaggacacaggctgagaaattgcagcaaggaagtgagctaacccgtgttaggcttaaggaaatggacttgccagattcaattcttgctctggaagggaattttagtcttccagaagatcttaagaatgaggttgaaaaggtgcacgctagtgggggcccagctggtctggaggct

SEQ ID NO: 17205 - DNA, 186 bp, Gossypium hirsutum
  Clone ID: uC-gsflnu33B114g10b1
gttgatgtgataagagttggaagacaatacatattttttctgctatatttgagaatttgaactgttgcatcctactgcaaaatgagatctgatgcgaccttaataagtcaacagctttgaatcttaagatgctctcaacttgtagtttgaccaagtatagatacatgattggctatttatatatac

SEQ ID NO: 17206 - DNA, 369 bp, Gossypium hirsutum
  Clone ID: uC-gsflnu33B114g11b1
gtgttaccgtggacctattgggccggacgacggcttaaaggtgggtgatgtacaatcgacgttacacagggctgcaggggctgccaatgccgagggcagacgctctgacgggcgcatcttgaagtggaacagatccatggccgcctgcactcaagcgtgcacagacgtatgtgtgatagtgcaaagagagtgattcctataagcttgaggcgagggcggagggatggccccctcttatctacatgtgggtggtgaaccttcggttccgcgctgttcgtccagttcactcccagcattggcatctgggagtggcggtgatcccaatcattatgataccgatgccaacactgatgcccggtttaatgttat

SEQ ID NO: 17207 - DNA, 450 bp, Gossypium hirsutum
  Clone ID: uC-gsflnu33B114g12b1
aattaaaacacaccctaaagagacaatgagaaagctgctagcctttgcctttcttttcttcttcttttgggataaaacattagctcaaatagctccggcgccgccgttaaaggtggacaacatcacttccatcctcgaaaaaggtggccaattcaccactttcatcaagctattgaaagccacacaggtggctgatcaactaaacaaccagctaagcacaccggaccctaacgacgggataacggtgtttgcaccgagtgacaacgcgttctccggactcaaacccgggacgttaaactcactttccgaccaagagaagcttcagttggttcagttccatatactcccgacgttaatgtcgacgtcgcagtttcaaaccgcgagtaaccctttgagaacccaagctggggatgttaaaggtgggaagtttccgcttaatgtgacggcgga

SEQ ID NO: 17208 - DNA, 387 bp, Gossypium hirsutum
  Clone ID: uC-gsflnu33B114h01b1
gtcccattctccagaaactatatgcctacttgggcttttgatcacattaagtatttcaatggtggctctgagattcagctccaccttgacaaatacactggtactggtttccagtccaaaggatcatacttgttcggacacttcagtatgcaaataaagctagtccctggagattctgcggggactgtcactgccttttatttgtcttctcaaaactcagagcatgatgagatagattttgagttcttgggcaacagaacaaggcaaccatacattcttcagaccaatgtgttcactggtggcaaaggagacagagaacaaaggatttacctttggtttgacccaacaaaagaataccactcctactctgtcctctggaacatgtat

SEQ ID NO: 17209 - DNA, 323 bp, Gossypium hirsutum
  Clone ID: uC-gsflnu33B114h02b1
ctcatcgtgtttatcatcttgtcttctcgggctggccaatgtagagctgagtaaagcgctggttgagctgctttagtagtattcttttattacttatcgtgtttattatgattggacatcaagtggtgggtttaatgagcagtgtctctttcctcttggtagaagtagaattgagttctctctctaataaattgtatggatattgtttggtcagtgtatttgcagtgtgtggaacactattaattttggagagataatatatctatgtatttaatccatagcttttagatggttggtggatatatttatttttggtacgtatc

SEQ ID NO: 17210 - DNA, 321 bp, Gossypium hirsutum
  Clone ID: uC-gsflnu33B114h03b1
cttcctctttttgtacatatttttcccctccacggccatggccttgtctctgtttcattacctgccgaagcttgaccaaatggtttcgtgcgagtacagggacttgcctgaagtgaggattccaggctgcatacctattcgcggcaaagaaatgctggacccggctcaagacaggaaaaacgacgcttacaaatggctgcttcatcatgcaaagaggtatagattggctgaaggcataatggtgaacagtttcgtggagttggaagcaagaacaacgaaagcgttgcaagagaaagaacccgataaggccccagtttaccc

SEQ ID NO: 17211 - DNA, 532 bp, Gossypium hirsutum
  unsure (1)..(532): unsure at all n locations
  Clone ID: uC-gsflnu33B114h05b1
aataaatctcaattccccagcagcaatggctactccaagtgtagagtatttgcctcctccattggatgctactgcagagcaacctgctatctttgatggaacaatcaggttgtatctggcttatccttgcccttacgcacagcgcgtgtggatcgccaggaattgtaagggtttgcaagacaagattaagttggttcctttgaaccttcaaaatagacctgcttggtacaaggaaaaagtttaccctgaaaacaaggtgccgtccttggaacataatggcaaagtcattggggagagtcttgatttgattaaatatgttgatagcaacttcgaagggccgtctcttctacctgatgatgctgacaaaaaggagtactttaagacgttgttatcacacatggacgaatttccagggatggtgtatgctacatttaaaggagactcaacaaaggatgctgatgctgcttttgatctcttggaaactgctcttgcataatatgatggtccattcctnctaggcacgagtttactc

SEQ ID NO: 17212 - DNA, 449 bp, Gossypium hirsutum
  unsure (1)..(449): unsure at all n locations
  Clone ID: uC-gsflnu33B114h08b1
tttcgcgtccgcccacgcgtgcgcccgaagacgtggggaaactcctgactccgagacacagttgcttacagttcagttcgaatggaatggggttcttaaatccgtgtcacgtacattggttggggtgagtcctgagtttgaaattgctctctatactctgtgtttcttcgtgggtggagaggataactatgtacagctgggtccatactctgtgaacatcaagtgctaccgatttggaaataaaatcggttctgtatttccaatagcagaatgttgattttcagctctgngtgttattattattattattattatccagaagctacagaaacactatagatatcatgttcatgttcatgttcatgttcctgtctagcattagtttatgatatatcataacatatcttttacttggatcttttaacttacaaaattgataattatgatat

SEQ ID NO: 17213 - DNA, 412 bp, Gossypium hirsutum
  Clone ID: uC-gsflnu33B114h09b1
tcgcgaaaacctattgattctctctcccaaaccaaggcctcatatttgagcaagagcgtgagagagaacttacatagctgatacttcgatcatcaatttctggcctcttaattcgattccccgattacccgataccccaattttacagatcaggtctgagtgttctagttgttcggctgtttctatccgctaagtttcatgtctgatcttgacatccagattcctactgcctttgatccgtttgctgatgcaaatgctgaagacgctggtgctggtgccaaggaatacgttcacattcgtattcagcagcggaacggtaggaaaagcctgaccactgttcagggattgaagaaagaatttagctataacaaaattctcaaggacctgaagaaagaattttgttgcaatggca

SEQ ID NO: 17214 - DNA, 216 bp, Gossypium hirsutum
  unsure (1)..(216): unsure at all n locations
  Clone ID: uC-gsflnu33B114h10b1
ccctcgcgtccgccatgagatgatgaacaaaattaaaagtggtgggtttcaagacattgatgttattaataatggcaaaggaggtgggggtgggggcggtgccnccgtttgcggctaatccttgcccctactcacacctcgggtaggtcagccggatctcgtggggtcttcgtgtggtctttttgtttatatcctgggccctatggcatacccttc

SEQ ID NO: 17215 - DNA, 340 bp, Gossypium hirsutum
  Clone ID: uC-gsflnu33B115a07b1
tttccacgcgtccggccgcctcctaacaacatgggtgggatgccaccaggtccaccgaatcaaggatggtctggtaacatgggtggaaatgctcagaatttccaaaatccttaccaaggtaatacacagaacgtgcaatatccgaataactatccaccaaatatgggcgggcatggtgggaattaccagtcttagatatttgttttatatgaattgaaggaagacatttttaggaatattgtagataaagagaatatctgttgagcttgtggctattaaaatgaattgctgtactgctgtgcatgtttgctaagttcatcagtatatcttcataagtacg

SEQ ID NO: 17216 - DNA, 109 bp, Gossypium hirsutum
  Clone ID: uC-gsflnu33B115a08b1
tttctcactgtgtttataatgcttcttcattgttggttcctgtgtttgtattgtattatgattgatgattattaattcagacctttttatttataattctttattgttg

SEQ ID NO: 17217 - DNA, 228 bp, Gossypium hirsutum
  Clone ID: uC-gsflnu33B115a10b1
tatctttccacgcgtccgcccacgcgtccgtggttatcttaacagtttagaaacaagttctgcaggtttgctgtgggtgaaacgggaatcattgtagcggccttgtagtctctttcaaactcaatatatgcttgaggattttcttcccttctcttttccaaaaactaaagatgattactttaggaaatgtgtatgtgcaaagagatggccctacatttacaaacgaag

SEQ ID NO: 17218 - DNA, 510 bp, Gossypium hirsutum
  Clone ID: uC-gsflnu33B115b08b1
tctttccacgcgtccgaacgaatcccctactttgtgtaaggaaatcgatgaacatcttaaacaacaagtgcttggcttacgttatacccggcgaaaacactagcaaccgaagcaacaacgtcgtatacgagatcgaagggtcgtattcgcaaagatcgtgttccgtatacgatgacaggaggagattagccgcagagatcaagaaaaaagaggccgttcatggaggagttgcctacggaaacgacatctttcgccttgttgttcagcctggtcatatccggacggattttgccatggctctcgtgatccttcttgatcaaatgttcggatcttcaagacgataaccatctttaatttcttgcttttctttaccaaaacattgtctgactgtttgtctatctatatatcgatatgaaaatcatagcaacaatttccaaacttgcagcatctggttatatatatatatgtctggttttgatcatcttcaagctggtttgtttcgtttttgat

SEQ ID NO: 17219 - DNA, 522 bp, Gossypium hirsutum
  Clone ID: uC-gsflnu33B115b10b1
tcttccacgcgtccgcgcctccacgtatataaatcttttacagagctttctttctcgtttcgccattcgattttttgagcaaagcggcagcacagaacatagcttgaaactcgccatctctcacttctttagaaactaagagtcgaaaacgatggcgtatgctgcaatgaaaccgaccaagcctggtttggaggaatcccaagagcagattcacaaaatcaggatcactctctcctccaagaatgtgaaaaacctcgagaaagtttgtgctgacttggttcgtggtgccaaggataagagactgagggttaagggaccagtgagaatgcccaccaaggttcttcacatcaccacaaggaagtctccctgtggtgaaggaactaacacatgggatcggtttgaactccgtgttcacaagcgagttattgaccttttcagctctcccgacgtggtcaaacaaattactttcatcaccatcgaaacccgagttgaggtcgaggtcaccattgcgattcttaaatg

SEQ ID NO: 17220 - DNA, 415 bp, Gossypium hirsutum
  Clone ID: uC-gsflnu33B115b12b1
tcgttcacgcgtccgcaagatggcttcaaaaagaacagcatcgcttgccctcttctttgccctcaacgttctcttcttttctctagtcagtgcttgcggttcttgcccttcccccaacccaaaaccaaagcctactccttccccatccccctcaggcaaatgcccccaagatacccttaagttaggtgtctgtgctgaggtgcttggcttagtcaatgtaactgctggttcgcccccagtgcaaccatgctgctcccttctccaaggccttgctgatcttgaagctgttgtttgcctttgcacagcactcaaagctaacgttttgggcatcaaccttaatatcccagcttccctcagcttgcttcttaacgtctgcttaaagaaagttccatctggcttacaatgtccctaatta

SEQ ID NO: 17221 - DNA, 510 bp, Gossypium hirsutum
  Clone ID: uC-gsflnu33B115c02b1
tttttattttggcttttgacgtcaaggtgaccccgttggctcgagaactagcagatgaattgggtgtgaggatgaatattgctgatatcatttatcacttattcgaccaattcaaagcatatattgatggtctcaaagaggagagaaagagggaagcagcggatgaagcagtcttcccttgtgttttgaagattttacctaactgcatttttaacaagaaggatccaattgtcttgggggtggatatccttgaaggcattttaagggttgggacgccaatttgtattcctcaaagagaattcattgatattggtcgaatagcttcaattgagaataaccataaaccagttgattctgccaagaaaggccagaaggtagccattaagatagttggatccaataccgaggagcaacagaaaatgtatggaaggcattttgagcttgaagatgagcttgttagtcatatttctagaagatcgatcgatattctcaaagctaattatcgggatg

SEQ ID NO: 17222 - DNA, 380 bp, Gossypium hirsutum
  Clone ID: uC-gsflnu33B115c03b1
tccacgcgtccgtttttgttttcttgaactacctacctacctacctacctacctatatatatattgatgttttcatgcagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaaaaaaaattaaaaaaacaagaacagagggggggccatttaaaaaaaagaaaataacgacctcgctgaagaaaatgggtatttgtattaatgagcctgaaaaaaaccaaaataatcgcaaagattgaaaacaacagtgattagaaaaa

SEQ ID NO: 17223 - DNA, 514 bp, Gossypium hirsutum
  Clone ID: uC-gsflnu33B115c04b1
ttccacgcgtccgcttacacattgcttcctttggagcggaaggagttgtcattctaataatcgtcaagtactaatacagattattgtagttcttctataagaatgattatggttggaaaaatttctgagactgtcatgtttagacttttgtcaactcctaattcagtctcgttttgttagttcattggtagttggttagatagtgatggctgggttattcacttcttggtatcatttcacccttcgggttgtttcttgtattgtggctggttgcagcagttgattcactccttcctctgaatttctcgattagtggtatggaagggggcatttgatcatggggaaagattttgatactctgcgttatgcaagctatggaaaatactattatatgacgcttaacccaaagccgatcgggtttggggtgtctccttccttcaaaaggtccattcaagtgccttaaccttttatctttacatgcattacccttgtgtactgaaactattctatgctc

SEQ ID NO: 17224 - DNA, 506 bp, Gossypium hirsutum
  Clone ID: uC-gsflnu33B115c05b1
ttcaatctctgttatttgcttaagaacatatggggggagatatactgccgtatatcttaaacaggatggtcaatcccttactttgaagatatcaagtaacaataggagagtgtatatgcatgtgctgtcattataagttaatatagtaagtagtattgggtttaattgaggcgtgaaacttggtctatgtgtgaaggagctacaccctccaatgaagatgttgcttcccatatggaaggccttgtgtgctagcattgacaacaaagaaggtccagacacatgtggggaaggtgaaggtggctgatgtcaaggccgtgaaagtagaaagaggaatatatgaaaacacatcaattagcaaagaaaacgtatgtggattgcttgctgcaagcgtagagaagagataggggtaaaatgcattctcgtcagagtaaaaacaatttagtccttttttgtagaagaggatgagcattagagattatcagcaagctgtcttgtgttaaaggaac

SEQ ID NO: 17225 - DNA, 521 bp, Gossypium hirsutum
  unsure (1)..(521): unsure at all n locations
  Clone ID: uC-gsflnu33B115c06b1
tctttcgctatctgccttttccctttctctctatctgattcctatcgacaatggccgccgccgccacttcttcaccccgcgaggaaaatgtctacatggcgaaactcgccgagcaagccgaacgctacgaggaaatggttgagttcatggagaaagtctctgcctccgccgacaacgaggagctcaccgtcgaggaaaggaacctcctctccgtcgcttacaagaatgttatcggcgctcgccgtgcttcctggcgcatcatttcctccattgagcagaaagaggagagccgtggtaacgatgaccacgtcgctacgatccgtgattaccgggccaagatcgagtccgagcttacttcgatctgtaacgggatcttgaagctccttgacactaggcttgtcccctcggcttcctctggagattccaaggtcttctatcttaagatgaagggagattaccacaggtacttggccgagttcaagactggagctgaacngaaggaagctgctgagagtactctc

SEQ ID NO: 17226 - DNA, 396 bp, Gossypium hirsutum
  Clone ID: uC-gsflnu33B115c07b1
tttagaccgtaaaccatttcgatcaatatcaggttagttatggttggacagcaagtgccgcgttcgcacataaatattgatgaacatttgtttttggtggatgctcttgtcctctttgtagtattagaaattgagtttcttttaactcttaataaaatgttttggagctttcccttgcttgattctttttcagcactgtatctttttataagttgaaactaactaatgggttaatttgacggaccaattaaaaattttagacactgactacaatggcgccaacatctcaagtggccacgtaaaccctgccgtcaaccttcagtgcttttgttggcgggaacatcactctgttgcgcggcattctttactggatgggccaactcctaagatgaacca

SEQ ID NO: 17227 - DNA, 511 bp, Gossypium hirsutum
  Clone ID: uC-gsflnu33B115c08b1
ttccacgcgtccgcccacgcgtccggtttgggcttgctgtaccctctacaactgttgatgaggaagagaaaaggaaagctcgtcttgcccgattttcaccatattccaaacctgacaccattgaaggagaaaaaagaaaagcaagggcaatcaggttttcggatcccctgtcaacttctttagcacaggaggctcctgttgctggaaaggctgctggaggactctaaataaaaattaccatagttagaaggtctagtgtcctaacagcttgtgattcgctcagcagcttccttacaatgttttatttctaacatcaaaatttaagatgcaatactccatctccagatgaatttctaaagaattggcaatgttcttttggcagtttggaaggtgttttacagtgtctattcatttggtgaggcctattggaatcaacaaccacctggagtgttaacctctcttaaatcctacaaaaagcattagaaattctggagtaatggctataaatttt

SEQ ID NO: 17228 - DNA, 463 bp, Gossypium hirsutum
  Clone ID: uC-gsflnu33B115c09b1
tctttttctaaagatttttttcaagctagctatgggaactcttgcaatcgataccgagtgtgtggattctgacatataccgtgctttgggattcaaagaattgggtaaaggagttgttggaactccacggattttgtcactgctttcttcgcttcttgaggaatccgtccaaagaaacgagatggagtccgagacggtgaagttcaaagataatgttgccatgtttcatgggttaagagctcccaccataagcattcagcattatattgatcgcatcttcaagtatgctggctgcagtccgttgtgctttctcgttgcatacatttatgtggatagatttgttcaacaaacggatgtgcatttgacttcccttaatgttcaccgactcctcataaccagtgtattggtagccgcaaagtttattgatgatgcgtttttcaacaatgcatattatgcgcgagtg

SEQ ID NO: 17229 - DNA, 513 bp, Gossypium hirsutum
  Clone ID: uC-gsflnu33B115c11b1
tcccacgcgtccggaacaaggtccatacccttttgaacaagcattcgagtccttcatcaatggcgtttcacacttcggtccatttttcgaccacgttttacagtactgggaccaaagcttgaaatcccccaacaagatactgttcttaaagtacgaagacctcaaaaaggaccccaaaggtgaggttaagaaactggcttcgttccttggaaaaccattcaataatgagaaagaggttgaagacgtaatatggaggtgcagcttggagaggctgaagaacttggaggtgaacaagaatgggatcgacccttgggttgggatgcaaaacagtgcattcttcaggtctggaattgttggagattggaaaaacattatgagtaaagagttgagtgagcgtttggatcaaatcacgaggcagaaatttaaggattctgggcttcaccttgagatatgaacccccctttggacctcttctctcgttatcttttgcatcatggaataaaatcaataatt

SEQ ID NO: 17230 - DNA, 515 bp, Gossypium hirsutum
  unsure (1)..(515): unsure at all n locations
  Clone ID: uC-gsflnu33B115c12b1
tcgttcacgcgtccggaatgcggcccatgtcatcaagataccctgggagtatacagcaatcttgcagcaacttatgatgctatgggaagggtcgaagatgcaatcgagatattggagtatgtactaaaattacgagaagaaaaacttggaatagcaaatcctgattttgaagacgaaaagaataggctggctgagctcctgaaagaagcgggcaggccacgcaacagaaaagcaaaatcactggaaaatctcatcgatccgaactcaaagaggacggcgaagaaagaggggacgaaaaaatggggtttcagaatttgaaaggaggcatttcccaggtcgtatctaatctgtttttccaacttatatccacattctgtatcatggaagatcatgtatagtgttacaagttgtaatttcttgagctttctggttttggagctttaagatttcatattttttttcccttaacctttttactattgttatttgngttattgaatgtctgtgatgtgctc

SEQ ID NO: 17231 - DNA, 433 bp, Gossypium hirsutum
  Clone ID: uC-gsflnu33B115d01b1
tttctcgcgatcgctggaatgaaaccaggatccaaccgtttatcactatggcatacatgactgcaaaaaagtcagtcatgaggtcagagaggaggccttagcacgtgcctatggagcatttgacggaccatcttcggcactccataactcaaactaaaactaagactctttttaacagcctctggagcaatgatgtgagcggctatggggatagcttatggcataaaagaatacattatctccttgcagctccgtatacggatgagtatagctccgatgatcgctccaacgagcgagctacatggactgtaacagatacccgttttgaagacggccattaagtccatcatgatgttcaccaagctgatacccaacctgatagctagatagactgcttgagcacctgcatgagcctgatctgtgaatggagctt

SEQ ID NO: 17232 - DNA, 510 bp, Gossypium hirsutum
  unsure (1)..(510): unsure at all n locations
  Clone ID: uC-gsflnu33B115d03b1
ttcctcgcgtccggcttattcagctctgccaggcgttggacaataatgattttgggacagctctacatatccaggttcttctgactaccaatgagtgggacgaatgcaacttttggcttgcaactctgaaacggatgattaagacaaggcagaatgtaagataagtgataaagatggcaaaaactgtccgaggatgtgttcatttttgcttgtgtacatttggggcaatgataaaagcccttggatgtagacaaagaatagcttctcttgattgctgctgcagaatatatagattggatcttttgatcccattgcataaacgcccctcctggatttggtagatattgacttttgcctttacacattaatactccttttgaaagcaaagcagttactggaaatagttttcaggacactatgtttgactgtttttttcatcgagtagagttgactcttttagttcagctatcacttctctttnttccttcttntttgttggctgaaattcct

SEQ ID NO: 17233 - DNA, 494 bp, Gossypium hirsutum
  Clone ID: uC-gsflnu33B115d04b1
ttccacgcgtccgcccacgcgtccgcccacgcgtccgcctaatcaggttgtcagtatactttgttagattcagatacagaagcagaatcagaatcagggtttgaaaaaaaatgcagatcttcgtgaaaaccctaacagggaagaccataaccctagaggtcgaatccagcgacactatcgacaatgttaaggccaagatccaggacaaggaaggtattccaccggaccagcagagattgatcttcgctggaaagcagctcgaagatggccgtactcttgctgactacaatattcagaaagaatcaaccttgcatctggttctgagacttcgtggtggcattatcgagccttctttgatggcattggctaggaaatacaaccaggacaagatgatctgccgcaagtgttatgctcgtctgcacccccgtgccgtgaactgcaggaaaaagaagtgtggacacagcaatcaactgaggccaaagaagaagatcaag

SEQ ID NO: 17234 - DNA, 181 bp, Gossypium hirsutum
  Clone ID: uC-gsflnu33B115d06b1
ttccacgcgtccggtaaatttaagctgttaaataacattgggccggtttttcttggagaataatattctgttttgtaatttcaattggagaagctcttttgtatttcatcttgtcttttccttttccttttttcgccggcattgtttgaacatggggttgtgcgcccgtcaattccagttt

SEQ ID NO: 17235 - DNA, 432 bp, Gossypium hirsutum
  Clone ID: uC-gsflnu33B115d07b1
ttccacgcgtccgttcaatgctggtggtggtggcactggttctggtcttggatctcttctcttggagcgtctctctggtgactatggaacgaagtcaaagcttggcttcactgcctatccttcacctcaggcttctacatcagggtgagagccttacaacagtgcgctgtccactcattcgcttcttgagcacactgatggcgctgttcttacggataacgaagcagtatatgacatgctcaggcgttctttttacattgcacgacccatttataccaactttaaccacctaggctgtaaagtcatctaatctgttaccacatctacaaggcaagctggacccctgaatgtacatgagactgagttccagactatcctgttcccatattcaacgatccaccaaatgcttttttcttatgcccctgtctttcc

SEQ ID NO: 17236 - DNA, 428 bp, Gossypium hirsutum
  Clone ID: uC-gsflnu33B115d08b1
tcttgcgttggtgtgacatttgcaacactagaaaccaagatcgtgctctccatgattctacaacgttacaccattacgctctccgctgcctatatccactctccgatatccattctcagcattagaccacaacatgaaattcaggtgatacttgaaccactgcatcataatgcttgaagtacatagctgataagaactaagggtttaacgtggttcatgtattttaggtttaagagatgagcacttaacatgtttaaggttccagcattggcatccccttccctatcctacgctatacccacctttatacataatggaattcaagtagctactgatttccaagatggtaaaacgcaatcatacagaagaatatgttgaggcaagtttcgtgaacagtgacttgaaaactgacatctgcactcggtacg

SEQ ID NO: 17237 - DNA, 505 bp, Gossypium hirsutum
  Clone ID: uC-gsflnu33B115d09b1
tttccacgcgtccgcaagtgtgtagttgttgcagaagagtaaaatcgtaaagagtcacagctgagacacggaagaagatgccttgcctaaacctttcaaccaacgtcaatctcgacggcgtcgacacctccgccatcctttccgaagccacctctttcgtcgctaaactcatcggcaaacctgaggcctatgtgatgattgtgttgaagggttcagtacccatgtcatttggtggtactgagcagccagctgcctatggagaactggtatcaattgggggccttagtccagatgtgaacaagaaactgagtgctgcaattgctgcaattcttgaaaccaagctacaagtgccaaagtcacggttttttctcaaattctatgacaccaagggatccaactttggatggaacggatccaccttctgagcctggcatgttctgaatttctcgaaacatcagtgatgtctattcaaaacactcttactcgtacggagaactggtgtgag

SEQ ID NO: 17238 - DNA, 503 bp, Gossypium hirsutum
  Clone ID: uC-gsflnu33B115d10b1
tgttcttccacgcgtccggtacttatgtgttgatgtttcatattttatatactgctgatgattatggtacgaacttactaagcttttgaaagcttactttgtgtgtgtgtttgcattgttttatagatattaaagctactgtcagcttggggatcgtcaaggatcatcaccacactatcaaacctaattttggtactttgaaaatgtaaatattaaagtatggcatgtataggctagaagttatggaattatgttttgtgatgtatatatttagccatgtgatatggcttggtatggttgtggatatgtcatggttttggtataagatatgtgatgcaatatgatatatttgatatgttttagttggacaaaagaaatggtaaatgttggtaagttttggcaagttttagcatgaaattgaatgatgtatagaaataaatgtattgacaagcttttgacttatgttctgaataaattgtaaggcttttgagatatatttgatt

SEQ ID NO: 17239 - DNA, 506 bp, Gossypium hirsutum
  Clone ID: uC-gsflnu33B115d11b1
ttctttccacgcgtccgatcaaagaggaggtgactgactgtaagcagagaacacagcaaatttttttttttaaatgggtgggaaaatcagcatggctgcattttttgtagttttggctgcaaatgtgttgcagagtacgtatggtgcaacttataaggtgggtggctccactggctggcgagtccctaccaatattgatttttacgaagattgggctgatgataaagtcttcgttgttggggatgctcttgttttcaactttactactggaaagcataatgttgcagtggtgaccgaagctgcttacgaggcgtgcaacaccaccgatactataactatcatatgcgacggaccggcaaggattacccttaacaggaccggcaatttttacttcatttgtgctgtccccggtcactgttccggcgggcaaaagctcagggtcgaagtcagaaatgggaaccgccacgctgctgcttccgcaccctgaccaatgcccaatagtaagc

SEQ ID NO: 17240 - DNA, 497 bp, Gossypium hirsutum
  Clone ID: uC-gsflnu33B115d12b1
taaaatggttgagaaaacaaggggaagaaaggaagaggtggtgaccagagaatacaccatcaaccttcacaagagactccatggctgcacattcaagaagaaggctcccaaggctataaaggagatcaggaaatttgccgaaaaagccatggggacaaaggatgtacgagtcgacgtgaagctgaacaagcacatatggagccgagggatccgaagtgtcccaagaaggattagggttcgtattgctcggaggagaaacgatgacgaagatgcaaaggaagagctctactctttggtaactgttgctgaaatcccagctgaaggactgaaaggcttgggcaccaaagtcattgacgatgatgatgagtaatttattggttttcttttagtttatgaaaacttttaaaattttgtttgagaccgacaactttatcattagaattttttgggttaagtcttgtagtaatttcttgtgagacattaaagtttttcctcgt

SEQ ID NO: 17241 - DNA, 367 bp, Gossypium hirsutum
  Clone ID: uC-gsflnu33B115e01b1
tttattggtggcatcacgatagtgaatgacgctttcaatgccaatcccgacagcgtcaaagccggcatcaacacgttgaaaaacatccattgcgatggacaaagagttgctattcttggggacatgtatgaactctgtactcatgagatagagtatcatgaggaggtattaaactattgtcttgatgcctgtattgatgtaattgccattgctgggcagaggtttcatttatcagctgacaatatgaatctaatgaagaagactaatgctgtacgtgctgatgaaacagaaaatcttattactaacatctagaactgtttgaatatgaatgatgaacacctagagtagggagggcgtcagatgcaaa

SEQ ID NO: 17242 - DNA, 515 bp, Gossypium hirsutum
  Clone ID: uC-gsflnu33B115e02b1
ttttctttactcccttatgacacgcgccgttttgatcggtttaccttggaacccatacgatcccttccccttgccctttccctttcaggcaccctttggatttgaaaaaaacccaattattatattcattattgtgttcttaattgcggttctcattttgctatgatctttcttcaatacatcatagaagcatttggtcatctcgtctacttgtctctgcaacctattgttggtaactcggtatggagagcggagagtggagaatcggaaatggctttttagggcttggcctaaggtgaatcgccatgctttaaacatgctttcacagttttactcgcacccgaaacccatctcttgcatttttagactctctgcaaatattgagactctctgagttaaaggagcctttgttcctgactgatgaagggccataagaggttgctagttcaaacctacacgaaatttatgggtttaggcatttcatgggagcagccgaagatagtgaaccacccttg

SEQ ID NO: 17243 - DNA, 482 bp, Gossypium hirsutum
  Clone ID: uC-gsflnu33B115e03b1
tccttcgcgtccggagccttttgctctctccccctctcccttcttcctttcggctagggtttttaaacccatcatcgccggcagtccttcattcatccaccatggacagtggtcgtggcagcatcaaacgggcttttcagcccttgatcaagccacgtttgaaggccaagccttcaaggcctgggcaatcgagattgggaggcttccccctctccctttggagtttgaacccgatgtcggagggaggagttccggcgacgcgatttgattcgagcggtgtgaacgctggtggtagcagggaggcacatgggtggtacggtgcaaagcagaagggctagggttagggtttccaaaaattttaaaaggattgggcctatcaggctctattttgttgggtttgtgaaattaggtagtgcattgggccatagagtatttgggctttgtatatggactttaaacaaattttttatgaatttggactg

SEQ ID NO: 17244 - DNA, 504 bp, Gossypium hirsutum
  Clone ID: uC-gsflnu33B115e04b1
ttcctcgcgtccgcctgatgcttttgatactgagcagcttctggaatgtgttgagaagcttaaaagtgggcaatctgttcaggtcccgatctatgattttaagcaacatcgtcggtcttcggatagtttccgacaggttaatgcttctgatgtcataattttggaaggaattcttgttttccatgaccagcgtgtcaggaaccttatgaatatgaagatttttgttgatacagatgctgatgtgaggcttgctcgtagaataagacgagatacagttgagaggggtagggatgtaaactctgttcttgaacaatacgcgaagtttgtcaagcctgcatttgatgattttgttctgccatcaaagaaatatgctgatgacatcatcccccgaggaggtgataatcatgttgcgattgacttgattgtgcaacatatccgcactaagcttgatgagcatgacctctgcaaaatatatcccactgtgtatgtcatccagtcaacatt

SEQ ID NO: 17245 - DNA, 405 bp, Gossypium hirsutum
  Clone ID: uC-gsflnu33B115e07b1
tgtcacttacattacctacaaaatcagagccactcctttcaccatgtcttctgccaatggcggctataccacagttcatttcttactttttcttttgagccctctcgttctcggaaatacatggatgggatctgcataaggaacaggcctaaatgcgaacacaaagtgagaaaaaggggaccaacaaggaactaacaaaccagattagaagaataaggagcaagagccaaggttgggccccgagacccaaaatggctatgggctttacggtcactagtcttggcatctacctactagcaccgtcagtaccaaagaaacctatgaaccctaagtcacacctgtgaaataccacgctgactaaccctacaataacatgccatggtacaaagccaacgacagagactc

SEQ ID NO: 17246 - DNA, 512 bp, Gossypium hirsutum
  Clone ID: uC-gsflnu33B115e09b1
tggcatttttaaggttgctgacccctgccactgccatagccgctgcctctgcctctgctctgcctgccgcctttgttttctcttcttcttcttcttcttcctcctcctcttctcgcaattcttctcatttccccaacgcaaaaagcctccctttcctctcttcaccacccaatcgcttaggccttataaggaacttcgcgacctctcccattgctcttaacatggattcaccctcatctaatcacaacccatctcaggaaaatgggtccttgcctgaccttcttactgagtatatggtggatatgaagtgtgaaggttgtgttactgcggtcaagaataagctacaaacagttgatggagtcaagagtgtggaagttgacttgagcaatcaagtggtgagagtacttggtaattcgcctgtgaaaactatgaatgaagcattggagcagactggtcgaaaagctagattaataggtcaaggagtgccagaagactttttagtttctgcagct

SEQ ID NO: 17247 - DNA, 506 bp, Gossypium hirsutum
  Clone ID: uC-gsflnu33B115e10b1
tttccacgcgtccggaaccatccatggctaattgctccttggcactgctttagccaatgcgttaaagaacgtggcattgccttcaagaaagctcatgggcgtgagatatgggatttggcatcaggaaatcctgaattcaacaagctttttaatgatggcttggcttgtacatccaaggtcgtcaccagtgcgatcctatcgggttacaaacaagggttaagctccattgaatcattggttgatgtcggaggtgggattggaggtttaatatcagagatcgtcaaagcatatccacacatcaaaggtgttaacttcgatttaccgcatgttgtcttggcggcaccagcatacaatgggatctttcatgttggcggtgacatgttccatgccattccaaatgctaatgcggtgattatgaagtgggtattgcatgattggggtgatgaagattgcatcaaaatattaaggaactgcaggaaagcaattccaagagaaaatgggaagtg

SEQ ID NO: 17248 - DNA, 489 bp, Gossypium hirsutum
  unsure (1)..(489): unsure at all n locations
  Clone ID: uC-gsflnu33B115f05b1
tcctcgcgtccggccccattccataaactgtcaccaccttcgcatactttcctttcaaagttctaatcttcgagatctccgaagatccaaagatccaactctcccaaaccttaaaaagcttcaaagggtttctccctttagccataacaaaaactgggtctcatttgttttgatctaaaaaaggatgaaggtcactctagtttctcggagtgggagagagttcatcaaaggtggccttgagcttaatgactcggctactgtggctgatctgcaggaagcaattcacaagagaactaaaaagttctatccttcaagacaaagactaacacttcccgtgccatcgggatcaagggagaggcctgtcatccttaactacaagaagagtctcaaagactactgcgatggaaatgagaacaccttaaccatagtgttcaaggacttgngtccacaagtgtcgtatcgaacacttttcttcttcgaatacttggg

SEQ ID NO: 17249 - DNA, 352 bp, Gossypium hirsutum
  Clone ID: uC-gsflnu33B115f08b1
ttagaacatttgaaagctgttcaactgatacatttcaaataaagggtccttgcacataccagatttgctatctttacctctacaggagtggatatgatggttggaagccagagagcgtgactgtgtacggatattataccaaagctgccacatttaattacaatgtctttattcctaatggggtttggtatggctttgatttctgttatggaaggggttccgcatctgcatgaacaatgtagcaaattgttgggggggggttcagtttgtgaatctttattcagggatttggagaaataagcttcttgttttaacattttgggtaataatgagtaatgacttgttttgtctg

SEQ ID NO: 17250 - DNA, 435 bp, Gossypium hirsutum
  Clone ID: uC-gsflnu33B115f09b1
ttcaatgtctcgtcgagagggtcgtgattccgactctagacgacaccgttctgggttcgaccgtgaacccaggtactccctttcgtttcccaatccttgatttcaaacccaaatgatgccttcaattctaacattacccccatgtatttcaaatgggttttcaatcttgtttaattttgtctaaagatttaattttgtttatgttgtttagccctaagaggtctaggagagatgggaaacctcagactgaaagacaggtctccagcgctgacgtcggagacaggcccgaccaggaggagaaacagcgccgtcggttgcaagatgctgtaccccttgaggcggccccgacacctcctgattcttctaagattgaaactgtgattgttggtaaggattctgataggaaaaacaatggacaacatgaaggaagccagc

SEQ ID NO: 17251 - DNA, 504 bp, Gossypium hirsutum
  Clone ID: uC-gsflnu33B115f12b1
ttccacgcgtccgtttcgatgtcggtgatcgctgtgtaattgacggaatacagatgatcgttgaagagatgaacattctgactaccgtgtttctgagatacgacaacgagaaaatattctatcctaattcagttctagcaaccaaaccgatcagtaacttctataggagtccagagatgagtgattccgtagagttcacagttgatgtttccacatcaatagagcaaattggagagttgaaagctaaaataaaagagtatctggagagcaagcctcagcattggcgacctggacatagtgtacaagtgaaggacattgaaaatgtgaataagatgaaaatgggtctttatgtgactcacaccataaactttcagaactatggagataagagcagccggagatcagaactggtgttggaactgaagagaatttttgaagctctaaatattaaataccatcttctgccacaagaagttcaggtcacctatgttggctcacttgcat

SEQ ID NO: 17252 - DNA, 492 bp, Gossypium hirsutum
  Clone ID: uC-gsflnu33B115g05b1
ttctttggcttcattaattggctgcaaagctctcatctctctttgaccatgtcgtcgattaaaaccattaaggtcagcaatgtttctttacaagctactgagcgagacatcaatgagttcttttccttttctggtgatatagaatatgtagaaatgcagagtgacaatgagcggtctctaattgcctatgttaccttcaaggattcacaaggagcagagactgctattcttctttcggtaattcaactgcatactattaataaatgctataatacgtgacatttttcgtggaaatggctgcttctggtttctttgttcataaccatagtaaaagaaatttgcagcgcgatttttgtcttgccagaccgtgcaaatattgaaaaatctttgatttttatgactaaacagtaataacaaccattgactttatatttttttggtatcttttttgctgctatctttttttaaactgaatttatcttatcttttatt

SEQ ID NO: 17253 - DNA, 469 bp, Gossypium hirsutum
  Clone ID: uC-gsflnu33B115g07b1
tcgtggacgcgtgggcaagtcatatatttcttgtagctaataagatcccagaaaaaaaaaatggttctcggagatctagcgagttctatcggtaatgtcgtcagcgacattaccggcatcaataaaaccaccaagaccgtcacaggcagtgttgttttagttaagaagaattttttggacttcacttccttgacctcaaccgaagttgatggccttttcgagttgcttggcaatggtgtcactctccagctcgtcagtgctgaaaatactgatcctgcaaatgaaaatggaggaaagctggggaaattagaggcattggagtattggaacctgacatatactcctacattggctggtagtgattcgttgtataaggtttcatttgaatgggacgaagagcttggaattcctggagctatcatcctacgaaataatcatgcggctagagtttttctaaagacaattactc

SEQ ID NO: 17254 - DNA, 388 bp, Gossypium hirsutum
  Clone ID: uC-gsflnu33B115g08b1
tcttctggttaatttccatgctgttggtagtatttaaaagtaagacaaattttgtttataatttcacaaaatttttcaaggaaaatgtcttcatatggtgccattttctgcagattgaagttgtcgatctagtttctgaaggatgtactggaggcaagttgagttcaacaacactaaggaagcttgaagctgagaaagccaaaaaccagtagtctgccacaagcttgatggtaacaagctgatatcatatcaatggctgcaagaaaggtggccatatttcgatggttctttttttttttcctttttctttttgtgaaactccaacagcaaaaatgtacaaggacacctgaaatttaataaaattaagcatgcaagtgtcttcttattc

SEQ ID NO: 17255 - DNA, 442 bp, Gossypium hirsutum
  Clone ID: uC-gsflnu33B115g11b1
ttgccctcgttcgttgttccttccgctcccctaccattcggttgggtgggctgttgggcggtgtgcgtgggcgctactactagtacgcaataggcatatgagtggtgttttggttgtgtgtattggcaggctccatgctactcgcatcgaactgtcgagccgcactcctcttcattaactccccttgttgtaatcgaactcaaggggtgcgatcgggatcctgtgctgcgtacctaagccagatggaattatggatgtgttgccgtcccttctccatcccgtgcccttcggggtgcgtggtggacctcaatcgtgccttgtgtcccgagtgcgcccccttaaatcggtgtggccttggcggagcactggtgctcgatcgtgcttttggatgcggaaaatgtttttgagagtagggttcatgccctcattttcgatgcctatg

SEQ ID NO: 17256 - DNA, 343 bp, Gossypium hirsutum
  Clone ID: uC-gsflnu33B115h07b1
ccgcgcgtttcttaaaaagaacaggcaaagctttcttggtattacgcaattagcaacaaatgtaaatcctgaaacttggccttccaagaaagtcctgcaactttataacaatgctgaggaaaacataaaaaagggcatgctgatgtgggaggaattacaagtgcaacgcctacgtgagctttccaaaccgaatgaggaacaaaatcaaataatgggattggatggtttattcaaagatatatcagcagacgaggttgcagagcaggctctcacaatgagtgctcagataaaccttttatggggtaccattctttacgaacgctcgatcatggaattcaaacta

SEQ ID NO: 17257 - DNA, 380 bp, Gossypium hirsutum
  Clone ID: uC-gsflnu33B115h08b1
tctgcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttgtttgggagcaaattttccttttgtccaaaggattttttgctgctcattcatggagacttggtttatggttttatctgttgttaaaatcttataaaaatatatatcgattgctgctcttggtttgttaactaaaaaaacatagaaaacaaataccaattgaataaacaatttgcaaggaaatattaaggtttaaaaaagggcggc

SEQ ID NO: 17258 - DNA, 511 bp, Gossypium hirsutum
  Clone ID: uC-gsflnu33B115h09b1
tatttccttatccgagggcttcgatttgtcaccgttgtttgaggagaagaagagagaagagaaagaggagctaagattcgctacaacaaggccagcgagcagtgtaatatcgagactggaagaggtggccaagtcgatgaatttcagcgtcaagaagagcgagtcaagtgtacgactgcagggtcaagaatgtggacggaaagggaaattagccatcgctgctgacattttcgcattgacaccgtcgtttctggtggtggaagttaaaaaagaccatggtgatacccttgaatacaaccagttttgcagtaaagagcaccgaccggcgcttaaggacatcgtctggacgtcgcccgccgataactcgactgtcgcttgacttttattatgttctagtccattggttcataatggttgtattattggttagatagaaaaccagaaccagaagatgttctgggtttggtccgttgtgattatgtctaagatggaagcatacgagcatcattcg

SEQ ID NO: 17259 - DNA, 482 bp, Gossypium hirsutum
  Clone ID: uC-gsflnu33B115h11b1
tcttttacgctttcgatactcatttaaccccttgcattaacatcaaaatcactccagatttctcaatcactgaaaaatggcttgctgaggtggaaactgtggctgcggcactggctgcaagagtggccatggctgtggaggatgcaagatgtatccagacctgaacgctgccgagatgaccacaactgacactctggatcttggtgtagcaccccagaaagcacactttgagggagctgaaatggaatttgtggctgagaacgactgcaagtgtggagacaactggacctgcatcccttgcaattgaaaatgattagagaccaaagtcaaagctccctggaagcagaggcgcctttgtctttaagaaataatatgttttgctggacatgagcttttagaataaagaaagcatggccttgtcgcacgatatgcctgttggcgtcactgatactagatgcttgccaatatttagagggaagccc

SEQ ID NO: 17260 - DNA, 510 bp, Gossypium hirsutum
  Clone ID: uC-gsflnu33B115h12b1
tcgtctgttacttataattcactcaaatattttaggagatatttacctgttacttataattcagaatatttaggaaatattcacctgttacttataattcgaggagtatcttctttttctttgaatttggttttcaactcatccgttgcttttctcaatctgcttggatattatcaaattcggttactgggtagtctgtttcagggtaggttcttcttttcttttgaactttacttcaaaattttctaagtaatgcttttgtttgcagtctctctttgcaacattttaacttaagataattttgatgcatcattaataagcatactgtgcatgcccatattttagcttctaggaatacatggctgctttcaacaaatagagaccaaaaagaaaaaaaacctttcttagcaagatgattgtaattacttaatttcttagggaatgtcatgaatgcattgcacgagattgaatcaatttcgaagtgatcaaagaatcctgttctgatccaag

SEQ ID NO: 17261 - DNA, 387 bp, Gossypium hirsutum
  Clone ID: uC-gsflnu33B126a01b1
tttcttgcgtccggccacgcgtccgaccacgcgtgcggccacgcgtccgtccacgcgtgcgtccacgcgttcgtccacgcgttcggccacgcgtccgaacttaattaatggatagaccatggcaagaaaatcccatgtcgaatcgtctgctattactattactatcagtactgatctaagaataaaactggcagctttgtactgagtttgcatttgaatatttgtatgctaggtttgattatgctgttatgagtgggggagcgcattgttttgtttttatgtaatgaattaaatctactatgtgcttttatttgagtgatattatttatatatgggttcataagatcattgagaccatcaaagaagttgtaaaaagggaatgtcctg

SEQ ID NO: 17262 - DNA, 439 bp, Gossypium hirsutum
  Clone ID: uC-gsflnu33B126a05b1
tgaatgcttatctcttttcgtctctgaatctgatcaatcaacacctgaaaaggaaaacttacaaacaacaactactactagtctactacccagcactagaagcagctcgtagccagccatggatgaagagtacgatgtcatagttctaggaactggtctcaaggaatgcatcctcagcggtcttctttctgttgacggactcaaggttctgcatatggataggaatgattactatggaggagagtctacatcactcaacctcattcagctctggaagaagtttagaggaaatgataagcctcctgctcatttgggctctagcagagattataatgtggacatggaccctaagtttatgatggcaaatggcactcttgtgcgtggacttattcatacggatgttacaaagtatctttacttcaaagctgtggatggtagc

SEQ ID NO: 17263 - DNA, 429 bp, Gossypium hirsutum
  Clone ID: uC-gsflnu33B126a06b1
ttagtttttctgaaacatttggatttcagaaactttttatgtctaaagaaaaacaaaaaaagcatgcaggcggcgaatgtggagctctaccgggttctcgtcgaaaacggcgttggatcctacggcggctttccttccggttccgagtgtccggctatgcaaagcttatccagttcctcgacgtagtaccctttggagatgttcggtgttaccaccgagacgacaccggatgatagagcacttgcggtgttgaggaaccacaaggaggtattcaatcggcggagagagagaattaactcgcatcttaacaggcttagagcccttatgccttgcaattctaagacagatatggcttcacttgtagcggagggggaccaactagtaaaagaactaaaagagcaagccctcgagacaactgagctcgacaac

SEQ ID NO: 17264 - DNA, 344 bp, Gossypium hirsutum
  Clone ID: uC-gsflnu33B126a11b1
ttataagagaaaaagttattgaagaaaggatgcaaatgtcaaactgacagatgctcaagccctataacacccgagggtatagaagaaggaggaaatgcgactgatatccctgctgatatttctgtccttaacaacctgcgacagggggggctttttaggcgaccgaagcaccttgctctgcgggcctcagcttgcactcttttttggggaacacatagctgatcttcgggcccagtttgatccacccgatgggggggaaaacccttggtttacccccgaagagatgggacggggccctccctccttatctcccttggaaaatgaaggaacggcgcgcccttgag

SEQ ID NO: 17265 - DNA, 573 bp, Gossypium hirsutum
  unsure (1)..(573): unsure at all n locations
  Clone ID: uC-gsflnu33B126b06b1
tccactcgtccgcccacgcgtccgaatttctataagtcctttcccatctgcaaactggaagcagaaaaagggaaaataatcaaatattattagtaaaatcgccaattttgtcacagttctccattctgcagtctctatccatagctttcggtgttaaaggagtctttaatcctgactggtgaagggccataagaggaaatttatgggttcaggcatttcatgggagtagccgaagatagtgaaccacccttgaaacgtgtgaaagggcccttggaagaatccaagagcttgccggaggatcattcaaccacaaaatctgtttcttgctctttgggagatcagatggctaggcctctaacctcccaaggggatggggaaacaattggttcacacggtgttataagaaaagcagaatttattaaaattataactagggcattgtactcgcttggttatgacaaaagtggtgcccttctagaggaggaatncggaataccattgcattctctcgtggctaatctatctcatgggcacgtgaccaatgggaaatgggatgatgtgtggccacattgc

SEQ ID NO: 17266 - DNA, 92 bp, Gossypium hirsutum
  Clone ID: uC-gsflnu33B126b07b1
tcgtccactcgtccgcgggaaggaaactgtcggtggcaagggtagaagactagctggttaaccacagttagggagccatatgttgtgctgtt

SEQ ID NO: 17267 - DNA, 498 bp, Gossypium hirsutum
  Clone ID: uC-gsflnu33B126b08b1
tctttcacgcgtccggttttcaactgccaaggtgctggttggtgcaaggtcaccaagaaaacccgaattcatgatgcatcacctggtacacttacaggttctgtttgtgccaacgatgttgatttgatcgctcaggttgccggtgcggactggaatggggagagtgtggtttatgctcatagatcaggtacattttgtctgcttagatgtcaggtgaagagtgccaattggatttattttgatgtaaaatgttaaaaaaatgcctttttgagtttcaggagagctggtacggttacctaaaggtgcttcagtgtcggtaacacttaaggttctcgagtatgaactattccacttctgtccctgtaaggatagtttcttttccttccttttaggctacttttttgtatttgactacggtggcttattgaatgcttttttcttatggtgcaagaaatttcccacaccatttcatttgcaccaattggccttcttgacatg

SEQ ID NO: 17268 - DNA, 533 bp, Gossypium hirsutum
  Clone ID: uC-gsflnu33B126b09b1
tcttttgctcatcaacagagcagcatgcctacatcagtgatttcaagtcagagcatgcatttaggagtactagcaactgcatctcatgccgtttcaacacaaaccctctttgttgtctactataaaccaaggacaagtcagttcattattgggttgaacaaatatttagaggctctgagcaataagtttacagttggcatgaggtttaagatgagatttgaaggagaggattctcctgagagaaggttttctggcacaatcgttggggttgaagacttttctccttactggaaagattcaaaatggcgttcattgaaggtacaatgggatgaacctgcctctataccaagacctgacagggtttcaccatgggagatagaacccttcgctgctcctattccaccaactctgggtcaacctgttgctgctaagaacaaaaggcctagaccaactgctgaaatttctgctctagatttatctttcacagcattagcttcttggaattctggagttatgcatactcatgatctaat

SEQ ID NO: 17269 - DNA, 165 bp, Gossypium hirsutum
  Clone ID: uC-gsflnu33B126b11b1
attcctttttccttttttggttctttccctttggcttttattttgagttattatgaattatatcactgtccaaaagaaaatcacacagcgggtaaaggtggtcatttatgaaaattgaagatattagtaattcttttgcattgccaaatcttttatctgcagatt

SEQ ID NO: 17270 - DNA, 540 bp, Gossypium hirsutum
  unsure (1)..(540): unsure at all n locations
  Clone ID: uC-gsflnu33B126c02b1
tttttaggtgacaatgttggcttcaatgtcaagaatgttgctgtgaaggatctgaagcgaggatatgttgcttcgaactcaaaggatgatcccgccaaggaggcagctaatttcacttcccaagtcatcatcatgaaccacccagggcagattggaaatggatatgcacctgtccttgactgccacacctcccacattgcggtcaagtttgcagagttggtgaccaagattgacaggcgatctggtaaggagcttgagaaggaacccaagttcttgaagaatggtgatgcaggatttgttaagatgattcccaccaaacccatggttgtggaaacattctctgagtatcccccactgggtcgttttgccgtgagggacatgaggcagactgttgctgtcggcgttatcaagagcgtggagaagaaagatccatctggagccaaggtgacgaagtctgctgccaagaaaggtgggaagtgaaccgtgtggngttcagttgatccaaccaaactattctatggttactacaataaaacaatt

SEQ ID NO: 17271 - DNA, 439 bp, Gossypium hirsutum
  Clone ID: uC-gsflnu33B126c09b1
tcgttcgaccttacaacacttttgttatgggagctgaatggaaatggtttttcagtcttctttcccttacattagtctgcgtcctcctcctcgtactttactcgatctcacctttcagctcccctagacctttcccttcactagtccaactcggccttccatatccaccaccttttgggtattatatattcggtggaaaaggtgataaagatcggatctttaggttactccttgctgtctatcaccccaggaatcgttatgtattgcatcttggagctgatgccactgatggcgaacggtatagtttggttgtggctttgaaatctgcgcctgctattaggagcttttcaaatgcggatgttatagggaaccctgatcggcttctgtacatgggttcttcgtatattgcttccactttgcacgctgctgctatcttgat

SEQ ID NO: 17272 - DNA, 463 bp, Gossypium hirsutum
  Clone ID: uC-gsflnu33B126c10b1
tcgtttttgaagccttcgtaaatgatccgttattgaacaatatggagtggtttgggtgggaatatcgatggaaaaagatggagaaaaaaatgaagaaaatggagagatttgttgcggctacgatgcagttgacacaagagttggaagtgttggcggaacttgagcaaactcttaggaggaagcagagaaatcccgagttagatcgggtgaaattactcgagtttcaacagaaggttatattgcagcgtcaagaagtaaaaaacctacgcgagatgtctccatgggttagaacttataattacattgtccgatttctgttgagatcactattaacgatactcgagaggataaaaaatgtgttcgggaccaaccaaatggtaccggttgagaggaatgatgatttcgaatctgttaatagtgattatctttcacgcagccattccttttctactgtaataccgtc

SEQ ID NO: 17273 - DNA, 428 bp, Gossypium hirsutum
  Clone ID: uC-gsflnu33B126c12b1
tgtcctttgaccgtggctataaagaaagttttacaggacaggatatacaaaaatcgtgaactgcagttgatgcgtgtgctggatcatccgaatgtgatttccttgaagcattgtttcttttccacgacaacgaaaaatgagctttttcttaacttggttatggaatatgtaccagagagcatgtatagggttttaaaacactacagcagtgcaaatcaaagaatgccgcttatatatgtcaagctttacacataccagatattcagggggcttgcatacctccacagtgttgttggagtttgccatagggatttgaagccacaaaatgttttggttgatcctctcactcaccaggttaagatttgtgattttggaagtgcaaaagtgcttgtcaaaggtgaagccacacattcctacatatgttcacg

SEQ ID NO: 17274 - DNA, 533 bp, Gossypium hirsutum
  Clone ID: uC-gsflnu33B126d01b1
tcctttcgtccggcagggtacatcatggaactacactgctcggagaagaatgggatgcaaatgacgaaaaagttcgtgtactgcactgatcacaggagcccaaatccagatgcagttgttgtcatgcatactccttcaggggtttttgctgccagaaatgttcttcagaatgtgaacgattgtcctagaggttcgaggctaatttcatccaagaatgctgagctccctgaatccccagctctggataccaatgactttgatgcatgctctgctgctagatgccgcatttttacaaggtcaaaatttaagggagctgaaagggagccaatattccacagtccgagtgggccaagtcatcatcatatagatgcattaagagcattaagcacatataaagaagtagatgattctactgttttctcgtcattccaggatcgactgtaccagttgcagaggactgagaaccaccgaagtttgttttggcaaatctagtaattcatggatgggggcttctttgcacgtagaaacattta

SEQ ID NO: 17275 - DNA, 533 bp, Gossypium hirsutum
  Clone ID: uC-gsflnu33B126d02b1
tccttgcgtccggtattctttattattcttcgtcttctgaaaaattttctttgaaattccagcttttgactacaatgtcaggaaggggaaagggaggtaaggggctcggaaagggaggagccaagaggcataggaaggtcttaagggacaacattcagggcattaccaagcctgcgattcgccgtctggctcgtaggggaggtgtgaaaagaatcagcggtttgatctacgaagaaacccgaggcgtattgaagatcttcttggagaacgtgattcgtgatgccgtgacatacactgaacacgccagaaggaagaccgttaccgccatggatgttgtttatgccttgaaaaggcaaggcaggactctctatggttttggaggttaagcttagtacactattgtattttaggcattgcagtattatgcttattatggtagaatcatggatcttggctatagatccactgcgttaatgtaattgcttcagttcgttgctgatgttactgtgattcttaatattcgaaatgctctc

SEQ ID NO: 17276 - DNA, 406 bp, Gossypium hirsutum
  Clone ID: uC-gsflnu33B126d10b1
tcgtccacgcgtccgcaagcacacaactctttcttttcctgctctcaaagatgacaacttttcatcattaaagctcaaggccttactttgataaatgagtttcggtcccatctcttgagctgtgaagcagattttcaaatctgggtacttctcattttttctacaaaacccgacaaacatttgtttttgtatgtattaacttgtaggtttttaccccagatcttgcaatggtctgaaactcttgagtaaagctgttttttcttttgttggggggggggtctttataaagggtagaaaatggcttatagcttagagcaaaggttttggtgtcagctagttttaaggtttgggtttgcatttgtatgtgtgtgtttgggtgggtacattggtggtcccacatcactgt

SEQ ID NO: 17277 - DNA, 547 bp, Gossypium hirsutum
  Clone ID: uC-gsflnu33B126d12b1
tgttccttttaagttttgtctttcaaacgatgaagcaaaagattgtagggtttataagctttttgtcgttagcttttcttcttctttgttgctcctcaacatctgctcgtttgctcatgcagatcaaccatgaaacaggtgaaaaggaggttaaagcaaacgagatgatcattcaagcagatgctaaagatgatttctcaaatttgattggagcagaaaagtgttatgagaaagatgaagaatgtttggaaagaaggatgattgcagatgctggtctggattacatatacagccaaagtaataagccttgaacgagtggcggaggtcggatcctcgttctgggtataaagtagttttaaaattcgtaaatcaacatttactctattaatggacctacagaatatgaaatattaaatattgagctcgctttaatagatatattgaaaaataaaaaaaataaaccttaaaattatataataaaaattagccataattaataaaacacacaggaataattatatagttttacatgtagtcttgctatgat

SEQ ID NO: 17278 - DNA, 577 bp, Gossypium hirsutum
  unsure (1)..(577): unsure at all n locations
  Clone ID: uC-gsflnu33B126e01b1
tttcttttaagcgcgtggtacactgaaaccaagttatgccaagggtcaatgccaaaattctaccaaggtcaccgaaacaccacggtgctggttttgcctttgtcaggacaaattcaaaacggtacaggtttgatcatggcggtgcaagagcagcaacagcggacgggaaacatcccattgagactgcgggtgagtcagtctgtgagggttaagcttgggaagttaaagcttatgaaagtgaagttctcggttaggtgcgggttagtggtagatgctttatctgctaacaacaccgtcacaattcaaagtagtagctgcaaatttaggcttagcttgtagagttcctaatttctaacacccgccatattttttacatttatgttcgagaaataaggagggttttaatatatgcggttttgttctgctccatgctatatacttcagtttggtgttatatatttgtaatggtgattttattctatatattcttttttttttttttngaaagattatgttcgatacccatttttgatcttcttgatttggggatcattacagggatattctcatttgtttt

SEQ ID NO: 17279 - DNA, 585 bp, Gossypium hirsutum
  Clone ID: uC-gsflnu33B126e02b1
ttcctttcgtccgcccacgcgtccgtggattctggggatggagtcagtcacacagttccgatctatgaaggttatgcacttccccatgccatcctcaggcttgaccttgctggacgagatttaacagatgctttgatgaagatcctgacagagaggggttactcattcaccacaactgctgagcgagaaattgtccgtgacatcaaggagaaacttgcttatgtggcactcgacttcgagcaggagcttgaaactgcgaaaagcagctcatcaattgagaaaagttatgagctacctgatggccaggtaataaccattggagcagagcgtttccgttgtcctgaggtcttatttcaaccatcgcttattggaatggaagctcctggaattcacgagaccacttataactccatcatgaaatgtgatgctgatattagaaaggacttgtacggtaacatagtgcttagtggtggatccaccatgtttcctggtattgctgatagaatgagcagggaaatcacagcttttgcaccaagtagcatgaagattaggtggtagcacccccagagagaaatacagtgtctg

SEQ ID NO: 17280 - DNA, 65 bp, Gossypium hirsutum
  Clone ID: uC-gsflnu33B126e05b1
ttcattcgttcggtaacaggcaagaaaaatttaacttgttatctaaaaagggagctgtacacaaa

SEQ ID NO: 17281 - DNA, 64 bp, Gossypium hirsutum
  Clone ID: uC-gsflnu33B126e06b1
tccatgtgttcgttaaagggtaagagacatggaggatgctttaaaacagagaggggcattacag

SEQ ID NO: 17282 - DNA, 477 bp, Gossypium hirsutum
  Clone ID: uC-gsflnu33B126e10b1
tgttctttgctgcacaaactctagagaaattcttccatcgaactttgtccatgtgtcttttatcataggactcttcatcaggcaatgcatcggtgggttcatcaacaagtcgaaagcttgtttgtagagaaaaaaggtgctgcatgtaaatggccaaccgattgcttcttttgccttcgagatagagcctaagacctgtaactggtctcatacctacatcaacctggcatagaattggtaaccccacaaaagaacttttgcagcaaaagaaacaagaaacagcagaagcattgaagaggatgaaaaaagaagtttactggaaaggtgttaatataaagcttgtgacccatgaacttgaactgtaaaaacgaattgctctgtcgcttgtgctgtaaaccacggggaaaccttttgaaaactgtggcccacccccttggccgctggaaattcaaacacaaatggagggtctttaagtga

SEQ ID NO: 17283 - DNA, 86 bp, Gossypium hirsutum
  Clone ID: uC-gsflnu33B126f01b1
ccgtccttcgaacgccacgcgacgcttaagaccggtcttaacatgtaaaacaagaccttcttccatgatcgagtagcttgacctat

SEQ ID NO: 17284 - DNA, 313 bp, Gossypium hirsutum
  Clone ID: uC-gsflnu33B126f02b1
tccttgcgtccgaaaaaaaaaaaaaaaaaaaaaaaaaaaaaataaaaaaaaaagaaaaataaaaaaagggaaagccgatttgtagatctcggggttctctttttgtggctgggggggggcatctcgttgatccagggtttcgtgcgtcttattgggaggcccttgttttcttttgggggcccttaaatctcctttaattgtccgcgtttttcccctgttgggcctgggagaaccttggcgttgccccttttgactgcttgggcgctctgcccgtttttttcgtctgttcttaataccttttaggcctgtttgg

SEQ ID NO: 17285 - DNA, 505 bp, Gossypium hirsutum
  Clone ID: uC-gsflnu33B126f04b1
tccattcgtccgcccacgcgtccgcggacgcgtgggtttttggttacttctctctccaccattatttccaatccttttcactttatctccccccccccctcctctctctctcactccccattgttggacgtagccaagattacattgggatagcaaaaattatctgtacggaaaaaacatggacataactaatgtcactgaatatgaggccattgcaaaaaagaagttacccaagatggtttatgactactatgcatcaggtgcagaggaccagtggactctcaaggagaatcgaaatgcattttccaggattttgtttcgaccccgcattcttattgatgttagcaagattgacatgaccaccactgtcctgggattcaagatttcaatgcctatcatgattgctccgactgctatgcagaaaatggctcaccctgaaggagaatacgcgacagcccgagcagcttcagctgcaggaacaattatgacactatcctcgtgggct

SEQ ID NO: 17286 - DNA, 548 bp, Gossypium hirsutum
  Clone ID: uC-gsflnu33B126f10b1
ttcacgcgtccgaaaggattttgctttgcctaatttgtaagctttgaggttgactgaaaaaactatggcggaagagggacaagtaatcgcctgccacactgttgattcatggaaccagcagctcgagatgggaaaccagtccaagaaactggtggtggtggatttcacagcatcatggtgcgggccatgccgttttatatcaccaatcctggtggatcttgctaagaagctgcccaacgtcatattcttgaaggtggacgtggatgaactgaatactgtggctcaggagtgggctattgaggcgatgccaacttttgtgtttctgaaagaaggcaccataattgacaaggttgtgggtgcaaggaaagaagaattgcagcaaaaaattggctttcattcatttaacccggtgcagacagcatgaatcaaccattaaatgtacttgatgtctggagttgtttatgaaactaggatcttatgaatgtctgacagacagaccctaaatatgtgtggttgatttatatttggctactctctctggcttttgc

SEQ ID NO: 17287 - DNA, 541 bp, Gossypium hirsutum
  unsure (1)..(541): unsure at all n locations
  Clone ID: uC-gsflnu33B126f11b1
tatcgacggccgcgacatgaagcaaaaaacatggccggatcgatccgacggcgtccgcttcactgcttttcccttgtcgaaacccaacgacaatgaagaaaatatcatattatcgaggcgttccaagatcggttcaaaaccttcattatcgccgaccgacggccctgatttctcggctctcccttttgacatcttgacgaaaatcgcggcgtcgtttaattttccgaaccttctagcggcttcgctggtttgccggtcatggagggacgcgctccggccgttgagggaagcgatgatgctgctgcgttacgggaagcgattcaagcatggccgtggcggtgttcggcgtaatttggataaagctctcgactctttcttgaaaggcgctgcgcgtggatctacgcttgctatggtcgatgcggngcttatctactgggaaaggngtctaaaagaagaagcaattgctttttaccagaaagccgccgcccttggcgaccctgccggccagtgtaatctnggaatttcatacttgcacgctcaa

SEQ ID NO: 17288 - DNA, 551 bp, Gossypium hirsutum
  unsure (1)..(551): unsure at all n locations
  Clone ID: uC-gsflnu33B126f12b1
tccacgcgtccgcccacgcgtccgcggcctcctacccatccagaagctcatattcacagacccagttcaagccctaacccagctcaaggaaaaactctcatcgtccttcgctctccgagtcggctcggcggccctcgctgacgcgcttcagatctcatcggaccatgcgcgtctcatcctcgacactctctcctcggttctccactccgaatccgacccactcgttaccgcccggcccgaggatgtcgactccattggagctgatttgcgtgatctggtcctgtttttgtacattcaatcgtataagagacttttgccgcgctcgcacaaggactccgctgcagttgccgatgtttggccttccacgtcagctttcgacggttacttgtcggctctttcgcctttgcagcttgtccgcagcaacactcgtcggtttatgccatcacaggctgatgaagaggcccatcaattgtcctatctacaaaagcacttggctaacattctctctcttttgtcngagcatgtggagggggaaggcaaagagtctatgg

SEQ ID NO: 17289 - DNA, 521 bp, Gossypium hirsutum
  Clone ID: uC-gsflnu33B126g03b1
attattattaatcacgaggatttagtaacttagctgttgccgattagctcacttctttgttttccttcacactcttgcttttggatattattatcaagcatgaacgactttgatatctgggctgtgggtaatcttagctcaaactttctccctttttatggcctttttggctacttggtatatgcttttcaagcccaaatgtttgttcttttttccattagcttgagatgccatttcttttgctattttgagtgttgattttgctccgaccatatgaatctgtggataccattactattactcgcttcagtagacagccctgtggatagaacttgtctttcattgcattatgtatgttgacattcatcttcaattatatgtttatttattcatttgcatcttggttaagagatactgtttgtattgtcttctagaatagcttacctgggcttctgacttgccatctgataggtgtccaaaggagagaatggaaccggaggacatgtatgtattatcaggag

SEQ ID NO: 17290 - DNA, 517 bp, Gossypium hirsutum
  Clone ID: uC-gsflnu33B126g05b1
gcgccggtcttctatctcctcgactcacttcccagccaaaggtaagccatggttaagcataacaatgttattccaaatgggcactttaagaagcactggcagaactacgtgaaaacttggttcaaccagccagcaaggaaggctagaagaagaattgcaaggcataagaaagcagtaaggatctttccaagacctactgctgggcctcttcgccctgttgttcatggccagaccttgaagtacaacatgaagttgagagctggcaacggtttcactcttggagagcttaaggcagctggtatttcaaagaaacttgcacccaccataggtattgctgttgatcaccgccgtaaaaatcgatatcttgaaggtcttcaagccaatgttcagagacttaagacctacaaggccaaacttgttgtcttaccaagatgtgctcgcaaatttaaggctggtgattctactgccaaagagcttgcaactgcaacccaagtacaaggatcatatatgcctattt

SEQ ID NO: 17291 - DNA, 551 bp, Gossypium hirsutum
  Clone ID: uC-gsflnu33B126g06b1
tttttatgttggttgtggtgttgcaagttttggagcgtatcttctttcttctgacattatagcaatgtcattagcacccaatgatgttcatcaaaaccaaatccaatttgccctggaaagaggaattcctgcatgtcttggtgttctagggacaaaaaggctcccttacccgagcagatcatttgaacttgctcactgttctcgttgtaggattgattggcttcaaagggatgggattcttcttctcgagctagaccggttacttagacctggaggctattttgcctactcgtctccagaggcttatgcacaagatgaagaggatctccggatatggaaagagatgagcgcccttgtggaacgtatgtgttggagaatagctgcaaagaggaaccaaactgtcatttggcaaaagcctttgacaaatgattgttatatggaacgagcacctggtacaaatccaccgctctgtcggtctgatgatgatccagatgcagtttggggtgtgccaatggaagcttgtatcactcccttattccgaccatgatcag

SEQ ID NO: 17292 - DNA, 463 bp, Gossypium hirsutum
  Clone ID: uC-gsflnu33B126g07b1
ttcaattacaattacaattaaaacagtttcgaagtcactttcaagaaaccaaactcttcaacacaaccaaacatgttcatctttgcagtcgccgcgtttgtttgcattggtgccatagtggcccaaccacctccaactcaaattccacaactcaacaatcgacctctgtttgaggctcttgaaaagagagcagacgcattggtggcacgcgctcgtgcggtcgcacaagagcaccgagttctgggaggaagcaacagacttttggactctttggatcgacaagccactctcgtggaggcactggcacttgatctcaaggccaaactgtatgtacctgatgataagcgaccccagcctgatgtgcatcacattcacgtaatcgaagaagagttgctccacctcgagaatcgtgtttcagaagaaattgaaattctggaacacattcgcaatggcggtgatcaac

SEQ ID NO: 17293 - DNA, 446 bp, Gossypium hirsutum
  Clone ID: uC-gsflnu33B126g08b1
ttttctagatcgcgagaacggaacttgcccttggctcatacctgatggcaagactcaagtcaccgtcgagtattacaacgacaagggtgccatggtgcctgttcgtgtgcacaccgtgctcatctccactcaacatgacgagaccgtgactaacgatgagatagctgctgatttgaaggagcacgtcatcaagccggttatacccgagaagtaccttgatgagaaaaccatttttcaccttaacccgtcaggccgttttgtcattggaggttcccatggtgatgctggtctcactggtcgcaagattatcattgatacttatggaggatggggtgctcatggtggtggggctttctctggtaaagaccctaccaaggtggattgaagcggtgcttacattgtgaggcaggctgtgaagagcattgctgctaatggactagctagga

SEQ ID NO: 17294 - DNA, 504 bp, Gossypium hirsutum
  Clone ID: uC-gsflnu33B126g09b1
ttttggtgagctatcaaaggatatgtctgacgaacacgaagacatgacatattcttgggttcgagaataccattgggatgtacgtggcgacaatgcatatgacccaacgacataccttggtttgttcgatgaaggagaagcttgttatgtgcctcttaccacgaagcttaatttaagaaaaaagacgctcaaagagggaagatcaggtgatgagattgaacattttcctgtacctgctagaattactgtgaggagaagaccaacagttgcagtaatagaactccatgagccagaggtttattccaactcaaggggtggtatttgtagctcaaagatggcaaggctagatgcataagatggccatggaagaccacacaagctttcacgacaccaagatattgaccaatatagtggagctgaagatgatgtgtctgattgatgtatgcatatgaaaatgacggttagctatggttagaagtttttgaggcttgtgcactaaactga

SEQ ID NO: 17295 - DNA, 532 bp, Gossypium hirsutum
  Clone ID: uC-gsflnu33B126g11b1
tctttgggagatgcccttgtccatcgcctaacgtatcctccaggtcaaagtcaagcaagtagcactgactatctcagggagaccaccgatcaaaatggcaaacaaaatccgcaaaaatttgttgtgttacaccttcgatttgataaggatatggctgcccattcggcctgtgatttcggtgggggtaaggctgaaaaattggctctggccaagtaccggcaaacaatttggcaaggaagagttctcaattcacagtttacagacaaagagttgagaagtcaggggcgttgcccgttgactcctgaagaaatcggattgctgctggcagctttgggtttcgacaataatacccgtctttatcttgcctcccacaaggtatatggaggggaagctaggatttccacactacgaaacctcttccccttgatggaagacaaaaagagcctagcctcttcggcggaaagggtccatataaaaggaaaagcttctttgttggctgctgctgattaccatgtcgggatgcatagtgaca

SEQ ID NO: 17296 - DNA, 555 bp, Gossypium hirsutum
  Clone ID: uC-gsflnu33B126g12b1
tcgtttgaatcagttcctcagaaatcaatccatgaattcactgtcaagaatagcaaaggccaggacgtggaccttagcatgtacaaaggaaaggctctccttgtggttaatgttgcttctaaatgtgggtttacggattcaaattacacccagttgactgagctttacaacaaatacaaggacaaagggttggagatcttggcatttccttgcaatcagtttttgaagcaagaaccaggtaccagccaagaggcagaagagtttgcttgcacaagatacaaggctgaatatcctattttcaaaaaggttcgttgcaacgggccgaatacagaacccgtcttcaagttcttaaaagcaaagaaatctggtttcttgggatctaggataaagtggaacttcactaagtttttagttgataaggatggtaacgtcctctcttgctatagcccaaccaccacaccactggccatagagggtgacatcaagaaagcattgggagtggatacatgaaaatataggaagtggaggcaaaatggaaactaagaacaatgtaaa

SEQ ID NO: 17297 - DNA, 248 bp, Gossypium hirsutum
  Clone ID: uC-gsflnu33B126h01b1
ttctcacttacacggacagcgtgaaaggagctgaagaatgcctatttgaggggatcggtcgtgtggtcattttggccatgatgaatggtggagtccttcatacagcacttgctacagatgaatgcttgaagtaaattaaattgcttgacaaagccatgcttggtccatacagctcaacgcaacaaggaaaagcgtgtctcatcacacaagttatagaaccagaagctgatctaaggcttgcaccaata

SEQ ID NO: 17298 - DNA, 468 bp, Gossypium hirsutum
  Clone ID: uC-gsflnu33B126h05b1
cttgccccagcaattgtaatgggcgtggaaagtgcctgccaaatggggtatgcgaatgtgaaaacagttgtactggcattgactgctccacagccgtttgcaatgaacaatggagtgtacacggcggtgtctgtgacaatggagtttgagagttccaatgctgttactattcaggctccacgtggcagaacagctcgactcttttctcgagtttttcggtatgcaaagatgtattagagagggagttatccgggcaacattgcgccccaagcgaggcaagtatattacaacagctagaagaaggtgttgtcatgcctaattaccaccgtttattccctagcggtgctcgcaagatgtttaatactggctttgggagcagctactgcgatgcagctgccaagcgactggcctgttgggtaaagtagctcaccccgtagcttttctatatgcgagcatatgctttttcac

SEQ ID NO: 17299 - DNA, 490 bp, Gossypium hirsutum
  Clone ID: uC-gsflnu33B126h06b1
gcgtcctttcatgcgtccacacgtacggccacgcgtccgagcatctgaccgtgcatttggattgagctctctagcactctaccgtggaagtacgaagacgcaataattattcaagtgaaacgatagggttatgcactcacaggaccgttaggccaaatggatctgagattgcggtaatggttctctcttgatggcattggggaattgaggctaactgaactaaattattggcctccacaagacagggatgtcaaccacaggagtctctcactccctgctgctggattgctggccgaatgtcttgagcttaggaagttatgtatccatgggacagctcatgaacacttcatgatgttccttcttaaaatacctaacctcagagacgtacagctgagagaggactactatccggcaccagagaatgatatgagaactgaaatgagagcaggcttatgtagtaccttagaagctgttctaaatgggccacaca

SEQ ID NO: 17300 - DNA, 340 bp, Gossypium hirsutum
  Clone ID: uC-gsflnu33B126h07b1
tcgtttacacgtccgcatatgcttaagacaatggatagagtgctgtgtggcccagacccggagactaagggagggagtggtgattggctgggtcatttgggatgtatgagctctgaaaagtgatgtttgagtgatttgactgaacacaaggcgtgtggtatttacagagctctcatagatgacaacatattcactttctgtttattgtatggcacatgagaataccgagatggggaggaagacacagcaagatgcatgggccggggtctatatgttgttgattggaagggatatgacagaggagatatctattgtggttgactgaaatggtggtatgtca

SEQ ID NO: 17301 - DNA, 475 bp, Gossypium hirsutum
  Clone ID: uC-gsflnu33B126h08b1
tcgtccacgcgtccggttagggctctttattttctgtgttcatcaggttctttttatctcttcgaattttcattacagaccctgatcctaaactctcaattatgtcttccaagcaaggtggcaaagcaaagcctttgaagcaacccaaagctgagaagaaagaatacgacgagcatgatttggctaacattcagaaaaagaaagaagaagagaaggcccttagagagctgagagcaaaggcatcacaaaagggatcatttggtggttctggtcttaagaagagtggcaagaaatgagtttcttaaaaacccgagctaaaccgaacttatcgagtcctgtcttgggattaaaacatctattatgctgatgtctcttgtttctattgtgatagttgggatgatttgatgctctagtttcattctgaatttgctaataaaaacattgggtggaattcgtgacggatacttaataaatc

SEQ ID NO: 17302 - DNA, 433 bp, Gossypium hirsutum
  Clone ID: uC-gsflnu33B126h10b1
tcgttgacgcgtgggcggacgcgtgggaccgccaacagtcccgccccttgccgcccgccttctgcctctccgtacgggtccagcagccttagcccacagcaagctttggccatgaattgggtcaaaaacaactatttggtgtatgactattgccatgatcctaagagggatcacactcagatacccgagtgctaattaaatgtgagtcatttaaaactttacaaaaaggaaaatgtaacaattgttgatcaaaagggggtttcttgagatgggcccttgaagagtggttaagcgtccaaaaccctctaagatttgcatcttttatttctattgttttgttgcttttaagtgctctgctttgttgttttctttggaataatttattacaagagttattttttaataaaaaagggttaattgtatcaaatatctc

SEQ ID NO: 17303 - DNA, 387 bp, Gossypium hirsutum
  Clone ID: uC-gsflnu33B126h11b1
tcgttcacgcgtccgtttcaatcacgccgttgcactccctctgccgttccagtctcttcccttttccgaccagataacggcgaaaggaggacacccaaatactctttcaacggtatgaaggtcatagaggacgtgcgcggagtgctgaacgtggggcatggaagcggttgctgcggcgctgaggcacaaaagctgcctagggtttctgctgttgaaaattgttagggctaggtattgggccagtgttggattattgtatttgggccaatgggtttgtaatttattgtatttttatttccaggtttatgcatttgggcccgggctaaaatggcctattacaatgtgatttaccattttattaattttagttttttattttgatacccc

SEQ ID NO: 17304 - DNA, 524 bp, Gossypium hirsutum
  Clone ID: uC-gsflnu33B127a05b1
ttccttgcgtacgtgtgtgtgcaaaaatggggttaatttccatgagaaacatacacattcttcttgtttttacggtgacaatagtactccttgaaacaaatggttgcaaagctgcttttctagtgaagagcaacttcagctacaagtgcaaaggccgtctcaacgaatgcaggatcgctgaggctttggactcggagctagagttggagttggacatggtgatgaattctaacgttgttagaatccttcagagcagtaacacgccggtaaccagtaacacgggaaaccggaatacgccggtgcaacagacttgcccgagtcctcagtatgctagttgtcttgccacaggaggtagagctaattgtaggggaacttactgccggggctaatccatcttttgtattaatactcttgttattatatgggcaaatgcttaatgagccaagaatgatccaaattatgcgtagttgattactttatattggaatattatggtttgagtaagaatgataatcatgtgggtg

SEQ ID NO: 17305 - DNA, 519 bp, Gossypium hirsutum
  Clone ID: uC-gsflnu33B127a07b1
ttttccttgaagaggcttgatatggattatgttgatgtgctctattgtcataggccagacacacagactccaattgaggagactgtgagggcaatgaattatgtgattgataagggttgggcattttattgggggacaagtgagtggtctgcacaacagattacggaagcatggggagtagctgagaggttggacctggtaggcccgattgtggagcagccagagtataatctattgactaggcacaaggttgaatccgagtaccttcctctgtatactaactatggtctaggtcttacaacatggagtccgcttgcttctggagtgcttactggaaaatacaacaaaggaaatataccatctgacagtcggtttgctttggaaaatttcaaaaatcttgctaaccgttcactaattgatgatgtgttgaggaaagttaatggactgaagccaattgctgatgaacttggtgtaccattagctcaacttgcaatcgcatggtgcgctgcaaatcctaat

SEQ ID NO: 17306 - DNA, 515 bp, Gossypium hirsutum
  unsure (1)..(515): unsure at all n locations
  Clone ID: uC-gsflnu33B127a08b1
ttccacgcgtccggttgctgaacatttccgtgatgcagaagggcaggatgtgcttctcttcattgacaacattttccgttttactcaagcaaactctgaagtgtctgccttgctaggtcgtattccatctgctgtcggttaccaaccaaccttggctactgatcttggaggtcttcaggaacgtattaccaccaccaagaaaggttctatcacttctgttcaagccatatatgtgcctgctgatgacttgacagatccagctcctgcaacaacctttgctcacttggatgccacaactgtgttgtcccgacagatctctgagcttggtatttatcctgctgtggatcctttggattctacatcttgtatgctctctcctcatattttgggtgaggaacactacaacactgctcgtggtgtccagaaggttctccaaaactacaagaacttgcaagatattattgctattttggngatggacgagcttagtgaagatgataagttaacttgtgctc

SEQ ID NO: 17307 - DNA, 391 bp, Gossypium hirsutum
  Clone ID: uC-gsflnu33B127a10b1
tttctttttgtctctcatctcccaaaatctgcgtggcatgaacctaatgattctcttccttttttcttctctgttcatcatactctttgaaacctgagccagcaaaaaataatgcccagatcactgtcatgggccttgtttattgtgacatttgctccaacaacagcttctccagacacagctacttcttaccaggtgcagaagttcaaatagcctgcaacttcagggcatttgttccaaaaacaagagaacaagtatcattctcagtcaacagaactacagataaacatggagtttacaggttggaaataccatcagttgatgggatcgcttgtgcagaggcagccattggattatcttgcccaggcagcttagttgggaccttatctac

SEQ ID NO: 17308 - DNA, 295 bp, Gossypium hirsutum
  Clone ID: uC-gsflnu33B127a11b1
ttttctatggaagtgaacatactgtgagcccaggggtgcttgtactcacggctactgtggtccctctactggctatgcatgcttgctacttgttttgactccccgagaattaccacatgacatgctatttgtaccacatactttattggccttatattctttacctgttctacttctacaccagcctcataggtggctacatactactttagatgggagacgaaagcaccgagtggcaacaccacattacctttttcgtcgttcttcacacttaccgcaggcttggccttcccag

SEQ ID NO: 17309 - DNA, 422 bp, Gossypium hirsutum
  Clone ID: uC-gsflnu33B127b01b1
ttgttcttacacaccgggccaaaaagtaaaacattttgcaaaacaaaaaaaaattaaaatcatgtgttgtgatggagattgcaggccactgggcttcctccttggccttccctttgcttttctttccctcatcatctccattgttggcgttgttgtttggatcgtggggttgttgttgacactgatctgtccttgttgtttgtgcgtgacggtgctagtagagatggcgctggagttggtcaaagctccaattcatgtcatggaatggttcactgaacaaatcccttgttaattccacactcactgctttgttctggttttttttttctttagggggtacaattaattggctattttggatctctcgattataatgtacttgatgtagacatgggatttatgaggatttccaatttattgtt

SEQ ID NO: 17310 - DNA, 524 bp, Gossypium hirsutum
  Clone ID: uC-gsflnu33B127b02b1
ttcctcgcgtccggtttgttttgtggaaaatgatttccatgatttccataggaaaacattttacaaacacgggtaaaatccaaagcaaaattttggaaattgtcttaccgatttctaatccgtaagacattttccctttctcctttctcttctaagcaaattttcttccacatcctctgcctcctcatctccgttcaccacctcacctcacctcaccatctccgtctgtcatctccgtcgaccgtcagccttacttgtattttgaagaaaccctaaaaaaattagcagccacagtcaagaaaagaagacccagaagcagtggttctctctctgtcatcaacaggatgggaatgaagttttctttaggatcaaaagaagcactcaactgaagaagctcatgaatgcatattgtgattgacaatctgtggatttcaactcgattgccttcttgttcgatgtccgccgcctgcgaggcgaacaactcctaatgagctggaaatagaggatggtgatgagatcgatgc

SEQ ID NO: 17311 - DNA, 531 bp, Gossypium hirsutum
  unsure (1)..(531): unsure at all n locations
  Clone ID: uC-gsflnu33B127b03b1
ttcctcgcgtccgaaatgcttatgcttttaaatactccatacgctctctccctttctcgctcattagcctcttcctctttcccttctcctcccacgcgccgccttctttccatttcttccacttttgcccttcctccccctcgattcccccattcctccctcgtttcctcgagggtatccccgtcttttcgcacccaagcttcagccgccaccgcgaccatgggtgacgctcccgacgttggtatggacgctgtccaaagacgcctcatgtttgaggatgaatgtattttagtggacgagagtgataatgttgttggccatgaatcgaagtacaactgtcatttgtgggaaaagattctaactggaaagatgctgcatagagcattcagtgtatttttgtttaacacanaatatgagttgctccttcagcaacgatctgcaacaaaggtaacattccctcgtgtctggacaaacacctgttgcagccatcctttatatcgtgaatctgagcttatttcggagaatcatctt

SEQ ID NO: 17312 - DNA, 453 bp, Gossypium hirsutum
  Clone ID: uC-gsflnu33B127b06b1
ttcctcgcgtccggaagagggctttttggatctgatgccgcacttctcaacaatgcggagaccaaagcttacgtcttgcaagcttctcgtcatggatcgacttttgctaaagattttgcagtgtcgatggagaagatgggtaaagttgaagtactcactgggaatcaaggtgagattaggaaacattgtgccatggtgaactaattggagagcttttgaatttgattgtttggacttagtttaaaatgtgaattgtttggggataaaaagaaaaaagagatcattggaataaatttccaacaaaatttgtattgctttgtataatttgtgtatgaccgtttggtgctatacatacattacccagaagtggagatcaatgcttttgtcttttatttcacaccattccaactcaaatattcaataaatgcaactcataccggtctgcttgtgacc

SEQ ID NO: 17313 - DNA, 519 bp, Gossypium hirsutum
  unsure (1)..(519): unsure at all n locations
  Clone ID: uC-gsflnu33B127b07b1
tctttcgagattggagctttcaggacataccctgaaggatataagcctcctgatgatcctatctctgaatatcagaccattcctctgaataagattgaagactttggtgtgcactgtaaacagtattatgcattggacatcacttatttcaagtcctcacttgattgtcacctcctggatctgttatggaataagtactgggtaaacaccctttcttcttcacctctcttgggtaatggagattatgttgcaggacaaatttcagatttagctgaaaagctggagcaagcagagaaccaactggctcactctcgcattggcccactaggaccccctcgaaagaagttgcaggaagaatctcagcttgctaagattactagagatagtgcaaagataactgtggagcaagtccatggtttaatgtcacaggtcatcaaagacattcttttcactctgtacgacagtcgagtaggtcccagaacgatcagtctggtcctgagcctatgatngaaacctaat

SEQ ID NO: 17314 - DNA, 491 bp, Gossypium hirsutum
  Clone ID: uC-gsflnu33B127b09b1
tccacgcgtccgcccacgcgtccgcccacgcgtccgaatcactcactttcctctcctgcgccatttcgggcctctattctccatccgactctgattgcaatggagcagaaggaagatcggccaccaggtacagccagcctggaacaactgacggaggcacccatggggaaaaggttcacgcgcttgatagtgatgcacgcgcggagtctggatccactgttgcggcaccaacgaaaccctagaagcttctagggtactccactgattcgggctgagcttggaagatccgggtttggggtctgttggttctagtattttggggttttggtattttgagtcttggtatttagtaattgggcctattgtatcgggttaggtgttattaggctgttttttaattattttttggactattggacttttggactattattttattttatttagtttatatatatattttgtgatgtatatgggccgggcactaaaaa

SEQ ID NO: 17315 - DNA, 477 bp, Gossypium hirsutum
  Clone ID: uC-gsflnu33B127b11b1
tcttatttcttccgttgatctttgttagagattagctttttaatttttcattatgggaaagatcaagatcggaatcaatggatttggaaggatcgggcgttttttgcgagagttgctctccaaagcgatgatattgagctcgttgctgttaacgatcctttcatcaccactgaatacatgacgtacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcgaagaaggttatcatttctgctcccagtaaggatgctcccatgtttgttgtgggtgtcaatgagaaggaatat

SEQ ID NO: 17316 - DNA, 462 bp, Gossypium hirsutum
  Clone ID: uC-gsflnu33B127b12b1
tcgctttattcattggccaaaatcattgagaaatgggacttcagcaatggcggcaatggcaatgttggaagagagaatcaaaacggcggtgttttggtgggtgaggacactcaacatgacttcaacaacctgttgaaggttttaggtgaagatgaagagttatatgattgtattgatggaattatagggtatcaaataatggtgcttgagctacttgcacaatcctcatttgaaactcaatctataaacaattccaatcatttacatgaatcaatggaatgtcagcttttagaaattcatcctcctattggctgtgaccttttatcaaacactgaatatgcatctcaagctgctctatggggaatagaggttagcgccaatggaacgtttttctatttatgtgtaggctaaattctcgaatagggaccaagggattacttgtataatgtaaactttttaaaa

SEQ ID NO: 17317 - DNA, 308 bp, Gossypium hirsutum
  Clone ID: uC-gsflnu33B127c01b1
cttaaaaacaaacatttcgtcagctaagatgaatatgggcaatgctaatggggaggatgctattgaggcactccaagcacaagctcacatgtgtagacatgctattaacttcgtaagcttcatgtttctaaaatgtgcacttgatttatgcattcttgatatcattcttgatcatgtctagcccatgactattaccgagctggttgctgcgcttcagatgctcaaccctacttaagcatgttgacatttataggctcatgcgcattttattttcacttggactttttagcacgctaaaagctagacaa

SEQ ID NO: 17318 - DNA, 431 bp, Gossypium hirsutum
  Clone ID: uC-gsflnu33B127c02b1
tttttatgaacctccacaattctatcagagatgaccggtatcttattggtcgtcgacttcataactttggggaaaactcggaagagaagcataatgtggcagggtcttcctcagaaacacagatttctgatctgcgttacactggaataatccagcatgaccgataggttgatgtggggctgagactaaggcgtgcagttaattaaaaacgatgctgatgctcgaaaagcttgtacgaatctacgttccattattgacaagctggtatacgtgttaggtagtgtttgaaattggccaatacaatatttggcttacgcttactttttgtgcatagaatacacaataactttgcaattagggtttgtcttaaaatttcagcatgttagaagataaatattgaattactatttgattttttatatataaaatgc

SEQ ID NO: 17319 - DNA, 365 bp, Gossypium hirsutum
  Clone ID: uC-gsflnu33B127c03b1
tctttgcgtccgctggattctttgagtccgcgattgcaggagttcgtggagtgtacgacgcgaggaaaaggggtggttccgcaacgtgcgccgatcagatctgctggagcgcgtcgtaggggctgttgcggcgctgaggcgaatgcatctagggtttcggtgttttggggtttgggtaattgggcctaggctagtagttttgctgtattgggccatgtcctgttttgtgcgggcttgggttatttttgtttgtttttattattttaaaagctcgggcaaaagggctattacaagcctgattctaaatatatttttttttacacagagaaacaagcaatcaaacgaaaaaaaaaagaacaaaaagc

SEQ ID NO: 17320 - DNA, 336 bp, Gossypium hirsutum
  Clone ID: uC-gsflnu33B127c04b1
tgtgctactggaaaatatgagaagaaggtttacgtattgccaaagcacctcgacgagaaagttgctgcacttcacctcggcaagctcggagctaagctcactaagctcactaaagatcaagctgattacattagtgtgcctgttgaaggtccttacaagcctcctcattacaggtactgagagaagagttgatgagtttttatcaagaaagaaaaaacatccggatggttcgattgcttcttgttttactgaaatttcatgatggttaggtttttgttttatttttagagttttttttgtgtttgggtgatgggaaagtgcctgggggtgggaaaa

SEQ ID NO: 17321 - DNA, 496 bp, Gossypium hirsutum
  Clone ID: uC-gsflnu33B127c05b1
tttacaaacccttagaaacttaaccaattctttcctaattagaattcatatcttacctttcctcaaaatcctaatagaattagaattccaccatttctttctcttcttttcctaattagattttcatattgctccttttcaaatcccaatagaatttgctctccatcttgctatttaatctctctattttctttcccttttctttccatcatattttcatcctaattattgataattattttgctttcctgaatcaaatcatcctccattcgattgttccttctattggtttttctaatttctgtcaatagcatccctattcttgccaataatcgataagtacatcttgtttctgatgtttagatcccgaatttttgttatattactattctgtgctaatcttatgttcgattaatcaatctttttcttgccaaaacttttgacaatcttgtcaaatcttggaatcaaccattaattcatgtgtaaatatcgtttg

SEQ ID NO: 17322 - DNA, 511 bp, Gossypium hirsutum
  Clone ID: uC-gsflnu33B127c06b1
tttcctcgcgtccgcccacgcgtccgaaaaaaatgaagtctcagatctgtttagcctttggaactctggccttgttgttagcttcagctttggccgatgacgtcgtcgtactgaccgaagcgaacttcgataaggaagttggtcaagatagaggagctctcatcgagttctatgctccttggtgtggacactgtaagaagctagctcctgagtacgagaagctcggggcaagttttaagaaggctaaatccgtcttgattggaaaggtggattgtgatgaacataagagtttatgcagcaaatatggtgttcaaggctacccaactgttcaatggtttcctaaaggctctttggaacctaaaaagtatgaaggaccacgcacggctgaggcacttgctgaaattgttaacactgaagaagggactaatgtgaagatagccactttgccatccaatgttgcagtgctaatgcggataattttgatgagattgtccttgatgaaaccaaagat

SEQ ID NO: 17323 - DNA, 514 bp, Gossypium hirsutum
  Clone ID: uC-gsflnu33B127c08b1
ttaaaaaatggcggaaagagcaccgatcgaatccgtacaatgcttcggccgcaagaagacggcggtggcggttacccactgcaagcgaggccgtgggcttatcaagattaacggttgtcctatcgagcttgttgagcccgaaatcctccgtttcaaggccgtcgagccaattcttctcctcggccgccagcgttttgccggcgtcgacatgaggatccgtgttaaaggcggaggccacacttctcagatctacgccatccgtcaaagcattgctaaggccctcgtcgctttctaccagaagtacgtcgatgagcaaagcaagaaggagattaaggatatcttagtcgggtacgataggactttgctggtggctgatccgaggcggtgcgagcccaagaaattcggtggaagaggtgctagggcaaggttccagaagagttatcgttgaataagatttatggtttgttcgcgaaacttcgtttgtttacaagagatactatgttatgtcattttg

SEQ ID NO: 17324 - DNA, 510 bp, Gossypium hirsutum
  Clone ID: uC-gsflnu33B127c10b1
ttccacgcgtccggaaaaatcccccaagcccgtcgcctcttgcgccatgcctgcccttcctggaatgaagattaagacagatacgccgttggcaaagaaggcacgagaaggagtgatggagtttttgctgatgaaccatccactggattgtccaatttgtgatcagggtggagaatgtgatctccaggatcagtctatggcatttggatctgatcgtggccgttttactgaaatgaagagatctgttgttgacaagaatcttggtcctttggtgaagactgtcatgactcggtgcattcagtgtactaggtgtgtcaggtttgcaacagaagttgctggagttcaggatcttggcatgttaggtcgtggtagtggagaagaaattgggacttacgttgaaaagcttatgacaagtgagctttctggaaatataattgatatctgccctgttggagctcttacctctaaaccctttgcatttaaggcccgaaactgggagttgaaaggaac

SEQ ID NO: 17325 - DNA, 527 bp, Gossypium hirsutum
  Clone ID: uC-gsflnu33B127c11b1
tttgctacctacttcctctcaactctcaaacccagaaagctcaaaggaaaaaaagatggctttggagatctgtgtcaaggctgctgttggtgcccctaatgttcttggagactgtccattctcccagagagctcttcttactttggaggaaaagaagatttcctacaaaatgcaccttatcaatatcagtgacaaacctcaatggtttttggagataagtccagaagggaaagtaccagtggtgaagtttgatgacaaatgggtggctgattctgatgtaattgttggaatccttgaagaaaaataccctcagccttgtctcaaaacccctcctcaatttgcctctgttggatcaaacatatttggaacttttgtcacatttttgaagagcaaagatgctaatgatggatctgagcaggctttgcttaatgaactcaaggcattggatgaacatcttaaggcacatggcccatccattgctggggaaaagataagtgcagctgatttagctttgggacccaaacttt

SEQ ID NO: 17326 - DNA, 521 bp, Gossypium hirsutum
  unsure (1)..(521): unsure at all n locations
  Clone ID: uC-gsflnu33B127c12b1
ttctgacaattgcaaggtcttggttaacattgagcagcagagccctgatattgcccaaggtgtccacggacactttacaaagcgtccagaagagattggagccggtgaccagggtcatatgtttggttatgccactgatgaaacccctgaattcatgcctcttagccatgtccttgcaactaagctcggtgcacgtcttactgatgttaggaagaatggcacctgcccctggctaaggcctgatggtaaaacccaggtcactgttgagtactacaatgacaatggtgccatggttccagttcgtgtgcacactgtcctcatctccacccaacatgatgagactgttacaaacgatgaaatcgctgctgacctcaaggagcatgtcatcaagcctgtcatccctgagaagtaccttgatgagaagacaatcttccaccttaacccatctggccgctttgtaattggtggtcctcacggtgatgcangtctcaccggacgtaagatcattattgacacttatg

SEQ ID NO: 17327 - DNA, 415 bp, Gossypium hirsutum
  Clone ID: uC-gsflnu33B127d02b1
tccttcgcgtccgcccacgcgtccggtgatacttttttggtgacagatttcatcacgtaaatagaatccgtggcaaggtttggttcgttgacaagtatgatgcaagcaatgaatgttgatatgaatttgtgatggatttaaaggaggttgtatgttgagatttctagcttccaagtatatgtagattcgatatgcaatttgaattctccgttaaaacagtttcagctttctatttggtcataataatgagcatagggtttaggcaattctggtgtgactgtctccttatgtttattatattatgcagcatgattttagttggaaagactgcaaattatatgagtttgagctaaatatatgttctgtgtcttgttaataatctattactctctataaatttttgtttttttttttt

SEQ ID NO: 17328 - DNA, 524 bp, Gossypium hirsutum
  Clone ID: uC-gsflnu33B127d03b1
ttcttcgcgtccgctcagtccaattttgtccctttccataatccatacgacaacgaaatacgctgaagaaaatgcagagtccctctcttcctcgacttctacttttatccttcactctaataagtgtgttcaacctagtactgggtgatgaaggattctgttccgctccttccatattggaccaaactgatagttcctctaaacctttgtactggaaagtcactagcccaactctgtctccttcgcatctccaagacttacctggtttcactcgtagtgtttacagaagggaccatgcgttaataacgccagaaagtcatgttttcagtcctttgcctgattggacaaatacactgggagcatatttaataactcccgcaattggttcacatttcgttatgtatctggcaaaaatgcaagaaaactcgaggtcagggcttccccctaatgatgtggagaggctcatatttgtgactcagggtgcttgcactctcaccaattcatctggcattagcaacaaattg

SEQ ID NO: 17329 - DNA, 294 bp, Gossypium hirsutum
  Clone ID: uC-gsflnu33B127d06b1
ttgttcttacaaatttcttgcctaccattttcccttcatcaattctttgttatattgttgattgatgctgtttcacgggggaattatcctatttttttgttcttttgttttgtttgatcaaagcaaaataggaaagcgtagcactattgcattggcaaattgctgtgcatgcatttctttgaactcaaatatagaactgcagaatttataataaaaaaaaaaaaaaaaaaaaaaaataaaaaaaaaaaaaaaaaaaaaaaaaaaaaaaaaaaaaaaaaaaaaaaaaaataatag

SEQ ID NO: 17330 - DNA, 514 bp, Gossypium hirsutum
  Clone ID: uC-gsflnu33B127d12b1
ttgaagttttttttggaacaaaatggatcgtagaagcgcgtttgctgttgctttgatctgcattgtggttgctggtgtcggtggtcaatcaccgagcgccgctcccactaaagcacccccggctgcgactacgccttctactgcacccgctactgctcctgtgagtaaatctaagtcaccagctcccactgctgctccaactactttaccaccggctgcggctccgtcagagtctgcggccgttccagccccatcaaaatttgctccagcttcttcccctccggctgctgctccagtgagtaccccaccggctccagttactgtgagccctcctctagccaaatcgccaccggctgctgcaccaacaactcctccagagagctcggcctctcctcctgctcctgttgcggctccaacaactgccgaggttcctgcaccagctccaagcaagagcaagagcaaaaagaagtcaaagaaacacggtgctcccgctccttcacctgatatgcttgga

SEQ ID NO: 17331 - DNA, 213 bp, Gossypium hirsutum
  Clone ID: uC-gsflnu33B127e04b1
ttattcttcctttgtacatcataatgtcagcttgaacttctagtctaataaaagcttgtttgagggtcccaaaaaaaaaaaaaaaaaaaaaaaaaaaaaataaaaaaaaaaaaaaagaaaaaaaaaaaaaaaaaaaaaaaagagaaaaaaaaaaaagataataaaaaaataaaaaaaaaaataaaataaaatttaaaaactaatataattaat

SEQ ID NO: 17332 - DNA, 516 bp, Gossypium hirsutum
  Clone ID: uC-gsflnu33B127e05b1
ttttatttcttcatctctttaatttctatctataaaatttatagttctttattttctcatagcaataaaaccttgttcaaaataaaaaacaaacaaaccaataaaacccttcaatttttgttcccattaatccttagatggctgtcaagtctcacataatctcaggatttaccatcccattgaaacccactgcttcttcttcaagctccgggaatagtagcaccctctgtttagttaagaaaccactcacttcttccttcttcaatggcggagtagcttccctaaaacttacaagcttaaggagtgttcctggaagatctcattgttatagacaaagaggaggtgcccttggtacgcgcatgaacctttttgatcggtttgctagagttgttaagtcgtatgcaaatgcactcttaagttcctttgaagacccagagaaaattttagaccaagctgtgcttgaaatgaatgatgacttggtaagatgagacaagccacagcgcaagtattagcgtc

SEQ ID NO: 17333 - DNA, 451 bp, Gossypium hirsutum
  Clone ID: uC-gsflnu33B127e06b1
gcacaatcataaaagctttcacaacagaaacagagtgacattatgtaattccaaaaaattactcacacaaccaaaccatacacagacttagctcatcaattcaagagaacaaaaggaaatggaaaacaaagctttatatcaaacgcagaaacgccaattgtgacagacacaccactctcccctctatagtggaggatttcaatatcatcattcattcttcaaataggcttgatcttgaagtggagtgagataagagagaatacaaagcacttcaaatcctgaaccagataataaaatatgcgaagaccttcaggatccttactgctctgaacatcaacaagggacccaatctttgaagttgtgaaagagatgtgctcattccccatcactatctcaagctcttgccgcccaacacggtctggttctggccaattgttggtctagatcgcga

SEQ ID NO: 17334 - DNA, 395 bp, Gossypium hirsutum
  unsure (1)..(395): unsure at all n locations
  Clone ID: uC-gsflnu33B127e07b1
tcccacgcgtccgattgcctcaatcttcaactgcaatttcttcacatgtttgaggtcgacggtgacggcagcatcaaaggtgacgatgaggatggagatatatcgtgatcgctgaatagtagctgttcaatcagttgggcaactgaagactcttttggcagttcatcaagaatggggatcattgtggctcaagccaagcgtataaatgactgaagaatagttaagttattttcagcatttgcctgtactatttagtatttatgcctgaacttgagctttcagaaatgaaagtgaaaacattagtggttgaaactaatattattagagctctttttgcaaaanaaaaaaaaattaaataaaaaataaaaaaataaaaaaaacaaatatattattat

SEQ ID NO: 17335 - DNA, 451 bp, Gossypium hirsutum
  Clone ID: uC-gsflnu33B127e08b1
tgaaaagcagcgtaatgggagaagaagtgaaggtttttggatactgggcaagtccttacagctacagggcagagcttgctttgaagttgaaaggcgtttcttatgagtacataaatgaggatatctttggaaacaagagcgatttgcttttgaaatacaatccggttcataagaaagtgccgggtcttattcacaacgggaaaccaattgtagagtctgttgttatacttgaatacattgaggaaacttggaagcataatccctatttgccacaagatccttatgacaaagctaccgctcgattctggatcaagttcatcgacgaaaagtgctttgctaccctttggctagctgcatggagcgccgagaatgagctagaaaaagtgaccaatgaagcttgcgagtatttgaaaacgcttgaaagtgcgcttaaaggaaagaaatttttggt

SEQ ID NO: 17336 - DNA, 507 bp, Gossypium hirsutum
  Clone ID: uC-gsflnu33B127e10b1
tcttcaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagagaaggcatcgtttcgttgggaggcccttacattcctctcaaaactggaagaagagacggtagaaggagcagagcagatgttgtggaggagtatcttccggaccacaatgagaccatctctggcgttctcgacaggtttgccgccatgggtattgacacccctggagtcgttgccctcctaggagc

SEQ ID NO: 17337 - DNA, 525 bp, Gossypium hirsutum
  Clone ID: uC-gsflnu33B127e11b1
ttcttgcaactactgtcactaagaagcaaggcatagtatctattcttggatcggatactgatcagagaccaaccaaaggttcttcacttagaagaactttatcagctgatatgtcttccaagaaatggctcactcaactgagcaatattgcatcttccgatgaactccctgtttccattgcagactcatcctcagaggaagcagaagaagaggattatcaagaaaagaaggcactcgaaaagcctgcccagttcgatatatggacctcaatcatttcaagcaaacctcaagacgactccaaatcgctccccccgccttacattcaccctcttgtaaaaagatcggggagctgtttaagcgagaaaagcctcgaaatatgcactgagagccttggttccgagactggctccgatgggttttcttcctatcctccgacggaaaccggtgacgtggaggaagatcgtaaagaggaaggtcaacgactccgacagcaaaaactcgcttctacgatgataaaatgatcag

SEQ ID NO: 17338 - DNA, 529 bp, Gossypium hirsutum
  Clone ID: uC-gsflnu33B127e12b1
tcttctgtctcagctcaatcggcagcaatctacacaggattcaacgcagagcagtactactacaggagcacctggtactcctagtctggacttgttgatgaatatgttcggtggtctcagtgccggtagccttagtgttcccaaccaacccaatgttcccccagaagaactgtatgctacacaattatcacaactccgagaaatgggtttctacgacaccgaagagaacattagagcacttcgtgctacttctggaaacgtccacgccgcagttgagagacttcttggaaatcccgggcagtaatgcctcgaaatattcgtgtaaaattagttcatttggcatgtttgccatagccaaccacaaattatcgacatgcctgctgatccccttgtttgtgcgtgtttggtaagcaagtaaaacacattgatgacgatgatcctgagaactttatatcgataggctttgtgcgtaattcggattggatcattcaagtacttgcttatgtacatacacatcagattattgttt

SEQ ID NO: 17339 - DNA, 485 bp, Gossypium hirsutum
  Clone ID: uC-gsflnu33B127f05b1
cctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagagaaggcatcgtttcgttgggaggcccttacattcctctcaaaactggaagaagagacggtagaaggagcagagcagatgttgtggaggagtatcttccggaccacaatgagaccatctctggcgttcttgacaggtttgccgccatgggtattgacacccctggagtcgttgccctcctaagagctcacagtgtcggcagaac

SEQ ID NO: 17340 - DNA, 161 bp, Gossypium hirsutum
  Clone ID: uC-gsflnu33B127f06b1
tttctttgcgtccgcccacgcgtccgatttacataagagtggtggtgatcgagcttttgtcatctttattttcattacagtcaaagaatttgggttgtctttgacatatatagaaataaaataaacaaataaactcaaaaaaaaaaagggttttacctggt

SEQ ID NO: 17341 - DNA, 525 bp, Gossypium hirsutum
  Clone ID: uC-gsflnu33B127f07b1
ttcttttttccaatacaaagcttcatattatcttttttagttccgacaaaagaaaacgaaaaaaatagaagaaatacaatcgttttctttttgaagtcgggttttagtttttggggagaaaaaaatgttgggagtatttagcagtgcgatagtgtctccgccggacgagctggtggcggccggttgccgaactccatcacctaagataacggcggatgctctggtgaaacggttccttgagacgaactcctccggcgtgtccatgcagatcggagaccatgtccaattcgcttattctcaccataaagagtctcctttacggcccagatcatttgctgtgaaagatgaaatcttctgcttgtttgagggagcccttgataacttggggagtttaaagcagcaatatggtctggcaaagtcgggaaatgaagtgattttggtcattgaagcttacaaggcccttcgtgaccgagcaccttatcctccaaaccatgtggttggccatctaattgggagctttgtttc

SEQ ID NO: 17342 - DNA, 525 bp, Gossypium hirsutum
  Clone ID: uC-gsflnu33B127f08b1
tgtttgtagaagacagaagaagaagaagaagaagaagaagaaaaaaagggaacaaaagatggcaattcagattcctagagtgaaacttggaactcaaggatttgaggtttcaaagctgggatttgggtgtatgggtctttcaggtcacaataattcagtgtcagatgaagctggcatagccatcattaagcacgcattcgaaagaggaatcactcatttcgatacagccgacatgtacggacccaaaactaacgaaattctagttggaaaggcattgaagcatttgccacgagagaaggtacagttggctacaaaattcggtgttgaaagcatgggtccaggtggtccggttatcaatggcactcctgaatttgttcgttcttcacttgaggctagccttcaacggcttgatgtggattatattgatctttactatataatcagagttgaccacaagactcctttagaagaatccatggaagaactgaagaagttgtggaaaaaaaaaaaaaaaaaataaaaggg

SEQ ID NO: 17343 - DNA, 510 bp, Gossypium hirsutum
  unsure (1)..(510): unsure at all n locations
  Clone ID: uC-gsflnu33B127f12b1
gtctattgaattctttccctcactttctcgaaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgactnggtttatggtt

SEQ ID NO: 17344 - DNA, 488 bp, Gossypium hirsutum
  Clone ID: uC-gsflnu33B127g02b1
tgattttccattttggaacttgtcagttccgttgatgatgaacaaatttgctatgatcatctggctttcaggacctttggggtaaatggttatgggattaactccttggcaagtctttttctggattatgggtatacccaaaaggaggaactaaggtttcctgctaaaaagttgaaggcattgtggttttctcctcccaatagttcttctcaagatggtggcagtggtgttaatgggcccttgccaagagtatttatttcagagcttcttgtggatcaacttaaccccagagcacaggaaattattagaaaatacaccaaaaaatctggtagtggaaataaatatgcagctcttgcaagtgctctgggatctttaacatgggagaagcctttgtattctgaatttcaacaattggcaggggaaagtgaatatgctgcctggacccttgtcaatgggtatgcactcaatcatgtcactatttccacaca

SEQ ID NO: 17345 - DNA, 400 bp, Gossypium hirsutum
  Clone ID: uC-gsflnu33B127g03b1
tggttattggtggatgagaatgggaagattgcagtggatagcaataatggagaggataacaaaggggtagtgtggccaaagctgtatatcacattgtcaagcaaagaaaaagaggaggattttatggcaatgaaagggtgtaaaccccttcacaggcctaaaaagagagccaagattatccgaaggagcttacttctggtgagccctggggcatggttgactgatatgtgccaagaaagatatgaagttagggaaaagaagagttctaagaagagaccaagaggattgaaggccatgggaaatatgaaaagtgattctgattgaagatacatcaatggcagcagcagggcctttttcttttctgatattttttgggggaatatttttggagttgatgata

SEQ ID NO: 17346 - DNA, 174 bp, Gossypium hirsutum
  Clone ID: uC-gsflnu33B127g05b1
ttagtgtgttgagaagaaggacccaactggtgctaaggtcaccaaatctgctgccaagaagaaatgagagattattgcagagataattatatcagttttcattacagctttggacaattatcttaaatttggactttaaatttactttttgtgagacttgttgatttgcttttt

SEQ ID NO: 17347 - DNA, 203 bp, Gossypium hirsutum
  Clone ID: uC-gsflnu33B127g08b1
tgacagctttaggttctatctgctgctacctgtaacttgcttttctttttctttttctttcctgaatttgtaaaattattgtgtacagagttttaggtctgtaatctgtaactttgtttcagtaatactagaattacctcccatatcccacaaaaaaaaaaaaaataaaaaaaaaaaaaaataaaataaaaaatattatcaac

SEQ ID NO: 17348 - DNA, 279 bp, Gossypium hirsutum
  Clone ID: uC-gsflnu33B127g09b1
tgtaacaaaagaaaaaaagaaacaaaaaacagcaacaataaaaaaaaacaatgagaatgaaggtcgaaatcgataatatgggggaggacatagccgcgtgggtccctcccaagggggggcgccactttgtaggaccagaactgatctccccttactgcactggcatttatcttttttttaccgccccaaattgaaatcgcctggccgtgttttaccagactggagcgggggaaaaccctggatttcccaagttgactccactggagcaccatccccttt

SEQ ID NO: 17349 - DNA, 513 bp, Gossypium hirsutum
  Clone ID: uC-gsflnu33B127g10b1
tcgtccacgcgtccgctgttttgagggtttattcatttgcagccatgaaattcagaagcttttgtttttgcatcccaggatcaaagcaagaagattcagacagttcttctaacaaagcaaaatcccataaaaagtctgacaaaagtgggaaaaaggaagggaatgtggatgatgctgattatcagggtgccactactactactacgacagccagcagtgatgctggaatggctgctgctgtagcagtgggtgccactacagcacatgcctccgctgtggaatgaagtggttgcgatggttgtcatgcaggtggtggtgttggcggctgatagccggacactatttcaaaaaagctggttcagtttttggcctttggcattcttcatcatattgatttcagaatctttctttcatcttgcatgaaaagtgcttggttttttcatctttatatttttgggggtcttttttttttccccgagtctaagttgtgcattgggattactggtttttatt

SEQ ID NO: 17350 - DNA, 483 bp, Gossypium hirsutum
  Clone ID: uC-gsflnu33B127g11b1
tcgttcagtcatatggttcaaatgtgcctccacagcagcagtatgcatatgcatcaagtgggccaacgcaacaaagctatcctccatatggctctgcaccacctagtgatgggtacagtcagccttcaactgagggtggccaggcttatccgcagcatggtagccagcctgttcctggttacagtcaaccaactgcatatgcacaagcaagtagcgctgctgggtatggtcaatacccaccatcgtaacaaggctactctgaacagacacaggctcctaacaatgcaggttatgggtatcaaggtgcgcatgattctggttatggtggtgcgcctgcagcaacatatggtgcgcccccagccagtggccaagcaacttatgctcaaacaacagctgatcaacctacctatgatcagactgttcctcaatctggtagttatgctgcaacgccaggtagtgcacctgctgggtatggaaaacagt

SEQ ID NO: 17351 - DNA, 508 bp, Gossypium hirsutum
  Clone ID: uC-gsflnu33B127g12b1
ttatgacaaccagtgtactgtgcaattgctggaaggctcactcctggtaccttcactaaccagctccagacatcgttcagcgaacctcgtcttcttatcctcacagatcccaggactgaccaccagcccatcaaggaagcagctcttggaaacattccaaccattgctttttgtgatactgactcaccaatgcgatatgttgacattggaatccctgccaataacaagggaaagcacagcattggttgccttttctggctgttagctagaatggttcttcagatgcgtggaacgattgctcctggacagaaatgggatgtcatggttgatctattcttctacagggagcctgaggaagctaaacagcaagaagaggaggaagcaatcgctgctcctgattatggactccctgctgctgattatggaatgggtgctttagcagctgaccaatggcccgcacatataggtgatcaatggtctgctgatatggctcaggcacctatctctg

SEQ ID NO: 17352 - DNA, 455 bp, Gossypium hirsutum
  unsure (1)..(455): unsure at all n locations
  Clone ID: uC-gsflnu33B127h03b1
tttgttttgacgagtggcggagaaatgaacagttttgggttatcggtggtgtgtcggcacatctttttgctgttttccaagggcttctcaaagttcttgctggcattgacactaacttcacggtcacttcaaaagcatcagacgaagatggggattttgctgaactttacatgttcaaatggacaacccttctcattccaccaaccactctcctcatcataaacttggtgggggttgctgcaggaatatcgtatgccatcaatagtggctaccaatcatggggtcccctctttggtaagctattctttgccttctgggtgatcatccatctctaccccttcttgaaaggtttgatgggacgccaaaaccgtacacctaccattgttnngtgatggtcaattctgcttggctccattttctctttgttgtgggtgccgatcgatccctttacaacc

SEQ ID NO: 17353 - DNA, 507 bp, Gossypium hirsutum
  unsure (1)..(507): unsure at all n locations
  Clone ID: uC-gsflnu33B127h05b1
ttttgtattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggcctataattatgtctctgtctgcgtcttgtgtaatagaagctctgtttgtggtgaaaataatgtataagccatttggttgggagcaaattgtccttttctccaaaggattnttgctgctcattcatggtgacttggtttatgggttt

SEQ ID NO: 17354 - DNA, 258 bp, Gossypium hirsutum
  Clone ID: uC-gsflnu33B127h06b1
ttctttcgtccgcccacgcgtccgggagtttaaggttgaattaggagtgtttccattgttgtctggtaactgttctcagtattgggtgcttgacagacggtggcatatctatgggtggtctctagcgttacctggttttgattaatttactactgtatcttgtcattgtcaagaggtgcccccttggttttccaaggtggcttgaaacttttgtttatgattttcgttgaagttgcggaattatttattatgaataaa

SEQ ID NO: 17355 - DNA, 438 bp, Gossypium hirsutum
  Clone ID: uC-gsflnu33B127h07b1
cgcgtccgcccacgcgtccgtaaagtactaaagtttgaaggtagctggatctgccacaggcattcttgtgctgaatgtggtggcccccctcagttttattgccttgcttgccctgattctgtctgtaggctctgtgttggggcatatgagattgtgcgacattaagttggacaaaagactctgcaagacacgtttcgagctcccactgcttgcagaaaagaatgcataaatggagttttagggagagaagctagactttcaagatccaacgacggatgaatacttgtttaaagaagatttcgctgataataatggagcaagaagagttgacccttgatgatttacatcatgcttattctaagagggagaactagtacagcggctcatattgtgataagaacaaagattaagatgatgcaatctaatatcggatgctga

SEQ ID NO: 17356 - DNA, 292 bp, Gossypium hirsutum
  Clone ID: uC-gsflnu33B127h08b1
tataaaaaaaaggaaaatgaaaagtgtgaatggaaaattcttgaagaagctgaaatcaatcaaaccagttggttacctaaagccagatcgtgttcttcaagtgtttgccattgatgggtttattgattcttatacgaaaacacccaatcccaatgaacaagccaagttgttcaccaaagaatttgaggagcaagaaattattaaagaaaaccagcctgaaatcatcgatgtagaagagctaatgaaagaatttgaatttgacgaagacgaagatgaagatggtgaagaagaa

SEQ ID NO: 17357 - DNA, 527 bp, Gossypium hirsutum
  Clone ID: uC-gsflnu33B127h10b1
tctttattatattgttgactgggagttccaaacagatggacttatcaggattaaggttggacttagcggcattttgatggtgaaaggtaccgcatatgagaacatgaatcaagtggaagggcaagaaaatctgttcggtacccttctgtctgaaaacgtcattggcgtcatccatgatcattacatcacattctacttggatatggacatagacggctctgataattcctttgttaacgtaaatatcaaaaggcaagaaacttctccaggagagtcaccaaggaaaagctatctaaaagctgttagaaatgtggctaaaacagagaaagatgctcaaattcaacttaaactctatgacccatcggagttccatgttatcaatccaactaaaaagacaagggttgggaaccctgtcgggtacaaggttgttcctggtggcacagcagctagtttgctggatcatgatgacccaccacagaaaagaggtgcattcacaaataaccaaatatgggtcacttcatataaca

SEQ ID NO: 17358 - DNA, 488 bp, Gossypium hirsutum
  Clone ID: uC-gsflnu33B127h11b1
tcgtacttgtggagcttcttgtgtgcattgggtgaagcgcaatatttgaatcggactttggttatggatctgaaactttgtttatcttcaatttatacttcctcaaatcaggatgaggaagggaaggatttcaggttttactttgattttgagcatctgaaggaggccgcatcagttttggatcacgagcagttttggcaagactggaataaatggcaaaagaaagatggcttgagtcttcatcttgttgaggattttagggtgacgccaatgaagctttctgaggtaaaggattctttgattatgagaaagtttggattggtggagcctgataattactggtacagggtttgtgaaggagagactgagtctgttgttcaaaggccatggcatctggtatggaaatcaaggaggttgatggatatagtgtccgcaattgcgtcaaagttgaactgggattatgactttgttccaatgtgagaggggag

SEQ ID NO: 17359 - DNA, 518 bp, Gossypium hirsutum
  unsure (1)..(518): unsure at all n locations
  Clone ID: uC-gsflnu33B127h12b1
tttcacgcgtccggttaaatacccaagtatctataaatttaaatatataaattaataagcaccaatctatggctcaactagggtcgtctctgtcagcagaaaccgagacactgagcaatgtcctaagcctggtggaggccttcagagcatttgattcacacaacgatggcgcaatcaatgctgcagagctagggggaatcctgagttcgctggggtacaacgctagcgagcaagacgtgagggccatgatgcgagaaggggacgccaacaaggacggattactgagcatggaagagttcctagagatgaacaccaaggacatggagcttggggagcttgccaatttcctcaggaccgctttccaagcttttgaagtcgaaggggatgatgctttgactgctgccgacttgtatgaggttatggggaacctnggcatcgatcagctttccttggaggattgccagagtgttattgcctccatggatgctgatggtgatggagcttgtagcttggaggac

SEQ ID NO: 17360 - DNA, 484 bp, Gossypium hirsutum
  Clone ID: uC-gsflnu33B128a02b1
tcctacgcgtccgcccacgcgtccgcccacgcgtccgatcgatcccttcttcgcctaacgatgcttgattaggtgctttgccggttaataactctagcaacaacactccaaagctatacacatcagacttgaaagtaactttttgggtttcaagcacttcaggtgctcggtagcctgcaacacgactaggtggggtggagttgccgaacaaaggattgagaccgaagtcagagatgcaagcatcttggtctggtcggagaaggacgttggaggccttgatgttgccgtgcaccaccttcccggaaacatggagatgggctaaacccctagccgtgctcaacgctattctcatcctgttgtcccaacctaacggagttcggcctgagcctctactaccgtgaagcagggcagacaagctaccgtcgcgcatgaagtcggaaacgagcaatttttcatctttggagtaataaaatgctcttaaagg

SEQ ID NO: 17361 - DNA, 169 bp, Gossypium hirsutum
  Clone ID: uC-gsflnu33B128a06b1
ttctatcgcgtccggaaaaaaaaaagtccccagaagcaaaagcgaaaagtttggtgttattttgtcataaatactgtaattacataccatttttttaatttttttttgtgtatgaatcattgcctcttattatataatgcataatgataataaatatgaacaaccttgg

SEQ ID NO: 17362 - DNA, 444 bp, Gossypium hirsutum
  Clone ID: uC-gsflnu33B128a07b1
tctctctttgtctctcttttcatttccatttttttctctcttctatttcatcccttttgcagggcaaaggagaaaaaacaaagcaacaaaaaatggctcaaagaaccgaaaaagaagaaaccgagttcaaggtaccggaaaccttaacgctttgcgtcaacgattgtggtgttataggaaatccggccaccaataacatgtgtcaaaattgtttcaacgctacaacgcctaaatcaaccgctgccgttgtctcctcttcaaccggtggtgctagttcagctggtgtttcgatcctgaaccaaagatctaccacgtcgcgttctataaacaagcgatccgatctttctccgcctaaaacgacgacgtttggtaggagttctggttcgaggaacgatccggagcctggtacggaaaagagggtggtgaacccgggttctggatgta

SEQ ID NO: 17363 - DNA, 484 bp, Gossypium hirsutum
  Clone ID: uC-gsflnu33B128a08b1
tttatttattacctctaaaagaaaaccgtagccgtctctcacagaccaaaaatgactggagaaccagtgaaccccaaagcataccctttagcacatgctcaattaacgaccacgattttggatcttgttcaacaggctgctaactacaagcagttcaaaaagggagctaatgaagctactaagacacttaacagaggtatatcggagtttgttgtgatggctgccgatactgagcctcttgagattcttttgcatcttcctttgcttgctgaagataagaatgacccatatgtatacgttcctacaaagcaagcacttggccgagcatgcggtgacacaagacctgtaatcgtatgctctgtcacatcaaatgaaggaagccagttgaaattgggaatacaacagctcaaggatgccattgagaagctccctatctaaagatatttacgtactcatattcggggtgatgggtctcttggaatgt

SEQ ID NO: 17364 - DNA, 374 bp, Gossypium hirsutum
  unsure (1)..(374): unsure at all n locations
  Clone ID: uC-gsflnu33B128a10b1
taatttgatcaccaactgtttaaataaggacttgccagccatgtttgagaaatccttaaagaaggaaatagctgcagttggccctgttgtggctcgtgctattagtcccactctggagaaaagtatatcttctgctattacagagtcattccagaaaggcattggggagagggcagtgaatcatttggagaagtcagtcagttcaaaacttgaagcaacagtggccaggcaaatccaagcacattttcaaacttactggaaagcangcacttcaggatgcactgagatctaacttggaaacttctgttattccagcatttgagatgtcatgcacatcaactgtttgagcaaaattgatgtcacatttcataaag

SEQ ID NO: 17365 - DNA, 261 bp, Gossypium hirsutum
  Clone ID: uC-gsflnu33B128a12b1
ttaatccgaaaactacctttccctcaatccattcggtcaagttccagcttttgaagacggggacttgaagctcttcgagtcaagagcagtcacccattacattgctcatgaatacagcgacaaggggacccaactcttaattcctggctctaacaaggatatggctgtcttacaattatggaaggaagtggaagcccaccagttcgattctccatgttcaaaaatagcctgggaggcgttttacaagccattaatgggcat

SEQ ID NO: 17366 - DNA, 136 bp, Gossypium hirsutum
  Clone ID: uC-gsflnu33B128b01b1
ttgaaaaagagaactacaccctgaatttagattccgaagtgtttccggtgtcggaaattgtagagttttaagattagaggtggaaagcctattgaattgaaaatgaaattcttttactacatattcttcattagtc

SEQ ID NO: 17367 - DNA, 431 bp, Gossypium hirsutum
  Clone ID: uC-gsflnu33B128b03b1
ttttgtgggttaacccagactgtggtctcaagactcgcaagtatgccgaggtgaagccagccctgaacaacatggttgcagctgccaagctgctccgcacccaacttgcgagtgccaagtgagaggcatatccaaggtcggacatcatcctttatatcgaagatgatccagaggaaatttgtcttaaatcatttgaataactgtgttggaagtatttgttaggcgtatcatatgcccctctttgaggccaattgttttccttttcttttttggttatttcccctctaaatattttgtatttttgggaatatatgaattaccttcaattactttgaaaggcacgaaatttggtagtgtatcttttatgagcctaatgaaaatgtcagtactggctgtggctgtggctgtggctgtggactgactatattagc

SEQ ID NO: 17368 - DNA, 461 bp, Gossypium hirsutum
  Clone ID: uC-gsflnu33B128b07b1
cccacgcgtccggttacacgggagcaaggctcgtttgagtggttcaggggggtaatgaatgaggtagctgagtatgatagagataggatgattgaacttcacaattactgcaccagtgtatatgaagaaggggatgctaggtcagctttgatcaccatgcttcagtccctccaacatgccaaaagtggtgtggatattgtttcgggaacacaagtgaaaacacattttgccaggccaaattggcacaaggtcttcaagcacgtggctgttaaccatacggacaagagagttggagtattttactgtggagcaccaggattaacaggggagctaagaaggttagctcaagagttttcaaggaagaccagcaccaaatttgatttccacaaggaaaacttttaaaaattggtcctattgggttcatttaattttttttttttctatatattttgggaaatgca

SEQ ID NO: 17369 - DNA, 385 bp, Gossypium hirsutum
  Clone ID: uC-gsflnu33B128b10b1
tcccacgcgtccgcttcgtttagctgtaagtaaagttttaaagatcattctctgagaaaagaaacccccccaaaaaaaaagagcaaatagttggcattctggtttctatgaatatgtcgtgttcaccggaatttatggttcacaaaccggcgaggtcaccggagaagacaagttttacccaaacttgtaacttattgagtcagtacttgaaggagaaaggtagctttggagatctaagtctgggtatgacatgcaacgttgaagctaatgagactcccgagatgctgcgtcccaccatgaatttgtttcctgtcaatgggaaatccggtgatgattgccatgcggcgccttctcctcgaaactgagatccatggaattgttccct

SEQ ID NO: 17370 - DNA, 476 bp, Gossypium hirsutum
  Clone ID: uC-gsflnu33B128c01b1
ttcccacgcgtccgctattccccagtctcaattattatcaatcaataccagcttcccttatccgccctttgtttttatatagcttttggattcaatctgaagattggagcctcgggttctgttttgataaggggcatttgagtttaagagttgatcttttgtttgtccgacaatggcgactgctattgggatgattggtgggaagggttgttcctcgtggatgcaagttaaggaaaagggaaagaagaagatggccaacagagttagagtttattgttcttctgctccgtcggtgatggatccttataaaactctcaggatccaacccggcgcctctgaatctgaggtcaaaaaggccttcaggcaacttgccctttagtatcatccggacgtttgcagaggacgcaattgtggggttcagttttaaacgatcaatgaagcttatgaaatattgatgagtagaatgagaggagaac

SEQ ID NO: 17371 - DNA, 473 bp, Gossypium hirsutum
  Clone ID: uC-gsflnu33B128c03b1
cccacgcgtccggtttcattttcaattttttcatgaaagaaaaagcggcactgacttaggaaatagagatggaaaggaggaggacaagaagaagaagtagctgctgttccttttcttaagaactctgtgacttaaccctaaaacaaatctaatccaagatcaaattgttttccttcctttttgaggcaaatatttcaaagacacagtagatctgtaaaagcttctcctttctattggtttctgacaacagagatggattcttaaactggttgattccaatgggtgctgtttgtaaacctaagttggattcttttcaaatgaaagcatgtgccgcggattagcgtggttaaattgcaggccacctccaacaacatctaatatttctttttaagatagctgagacatgaatcactcgactctagaaactgaagatacttttgcaagcttgcttgagcttgccgctaataatgatg

SEQ ID NO: 17372 - DNA, 454 bp, Gossypium hirsutum
  Clone ID: uC-gsflnu33B128c04b1
ttttatcatcttcatcgtcgtcgtttgttcctcaggtggaattttctcgggaaacaagcagaaaattgctgtaaagaaaaggaaaagaacagaatacaagaacaaaaaaagaaaacatgatgatgatgtcatcagcttcatcatcagcagcgacagtagctgtagataaggcaacgagcgatcttctaatgggtcctgattggactatgaatatcgatatttgcgattctgttaattctaatcattggccagcaaaggatgttgtaaaagctgtgaagagaaggttgcagcacaagagttctaaagttcaattactagctttgacgcttttggaaacaatggtgaagaattgtggtgattatgttcattttcagattgctgagaggaatatattgtgggagatggttaaaatagtgaagaaagaaagcggatatgcttagtgagggataaaatt

SEQ ID NO: 17373 - DNA, 482 bp, Gossypium hirsutum
  Clone ID: uC-gsflnu33B128c06b1
tggtagagacatcggtgttgatattaacgccttacggaggaagaatgaagcaaataaagagttcggcaactccatttccttatagaagtgagtatttatatgggatacaatatatgattagttgggatgtagcagaggaaacagggaaacgcatagggtggatgagaaggttgtacaagtacatggaaccttatgtctcaacagcaccgagggctgcatatttcaattacagggatcttgatttggggaggaacagttacccaaatacaagctatgtggaatcaagcgaatggggtttgaaatacttcaaccataatttcaatagactggttcgggtgaagactttagctgatcctcacaatttcttttggaatgagcaaagtattccagtattaaggttagaataaagcattgatttgctttgtttatatacacttgtttgaggtcacatacagtatatataatgcatgctgtaactgaaa

SEQ ID NO: 17374 - DNA, 447 bp, Gossypium hirsutum
  Clone ID: uC-gsflnu33B128c07b1
gttcacacaccctatcattttttctttgttattcggcgtactcagggacctccatttccagctactacttccgcagcaaacgcagaggtgatatcgttgtggatctttgaataagataacagaactctgccttcatcatctctggccacaatacctgaggctgagtatttctggctttctttgtatgctccgtcgaagtttatctttatgaaatcgcgattgcgcagtagaataaacaactttgccaatggttgagctattctaacacccagggcattctcgaaataggtggtccattgtttaagctctttcaccacatctggggcagtttgtgtctgctgataatttcctgtgttggaaattcacttttgtaggcaaaaagttccatgatagtctccatattggaatctttatctttggtggtaaaatcaggctccaaaggttttt

SEQ ID NO: 17375 - DNA, 473 bp, Gossypium hirsutum
  Clone ID: uC-gsflnu33B128c09b1
taaagcatatattggagccatgtcttttattggtacccaacaaaaatgcaaggcttgtgaaaagactgtttacccagtggaacttgtatcactagatggggttcctttccataaatcttgcttcaaatgcagccattgcaaagggacattaaagtggggtaattactcatcaatggaaggtgttctttattgcaagcctcatttcgagcagctattcaaggaggcgggtaactacaacaagaattttcagtcacctgccaagtcagccgagaagttaactcaactgacaagatcgcctagcaaagcggccggcatgttttccgggacacaagacaaatgtgctacttgtggtaaaactgcttatccactcgagaaggtaacagtggaaggtcaatcttaccacaaatcatgtttcaagtgctctcatggtggttgccctataagcccttcaaattatgcagcacttgagggca

SEQ ID NO: 17376 - DNA, 265 bp, Gossypium hirsutum
  Clone ID: uC-gsflnu33B128c10b1
tttctgccacccgtcccagaggctcctctaagagcgtcttatgttgcaccatgcctggcttaacgggaatcaagcctgctcatctattcccctttcccaattatactactcaacggagggacggagacattgggtagacaaccatacgcgggggtaccacagttctggctacagggcacacacacgtctatcaccatatatcaggactcatggcattttgacactgacatctcacattgtttatgtgcaccgcaatcagatttag

SEQ ID NO: 17377 - DNA, 362 bp, Gossypium hirsutum
  Clone ID: uC-gsflnu33B128c12b1
ttttccacgcgtacggtagatttcattatcgataaggtaccccatttgataggaaagaaagtaaaagagtagtaatctaatggttgaaattcatgcatacgatcatattgatgtatgctatatgttcttggtcgagtcattagattagacgtgttcctttcaatttttctttactttccttcttaccaaacagagtgttagtgtttgtggcggcaagtggtggcttggcggcttggcggctttggtatttggttgaattcttcattgcagattcatttgcatcattttatgtataattttgcattggacctctttgaggcattgaagatggaaaagcttaaatctgttgaaatagctttaac

SEQ ID NO: 17378 - DNA, 403 bp, Gossypium hirsutum
  Clone ID: uC-gsflnu33B128d02b1
tttcttcaacgcacctcacgacgttccctcccctccctacatctgcaccttcaccgttgttgtagagtcagagaaatgacgtcagatggtgctacttctactccggcaccggtgccgaggaggaaaccgtcttggagggagagagagaacaacaggaggagggagaggaggagaagagctatcgctgctaagatatatactgggctgagagctcaaggaaattataatctgcccaagcactgtgataacaacgaggtcctcaaagctctttgtgccgaggctggttgggttgttgaagatgatggcaccacttatcgaaagggatgtaagccacctccgattgatatagcaggcagttcagctaaaattaccccatattctttccaaaatcctagtcccttat

SEQ ID NO: 17379 - DNA, 478 bp, Gossypium hirsutum
  Clone ID: uC-gsflnu33B128d03b1
tgtcctcaagactgaaggaaggaaagttgatgtcaaagagttcgagtccatgcaacaactttcgaacaagaagagcaatgatgacatctttatcaaactgggatctgaaaaggacaagcgcaaggatgctgataaagaagaaaaagccaaaaagtctgtgagcatcaatgagttcctgaagccagctgaaggggagaagtactatggacctgggcgtggacgaggccgtggccgtggtcccagaggtggatatggaggcaacacagccagcaatgtgcaagctccctcaattgcagatcctggacacttcccctcattgggtggcaagtgatgttcgccaccacaatctccgcaatggttttcacttggaatccattgtggtttattctatagtcaggagttcccccaccttttccccaaaaaacttttaagacaaatcaccattttccttgttagaaaccatgaacgtgttttttga

SEQ ID NO: 17380 - DNA, 479 bp, Gossypium hirsutum
  Clone ID: uC-gsflnu33B128d04b1
agtagagcttctttctatctatatccttatcagctttcaaagatggcaggaatcgcctttggtcgcttcgatgattccttcagtttggggtctgtcaaggcctaccttgctgagtttatctcaactttggtgtttgttttcgccggcgttggctctgccattgcttacaacaagttgacaactgatgcagccctagatcccgatgggctagtcgccattgctgtttgccacggatttgctctctttgttgcagtggctatcggtgccaacatctcaggtggccatgtcaaccctgcagtaacttttgggttagctcttggtggccaaatcaccatactcactggcatcttttactggattgcccaacttcttggatccattgttgcttgcttcttgctcaaggctgtcactggtggtttgacagttcctatccacggtcttggagctggagttggagctattcaagagtggtgatggag

SEQ ID NO: 17381 - DNA, 459 bp, Gossypium hirsutum
  Clone ID: uC-gsflnu33B128d10b1
gaaggcctattctcctgcctctccttttgactcattcgagaatcaatcaaggcttcatcgaatcgaaagactcacgcgtcttgctcataaaccccgaatcgccactcgatttcgatcatggcgaagcaagcaagggtttgaaggcatcaaacgcaggtaagcttcgcttctcccttttttattataaaacgatgaagaaaagcccactgaaataagtgaagaacgagagttcaaaagggaagggaaatcaccttctcagttttttcgattgctttctattgtctctgtattcatacaatatgcgctgatatttcgttttttttgttgcgtaaccctttacaaagactgaaattctggctttatagtcgaaaaggaaaggaaaaatttacgaaaaataaaaaaaaacaatggttttctttttttgttccctttgctgctgttgctggtttgcctctttgc

SEQ ID NO: 17382 - DNA, 379 bp, Gossypium hirsutum
  Clone ID: uC-gsflnu33B128d11b1
cccacgcgtccgggatcgttaaaggatttactgccgaaagaggaggcagagaattcagttgggatagctaagcttctcgaaatcgcgatcggggtcgctcaagggatagaatacttgcacaatggttgcgaatcaaggattttgcatctcgacataaagcctcaaaatgttttgcttgaccagagtttgaaccccaaaatttctgatttcggattagccaaagtatactctcgagaccatagctatgtgacgatgacgagtgcaagagggactattggctttatcgctcctgagatattcatgagaaatctgggaaacccttcgcataaatccgatgtgtatagctatgggaagctgctgttggagatggtaggtggga

SEQ ID NO: 17383 - DNA, 423 bp, Gossypium hirsutum
  Clone ID: uC-gsflnu33B128d12b1
ttcttaaaaaaaccaagcctatcctcctactattcggccgaaccaaaggacacccctcaacttctcttgttggccgatcatgggtttcatcggcgtctacacctccacctctgtcgtggttcatggctcaagtcacggaaagatgagatgacgcctattcatctcttttggtccgatacccaagccggagaacggcctccgacaatcgaaaccgcaggtaagaacctccaaaatcttttcttttttcttatagtagtgaaaagagaaaaatgagagtttgaaagcgagatcagtagccaaatattgaaacgaaaaatcacctcttttgatttctttgccctttttttgtgctatgtgcgcgtaaaaaaacatacaatctagtcttggggctttatagcccaatacatgtgaattgatttttgc

SEQ ID NO: 17384 - DNA, 309 bp, Gossypium hirsutum
  Clone ID: uC-gsflnu33B128e03b1
aaaaagaaaaaaaaaaaaaaaaaaaaaaaaaaaaaaaaaaaaaaaaaaaaaaagataaccgttataggggggaggaggtttgcgtccccctggtctcccccctttctagagtgtcccgtgcttgcgtcctacggtcatgcaacgtgtctcgtttttttctagtgtcccctctgtgcaatcccttggccgtcctttttcattgtcctggttgggaaacccctgtttttccccagcttatttgctttgcaggtctgccccctttgccctttgggccttttgcccaggcggcctggcccgtgggcccttccc

SEQ ID NO: 17385 - DNA, 465 bp, Gossypium hirsutum
  Clone ID: uC-gsflnu33B128e05b1
tttctacgcgtccgcccacgcgtccgggaatctgtcaaggaatgttacgaggcttttgtgatcgctaagttcatggctttgatgtatagttacttgaatatatctattagcaaaaatattgtacctgatgaaattaaaggtagagagattcaccattcatttcctatgaccctttttcagcctcgaacagttaggctgaaccaccatacactaaagcttctcaagtattggacatggcaattcgttgtcatccgcccagtgtgttctgtcttgatgataaccctgcaacttcttcagttttatccatcttggttgagctggacattcacaatcatcctcaatgtgtctgtttcattagcattatactctttggtagccttttaccatgtctttgccaaagagttggaacctcataagccacttgcgaagttcttgtgcatcagggaattgttttcttttgttttg

SEQ ID NO: 17386 - DNA, 300 bp, Gossypium hirsutum
  Clone ID: uC-gsflnu33B128e07b1
ggaggctggagagagacaccgggatgaacattgacagacaatcaggatcgaacctcgacaacaagggcggacttgagggatgactctattatgctcaatagggacgttatgctgtgcctacaaacttgttcggttgcagccggatgggcttcgattatttaggacgtattatgagtgggatatacactatctatatatgttctccgttgtgtttcaaaaaaaaaattatcagtaaaaaaacaaaataaaaaaaaaaaaaaaaaaaaaaaaaatcattaaaaaaaaaaaaaaagggggggg

SEQ ID NO: 17387 - DNA, 479 bp, Gossypium hirsutum
  Clone ID: uC-gsflnu33B128e09b1
tgtatttgaaagtggagaagttggctgagaagcatggatgtagccctgcacaattagcacttgcctgggttcttcatcaaggggatgatgtagcaccgattcccggaacaacaaagataaaaaatctggatagtaacattgattcagtaaaagtaaagctcacagcagaagatttgaaagaaatttctgatgtggttccgataaatgaggtagcaggtgatgttttgcctgatagatttagtcaattacactggaagtttggtaatacaccaccaaaggggagcaaggtttcaacctgaaaaaaccatggatgccaagtctgcagcaaaatatgaggttttggatgaatggactgtccaacaactcaaactattgaaaaattgtatcaatgatttagtaagcaatttggttagagtactaatgagggttgagtgagagtagaagcctgcattaccaaaccaaaacaaataagcagtttt

SEQ ID NO: 17388 - DNA, 310 bp, Gossypium hirsutum
  Clone ID: uC-gsflnu33B128e10b1
tttgtgtgatagaagctgttgcgattggcgatggtacgaggatggagcgccttattgatgccgagcaaattatcactatttggtcttacaaaatccatgaaatcttagataaagctactgtgagtaactatgaggggaggacgctaagagtcctcatagaggctgctagggaagctactcaagttaacaatatgatggcacataatgatgaaacagatgcacgacctatatgaaccggccaaatgacagacctggagattaatctagccggtcaggaagcatacgcagctgcatagactgaaaaatgttc

SEQ ID NO: 17389 - DNA, 459 bp, Gossypium hirsutum
  Clone ID: uC-gsflnu33B128e11b1
ttgttttatctaaaaggttcaaaaggaggggtatttacattgaaagactgaatgatctaatggagaccaagggtgggaaaaagactaagtccaatagtagtagtaaatcctttttctatgaagctcctttaggttacagcattgaagacgttcgacctcacggtggaatcaagaagttccgatctgctgcttattccaactgcgtccgaaagccatcatgagatttgcgagattcatagatagtcccaaagcctcaacctcactgcaattatatctagtttgtttggttacttgcttgcttccttattctctagttcttccttctttgtatgcttgcttattttaatccaagatggcctttcctgtctctgcaatcggatatgaaggctatgaaaaaagacttgagaattcggatttttgactctggtttttcttgatgatcctcgagggatggggcct

SEQ ID NO: 17390 - DNA, 424 bp, Gossypium hirsutum
  Clone ID: uC-gsflnu33B128f02b1
tattttggtgggacgacgacagctgcaattggagggctaagcagccgtgaattgtctgttcccctcgaccagaaccaccgtcagatgaaggctgagatagccacacatccgctctacgaccagcttttaactgctcacgtctcttgtctccgtgttgctaccacaatcgaacagttgcctttgatcgatgcacagttagcacagtgtcataatgttcttaggtcctatgcttcacagcatccccaacatggccactccctttcaccccatcacagacaagaccttgacaacttcttggcacaatatttgataatgctgcgtaggttcaaagaagagcttcaacaacatgtgagagtcgatgccgttgaagctgtcatggcttgccgtgaaatcaaaaaaaactacatgctctcactggagaacc

SEQ ID NO: 17391 - DNA, 485 bp, Gossypium hirsutum
  Clone ID: uC-gsflnu33B128f04b1
gcttgtacaatcatgctgtcttgctttgtgcgaagatggaatttatggacctagtggggtgcttcttttacctgatgtagaatgggtttactgttcaaccatgccacctgtctctaggctgcacatagcaactttatccgccgaaacatctgatatatatcaatatgctactgtgtgattagtgtgggtgcatttatcgcctcttaaattcgagttgtactgagctacgccttagctttttcagaaaacatacattatttttatatttcttatcttaattttgaaggactttgagtgagtcttgccttgtgtttgtttggtgtaacaataaaagggttcaatgatacttgctaatagcccaaatttcttcaagacgagcttgtttgtatttaaggtctttttgatgtcctttgagggcattgaagtgactaatacatgatttaattggcactcctgagtttgatttgctatccggtacctctact

SEQ ID NO: 17392 - DNA, 426 bp, Gossypium hirsutum
  Clone ID: uC-gsflnu33B128f07b1
ttgaggcatcacattggtttgacatctacacgcatctgaattaattggacagcaacatattcatattttgcattactttactataaattccaactatctgacgccaatttatatcatcctcttcctcacatactaatcttcagtttttgccttcccaccggcttaacaccgcctttcagttttcatttcctctaagaaaaggattaaaatggcgaagaatatgatgcgagccgttcaatacagtaaatataacggaggcgccgctgatctcaagcatgttgaagttccggttcccagtccaaaaaaggatgaagttttgatcaaagtagaggcagctagtattaacccaatcgactggaaaatacaggagggggtagcgcgcccattttaccttgcaaattccccacatttctggtaccgatgtag

SEQ ID NO: 17393 - DNA, 290 bp, Gossypium hirsutum
  Clone ID: uC-gsflnu33B128f08b1
cccacgcgtccgggcagcgtttgggcccagagctccaatttccctcagttcaagccagaagaaatcactggcatcatgaatgacttttctgaacctggatcgcttgctccgactggattgtaccttggtggcacaaaatacatggtgatccaaggtgaacccggagctgttattcgagggaaaaagggccccggaggtgttactgttaaaaagaccaacctgtccttgatcattgggatctatgacgagccaatgactccaggtcagtgcaacatgattgtggaaaggct

SEQ ID NO: 17394 - DNA, 423 bp, Gossypium hirsutum
  Clone ID: uC-gsflnu33B128f09b1
tcaaagttaaccatgaagaagctctaccgcagaggcacggttcatccatcacctccgagcacaaccgatcatctgtctttccttcctgccaccatcttagccctcgcggctgctctttccccggaagacagggaagttttggcctatctcatctcttgtgctaacaacgatttcagcaccttctcaacccaccggaaaaacacccagaaatacccgactaaaagaagcatcagcttcagcagcggcagcgatcatgaccatccacctctttttacctgtgattgtttcaggtgctatatgagctactgggtcaggtgggactcatcgcccaaccggcagctgatacatgagattatagatgcttttgaagatgggctagctcaaagcaagaagacaaagagcaagaaagacaggcaaaagaag

SEQ ID NO: 17395 - DNA, 480 bp, Gossypium hirsutum
  Clone ID: uC-gsflnu33B128f10b1
tctcatttgttccactcatagatccactcaattggcaacagccaccaactcatcaacaagatcaagttttcactaaagacaatcatcatcatatccataatcctcagcttccaccgccaccaccagctggtagtagtgttggtattaataggcctggttcaatggcggaacgagctaggctagccaacatgcaaaagcctgagaaagctcttaaatgccctcgatgtgaatcaacagacactaaattttgttacttcaacaattacagcctttcacagcctcgctacttttgcaaaacctgtaaacgatactggactagaggcggtgctttaaggaacgtgccgatcggtggtggttgtcgaaccaacaagagaagcaaaggaagtaaaccaacaaagtctccatcaataggccaaatgaacccaacaccgccacagttgcctctattattgcaccctttacattatcttggtgactata

SEQ ID NO: 17396 - DNA, 465 bp, Gossypium hirsutum
  Clone ID: uC-gsflnu33B128f11b1
tttaaaaagcttattaaagggaaaaaaaacaccgatccaatgagttacctgaaccgggtttggatggcgacgagcatggcgatggtacaaggtcacggtgaaaaccaaggtcaaaactggaaatcaggcatcaagtttctccaaaggggccaaaggaggcccttcgacggagaatcttcgaatctccggccgatttccggttctgatctaaccggcgtggtcgggaaccgtgacggccaagccgatgagtcgatccgtcgagtcatgtatcttaattgttggggtcaaggatgaggattttgacttgttcttcggcttttttttttcgatttcgcaaccctaaaaaaacggaaatttggactgacgggtgtctgggagagatgtaaataaaaaaaggaaaaattttcagttctagggttttgagaattagtggaaattatgaaatcgaattggggaaaaaagcac

SEQ ID NO: 17397 - DNA, 424 bp, Gossypium hirsutum
  Clone ID: uC-gsflnu33B128f12b1
tcccacgcgtccgcccacgcgtccgagagagaggaggagatcttcgcttctctccgtcgttctgctccatttgataaccgcttgcagttctctcagacgtgaaaaatggggttgtctttcacaaagctattcagccggcttttcgccaagaaggagatgcgtatactgatggttgggcttgatgctgctggtaaaaccaccattctttacaagcttaagttgggagagattgtcactaccattcctaccatcggtttcaatgttgagaccgtggaatacaagaacatcagcttcacggtttgggatgttggtggccaggacaagatccgaccattgtggagacattacttccaaaacacacaaggacttatttttgtggttgatagcaacgatcgtgatcgtgtggttgaagctagagatgagt

SEQ ID NO: 17398 - DNA, 52 bp, Gossypium hirsutum
  Clone ID: uC-gsflnu33B128g01b1
ttttatcagctcgcgttgactacgtccctgccctttgtgccacttgtgattg

SEQ ID NO: 17399 - DNA, 169 bp, Gossypium hirsutum
  Clone ID: uC-gsflnu33B128g02b1
ttttacgcgtccgcccacgcgtccgcccacgcgtccggtttgtgggcttttttctttttattattgttattattctctcttattttttttatagtatattctcatgaacattttacatgtactttatcatcatttagccattcataatcaattctcccttgcttcattc

SEQ ID NO: 17400 - DNA, 486 bp, Gossypium hirsutum
  Clone ID: uC-gsflnu33B128g05b1
ttattcgattcttcctcccctcgaagccgccgaagagagagtcgagaaagggaaacagagagcaagagaaaatgaagaccatactctcatcatagaccatggatatccccgatggggtcaatatcaaagtgaaggctaaaatgatcgaggttgaaggtcccaggggtaatctcactcgtaacttcaagcacctcaacctcgatttccacctcaccaaggacgaggagaccggcaagcgtaagctcaggatcgaggcctggttcggtaccaggaagaccagcgctgccatccgtaccgccctcagccacatcgagaatctcatcaccggtgtcaccaaaggttaccggtacaagatgaggttcgtctacgctcactttccgatcaacgcctccatcactagcggcaacaagtccatcgagatccgtaacttccttggcgagaagaaggtgcgtaaggtggatatgttggacaggggttgccattact

SEQ ID NO: 17401 - DNA, 378 bp, Gossypium hirsutum
  Clone ID: uC-gsflnu33B128g08b1
ttcaagatgtacactctgcagtgcagacatcgactctggatcattgatccctaataaagctctaagagctgctgctttagctgtgaagcaagaggataatcggaggctattccataatgccgctcttcgtaaacgacggaaagaaatgggtgaccaaattgatttatcaaagagatcaagcagggagaatggagaggatggtgctgaggatgggttgcataggggcgtgcaatatccattttcagtgaatgagaaggtgttgattaagggaaacaggaggacaccagaaaagtctgttggaaaggaagccgttattacattccaatgcctcaatggctgggaatttgcttaagaaaattggaagtggtgagaatgttc

SEQ ID NO: 17402 - DNA, 476 bp, Gossypium hirsutum
  Clone ID: uC-gsflnu33B128g10b1
tcccacgcgtccgggattgggccaaaccttacctagccaacaaaagaaaaatgttccgtgtgttagattcccgtctcgaaggccagtactcgatggaaggagccttcaaggttgctacccttgctttacgatgcatttctattgaacccaaattccgaccgagaatgaacgaagtcgtaatagtattggaacaactccaaaattccaatgaatctggaagtaatctgagcaacaacactagcagtacaccccggatacgtaggcgaagtgcagaatatcctagtggtggaaggagtaccactactacggcgtaccctcggccatcggcttcgcctctttatgactgaaaatgaaaactgaagttcatctctggcggctccgggatgatctctgcaacccgaggcattcaccattttataacctgttagtgtacagttttgtttaaaaatggatgtaaaaaaaaaaaaaaagggcgg

SEQ ID NO: 17403 - DNA, 444 bp, Gossypium hirsutum
  Clone ID: uC-gsflnu33B128h02b1
tattatatcaatatgcttgtagcatactagattgtacaaggatgataatatcaactgtactatgtagtgattcattaaggatgcaacagcaaccattacccgcaagttaaaactttatatgaagggtcaaaagaatctgtctaaaggctattgcattcaccacaaaagaaaactatatcttttcataaggaatgccagtacttatcaaaaaaattgatattggttattatgcttttgcaaaaccgcttcaattgtcaccgttactggctttatacctctagatcttgggattactggaccaaaaattccacgaagaaaattgtactttagttgcggcttaactattttgatcaatacagtccatatctatattactcaatagatatattcaaggacgtgcttttattacattgtttcaatgataataatgcatggaaaatcatt

SEQ ID NO: 17404 - DNA, 231 bp, Gossypium hirsutum
  Clone ID: uC-gsflnu33B128h03b1
ttctacgcgtccggacaaagaatagcttctcttgattgctgctgcagaatatataggttggttcttttgatcccaatgcataaacgcccctcctggatttggtagatattgacttttgcctttacacattaatactccttttgaaagcaaagcagttactggaaatagttttcacgacactatgtttgactgtttttttcatcgagtagagttgactcttttagttcagct

SEQ ID NO: 17405 - DNA, 89 bp, Gossypium hirsutum
  Clone ID: uC-gsflnu33B128h08b1
tcccacgcgtccgtaactgtgtatgtgctctgcaaccattttgcaaatgcatgggtttatattatataaattattaatgtgtcacgatt

SEQ ID NO: 17406 - DNA, 477 bp, Gossypium hirsutum
  Clone ID: uC-gsflnu33B128h12b1
tctggatcccaaacgtttaatggatccgaaaaccggattctgtcaccaaaccggaacttacagtagccttagacggcccctccctttgccgccaatcaatcaaccgctttccgtggccgaattttgtctctcccttttccagcggacttccactgacggctccaccactttcgtcgtcaatgaaaccgccggcgaatcgctatctcactctcaattcgtttctcaagtacgttccctagcttactctctacagcagcgttactctctttcccaaaacgacgtcgctttcgttgtctcaccgccttcgattcatattcccgttgtttacttcgccttgctgtctttgggaatcatcgtttctccctcaaatccactcagttccaactcggaaatcgcttaccagatccaactcagtaaatccgttattgccttcgctacttcaaaagccttccataaaatcccttttttttaacacgg

SEQ ID NO: 17407 - DNA, 597 bp, Gossypium hirsutum
  unsure (1)..(597): unsure at all n locations
  Clone ID: uC-gsflnu33B129a01b1
ccttgttctcttctacattcagcgaaggggtgctctgagatcacataccaaaatggtgaaggccgttgccgtccttggcagcaatgaaggtgttagcggaactgttttcttctcccaagaaggagatggtccaactaccgtgactgggaacctttctggtcttaagccgggactccatggcttccatgttcatgcccttggggacacaactaacgggtgcatgtcaactggaccccattttaatcctgctggcaaagagcatggtgctccagaagatgagaaccgccatgctggtgatctagggaatgtcactgttggtgatgatggctgtgcaagcttctccatcaccgacaaacagattcctctcacaggcccaaactccattatcggaagagctgtagttgtccatgcagatcccgatgaccttggcaagggcggccatgagctcagcaaaagcacaggaaatgcttgcggcagagtagctcgcggtattattggtctgcaggctaaaatctgaaccaagatgcngttgaaggatgcaatgggctttgagaactctttatgtgaagtagccagaacttggttatataataaaac

SEQ ID NO: 17408 - DNA, 70 bp, Gossypium hirsutum
  Clone ID: uC-gsflnu33B129a02b1
cacaaggaaagcaggcacgcctgcaggaacgcaccccggcaagacccggcggcgacccacgcaggccgtc

SEQ ID NO: 17409 - DNA, 224 bp, Gossypium hirsutum
  Clone ID: uC-gsflnu33B129a03b1
ttattttaaaagaaccctaattatttaatgaaatatatgcattatgaatgttgaagtactaagagaagggatcattgctacaagaaatcattagttggtttcttgcaagccttgttgttatgccaactcatagataaaggatttgttatgttttcaagaatatttacttcgtgaattttcaatctcatgtaaatttaaatcaattaatgtttatatgctttcat

SEQ ID NO: 17410 - DNA, 551 bp, Gossypium hirsutum
  Clone ID: uC-gsflnu33B129a07b1
tcgtttgatagaagacgaccgcagaaagtgaagtccagggttccagagaaacttcttatctctagtggaagccaagaaaaagagggtagtgaagtaaaagccaaaatgggggaaaaccagagaagcaaaaatgacaatggtggacaagaagtgggtcgtagtggcaaaaataagatgtcaaaagagagtaagaaatcttctgtgcaggagcaaagttcaaatgtttctaccccccgacctgatggcaacaatgaagagagagaatcaaataaaggtggtagagatcctaaggaggttgccacttctcagaatttatttctgaaacggaaacagcaacgggaagctgttgatgctattcttttctctggtctaattccttcaaaaaagtccgaacaatcatccaaaaagttgcaccaagaaaggtcaattgtcccaccttcagttgcaagcggcagcttcaaaccaccaaagaaaaggaaaggtccaccaaattcctaaaacaagggcaccacgccatcagattcatcaagggctcagttcaggagatattc

SEQ ID NO: 17411 - DNA, 557 bp, Gossypium hirsutum
  Clone ID: uC-gsflnu33B129a08b1
tcgtttaggcgtagctctcgatccacatcataaaaaaagtaaaggagaaaatgaagggtctgcaggcacttatattggcaatggtaacggttatggcgatcgctacaactgatgctcaaagcatttgcagcatgccagcttcaggtttgatggcatgcaaaccagcagtgacccctcccaaccctccgccgcccacgtcaacttgctgctccgccctctcccacgctgacatgcgttgcctttgctcatataagaactccaagctgttgccttcccttggtattgacccaaaccttgccatgaaattgcctagcttgtgcaagcttcctcatcctgcaaattgttagttcctggctctccatatttgatctcaaatgtgagggaaaatcatgcttattataagcctctacttcacattattgtactgagcttcgggttttctttttcctttatttctttttatgtgctgcgtttcgattggaatcttatagtcgtgtaatatcacataccgtgtgatttctcaccaataatcatatattaagatggtttccaccatg

SEQ ID NO: 17412 - DNA, 518 bp, Gossypium hirsutum
  Clone ID: uC-gsflnu33B129a11b1
gctgttcttcacgcgtccgggttggagaaatcattggcagatttgagaagaacggtttctatttgaagggtttgaaactcatcaccgtggatcaatcttttgctgagaagcactatgcagacctctctgcaaaacccttctttaatgggctcgtagagtacattatctctgcgtctgatgctgctatgatttgggagggtaagaatgttgccaccactggtcgcaagattattggagccacaaaccctgctgagtctgctcctggaacaatccgtggtgactttgcaattgacattggcaggaatgtgattcacggaagtgattcggttgagagcgctaggaaggaaatcgcattgtggttcccagaaagccctgttaactggcagagcagtgttcacccctggatctatgagcagatctcaaattaagctgctgcagatcatggcatccttgtgtttgcttctagttagtcaacttttttatgaactttttactgaattacctctagttactattta

SEQ ID NO: 17413 - DNA, 340 bp, Gossypium hirsutum
  Clone ID: uC-gsflnu33B129a12b1
aggcgtttcttaccatctcctacattaccggctcttgggtcctttctctaaaacgcctctcgaatatcgccatcatagatgtccgggatgatgaacggcagcctgatgggcatacagctgagcctttgcactatgccagcggccctttcactgataagaacgtcaatcttatccaacatgtcaaaggcaaagaaactcttgttcctcattgggccctaagccaggtccgtgggcccaacctgggcaccgcgggtaagcgttatcatcaaaaggagtttccggaagcatactgggatcaagaacatttggcttttgagcccggtttcaatggctgggaagc

SEQ ID NO: 17414 - DNA, 441 bp, Gossypium hirsutum
  Clone ID: uC-gsflnu33B129b01b1
ttcttacaaacctttcacttctcaactctctcaaattcaccatgtctgacaagtgcggcaactgcgactgctctgacaagagccagtgcgtgaagaaaggaaacagcatggtcattgagactgaaaagagctacatcagcactgtagtggtcgaggctgtggcagagaacgatggcaagtgcaagtgtggagatagctgcagctgcacaaactgcacatgtggaactcattaagcagacatagaaccatgatgttttagtccatagaactattaggacctaaaactaatgaaattgagttgaataaattggtgttttgttgttgctggttgagacattgagtgtgttttcatgtctgtctgtcttatgtctgagtctcattgtacacaatgatggaatggccatatctatggacattgtatgattaatgaattattatcag

SEQ ID NO: 17415 - DNA, 513 bp, Gossypium hirsutum
  unsure (1)..(513): unsure at all n locations
  Clone ID: uC-gsflnu33B129b03b1
tttctttcgtccgtgatgacaagaaggttataaagaagatcttgaaggaaggagagggatatgagcgcccaaatgagggggctgttgtccaagtgaaattgattgggcaactgcaagatggtaccatattcttgaagaagggccacaatgaaggagaagaattgtttgagttcaagacagatgaagaacaagtcattgaaggtcttgatagagctgtgctgaatatgaaaaaaggcgaagtagcactgttgactattgcacctgagtatgcatttgggtcatccgagtcaaagcaggagttggctgtggtaccgccaaactctactgtttactatgaagttgagttggtatcatttgtcaaggaaaaagaatcatgggatctgaacacccaagaaaaaattgaagctgctggtaaaaagaaggaagaaggaaatgtattgctcaaggctggcaaatatgtgagagcttctaagacatatgagaaggctgctaagtatatngaatatgatactt

SEQ ID NO: 17416 - DNA, 317 bp, Gossypium hirsutum
  Clone ID: uC-gsflnu33B129b05b1
tttttatagagggggaacgcgtggaaagtgatgagacccaaaataaagtaatggccgtatgggttgcgtccggctcgcttttgacatcagaaacttgagctccacttgatgcaacccttcccttggagatcaaaggagaggtcggggagtttataaaagccaactttactttctctcaagagctacattatacatttcttaaaatgaaccctaaaacgactggacgagggaaagccttacactttagacatgagaaaaacgctggatgaccctactgtaatcaagaacttcaacaagcgcctttatgcagaatgccc

SEQ ID NO: 17417 - DNA, 418 bp, Gossypium hirsutum
  Clone ID: uC-gsflnu33B129b08b1
tcgttaagtgcagctcatggttaaagcagatctggtgagcgcagatgcatctgtattacttaagcctccaatgtgctacgtgtgaaacctgctttgagggcgaacgagtggtagtgaccaaacaccagaacaagacaggtctactgtatataaaaggatgaagggcatgagagatccacaacaacagagggaggatcactgatgaagtacatgccacaccaccacacaaaacagtgttcatgagttctactatctatctacatctaatagctgacttgagaccgcaccagatgcaggataaggacaaacgtagggagcccccattcgcagcaggatggtagatgcacgagttacttctccaggagctacctaccttgaacaccaggtgtgtggcgtgcatgactgcagtggtccttat

SEQ ID NO: 17418 - DNA, 537 bp, Gossypium hirsutum
  Clone ID: uC-gsflnu33B129b09b1
ttctagtgacttcacacttcaaaaccctagccaccgttccatgccgatccacttctaagacgccatcgctgtcgccgctcagtttcaagtctcacgtttctccattaccttccgcttttccttactcgccgcttctctactggttcagcgggtactgctgtgaagaagagggttgaggatgtaatgcctatcgccactggtcatgagcgtgaggagcttcaggctgagcttgagggaaagaaaatccttgaagatgtaaacaatccagtcggtccttttggcacaaaggaatctcctgctgtcgttaagtcctactacaacaagagaatagtttgatgcccaggaggtgaaggtgaggatgaacacgatgttgtctggttttggctggaaaaaggcaaaccacatgagtgcccagtttgttcacagtattttgtgttggaagctgtgggccctggaggtcctccagatggacatggtgacaatgatcattattaattgcaacctccaatttttctattgaaataaagtttgggagac

SEQ ID NO: 17419 - DNA, 505 bp, Gossypium hirsutum
  Clone ID: uC-gsflnu33B129b10b1
tcttatccctttgaccaagatgattgggagcattgctccgaactgaccaatgaaatgggaacaaaagttcaaattgtcggagatgatcttttggtcaccactccatagagggttgagaaggctatcaaagaaaaaacttgcaatgctcttcttctcaaggctaatcaaaatggatctgtcaccgaaagtatcgaagctgtcaaaatgcccaagaaagctggatggggtgtgatggccaggcaccgcagtggtgaaactgaggatacatttattgcggatctttcggtcgggttggccacggatcaaattaagaccggagctccatgccggtctgagcgtctagctaagtacaatcagcttttgcgtatcgaggaggagctcggttcggatgccatctatgccggagctagtttccgtgctcctgttgaaccttattaggagttggttttgtgataaagttttgtgcgactggatgtgcgcgatagagctctacttttcatgaata

SEQ ID NO: 17420 - DNA, 527 bp, Gossypium hirsutum
  Clone ID: uC-gsflnu33B129b11b1
tcgtccacgcgtccgctagcctttcttttcccctttcttaccgaaccctaaatccctctgtcaagcatcaatccaccattaagaatggcgccttatgctttgggcctcgattcatcactctttggcctcaagaaccctcccttcaacttcgatttcgacgaagcaagaggggatcaacggcagatacgcgaggtacgggcgatgtgctggcgtatggaggcgcaggcgtacgggggctgctgacgtggaggcatgagcggcgttggggctgtacggtggctgaaggctacggcgcatctgctgctagggctagggtttggcaaaatttgcttagcatttgggtcgcttgggcccatttcgagtgctgtgtcagtctttgggccatggggttctagtcattgcgtctaggtattgggctgtcaaaggatattaattactggactgtcttatttatttctttgacttttgcttcataatttgcatttattttgagtttaaaaaaaaaaaaaaaaaaggcggccgtttaa

SEQ ID NO: 17421 - DNA, 456 bp, Gossypium hirsutum
  Clone ID: uC-gsflnu33B129b12b1
tcgtttaaagcgaagatccaagacaaggaaggcatccccccagaccagcaacgtctcatctttgccggaaaacaactcgaagacggccgtaccttggccgactacaacatccagaaggagtcaactctccaccttgtccttcgtttgcgcggcgggatgcaaatcttcgttaagacgcttaccggaaagacgatcactctcgaggtcgagagctctgacacgatcgacaacgtgaaagccaaaatccaagacaaggaaggcatcccgccagaccagcaacgtctcatcttcgccggaaagcaactcgaggacgggcggactttagccgattacaatatccagaaggaatcgactcttcatctggttctacgtcttcgaagtgggatgcagatcttcgtaaagactctgaccggtaagaccattactttagaagtggagagctcggatacgattgat

SEQ ID NO: 17422 - DNA, 536 bp, Gossypium hirsutum
  Clone ID: uC-gsflnu33B129c02b1
gccttcgcctgcgtctctctcttcatctctctgaacctaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgcgcaaggagctattgatgttgacattggtgccaatccttcagccgaagatgctgatgaggatgaaggtgttgatgaccaatctgcgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacattgagggagcaaccaagtttttgctttcaaaattgaaggacctttaatttttcatcggagagagcatgcacgatgatggatgtttggtatttgcttactacaaggatggtgctgttgacccgaca

SEQ ID NO: 17423 - DNA, 527 bp, Gossypium hirsutum
  Clone ID: uC-gsflnu33B129c03b1
ttcatgcgtccgattgttagcgagcagaagcaaagagcctccaaaaaacacttcaaccctctagccatgacattcaagcgtaggaatggtggccgaaacaaacatggccgtggccatgtcaagttcatccgctgttctaactgcggcaaatgttgccctaaagataagtcaatcaagaggtttcttgtgaggaacatcgtggagcaagctgctgtcagggatgtccaggaagcctgcgtttatgacacgtacactctgcccaagctgtatgtgaagatgcaatactgtgtttcatgtgcgatccattcccatgttgttagggtccggccccgcactgacaggaggaaacgtgacccacctcagcgcttcattagacgcagggatgatatgccaaagcctggtcagccttggcaggctcctcgtcctggtgctgccgcttctgctcgtgcataaggctcttgaaagttaagatgaatttgtatttcgtgttttgctttgagatatcgctgcttgaattttgagaactt

SEQ ID NO: 17424 - DNA, 412 bp, Gossypium hirsutum
  Clone ID: uC-gsflnu33B129c04b1
ttttcagtaacctgaataacaacctcatgaacaacactctgcttgcttgtaacaacgggggaagagggggagcttgaaagtcgccgaggagtgccaagaacttgcctgcaagcttgctagactccccaaaggtaggactaatgccggatacaccatcaatggaagaccgtttcaacaagactgcacctactttagggaattgatctgaggaagagaaagctataacagacaaaggcttacactcagcatacatcaactatgtcaacacctagagatactgatcctgatgtgttaccactgtatcctgttactacaccaagaggttccagctctgattaaacatatgtgagtcacgcgagagagcagccacgtgggttttgagggagaacagagtgaaaaaaaaaacaagaag

SEQ ID NO: 17425 - DNA, 58 bp, Gossypium hirsutum
  Clone ID: uC-gsflnu33B129c06b1
tttatacccaccagccaccttggctacgcctcacggctctttaacagtaaagtccacg

SEQ ID NO: 17426 - DNA, 233 bp, Gossypium hirsutum
  Clone ID: uC-gsflnu33B129c07b1
tcgtgtagccctagcaacaaccttatctttgttgcccctttatgtaatgtaacgggcacggcttacaccttgatggcatataccagtgaggactttgactataagagcctatttctgtgcttgcatcactgcttactatctgagattgtgatttcacgcgaatcatcgagtggtttctctttccttgatggtttccatcctgtgagtggggttaagtcatcaagtccaagttc

SEQ ID NO: 17427 - DNA, 511 bp, Gossypium hirsutum
  Clone ID: uC-gsflnu33B129d05b1
tttattagctcaaactcttctttatcctacttctctgattctggttgttcatggaaaggggtgcactgtgataccaagaaggagagtgttcttggtttaaaggcttcaggtttaggcctttctggtttaattcctgataccaccatcggtaagctgatccagcttcagtctttggatcttagcaataacaaaatcactgctttgccttcagacttatggagtttaggctcacttaagagtcttaatctctcctctaatcagatttctgggtttctgcctaacaatattggcaactttggtcagcttgaagtcattgatctttctggcaataacttcactggggaaattcccactgctataagctccctagctagtttacgagtgcttaagcttgctggaaatggatctgaatggagaatttcaacagggattctaagttgccggtctttgtttcgctcgacctctcgctaagtcgctaaatggttccttgccagatggttttggtgcagct

SEQ ID NO: 17428 - DNA, 445 bp, Gossypium hirsutum
  Clone ID: uC-gsflnu33B129d07b1
tcgtagtgctccactcatgctccgtctagcgtggcactcatctggaacttttgatgtcatgaccaagaccggaggtccattcggaaccatgacgcaacctgctgagctcgctcatgctgctaacaacggtctcgatattgcagtcaggcttctcgagccgatcaaggagcagcttcctatcctttgatacgctgacttctatcagcttgctggagttgttgctgttgagatcaccggtgggccggaaattccattccatcctggaagagaggacaagcctcacccaccacctgagggtcgacttcccaatgctactgagggagctgaccacttgaggcaggtgtgtagttatcaaatgggtcttagcgaccaggacattgttgctctttctggtggccataccctgggaaggtgccacaaggagaggcctggatttgagggacca

SEQ ID NO: 17429 - DNA, 487 bp, Gossypium hirsutum
  Clone ID: uC-gsflnu33B129d10b1
ttttctggaaaactgctaagaaaccacagagtgagagagtgaagaaggcgggtaatgaggcagctaatgttgatggtagtgggaatttgagtggtgcgtccactgtgccagaaggtgcggtgactgctgaatcgagtagaagaggagttgttaatagtgggaggaagcagatgtcgaggtgcacaaagaatttggggaagctggatttgaatgcggagtttagtaatgaagatgaagagccggcaccgaggaggaatgaggggaatcaccccagctatggggaggaggataacattgaagggaatgggttctttgagggtcttgatgagtttttgagtatcttgcctatactttcagctgttggggatgataaagctaaggctacttactgaagttagatccttgcttttctgtttttcgcaccaattgcagttgttgaattgcttgttgtatcaaccttgcggaggtgcttatggcctcctttata

SEQ ID NO: 17430 - DNA, 532 bp, Gossypium hirsutum
  Clone ID: uC-gsflnu33B129d12b1
tctttgaataattttcgtatccattcaatctttctgccgctgaccattctttcctgagggcattatggatgcgagattcgggctcttgttcctcttcatgttgggtgctacttgggcatgtaacgcccgacaactagaagttgttgagatagaaatctcggatccatcagttgtccaggtaaactggaggcaagatgaaaaagtgatagaaacggttgctcggaacgacaacgtgtgcaccttgtgtgagcaatttactactgaggcagttgattacctttcacagaataaaatgcagactgagataattgagattcttcacaaaagttgctcccgtttacgagcttttgagccccagtgcattacacttgtggactactatgcacctctcttcttcttggaaatatcttcggtacaacctcaagatttctgtacaaagttcaacctttgtcaaaaagttgcacttatatcttcacaattccgcgaagatagttgtagcatgtgccaccgtgctatttccgagtactaatga

SEQ ID NO: 17431 - DNA, 436 bp, Gossypium hirsutum
  Clone ID: uC-gsflnu33B129e01b1
ttctttcgtccgcccacgcgtccgcccacgcgtccgcccacgcgtccggggttctcctgatgagggagacgttcaacctggtgctcttatcacacttccgcctccgagggaagttgctaggcctgagatacaaagaaattctgcacctgcaggcaatctggatgaggaagaatgggttacagtttatggattttctcctgctgatacaaattgagctttgcgagagtttgaaaagtgtggtgtgatattgaagcatgttcctggaccaagggatgctaactggatgcacattctctatctgaaccgatctgatgctcacagagctctcagcaagaatggaatgcaaattaatggagcactaataatcggtgtgaagccagtagatccgatgcaacgtgaggctctaaatgaaagaattagatatcaagggttaatg

SEQ ID NO: 17432 - DNA, 443 bp, Gossypium hirsutum
  Clone ID: uC-gsflnu33B129e02b1
tgtatcaagctgctgttagggatgtccaggaagcttgcgtctatgacacctacactctgcctaagctttatgtgaagatgcaatactgtgtttcatgtgctatccactcccacgttgtgagggtccggtctcgcaccgacaggaggaaccgtgacccacctcaacgcttcatcaggcgcagggatgatatgccaaagcctggtcagcctggtcaagctcctcgtccaggtgttgctgttcctgcccgtccttaaggcccccaaagttaaagataaatttctatttttgtatttgctttgaaatgggctgctttaattttgagaaaatttggatttgtgtagaaggtttttgattagttaaaagtttgatcgcatttgacaagctatgaatggttgagaatactgggtggaatctcataatttctatttagttgcttattttat

SEQ ID NO: 17433 - DNA, 544 bp, Gossypium hirsutum
  Clone ID: uC-gsflnu33B129e05b1
ttgtcgcgtgggcggacgcgtgggagaaaagatgactcagatcatgtttgagaccttcaatgtacctgccatgtatgttgccatccaggcagttctttctttgtatgccagtggtcgtacaacaggtattgcgctggattctggtgatggcgcttctcacactgtgccaatctatgaagggtatgcccttcctcatgccatcctccgtctagaccttgctggtcgtgatctcactgattctctgatgaagattcttactgagagaggttatatgttcaccaccactgctgaacgggaaattgcccgtgacatgaaggagaagcttgcctatgttgccctggactatgagcaggaactggagactgccaagagcagctcttctgttgagaagaactatgagttgcctgatggacaagtaattactattggagctgagagattccgttgtccagaagttctctttcagccatctctcattggaatggaagctgctggaatccatgaaactacctacaactctatcatgaagtgtgatgtggatatc

SEQ ID NO: 17434 - DNA, 524 bp, Gossypium hirsutum
  unsure (1)..(524): unsure at all n locations
  Clone ID: uC-gsflnu33B129e06b1
tcctttcgtccgcggacgcgtggggccgccgcaaccacctcgacggaccagaggtcctccccggctccggttcggcagcaggtttcttcctcgcaggacgaacgtgcatggtgaacgcaagggatcgctgaacgtgggtgattgcgacgtggggtgatggggtcgttgctgcagatggagaacgtgcggcacgccctagggcttctacttccattgctgctgaaaacatgttgcgggctagggttaattttgggccaattgggccaaatgtatttagtcgctgttttattttggtaggctaaatgctgggactgatgtagtgtgggctttaggtttagttgggcccgagcaaaatttaggtcttacagttggaattgaggttgtgagcattcatctcatcatatctccaagtgctaatagggtattttccaaaatttttaatagaatgacatgtacttaggaagatcaagtgtgctccaagtagtangggactaaaatataagttatgaaaactttttttttat

SEQ ID NO: 17435 - DNA, 529 bp, Gossypium hirsutum
  Clone ID: uC-gsflnu33B129e07b1
tcttgtaaattcaacgaggttgtcgattcctctgaacaaggctgacttcacttttaggagggaaaatgctgtagcattgaatttatcaagcttcttgaatttatcaggctgcagtgctagcaatggatgatacggtattagatgttgatcaagtggaaaatctcataaaattttgtccaactaaagaggaaatggaacttctcaagaactacactggtgacaaggaaagtctagagaagcgtgaacaggtttctgaatttaaaaggagcttaaatactgtaaattctacatctaatgaggctaagaagttagcatcacaatatcaaaaggaagcggacaaatgcaattcgggtatggagacgtgcgaagaagtaagggagaaagctgaagaagcactgtcggctcaaatgaaattaacagcaatgtgggaaataagagcttgtcagaaagggtggagagaaaaggtcgccaaatctaatgcattttcttatttcattaaagaacttcattataatgtcctattttattg

SEQ ID NO: 17436 - DNA, 403 bp, Gossypium hirsutum
  Clone ID: uC-gsflnu33B129e08b1
tcgttttaatctgcttctgtgttgggttgggttggtttacacagaaaaagaagaagagttgaagagtgtggtttttatttccaggacttggatctgatggagatttgcttaggtgccagacttaatgagagtccatgcaacacaaggctgaattggaagtatgtttgcagtgatgggaaagatacgagtagtacaagcagcaaagcttcatcattttcagcacctttgactccccgaagtgagggtgagatcttacagtcccccaatttgaagtgtttcagattcacctatctcaaaatggccactaggaatttttgtcctgacagtgtgctcaaggaaggcaggttcttgctcagagtttaaggcttgtatcgatgagaattcattagctggtgtcaagcct

SEQ ID NO: 17437 - DNA, 600 bp, Gossypium hirsutum
  Clone ID: uC-gsflnu33B129e09b1
tcgtttcgggagagcaccaaagaaaagcgataatactaaatactatgagatattgggagtgcccaaaaccgcttcccaagatgatttgaagaaggcttacagaaaagctgcaattaagaatcatccagataaaggcggtgatcctgaaaagtttaaagagttggctcaagcttatgaggtgctgagtgacccagagaagcgtgagatatatgatcagtatggcgaggacgcccttaaagaaggaatgggtggagggggctggtgcccatgatccatttgatatcttccaatccttctttggtggcaatccttttggtggtggtggtagcagccgaggccgaaggcaaagaaggggagaggatgtaattcatcccctaaaggtttctttggaagatctctataatggaacttccaaaaagctctctctttcacgcaacataatttgctccaagtgcaagggtaaagggtctaaatcaggtgcatcaatgaaatgctctggctgtcaaggctcaggaatgaaagtctccatcagacaccttggtccttcatgatcaacagatgcacacccttgaatgattgtagggactgtgagacatcacc

SEQ ID NO: 17438 - DNA, 501 bp, Gossypium hirsutum
  Clone ID: uC-gsflnu33B129e10b1
tcgttgggaacgacttgaccgagatgttgcttcaacagggatgcctcaaatttaccagaataggagggtttggattctctgcaatgactgtggggaaaattccgaggttaatttccattttgtggcacacaagtgcccaatatgcagctcatacaataccaagctgacacgtggacgcattgctacaggttcatcagagattatgaaaacagtttgatgatggctttctcgatgtttatttcgcacttctcagtttcctgttttagttcaatcgttaactcttatggaatgggtaaatttcacttgggggcagcagagggtagctggaataacagatttctttattctttgttactgatctctgtaagctaatccgctgcaacatgccagctcggtctggagccgcggattgtattagtagaacaagtgaaacttgtaagaatgcagatgctatgtacttggatcattgctggtgctaaatatattccagatttcctaatc

SEQ ID NO: 17439 - DNA, 508 bp, Gossypium hirsutum
  Clone ID: uC-gsflnu33B129e11b1
tcttaacctttgaaactcttcatcattgaagtcgtagtgaggtctggtctatggaatcttccgtttgtcccttttgtcaccttagcgttccctcctcagaactccaatggcacgccaacagtcacttcgaggatgaggataaggaagctaatgacatggaattgggtaatcaaattcaaattgcctcttcttcaggctccactgacgttgttagcatttcttctttgattggtttacaaacaaggagcaatttttaccacgtcaaggatggtttgatttccttgctgagaaattgtctagaactagaagctcgacacaactcatctgtaaccatattgtctggccacgtggatcacttccaaagtcttccgtccgtcgatgttggttggggttgtggatggcgtaacattcaaatgctaagctctcatttgcttgctcacaggaaggaagctagaaaagtccctgttgtgagtcaggttttgtcctgatatcggtttcctcagcgttg

SEQ ID NO: 17440 - DNA, 251 bp, Gossypium hirsutum
  Clone ID: uC-gsflnu33B129f04b1
tcctcgcgtccgaaaaaaaaaaaaaataaaaaaagaaaatatttaaaaaaaaataaaaatcaaaaaaaaggggaggacgctgtgtgggctccttgtttgattccgggtggcgtgcacgtgatagctattctatagtgttgggttggtggtctttagtttccatgttttggccccggttttactgggaaaagcctgggtgttccggtgtttttccccttttattttgtttcgctttttacccgttttgtgtt

SEQ ID NO: 17441 - DNA, 555 bp, Gossypium hirsutum
  unsure (1)..(555): unsure at all n locations
  Clone ID: uC-gsflnu33B129f05b1
tcactatgtcatgcttgagggtactcttttgaagcctaacatggtgacccctggttcggactccccgaaggttgccccagatgttattgctgagtatactgtccgtgccttgcagcgaactgtccctgctgcagtcccagctattgtattcttgtctggtgggcaaagtgaggaggaggctaccctaaaccttaatgccatgaacaagctccagaccaagaaaccatggtcactctcattctcattcggacgcgcccttcagcagagcactctcaagacctgggcaggaaaagaggagaatgtgaagaaggcacaagatgctttgctcgttaggtgcaaggctaactcagaagccactttgggtacatacaagggtgatgcagagctttgtgagggtgccgcagagagccttcatgtcaaggactacaaatattaagaaattaggcttgtggtcaaatatgtgatgtttagcagagtaaattccggtattgatattagggctctagggttttttcttcttctttngagtttctgccgtgctcatcgactttagtc

SEQ ID NO: 17442 - DNA, 541 bp, Gossypium hirsutum
  Clone ID: uC-gsflnu33B129f06b1
tttttagtaacagattctgacgcatatgatcaaaccaaacgattgcgaactggtgggaattattcacacagtccttacacgagtccatctccatttcacccccctgctcctgtttggggaccacatgggtatatgactccaactcctccatatgatccatatggatgttatccagttcctccagtgccaatgcctactccggcgcctgtaccagctccaagcagttatgtgcctgttcagaataccaaagataaccctccttgcaataccttatttattggcaatcttggagagaatattaatgaggaagaattaaggggcctattcagcgctcaacctggttttaagcacatgaagatcttgagacaagagaggcatactgtttgctctatagagtttgaagatgtgagtactgcaaccaatgtgcaccacagtttacaaggtgctgtgatccctagctctggttctattggcatgcgaatacaatatttcaagaatcccttttgtaaagggaggactctggccatcttgttctttccct

SEQ ID NO: 17443 - DNA, 434 bp, Gossypium hirsutum
  Clone ID: uC-gsflnu33B129f11b1
tcgtcttagtatgtcttgtaagaccaaatttatgcccgggcctaaaattacaacccaaattccaaacccaaaaaaacaaggcccagatggtccaaaattaaaacaatttcagcaaaaaatcagaaacctagaaaccctagtgcgccgcatcttgctacccatgtgcctccagcgtactcgtcgcccgaggtctgccaccgccagccacctttgcaccaaaacggcaaatctttgcctctgttgaccgcagcatctgcaaaggaaagccgaaagaaatacctgcaaaagaagaaataacagcaaggcaaaaagaaaagagaaaaacgaaaaaatgtaaaacatttggttatataagccaccaacccagaatgtaaaaaggggggatttggattgaaaaaaaatattgaaatcaataaaatcaaaaatctttgaac

SEQ ID NO: 17444 - DNA, 502 bp, Gossypium hirsutum
  unsure (1)..(502): unsure at all n locations
  Clone ID: uC-gsflnu33B129g02b1
tccattcgtccggcaattcagactgcttttacctttctggtttatccagctcttatattggcatacatgggccaagctgcttacttgtctcaacatcatcatacgagttaccaaatcagcttctatgtctcagttccagaaagtgtgagatggcctgtgctcataatagcaattcttgcttctgtcgtgggaagccaagcaatcattagtggaacattctccataatcaatcagagccagtcacttagttgtttccctagagtgaaggtcattcacacctctgacaagatacatggccagatttatatccctgaaatcaattgggtgctcatgatcctctgcattgctgtgactattggctttagagacacaaaacacatggggaatgcatcaggattggcagcgatgactgtgatgttggtgacgacatgtctcacatccctggntattatcctctgttggcacaaaccccctattggggcttttttctttcttcttttct

SEQ ID NO: 17445 - DNA, 519 bp, Gossypium hirsutum
  Clone ID: uC-gsflnu33B129g03b1
cctccgcggacgcgtggggtcggatctgagatttcaggagggcagctgccaggcactgatgtgaggcatggtggtcgccaaagatcaagaactagtagacggaactgttgcacaggagtctggaaaatccatgccgtcatctcaacaggaggaggcagttgtaaagaaaaaatacagagggattatgcccaagaagcctccacttatctctaaggaccatgaacgtgcctactcagactgtgcagactgggcacttggaaagccaggcgttgagaagcccaaaggtccacttcaagccctgcggtccaaattgcagcctacacaacaacaaacacgatataggaagtctccatatgctccatcagatgtcgaagatggagggagtggccaaccataggatgggactgccaatgaatgagaaactgcgctcagtcttctggttttccgagaactatcgatcgctattcaaatggctagacaggtaatgagtaaatttcaattgatctcgcggataaacct

SEQ ID NO: 17446 - DNA, 343 bp, Gossypium hirsutum
  Clone ID: uC-gsflnu33B129g05b1
tttcggtggctgcagactttggtggctagggttgttgaaatgttttctttgtaatgggctagttgggctttagggtttctaggattctgggtctgaaatgggtttaggcttgggctggtttgggttttattgtttgggtcatttggattctgtgttgttgggcgacacatgttgtaaatggacttaaaatttggactttttatttggtgattcgggttttattttgctgtttttttttgcttgttggtctgggccaaaattggcttctacattcggtgtttcttctttttatcctttttaatcacaccatcgaccttttcgtttggcgtggccaacactacaa

SEQ ID NO: 17447 - DNA, 79 bp, Gossypium hirsutum
  Clone ID: uC-gsflnu33B129g07b1
ttgtctacgcgtccgcccacgcgttcgttcacgcgttcgatataaataaaaaaataaaaattataaaaaaatgtttaaa

SEQ ID NO: 17448 - DNA, 356 bp, Gossypium hirsutum
  Clone ID: uC-gsflnu33B129h01b1
tttattagagcagcagcagtcgcggcggcggcagttctacccagggtctgttttctaaacaaccatcaaacagaaatgaagttcaatattgcaaatccgactactggctgccagaagaagctggaaattgacgatgaccagaaactccgagccttctttgacaagaggatctcccaagaagtcagtggtgatgcccttggtgaggagtttaagggctatgtgttcaagataatgggaggctgtgacaagcaaggttttccaatgaagcaaggagttctgactccaggtcgtgttcgtcttttgcttcacagaggtactccctgcttccgtgggtatggtaggagaaatggagagcg

SEQ ID NO: 17449 - DNA, 391 bp, Gossypium hirsutum
  Clone ID: uC-gsflnu33B129h03b1
acaaccgaaagaaggttactgctgttcataaggccaacattatgaaacttgctgatggattgctcttagagtcttgccgtgaagttgcaactaagtatccaagtatcaagtataatgaaatcattgtggacaattgttgtatgcaactcgtttcgaagcccgagcaattcgatgtcatggttacccctaatctttatggaaatctggttgcaaatacagcggccggtattgctggaggcaccggtgtcatgcctggaggcaatgtgggagctgaatatgccgtgttcgagcaaggtgcttcagcaggaaatgttggaaaagaaaagatagtagagcaaaagacggcaaatcccgtggcattgcttctctcctctgccatgatgttgagaca

SEQ ID NO: 17450 - DNA, 294 bp, Gossypium hirsutum
  Clone ID: uC-gsflnu33B129h06b1
ttcactcgtacgcacaatcaaagggagaaaagagggggaccaccctttaacctccggaagggcatagatcggccatgggcgcggatccaccttccacaaatgcacaccgcggtggccgacgatgccacatatgtcggaggcgagggagcgtggcatgctgtatcgcacgattcggaagcttggcgcgcatcgtacgctgcttggactcgaagcttgcggcgccgattccctttgctgctggggcttaggcggcttatgtccgtgattggccgagagaagggatagggctttcac

SEQ ID NO: 17451 - DNA, 393 bp, Gossypium hirsutum
  Clone ID: uC-gsflnu33B129h07b1
tcgtccacgcgtccggtttgtctattgaattctttccttcactttctctagaaaaagaaaatgtcttcaggttgcaattgcggatctaactgcagctgcggtgacaactgctcatgcagcaggaaccttaaccttggatactcggagaagacaaccagcactcagaccatcatctccggagttgcgccagtaaagatgacctttgagggaccagagatgagcactactgaatcaggacatggatgcggctgtggatcaaactgcaaatgtaatccatgcaactgctgaaaagcttgatgaaagccatagattatgaaaaaagaaagcagcaaaataacaggcctctgtaatgatttattttcaaggatggatgcgtgcaaggtctataattat

SEQ ID NO: 17452 - DNA, 582 bp, Gossypium hirsutum
  Clone ID: uC-gsflnu33B129h08b1
ttgacgcgtgggatcaaactgggccaaattggctgttacactggtgaggcttaaacaattccagggtgctgttgatgcagcacgaaaagcaaacagtgccaagacatggaaagaggtttgctttgcttgtgttgatgcagaggaattccgattggcacagatatgtggtctgaacgttattatacaggtggatgacttggaagaagtcagtgaatactatcagaatagaggatgcttcaatgagttaatctctctcatggagagtggtttaggattggaacgtgcacacatggggatctttactgagttgggagttctgtatgccagatatcgtgcagagaagcttatggagcacattaagttgttctctactcgtctcaatattcccaagctgataagagcatgtgatgagcagcagcactggaaggaacttacctacttatatatccaatatgatgagtttgataatgctgcaactactgtgatgaaccactctcctgaggcatgggatcatatgcagttcaaagatatcatagtcaaagttgctagtgttgagctatattactacgaaatcaatgaagc

SEQ ID NO: 17453 - DNA, 255 bp, Gossypium hirsutum
  Clone ID: uC-gsflnu33B129h10b1
tcgttggaactggcggacgatgatatccaagggattcaattgttgtacggcactaatcctaactataacggttccaccacttcgaatacgcaggagagagagagtagcgacggcgttccccgttatctgggtccacggtggggccttgctctattcttggccgttggatttgggtctttatttttgtagattctttatttcgtgctctgttgattatgaataatttatagacatacttcttattttatttttttt

SEQ ID NO: 17454 - DNA, 148 bp, Gossypium hirsutum
  Clone ID: uC-gsflnu33B129h11b1
tcgttctgctgctgtttttagttacttgttcttttttttttttgggggggggggggcgggaatttaattacttgcattaaatgtttctttgtatcaagaagatgactacagcaaaatgaaatgaatatataagatagtgtttttactc

SEQ ID NO: 17455 - DNA, 296 bp, Gossypium hirsutum
  Clone ID: uC-gsflnu33B129h12b1
tctttcacctgtgcgtaagtgcttcgacatccatgcgtccctttcgatttgcttcattagcaaaaacactggagagccggctaacatcgctgagtgcatagactggcctgggagggtaccacttggggctgtgggatgcagagcaaccatcgcggagaatgttccaagcatagcagggaccagatgtgtgggagaacagatgtgctataaaggagatgatattcactgatacagagagcgactcgaacacctgagtgaaagggattactattcgaggagacacatgcatcaggaag

SEQ ID NO: 17456 - DNA, 129 bp, Gossypium hirsutum
  Clone ID: uC-gsflnu33B130a02b1
tttattcgtccggtgcatgtctttcttgtgatgacagttatgattataatttttcacatttaattttctgtaaagctttgtgctagtttcttttaaaatcttcagtttcaataattggtttttatgatc

SEQ ID NO: 17457 - DNA, 403 bp, Gossypium hirsutum
  Clone ID: uC-gsflnu33B130a05b1
gtcttgcgtccgctttttgctcccccctcccctgttcatttcgatcttcaaaagagaaaagaacccttcaaatttcgaagattctccatgtattcgaagattctcgtgatcctcgacaaactcgctgtgatcgcttatcaaaacagatctttgattcttgatctgtatcgttgctgagcctgtttcggaaaccttttctggtggtgaaagaggaaagatggactcgttgcaaggaccggagatttgcccagccgttcggagcaaacaatttggggtttacatgccaccggcgaacgggcctttcccgagggcaaaattgtatagaagtgatatatggggatatcgagggataactgatggaaaggataaggcgcgtgctatttttcggcacctcaaattacgt

SEQ ID NO: 17458 - DNA, 359 bp, Gossypium hirsutum
  Clone ID: uC-gsflnu33B130a06b1
tttatatgaaactatgtatgaataaaatctcctgctttaggcggcatcaagaaatagaggccatcttagccgcattatctatgatgcatgaaaataggtttctctttagatccaattaggtaccgtaccaaaatatcattggtaaaatgaaagtagtaagtactgtcctggtgaggaatgatgtgtgcttttgtatgttgcatgaaagagttagcttgcaaataaataaacacaagtgtgatgctttctagctcaaaatggaaaggcacttgcggaaggcatccttggtgattttaatcccggggggagacttccaatgacttggaatcccgaatcatttaccaagattgcaggggggg

SEQ ID NO: 17459 - DNA, 385 bp, Gossypium hirsutum
  Clone ID: uC-gsflnu33B130a08b1
tcgttcacgcgtccgcccacgcgtccggctaccacagggacgatactgggcgatcgaacaacccgggatcgttcaaacatacactatgatacacagtgtgggccaaagttggataactaactaccaatgattgctaatttgattgaaatggagcagaaatttgttatacaaatgctatctatggtaaagacaacgaatgcttacattatgaacactatggacgacgtgggagagcgggtactactgataggagcgaagcgtgaatgaccttataacaaagaaacaagtggagggcacttaatttcctgtagagccattctagcaaagggcggaagaggcaagcgaagatcattggagagcatacaacttggacacagactaccac

SEQ ID NO: 17460 - DNA, 425 bp, Gossypium hirsutum
  Clone ID: uC-gsflnu33B130a10b1
tcgttcacgcgtccgtcttcacctatctctttcacaaaggagagcacagaaaaaaggggttcttgttcttgctcaagttattgatcaatggctaaggatgttgaggttggtggtgagttccaagccaaggactaccatgatcctccaccagctccattggtagatgcccaagagttaactcagtggtccttttacagggctataatagctgagttcattgccacccttttgtttttatacatcactgtgttaacagtgatcggatacaagagccaagttgatccagataagggtggtcaagattgtgatggtgttggcattcttggtattgcttgggcctttggtggcatgattttcatccttgtttactgcactgctggtatctcagggggacatatcaacccagcagtgacctttgggctttt

SEQ ID NO: 17461 - DNA, 465 bp, Gossypium hirsutum
  Clone ID: uC-gsflnu33B130a11b1
ttgttcacgcgtccgcggcataattcccccctccccccttctcttcgcctaataccagattcctgtattttcttccattttctttcaatccatccaaaaccctgctctccttgccgaaatggcgacgactctgatagcttcctctcaaacaagcttccaccacccactctctgtctctgactcatcattttcaagtccttcatcctcttcttcatcggtctctatgttcactctcacaaaacctcgaatcctttcattaccttcttacaaatccagtttcttcaacccaattgggagctatttcaagtgcattgagatggaaccaagaaaaatcaggagctcttcactagcggttcgaatgtcatgggacggtccactcgcttccgtcaaattaaacatacaaggccaaaatctcgaattaacagatacagttaagcagcatgttgaggagaaagttggtaaggc

SEQ ID NO: 17462 - DNA, 482 bp, Gossypium hirsutum
  unsure (1)..(482): unsure at all n locations
  Clone ID: uC-gsflnu33B130b01b1
tgtattctatggcaaagtggctagactacacggatccgttaagaatttaccagcgtcttgcacttcaagaatgggagccagaccagagttgtgtttcttccctcagtacgtggtgcagactatgcaaacaccaatcttcttcgtaaattcagcttatgactcctggcagattaagaacattttggctcccagtgctgctgacaaaagtaaggcgtggaaaagctgcaagcttgacttgaagaagtgtacagcagcgcagctcaaaaccatccaagatttcaggacgcaattcttaagtgccctgaacagagccggggtggtcaactctccatctaaaggaatgttcatagattcgtgctatgcccactgtcaagtaggaaagcagatacaatggtcaagcgatagttctccggtagtaagcaacatgaaaattgccaaggctggtggagactggtattatgagcggagccncatcaaaaagc

SEQ ID NO: 17463 - DNA, 454 bp, Gossypium hirsutum
  Clone ID: uC-gsflnu33B130b03b1
tttcttgcgtccgtatgcatatggctcattagggaacaactttcattgataaaacctgcaactaaattccctacaaagaaagctaatctgcctgcaactgccatcgccaactttgccatttggaggagttcaaatactagtataccccagctggctgattcgacctatttatgtggaatgccatgccacgccattcgatccctttggtcgtgtgtactataatcgttctagtctgtccaaattgctttcttacaggggaatctggggggttagttttataatcttttttttttcttctttttttatcattttcctctattcttcttgctatgttttctcagtagaacattgacccctcccacttttcgtagaatgggcattttaattaaagatggaacaataagcaggctttagagaagaaaactgaatcaattcatttttagtcaataatatg

SEQ ID NO: 17464 - DNA, 488 bp, Gossypium hirsutum
  Clone ID: uC-gsflnu33B130b04b1
tttgtgtaattggtcatattttattgatgaaaggggttgggttggtattagtctggatacaacaaaataatttaattaggtctaatgtacttattcgatctaataagtatcttgtttcagaatttagaaattctatggctcgaatctttagtattctgttatttattacctgtgtttactatttaggcagaataccggcacccattctaactaagaaactgaaaggaatttccgaaccggaagaagtgggggaaagtgaggaagaaagaaacatagaaatagaaactatttccgaggggggaggggctaaccagaaacaggggaccgaagaaaatacttctttttcccttttttcggaggaagaggtggatccgagcaaagaaacagaaaagctacgagcgactggaaagaaaaaaaaaaaaaataaagggcgaattccactttcgttttaaagagacatactataaaaatagaccgggttatgaaac

SEQ ID NO: 17465 - DNA, 475 bp, Gossypium hirsutum
  Clone ID: uC-gsflnu33B130b06b1
tttcttctcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaatgaaattctacactataggcgataatgttatcactgaagacgaaatcaaggctctcattaagggagtgagggagttta

SEQ ID NO: 17466 - DNA, 473 bp, Gossypium hirsutum
  Clone ID: uC-gsflnu33B130b07b1
tcgtccacgcgtccgcccacgcgtccgacttccatgaaaaagctagcggagcttgatgtggaactgaccgtagaagagcggaacctgctctctgttgggtacaaaaacgtgatcggtgctcgaagagcatcgtggaggatcctgtcttcgattgagcaaaaggaagagagcaaagggaatgagcaaaatgttaagaaaatcaaaacgtctaggcagaaagtagaatcggagttgtccaatatttgtaaagatattatgggtgtcattaatgagcatctcattccttcttgctcgggtggagagtctactgggttttattataaaatgaaaggagattattataggtacttggcggagtttaagatgggtgatgagaggaaagaggccgctgatcagtccatgaaagcatatcagtctgcaacaactacagcagaagctgagttgcctcctacgcatccaatccggttgggttt

SEQ ID NO: 17467 - DNA, 480 bp, Gossypium hirsutum
  Clone ID: uC-gsflnu33B130b08b1
tcgttgaaaaactgatactagatgaaatctgtatcgattcagctttttttttgcactgaaaactgagtaaattgaaaaaaagttgaaccctgttttttagagaagtggtggatgatgtctaatgagaggcacgcttcttccaatcctacatctcctcaagaaaatgatgctatgttccttgatatacttcatgaagctccattatttggtcaccggaaaccaaggagtatagttgggggtgttttttattgtttcatactggcgggttacgcaatcttggctgcagcagctccttggatatttcagcctcttgggcatttagtcttaccattgctttgcagttgtgatgttgttcttttaatagtcacaggcatttttcagcaataccatgtttatcaagtccagaagatacgtttacaaggttactatagtttcagtcagaagttgaagcatattgttcgtctaccattcgccattact

SEQ ID NO: 17468 - DNA, 403 bp, Gossypium hirsutum
  Clone ID: uC-gsflnu33B130b09b1
ttcgtgtggggtcccctccgctaatgggtgaggggtagtttacttcacgacagttcatactcactaccggaggattagcacaatcatacatcgcatttacgggtgaaggctacatgaaaagagtccaagatactgcaaagtcttggaaggaaattcacctaatggagttagctgtctacgccgataccatcactcaagattatcacatatggagaaaaccaccagtgaatagtcaacaagtctcatcgacgagttacacttttcggaatcctttctcagaataaatgccatccgagccgggagtagtgagacatgaattccaacatgacaaggccaagctgtcacgggatattagttatcttcaagagggaaactaccagctaaagaccgatgttcagattga

SEQ ID NO: 17469 - DNA, 490 bp, Gossypium hirsutum
  Clone ID: uC-gsflnu33B130b10b1
tcgttataaagtcattttcacaatggacccttcatgggatcgatatgaagattttagcagccattgctggtttcacagttttagctctcagtttgaagagatattcaaagagatcttagaaggaaaaaaaaactgcacacaaaatgcttccagcaagttaataaatgtgaagaaatagggtttcatttccaccatattgatattcattaccagagagattgaatggattcaacaacttcgtgtaatttttttgtgtcgggatcgtatttgtagtttcgatatttttccagtaatttgtattgtgtaattcttttaagacattagcgtattcatatcgtgtttgtattattctttcgtgtggggtttaatagtcaggtttagccaaaaccatgaatttcatactcattgtttgtagtaattctttcatactgcaatatcatactgataaattttaaaataaaataatgaagcatatatttgtttggctatg

SEQ ID NO: 17470 - DNA, 491 bp, Gossypium hirsutum
  Clone ID: uC-gsflnu33B130b11b1
ttgttattttaaaaatttctttcaaatataattatcaatttgagttttaaaatactcaattactaaatttacttccacctgatttttagattcttgagattgattggcataagagcttaatttatttcccctcgcttccacccgatcgttgggatcgattagtattagtattgagaagtacttatgggaattggttttaagataactccagtactagtagctgtggtcaataaaaattaaagaagggattctcagattctgttttgttgtgttgctctctgtggatacacaagataattagggtttaattagatttggattcaagattccttcttcatcgtcattttcctaaggaagctacggagcaggcaagtcattctttcttcttcgttgcactttttctatttaatatttgcattatctttatgccattgcaataaaattgtaaagattgttctttggtttggggactttttttaccgctcatactt

SEQ ID NO: 17471 - DNA, 420 bp, Gossypium hirsutum
  Clone ID: uC-gsflnu33B130c02b1
ttttgggctacaccctgctccttaccgaaccttgccgtgttaagacgggtcgggtcgtcggcgtcgggtctgtttcttcgctcatactccggaccatcttagggttgccaactttgctgattcttacgatagttcaccgccattgtcgaaagcaatgccgctttccggttctccacgggccgagtcttcgccgacggtttcacctatgtgtcaattccctactatgaacactatggtggcttctttgaggcacttgcaactcggtaaagtcaagtctttgccttcttctggttgcgggttctccaagagggtcactgatccgacccattttatctagcctacctaggactccgacccgaaacctgacccgtcctgggatcgggtacttggatttccggggcggagaaaaacctgtgatgg

SEQ ID NO: 17472 - DNA, 469 bp, Gossypium hirsutum
  Clone ID: uC-gsflnu33B130c03b1
ttgtgtgacggggagactctcaggacaaataatatcagatcctgcttctaaactctccacaaagaaaagggaaaaaaaaagagggagatggggttgtcttttacaaagcttttcagccggcttttcgccaataaggagatgcgtattttaatggtgggtcttgatgcagctggtaaaactactattttatacaagctcaagctctttgaaatagtcaccactatcccaaccatcgggttcaatgtccagacagtggaatacaagaacatcagcttcactgtttgggatgtcggtggccaagacaagatccgtcctttgtggaggcactatttccaaaacactcaaggtcttattttcgtggtggatagcaatgacagggaccgtgttgttgaagccaagggatgaactgcacaggatgttgaatgaagaagaattgagagatgccgttttgcttcgttttgccaacaaa

SEQ ID NO: 17473 - DNA, 485 bp, Gossypium hirsutum
  Clone ID: uC-gsflnu33B130c04b1
tcttttcgtccgtgaatttccagatgtccgactgaatatcattagcaagcttgatcaagtcaaccaggtaattggaattgatttgctgtcccagtccctattgcctgcaattgtggagctcgcagaggatagacactggagggttcggcttgcaataatagaatacatacctttattggcaagccaattgggtgttggcttcttcgatgacaaacttggtgcactctgcatgcaatggttaaaagataaggtttattctatacgtgatgctgctgctaataacgtgaagcgcctcacggaagaatttggacctgattgggcaatgcagcatatagttccacaggttttggacatgataaacaacccgcattatctatatcggatgaccattctacatgcggtttctctacttgcccctgttatgggaaaggatattacttgttcaaaacttctggccgtggttattaatgctcctaaagataggg

SEQ ID NO: 17474 - DNA, 491 bp, Gossypium hirsutum
  Clone ID: uC-gsflnu33B130c05b1
tgtttttattctctagagtcttcccttgtccctgttaaaatctgtcactgtgatcattaatggccaccgctgaacctgaagttccagtcactgagcagcagcccgcggcagcagaggagccaaagccggcggaaaagcctgtgaaggagaagagacccagagctccaaaggagaaaaagcctaagcaacccaaatccgcagcacatcctccttattttcagatgatcaaggaggcgcttttggctttgaaagagaagagtggatcaagtccgtacgctatagcgaaatacatggaagagaagcacaaggcggtgcttccagcgaatttcaggaaaatcttaggtcttcagcttaaaaactcagctgccagaggcaagctgataaagatcaaggcctcttacaagctctccgaagccggcaaaaaagagagagcccctgttacgaaagctaagatggagaagaaagctaagccagctttcgagccgaagaac

SEQ ID NO: 17475 - DNA, 487 bp, Gossypium hirsutum
  Clone ID: uC-gsflnu33B130c06b1
ttacaataaggtttcaaaggaatacattaagcaactggtggacgatccaaggatcaaccgggtaccaggaatcggtcttttgtactcggagttggttcaaggcatacctcccatatttcctcatttcatttctagcattccttccatgcattcagttctagtctttgtctccattaagaaacttccaatcagtaaagtaagaccagaggagcgttttctcttcagacatgtcgaaccaagagagtatcgaatgtttcgttgtgttgtaagatatggttataaggatttcatgggaacacctgtagagtttgagcaacaactggttgagaagctgaaggaattcattcgtcatgaatatttcatggctgaaggagaggccgcagttgtagagaacccgccccagagctccaatattctagtaaatcaaggaaaagataaaggaagtagtagaagggctgtttttgtggaggaaacactgaaccaactc

SEQ ID NO: 17476 - DNA, 456 bp, Gossypium hirsutum
  Clone ID: uC-gsflnu33B130d03b1
aactataaaccccaactctccagattacatattgcaatcaatggggtcattggatacagaagattaaccagccaataacccaagccttaattctcccccatgaaaagccaccaaaggctacatcatgcagtagaccatgtttccaatcaaggacccaaaacctacccttgaatttttagtcgcgttttgggcatgtcgttgctaaacaaagtggatgttccatatatgaaaatgacattgtatatgatgggctatgacgatgttttatcagctccgggtgacccagttgagaaaactatttggacatttggaagaccagctactatggaattaacacatttctggggttctgttaacgaccctgagttcaaaggataccacgatgggaattcagaacctactggcttcggggccattggcattaccgtggatgacatgtataaggcatgtgagaga

SEQ ID NO: 17477 - DNA, 480 bp, Gossypium hirsutum
  Clone ID: uC-gsflnu33B130d04b1
tttttgttcatagtgaatattgatgaaccttcacttgacccatttccttgggatagtgatgcagattcgcatcctgtcagtgtgaagcatgctttcatgggagaaggtattgcaaatggatatggttttagatatcctggctcaaagcctggctctctttttgttattcaaaatggcctgcttgccttcatatggaaggaatccagggctgtcttgaccctgcaaagactcaacttgcaagatcttttgaagaaaggtgaacaggtgcctgctttacctccagttgccaacttttcatatttgaccaaatcctactcaaatgtgtttgcggggttctcaaacacctcaacgttttcatcttccttaaggcaaaggcatatctaggtcaccgatgggactagaatagttgccaatactcaactattgtttccatgccaatacgtcatgtagagccggggctagtttgctgctacttgtgac

SEQ ID NO: 17478 - DNA, 417 bp, Gossypium hirsutum
  Clone ID: uC-gsflnu33B130d05b1
ttcattgcgtccgcccacgcggccggaggggatgggggggaatgccaggaaaagaggattctacgctagacagtattagtgaacaacagcaatccaagaccaacaagaagcatgcaagtattattagtagtgcatcatcaaaagcctcgactgataaagcgaacaagggagaggagaaaggcaacctgaaaaggagtgtactcacagtaccttttaaagcaaattcaaagaccgctaacttgggaggcggtttaagagggacagccaacatagcttcgatggctaataactggaggaggttgtcaatgaaagggagagaaccacaatatctggaatgccttgggagaccggtgaaactggaccttcagtgtttcccttgttcggaaccacctacttggctggtaccaagaaaaatga

SEQ ID NO: 17479 - DNA, 476 bp, Gossypium hirsutum
  Clone ID: uC-gsflnu33B130d06b1
ttcctctcgtccgcgactaacaaacaatagcgggacgggaggatctctcagggtttaggtgatggcttcaaagcggatattgaaggagctcaaggatctccagaaagatcctcctacctcttgcagcgctggccctgttgctgaagacatgtttcattggcaagcaactattatgggtcctccagatagcccgtatgccggtggggtgtttctagtcaccattcatttccctccggattatccatttaaaccacccaaggttgcattcaggacaaaggtatttcaccctaatattaacagcaacggtagcatttgccttgatattttaaaggaacagtggagccctgccctcaccatatccaaggtgttgctgtcaatctgctcactcctgacggatccaaatcctgatgaccctttggtgccggagattgcccacatgtacaagacggataggaacaagtatgagacaaccgctc

SEQ ID NO: 17480 - DNA, 410 bp, Gossypium hirsutum
  Clone ID: uC-gsflnu33B130d08b1
ttaaagccccttattttcccccagaatcaagaactgtttttcatcttggtcagcccagaattcgaggcccccaccaagaaaatgcgtgcggctttgcccgccgaaattgggatgccgcaccacgtctggaattgcagccaagcgggtgcactggtagcatcagtgttggagggcgacgtcgtggggttagggaaagcattgtcgtcggacaagatcgtggagcctaaacgagcaccccttattccggggatggaagctgtgaagaaggcggctatcaaggccggagctttcgggtgtactattagtggtgctgggccgacggcggtggctgtgatagacaatgaagaggaagggaagaagattgtgcaaaaaatggtggaagcgtttttagaagaagggcatttgagatc

SEQ ID NO: 17481 - DNA, 326 bp, Gossypium hirsutum
  Clone ID: uC-gsflnu33B130d09b1
ttgtggtgagggaggggctttctctcttttgtaccggtgcttttttagcctgcggtcagtactgcatcgattgcgttctaggcccctcatattacaacgtcaagcaagcttgttgatctctccggtgggttcattttcgctgaaaagtctctaaacaactacaatcattattggtctttcttgcgccgcccaaaggagatctaaacctctgttaaagccccggacttctaacacactctatacaatctattcactgatatacaccaatggtggcggggacaatccttacattcttctcattcaatctcgaggaaatctcaccgtga

SEQ ID NO: 17482 - DNA, 339 bp, Gossypium hirsutum
  unsure (1)..(339): unsure at all n locations
  Clone ID: uC-gsflnu33B130d10b1
ggccgcccttttttttttttttatataacacgaatattattaatatgnaaaaatttatatcataaacacgattactacaaagcaaaatacacgaataggaatatatgaaatttcaggtctatcgtacatactcacagatcataggaaataaagaaaataaagttcatatgagagaaaaccaggaattattcaaaaacactacaatcacttcctaaacaaattgttgcttaaatgccctgcttatcaaatgaataggcaaaccaacccaggcttttgctggagacaaacgaggcggtgcggcaccgttgttagtactctgacatagatccccggaactgc

SEQ ID NO: 17483 - DNA, 275 bp, Gossypium hirsutum
  Clone ID: uC-gsflnu33B130e01b1
ttctactctatgcagctttttttttagtgaatttaggcaggaagatggaaaaccatttgttttccaccctaaccaacttcctttttctgtgatgagcaataagagaaaataatgatatcataattcaactgtaaattttaatttgtttgaacaaatttgatttgctcattccaactattgtaattttcttattcttatgcgtcatttttagaaataaatgccaggtaaccttttctctcaaaagaaaaaaaaaaaaataaaatatattttataag

SEQ ID NO: 17484 - DNA, 244 bp, Gossypium hirsutum
  Clone ID: uC-gsflnu33B130e02b1
ctatattataagctgctctcctgcatgaaccagtccgaattactgttcacccacacctcctgatgcttgacaccgctaaacaatctccttggggttaatatttgtcgattgatggtgacaataagggagatagaatttctatagagggcgcatggtgtgtttgggaaagggaaagaatatcttcaatttctgtatatcatgtcaggatttagcaatgacttctaaaaagttttattcctgcttt

SEQ ID NO: 17485 - DNA, 472 bp, Gossypium hirsutum
  unsure (1)..(472): unsure at all n locations
  Clone ID: uC-gsflnu33B130e05b1
tctcactcgtccgtgaatttccagatgtccgactgaatatcattagcaagcttgatcaagtcaaccaggtaattggaattgatttgctgtcccagtccctattgcctgcaattgtggagctcgcagaggatagacactggagggttcggcttgcaataatagaatacatacctttattggcaagccaattggctgttggcttcttcgatgacaaacttggtgcactctgcatgcaatggttaaaagataaggtttattctatacgtgatgctgctgctaataacgcgaagcgcctcacggaagaatttggacctgattgggcaatgcagcatatagttccacaggttttggacatgataaacaacccgcattatctatatcggatgaccattctacatgcggnttctctacttgcccctgttatgggaaaggatattacttgttcaaaacttctggccgtggatattaatgc

SEQ ID NO: 17486 - DNA, 467 bp, Gossypium hirsutum
  unsure (1)..(467): unsure at all n locations
  Clone ID: uC-gsflnu33B130e09b1
tcaggtgctgaatacgggagtggaagttctcgagactgggctgcaaaaggtccaatgttattgggtgtaaaagcagtcattgccaagagttttgagcgaattcaccgtagtaatttggtgggcatgggcatcattcccctatgtttcaagtctggagaggatgctgacactcttggattgactggccatgagcgctacacaattgatcttccaagctgtgtgagcgaaattcgacctggccaagacgtgacagtggctacagacagtggcaggtcattcacctgcactgtacgatttgatacagaggtggaactggcatatttcaaccacggaggcattctgcagtatgtcatcaggaacttgatcggcgcaaaacagtgattaggctgtgtagtgtatggttgcggagtttgacgaaatatttcataaccgtggttgctgcacatttaaatggngtttgtgaactg

SEQ ID NO: 17487 - DNA, 337 bp, Gossypium hirsutum
  Clone ID: uC-gsflnu33B130e11b1
tcgttttactactactacttactagtctagtattcggatactctgttgtgggatgcttaagggctgtactacaatcagaaggacctggcgttccaaagcagccaggaagcaaggcggaacatcagcttctgagcattcgaacaagctgagaataggaaacaatactggctatgaggaagagccggctgtagagaaaactgagcgtgagctagagggttccctgacagtgcatagatgtgacaagagacttcactttgggagctgactagagaacgagatggatgctagggtcattgagcaactcgatacagtggactttcaggataggatgtctacg

SEQ ID NO: 17488 - DNA, 487 bp, Gossypium hirsutum
  Clone ID: uC-gsflnu33B130f01b1
tcttttcgtccgcgaagagacaaaggcagaggaagaaggtgaggagaagaagaagcatggtctcctggagaagcttcaccgatcagatagcatcagctccagctcttcaagcgacgaggaagaaggtgaaggagaagagaagaagaagaagcaaaagaaggagaagaaggggctgaaagaaaagattgaagagaagttagaaggagaaaagaaagaagaggacacctcacttccagttgagaagtgcgatgagccagtagtccagccagagacgccagagaagaaaggtttcctcgagaagatcaaggagaaactccctggacaacacaagaaagctgaagaggccagtagcccagctccagccccagcagctgagccccatcacgaaggggagtcaaaggaaaagaaaggaattcttgagaagacaaggagaagctttctggtaacactccaatcagttgaaaaaaaaaaaggcttgagatcaagt

SEQ ID NO: 17489 - DNA, 485 bp, Gossypium hirsutum
  Clone ID: uC-gsflnu33B130f03b1
aatagaccttaaaaatttggaagaaacttggcgatacagatgtgaagcacttactgcagaaaatgaagcatcctctggtgaagatatacgaaaagaattagaggagacaaaactacagtacaagcggttgaaggaagagcatgcatcattacgagatcttgctgataaaatgattgaggagaaggataaagaaatttgtatacttttggatgacaacaagaatcttcaacgatctctggagtcaagacaactggttgatcacactgagaattacaacacagccacacaaaaacaagatgctccaaatctaaacacctctgcagcagaacagcagattctgcttttagcaaggcagcaggctcagagggaggaagagctggcacaatcacagcgacacattttagccctttaggaagaaattgaggagctcgaacgtgaaaatcgtctccacagtcaacaggaagctttgctgaaggaggaacttc

SEQ ID NO: 17490 - DNA, 440 bp, Gossypium hirsutum
  Clone ID: uC-gsflnu33B130f04b1
tgtagttccgtggagtaaagaagaccaaggccagtgaagcagcaaagaagaagtgagctaaaagggatgaaagaaaaggtgaaatctatgtctatcttagggtcagtctttttcaacagcttttgtttactagcctcgcctcaagtgtttaggtgtccttgaacctgatttaccattttgttttcgaaagtggattttgatgttgtattatctgattgctctaatttgagtaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaacaaaaaaacaacaaacaaacaaaaaaaaaaaaacgggggggggcccttttagggaccccattttctctccccggggtttgcaaaattaaactttttttatgggcccccca

SEQ ID NO: 17491 - DNA, 480 bp, Gossypium hirsutum
  Clone ID: uC-gsflnu33B130f05b1
ttgttttctaaaggaaaacggcatagtttacctaattcacggataatgatacatcagcctcttggtggagctcaaggaggtcaaactgatatcgatattcaggcaaatgaaatgctgcatcataaggcaaatttaaacgggtatcttgcttaccacaccggtcaaagcttggatcagattaaccaggatactgaccgagattttttcatgagcgcgaaagaagcaaaggaatacggacttattgacagtgtcattatgaatcctcttaaagctcttcagccactagctcctacagctgatagtaacgaatagccggatcttccttcaggtatttttactatcatttgacatggctaagagataattcgaaatgattgttcggttttctgattgcctcttcgaatactagataatctcgagtcgaattttgatgttaattaaatataccggtatcgaacctcgaaaaacaagttccatgtg

SEQ ID NO: 17492 - DNA, 203 bp, Gossypium hirsutum
  Clone ID: uC-gsflnu33B130f07b1
tcgtttacgtaccaatcccaaccggttgaaggttcgatgtaaatttaaccttggcgttttataacatcatattgctaagaaacttaagtgatgtttattgcgttgtgtgattaaatgctgcatcatggcatggcataatgctacaatttcattttcctcacgtcctttatctttatgagtgaatagcagtcgcttgtttatat

SEQ ID NO: 17493 - DNA, 487 bp, Gossypium hirsutum
  Clone ID: uC-gsflnu33B130f08b1
ttcataactcctcaaaattcttcttcaatggcgtctcgagttcttgttttggcttcaattcttattttctcttgttttgcagagacatgctatggggcgatctcattctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatagtcaagaaaccctacatcaacgtcaacgaaacccttgaatggaccatcgaaagagacgtgccgacggcgacgttctttatccgagcctacgctttggactccgacgaccaccaggtggcgtacggtcaaaacaccgacgctc

SEQ ID NO: 17494 - DNA, 471 bp, Gossypium hirsutum
  Clone ID: uC-gsflnu33B130f10b1
ttcttctttctagctatatccttatcagctttcaaagatggcaggaatcgcctttggtcgctttgatgattccttcagtttggggactgtcaaggcctaccttgctgagtttatctcaactttggtgtttgttttcgccggcgttggctctgccattgcttacaacaagttgacaactgatgcagccctagatcccgatgggctagtcgccattgctgtttgccatggatttgctctctttgttgcagtggctatcggtgccaacatctcaggtggccatgtcaaccctgcagtcacttttgggttagctcttggtggccaaatcaccatactaactggcatcttttactggattgcccaacttcttggatccattgctgcttgcttcttgctcaaggctgtcactggtggcttgacagttcctatccacggtcttggagctggagttggagctattcaggagtggtgatg

SEQ ID NO: 17495 - DNA, 481 bp, Gossypium hirsutum
  Clone ID: uC-gsflnu33B130f11b1
tcgtttcccttctctttattactagtccagagaacccaccaactgaactgtcattcgtgatggaggaaacacagcccgtgccacgagtaggtgtagtgctgttcgtgttgaaggggaaatcggtcctcctgggtcgccgccgcgcctcaatcggtgaatccacctttgctctccccggcggccacctcgagtttggtgagagcttcgaagagtgcggagccagagagttgatggaggagacgggcttggaaatggggaaagcagacttcttaacagtgaccaataaagtcttcctggacaaatccaaacactgccattacgtcatcgtctttctccgtgcagtgctggcggaccctaatcaagttccacaaaacccggagccagacaagtgcgacggctgggattggtatgactgggataatctgccccaacctctgttttcgacgcttgacgaaatggtacgaagtggcttcaacccctt

SEQ ID NO: 17496 - DNA, 421 bp, Gossypium hirsutum
  Clone ID: uC-gsflnu33B130g02b1
tttattttgagtgcattgtgggggaagcttgctgccgagatactgatgcaaaactgggatattgctcttgaagaacttaatcgtttgaaagaaataatcgattccaagagcttctcatcacctttgaaccaagttcagagtagaatatggctcatgcattggagcctcttcatctttttcaaccatgacaatggaagaacacagatcatcgacctatttaatcaagacaagtatctaaacgccattcaaaccagtgctccccatcttctaaggtacttagccactgcttttattgtcaacaaaaggagaagacctcaattcaaagaatttatcaaggttatccagcaagatcaatgctcttacaaagatcccatcacggagtttttggcatgtgtttatgtcaactatgaatttgatggag

SEQ ID NO: 17497 - DNA, 482 bp, Gossypium hirsutum
  Clone ID: uC-gsflnu33B130g04b1
ttcactcgtccgcccacgcgtccgatgagccaggagaggatccttttgctaaaagacaagatgataaaaagaaacgggttgagaagcaagagaagaatcgcttccagaacttgaaacaagctgcaaaacttggtgctctgccaagccatgttcagcttgctgctacggctttgcccataacaggaacccaagttccacctaagaaagtgaccaaagatgaattggggaatgtagctgggatggctgctacatctacagccagtggtgggaaattcgataggaaattgccaggagaaaagcctgctaaaaagcaaggaaagcatcgcaagttcttaccagttgttgaagggtcagggataggctcaagggagaaggagcaaactgagaatgttctaaacaagctaatctctaagcattcacatgagatactcaacgttgacaaggctgttacgatgtataatgtgaaaaaagagaagaaagct

SEQ ID NO: 17498 - DNA, 482 bp, Gossypium hirsutum
  Clone ID: uC-gsflnu33B130g06b1
ttgaaacgtagggtgcaggtcgagaaggcagctagggaatctcaggctgaagctatcagaaaaattctcggccaagattcaagtaggaagaaacgagaagataagataaaaaagaggcaagaagaaatggcacaggaaaaagctacaaattctatgatacttgcatcagacaccgtaagatggcttatggggccttcaggaacagttgtaacattccccaatgaggttggtttaccaagtatattcgatcctaagccttgcagttaccctccacctcgagagaaatgtgcagttccatcttgtacgaatccatacaagtaccgagattcaaaatcgaagcttcccctttgcagccttcaatgctacaagacaatgcatgaaaagatgtctgcccttactgcctggtagtgaaatgcactaccaaaacgtcatttctgtttgtatataagctgtgtaaaggatagcttatttatgatacaatg

SEQ ID NO: 17499 - DNA, 489 bp, Gossypium hirsutum
  Clone ID: uC-gsflnu33B130g07b1
ttgtatctttgggtgcaatggtggtttgccatcccaagcctttgagtatatcaaatacaacggtggccttgatacggaggaggcatacccttatacagcaaaagatggtcaatgcacattctcatccgaaaatgttggtgtccaagtcattgacgctgtcaacattaccttgggttctgaagatgaattaaagcatgcagttgctatggttcgaccagttatcctggcatttgaagttgtcccaagtttcaatttttacaaaagcggggtttacaccagtgacaagtgtggcaacacttcctcggatgtgaaccacgctgttcttgcagttggatatggaattgaaaatggagtcccgtattggctcattaagaactcatggggagcagaatggggtgacaagggctacttcaagatggaaatgggcaaaaacaatgtgtggtgtggcaacatgtgcatcataccccgttgctgcttgatctgagggag

SEQ ID NO: 17500 - DNA, 476 bp, Gossypium hirsutum
  Clone ID: uC-gsflnu33B130g09b1
tcgttcacgcgtccggctaaccatgagctacttaaccatttcccaaatgtgctccctcctcttctttagcgtccttttcatttccgctcatgcagcgcgctttgaaatccgcaatgagtgctcctacaccgtctgggcagcagcctctcctggtggtggccgtcgcctagaccctcggcaaagttggaccatcgaatgtgcctgctgccactcctatggctctcatttggggccgaaccaattgcaatttcgatgccagtggtaggggtcattgccaaaccggtgattgtggtggactccttcaatgcaaaggctggggtgtaccttcaaacaccctggctgaatatgcacttaaccaatttggaaacatggatttctacgacatttccttagttgatgggtttaacatccccatggtgtttgggccaactaatggcggttgtcacaacatttcgtgcactgcagacatcaacgga

SEQ ID NO: 17501 - DNA, 371 bp, Gossypium hirsutum
  Clone ID: uC-gsflnu33B130g11b1
tctgtcacgcgtccgcccacgcgtccgcccacgcgtccggttcactaaacgattccgaggattcagcttgaaagaacgaatgggaatgggattaatagtatcttgtgtggcaacgtcggtggggagcaagcggccagccaccgcaacaaggtttggctcatcaatctcatgtatgcttaaatttgtagctattagtctctgtattctgctaaagttcagaattttttctactattccggttctgttaaactcagttaagttttgttattttcgaaaattgatatcctaaaattattatcgcgttgaaatatataaggatttggaattttaaaaaaaaatacaaaaaaaaaaaaacaaaataaaaaataatg

SEQ ID NO: 17502 - DNA, 463 bp, Gossypium hirsutum
  Clone ID: uC-gsflnu33B130g12b1
ttcttagatttcagctggtgtccttggtggagcaaccgcaatttgggtcctttttgagttgattgaataccacctacttgctttaatctgtcacatttcgatactctgtcttgcactactgtttttgtggtccaatgctcataccttcatccacaagtccccacctcgcatccccgaaattcatttgccagaggagccattcctccaagttgcctctgcattggcaattgaacttaaccagggattgaaacttctgcgagatattgcatctggaagaaatctgaaggagttccttatggttatagctgcattctgggttctgtcaattgtggggagttggtgcaacttcttgaccttgttctatatatgtttcgcattgctgcacacggtacctgtattatacgagaagtacgaggataaggtagacccatttgcagagaaggctgcgatcgagatgaaaaac

SEQ ID NO: 17503 - DNA, 440 bp, Gossypium hirsutum
  Clone ID: uC-gsflnu33B130h04b1
agtcaagatggctcgatcaaaggagggcgaaataacacttctagagtacagcggggacatctcgaaactaggctctgcagaaagatttcttaagacaatacttgatatcccttttgccttcaaaagaattgaagccatgctctacagagctaactttgatacagaagtgaagtacttgaggaagtcttttcaaaccctagatgaagcaagcgaggaggtgaagaatagcaggttattcctcaaactcctagaggctgttctgaggacaggaaaccggatgaatgatggtaccaatcgtggtgatgctaaagcttataaacttgatacccttttgaaacttgacgatataaagggaacagatggaaaaaccacacttgtacactatgtggctcatgagatcattagatctgaaggtgctggcactgactctgcaaatggga

SEQ ID NO: 17504 - DNA, 431 bp, Gossypium hirsutum
  Clone ID: uC-gsflnu33B130h05b1
cgtccgcgaacaggagctttggcctgaggtatttcaggtacattgagaccatcaaagaatctggagaaagggaatgtcctggagttgctgcttgtgctgatctccttgctctgtctgctagggaaggcatcgtttcgttgggaggcccttatattcctgtcaaaactggaagaagagacggtagaaggagcagaacatatgttgtgcaggagtatcttccggaccacaatgagaccatctctggcgttcttgtcaggcttgccgacattgttcttgacacccatggagtctttgtcctcctatgcgctcacagtgttggcagaactcactgtgtgaagctcctgcatcctttgtacccagaggttgaccctgccctcaacccctacatgttccacacatacttcatacatgccctgaacagatcccagacc

SEQ ID NO: 17505 - DNA, 479 bp, Gossypium hirsutum
  Clone ID: uC-gsflnu33B130h06b1
tctgtggcaaagagatcggtgtacttgagaggttttacagagggaactatgattgttggagaatatgctggaagaagagtccaggaagctaagccgctgttgaggaccaaactgattgagacgggccaggcaataatttatagtgagcctgagaagaaggtcatgtcaaggtctggtgatgagtgtgttgtggctcttacagatcaatggtacatcacatacggggaaccagaatggaaaaaattgtctgaggagtgcttatccaacatgaatctatactctgatgagacacgtcatggctttgaacatacgttaggatggctgaaccaatgggcttgctcacgatcctttggccttgggactcgcattccttgggatgaagaattccttgctgagtcattatctgactcaaccatttacatggcttattacacagttgctcatcttttacaaaatggagacatgtatggaaaaagtgc

SEQ ID NO: 17506 - DNA, 489 bp, Gossypium hirsutum
  Clone ID: uC-gsflnu33B130h08b1
cacgcgtccggcttctttctagctatatccttatcagctttcaaagatggcaggaatcgcctttggtcgctttgatgattccttcagtttggggactgtcaaggcctaccttgctgagtttatctcaactttgctgtttgttttcgccggcgttggctctgccattgcttacaacaagttgacaactgatgcagccctagatcccgatgggctattctccattgctgtttgccatggatttgctctctttgctgcagtggctatcggtgccaacatctcaggtggccatgtcaaccctgcagtcacttttgggttagctcttggtggccaaatcaccatactaactggcatcttttactggattgcccaacttcttggatccattgttgcttgcttcttgctcaaggctgccactggtggcttgacagttcctatccacggtcttggagctggagttggagctattcaaggagtggcgacggagatcat

SEQ ID NO: 17507 - DNA, 502 bp, Gossypium hirsutum
  Clone ID: uC-gsflnu33B130h09b1
tcggtttcatctctatccaaatatgaatgcaataccaccctctgcacttcttcttttctcactcactgccccttcttcatcatgacttcacccccaatttcaatgacagggatgtgggaaatgttggcccaatctttgcccttctccttttcacaacgctcctccagcaaaggacaattactaatgcacaaacgagaaagagagggagggagcatgtttgggggcatggattggagcttgggacagctgtcgataagcaatctggaaagagaggcgaggtgttgaaaccccttgtactccaaactctttagatttggaagttgagagagccagagagtttcaagagaagagggaagcagatgttcatctggaaaacactccatctctacttctgaacccccgatcaacagatatgtaagagaagggagtgtatacaaactccattcccttttcctaatcaagctcccaattagtttatcactgcttccaattgtaaatgctt

SEQ ID NO: 17508 - DNA, 480 bp, Gossypium hirsutum
  Clone ID: uC-gsflnu33B130h10b1
ttggtcatggttccggccaagaaaggttgcatactattcacatcaagtcttgcttcaaaaatcagcttcggtagcccccatgcatacaaggcatcgaagcatgccgttgcagggttgacgaagagcttggccgtggagttaggtgagcatggaattagagtcaactctatttcacctcatgcaatttcgactccaatgttccaaaaatcaattgggatacccgataagaagaagggagaggagatgattgcggcttcagcagtgttgaaaggcactgtattggagcctgaagattttgcacatgcagcactgtatttggcaagtgatgaggctaaatttatcagtggtgtcaacttaccactggatggagggtatagtctcagcaatcaatcatggaagctgggattcgcagcactttttggataaaccaccaagtcctctgcttcactccttgaattatattctcttaaataggaaaac

SEQ ID NO: 17509 - DNA, 468 bp, Gossypium hirsutum
  Clone ID: uC-gsflnu33B130h11b1
tttttatagcaagactccttatttctccgatgtcgatcttcgaatacaacgggagtgccctaatagccatggtaggcaagaactgcttcgccattgccagcgatcggagactcggagttcaactccaaactatcgccaccgatttccagaggatttataaagtccacgatcgcctcttcctcggtctctccggcctcgccaccgatgctcaaaccttgtatcaaaggcttgtctttcggcacaaactgtatcagctaagagaagaaagagacatgaaacctgagacttttgctaaccttgtttctgcgattctttacgagaaaaggtttggtccatacttctgccaacctgtaattgctggattaggagatgaagacaagcccttcatttgcaccatggattccatcggagccaaggagcttgcgaaagattttgttgtagctggcactgcctcggagtctctctatg

SEQ ID NO: 17510 - DNA, 86 bp, Gossypium hirsutum
  Clone ID: uC-gsflnu33B130h12b1
aactaccacgcgtacggatatagatcgcgagcgggccgcccttttttatattattttagagaaaaaaaaataaagtaagggaggaa

SEQ ID NO: 17511 - DNA, 381 bp, Gossypium hirsutum
  Clone ID: uC-gsflnu33B131a03b1
tttctctcctaggcggggactactcgagcttcataacaccctaagcttttaactatggcggatgtagagacggacgttgcgacggccggtgtgcccaagaagagaacattcaagaagtttagcttccgaggtgtctatttggatgctctccttgatatgtccactgatgagcttgtcaagctcttccctgctcgagctcgcagaaggttccagaggggttcgaagagaaagcccatggctctaattaagaagcttcgcaaggcgaaaagggaggctccacctggggagaagccagaaccagttagaacccacctgcgtaacatgatcattgtacccgaaatgattggaagcattatcggtgtgtaccatggcaagacattc

SEQ ID NO: 17512 - DNA, 409 bp, Gossypium hirsutum
  Clone ID: uC-gsflnu33B131a05b1
ttctctcgtccgagaaatcatgagccaggctccgaccgatcatgaaaaggtctcggaaaccaaacagccaacgtcgtccacggagtcaacccaaccggcgactctctcttctgattacgctccctacccgaaattagaccccaaggacgtcgctcctccaccggaaaattggaccaccgtttccatggcttcgcaatcggatcccagtccggaccccgtcccgatctccagcagcgctgctaccaccatgcctgctgagtccaacccgtacgtttctccggcgccagttcaatcttcttccgtcaagaataagatggaatcagcgaaagacgtgttggggaaatggggaaagaaagcggcggacgacactaagaaggcgaaagagatagctgagaacatgtggcaacac

SEQ ID NO: 17513 - DNA, 272 bp, Gossypium hirsutum
  Clone ID: uC-gsflnu33B131a06b1
tttttgaatctagggatttgcgggtggagaagacgagagctcatctctctgcttcaaagctcctgtccaggtagaattctcttcttcctttgcgttgtgttctttgttgttcagtcgccatggcttcaaagcggattttgaaggaactcaaggatttgcagaaagatccacccacttcttgcagtgctggtccagtagctgaagacatgtttcattggcaagcaacaatcatgggaccctcagatagcccttatgctggaggtgtgttttta

SEQ ID NO: 17514 - DNA, 334 bp, Gossypium hirsutum
  Clone ID: uC-gsflnu33B131a09b1
tccacgcgtccgggtacctcattggctttgagtaaaaatagcattgcgagctttgagccaaagcccttttttttatttttttaattttaccttgtttttgctacttgccaattccaagcgagataatcaatcaatcaaagagacatcccataaccatgacggcactctccaatttccgatcattattaacggtagtgctattgggaatctgcacctgcacttacttgaagatgcaagtaccaggtatccttgaacagagaactgggatccgtgggtatttttagaaggcacccacaatatgccaacgggtaagaccccgggggggatgcagatg

SEQ ID NO: 17515 - DNA, 264 bp, Gossypium hirsutum
  Clone ID: uC-gsflnu33B131a10b1
tttcacgcgtccgctcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcgaagaaggttatcatttctgctcccagtaaggatgctcccatgtttgttgtgggtgtcaatgagaaggaatataagcctgaccttaacattg

SEQ ID NO: 17516 - DNA, 344 bp, Gossypium hirsutum
  Clone ID: uC-gsflnu33B131a11b1
ttttagctattccatcctcctgttccgattttgcttttcccattgtctaatttttgccctcagttttatcttctgcttctgtaactttttttctaaccatctttacgtttccctttttttccattgattgcacaggagacctagatatttcaggactggagtaccacctgttcagaggaggctaagaatggaggctctgcagcaaagccacgccagcaccagccgcaacagcaacaagaagggaatgtcgttacaaagcaaaggccctggactggatttcgtgctcgccaagatgaaaaaagatagcatgaatggtcctgcacaatgtaacggcagcagtcgac

SEQ ID NO: 17517 - DNA, 177 bp, Gossypium hirsutum
  unsure (1)..(177): unsure at all n locations
  Clone ID: uC-gsflnu33B131b02b1
tgttctctcgtccgctattttacctggatttgaaagtgagggataaaaatgttgttcaggtaatagagatgcagtgggcattgttttgatccttatttccaacttgtaaaaattccccaaatgttggcatctaaattctatttatttaaatgaaattcaccaaatttctcattgcnc

SEQ ID NO: 17518 - DNA, 213 bp, Gossypium hirsutum
  unsure (1)..(213): unsure at all n locations
  Clone ID: uC-gsflnu33B131b03b1
tttctctcgtccgctgagctgttataagaaatggaagatggaagatgtttgcggtattgtttattagtataatgtactattatgttgaatgtgctatgaattatttctgatcttanaacttttgtttactataatctcattatcatgtcctaaaaagttttctttttgggtcatattgtttttttgactttataatatttagcaatatttcat

SEQ ID NO: 17519 - DNA, 327 bp, Gossypium hirsutum
  Clone ID: uC-gsflnu33B131b05b1
gggcgtgatggaatggctaaaaaggcaaagggagtggggggagcacaggaccctgctatgaattaggacagtttgagagtgatccagggagatctagtggaagagtctaaaacctttgcaataccgactcaagctcatgccatgatggagggcggtggcagcaagtggcactggactttggagctcgagaagctggacggggggattgcgcactctgagactatagccgcgttggttcaagatatgtctacagagattgacgcccaccttaccctagccagctaaagagtttcacaggtggctatcgctgccgctacttgaagcact

SEQ ID NO: 17520 - DNA, 260 bp, Gossypium hirsutum
  Clone ID: uC-gsflnu33B131b08b1
atcgtccccgcccattggcaatttggtcaaacattcacgggcaaaaatttcagagtttgatttctcaaagaaaaagaaaaaaagaaaaatattagccccataagttagaaaagccatttccagttttacccttgatggtccaacttttgttttgttagggtgatgtctctttttgacaaattgggtacttggggtgtcttctttattttaatttttggttctgattttggggttaatgggtttgcatttggggttggggg

SEQ ID NO: 17521 - DNA, 334 bp, Gossypium hirsutum
  Clone ID: uC-gsflnu33B131b12b1
ttgataagggtctgttttcacatcttgctcatggtggtcatggacaccctcctggcggatatccaccggctggagcgtacccccctcaaggctatccaccagctggctaccctcctcaaggaggatacccccctcacggctatccaccatctggctatcctggtgcatcccattcagggcacagtggcatgggagcgctgcttgcaggtggtgcaagagctgccgcagctgctatgggggctcaccacgtgtctcatggtgctcatggtgctcatggtgcttatggtgctcatggtgcttatggtgctcatgggtttggtcatggtcatcatgg

SEQ ID NO: 17522 - DNA, 456 bp, Gossypium hirsutum
  unsure (1)..(456): unsure at all n locations
  Clone ID: uC-gsflnu33B131c09b1
tgcgtttctctttatatcacccaggtctactgcttccagtcctagagaaggtaatgttggtagtggtaaagtcaatgaagaacccgagaagtgctctttgcaagacttcnattatggctgcttcagatatcttcaatgcctacggcgaaaaattgcttgattcaactgattccactgcatttgatcagctgttactgcagttgttactgaaagcttctcaagacaagaagtttgtgtgtgaagaagccgataagtcgctgacagcaatggttaactccattgctgctttacctctgcttcaaaagctccgcagatttgttaaccatggcaaccttagagtcagagccaaagctgcagtttccatttccaattctgtttacaaaatgggatcagaagaaatcaaagagttcgggtcagttaccttgcttcaatggctacggatttgctaaacgatag

SEQ ID NO: 17523 - DNA, 335 bp, Gossypium hirsutum
  Clone ID: uC-gsflnu33B131c11b1
ttcaaatcaaaatcatttccataaatccattttttcacgtagtcgcttcaaatacgttccagaatcaaaacaacgtcgtttcaagttcagatggaatcaacggcgaagccagcgggtggtagaaagggaggagtgaagaagaaggcagtatctaagtcggtaaaagcggggctccaatttcccgtgggtcgtatagctcggttcctcaagaaaggtcgttatgcgcagcgttacggcggtggcgctcccgtttatcttgccgccgtccttgagtatcttgccgctgaggttttggaactggcggggaatgcgggacgtgacaacaaaaagaacag

SEQ ID NO: 17524 - DNA, 406 bp, Gossypium hirsutum
  Clone ID: uC-gsflnu33B131c12b1
tttgaaaccggacgtgattggacctggtgtcaacatattagctgcttggtcagaggctattggtcccactggtttggccaaggactcgaggaagaccatgttcaacatcatgtcaggtacatcaatgtcatgtccacatatcagtgggctagcagcgttgatcaaggctgctcatccagaatggagcccaagtgcaatcaaatcggctctaatgaccactgcctacacccaagacaacaccaactcgactcttatggatgcggcggacggatcgttgtcaaacccatgggcacatggggctggccacgtcgatccccaaaaagctctttcaccaggcctagtatacgacatctcgaccgaagaatacatcacatttcttgtgctcactcggctacaccgtcgacca

SEQ ID NO: 17525 - DNA, 433 bp, Gossypium hirsutum
  Clone ID: uC-gsflnu33B131d02b1
caaaagaaacgtttcttttacactaacatggctagaccgcaacaacgatatcgaggtgtccgacaaaggcattggggttcttgggtttctgaaattcgccatcctcttttgaaaactagaatttggctgggaacatttgaaacggcggaagacgcggctcgtgcctatgatgaagctgcaaggcttatgtgtggacctaggactagaactaacttcccttacgatcccaatgcacctcagtcatcatcatccaagctgctctcagcaactttgacagctaaactacataaatgctacttggcttcacttcaaatgaccaaacaacaatcagtgcagaagccaaaaagtgagctaccgactccacatatcatcaccaacaatggcattgcagatagaggtagtgggacgggagttcgcctgctggagaagagac

SEQ ID NO: 17526 - DNA, 67 bp, Gossypium hirsutum
  Clone ID: uC-gsflnu33B131d03b1
tccatgcgtccgaaaaaaaaaaaaaaaaaaaaaaaaaaaaaaaaaaaaaaaaaaaaaaaaaaacagg

SEQ ID NO: 17527 - DNA, 423 bp, Gossypium hirsutum
  Clone ID: uC-gsflnu33B131d08b1
ttaacccccaaatctctccttgcctctcttttcatatccatttttttctctcttctatttcttcccttttgcagggcagaggaaaaaaaaaagcaacaaaaaatggctcaaagaaccgaaaaagaagaaaccgaattcaaggtaccggaaaccttaacgctttgcgtcaatgattgtggcgctataggaaatccggccaccaataacatgtgtcaaaattgtttcaacgctacaacgcctaaatcaaccggtgccgtcgactcctcttcaaccggcggtgctaggtcaggtggtgtttcgatcctgaaccaaagatctaccacgtcgcgttctataaacaagcgatccgatcttttttcgcctaaaacgaccacggttgataggagctctggttcgaggaacaatccggagcctgggtacgga

SEQ ID NO: 17528 - DNA, 369 bp, Gossypium hirsutum
  Clone ID: uC-gsflnu33B131d10b1
tttcttccacgcgtccgatgaactattggccttgaaattaagtaggagcattgcctctgagaaagtgattcaagaaagtgctcaaaaattatattcagccttttgtgaagtacaaggaataactgaggataagggctatcgtgtgttgagcaaaatctcaaaccatccaacgcaaatgctaatttttttcagtttactttcttctgtgcaattggaattggtgaaaagatttcttattgatcattaaaaattatggctgcgttggtaatattttgataactttttgtatatgcaatatttggatggaaagatgtcattagtagaatgttataaactattataactttttgatattggaaaatttaacat

SEQ ID NO: 17529 - DNA, 481 bp, Gossypium hirsutum
  Clone ID: uC-gsflnu33B131e01b1
tttatcaagagtgctagggagagcaagaggtggtggcttccattgccacaagtaccaaaaactgggctctcagataccgaaaggcagaagttgcaatgtaaaggcaaggtggtatatcaagtattcaaggctgcagcatcgattaatgaaaatgttttgcttgaaatacctcttccatccattattagggatgctcttcccaagtctgggaaggcaagccttggtgacgacctgtacaaggttttgactctggagtccagctcggttgatgaaatgttcatttcgctaaatttaaagtctgaaaacaatgctctcgaggtcattaataggttggaagctgctgtatttgcatggaaagggagacttacagaacaagctagtggtaaatcgccagtgcgaaaatcatggtcttttattaaacctatatctgaaatggataagatggagctcctagtggaccgtgctgaagcacttttacgtc

SEQ ID NO: 17530 - DNA, 364 bp, Gossypium hirsutum
  Clone ID: uC-gsflnu33B131e05b1
tttctttcggacattacaagggaacaagcagttcaagatctggaggaatcggagagatgaagagaagaacttgtacaattgctgttggcataaagggtatgagagaatgtggcttattaagtcaaatggagaaagggacatcatgtccttgttgtgtgtaagagctttctccctgagacaggcttggaacctgacatcaagaatggttcaacttaaagatgcctccttgtactcattctcatcctctttatattttccgatgctttcttcaagtaggatactaagaaacatcatttcctgtactattctttctgattgcttataaaacagcttgctcattagaaccccttttcttggattattt

SEQ ID NO: 17531 - DNA, 147 bp, Gossypium hirsutum
  Clone ID: uC-gsflnu33B131e06b1
gctttctttcgtacgggctcctgttgaaactgtattggagaactctgagaacatcacactgagctggcacaccaatccctactctttatccctcggggggatgtacccagggcaatggacaccatctaatcttaccgattacaacct

SEQ ID NO: 17532 - DNA, 367 bp, Gossypium hirsutum
  Clone ID: uC-gsflnu33B131e08b1
tttctctccattaaattggatagtgttacaggcaataaagagagcttcttccagcaatatctggctctgagggagatggatccattggacatgttgggccataatcctgattccttattcggcaaattttcccagagcaagtacctgatggttgttcatccaaagatggaagcttcattctttggaaatttagaccagcgtaattatgtaacaggaggtgggcatcctaggactccattttaccaagcctttctaaaattggctaaatctatttggcttttgcatcggctggcttactcattcaaccctaacgtgaaagtctttcaagctaaaaggggaagtgaatactcagaggtttatatggaaa

SEQ ID NO: 17533 - DNA, 159 bp, Gossypium hirsutum
  Clone ID: uC-gsflnu33B131e09b1
tccacgcgtccgaggaagggtcttgagaatacgggggagatggtttagtcggcactatagatcaaatagacagactgaaagtctcagggcacggtagatgataatcctagatcctaacctaacatctactaagagaggccgctcgctttctacagcacc

SEQ ID NO: 17534 - DNA, 379 bp, Gossypium hirsutum
  Clone ID: uC-gsflnu33B131e11b1
tttctttgttatacctcctcctgctacttattttgagaagatacaagctgttgtgaaaaagtatgacatactttttatcgccgatgaggttatttgtgcatttggaaggcttgggacgatgtttggatgtgacaagtacaatattaaaccagatcttatttcactagcaaaggctctttcttctgcatatatgcccattggagcagtcatggtgagccctgaagtttcagaagtcatttattctcaaagcaacaaacttggtagtttctctcatggattcacctactctgggcaccctgtatcctgtgctgttgcaattgaagcactcaagctctacaaggagagaaatattgctgagaaggtgaagagcatttaccga

SEQ ID NO: 17535 - DNA, 464 bp, Gossypium hirsutum
  Clone ID: uC-gsflnu33B131e12b1
ttagaggttactattaaggaattagctgaattggttaaggaagttgttgggtttgaaggggaacttgtttgggattcttcgaagcctgatgggactcctaggaaactcatggacagctcgaagcttgcttcattggggtggaatgccaagatttctttgaaagatgggcttattgatacttataaatggtacttggagaaagtcaagcaatgatggcagagcaggcgatattgttggtttcttccctgatgaattttttgatcggggtatttgttgttttgtgattgttgtcattattatcatcgcctattggtcgtttattgatatgtttggatacgccgcggaataatttgaggttaattttgtaccaattatatggcatccaagttgagcatgaagaattcctttgctattattggatcaaactctctattgaggactgactagaatttctttttatttaa

SEQ ID NO: 17536 - DNA, 123 bp, Gossypium hirsutum
  Clone ID: uC-gsflnu33B131f02b1
tcctctcgtccgctttgggccttggactgtttctatttttgtttgggttttatatttatttgtttgtaacgggctgggcaaatttggcccactacagaaatgatatgttcttcatattttaat

SEQ ID NO: 17537 - DNA, 444 bp, Gossypium hirsutum
  Clone ID: uC-gsflnu33B131f03b1
tttctctcgtccgagacgctatggtttgctaggattaaatggttgtgggaaatccacgctgcttactgcaatagggttgcgtgaacttccaattccagagcacatggatatctatcacctgacgagggagattgaagcttcagatatgtctgcattgcaggctgtcataagttgtgatgaagagaggttgaagttggagaaagaagcagaaatcttggcagcacaggatgatggtggtggagagacacttgaacgtatctatgagcgattggatgccttggatgcatcaactgctgagaaacgtgctgctgaaattttatttggcctcggtttcaacaagatgatgcaggcaaagaaaacccgagatttctctggtggttggagaatgaggattgcattggcacgggctctattcatgaatcccaccattcttttgcttgatga

SEQ ID NO: 17538 - DNA, 417 bp, Gossypium hirsutum
  Clone ID: uC-gsflnu33B131f04b1
ttagcgtgttcttgctacctgctacaaggctctaaatgaccaccatgtcatgcttgagggtactcttttgaagcctaacatggtgacccctggttcggactccccgaaggttgccccagatgttattgctgagtatactgtccgtgccttgcagcgaactgtccctgctgcagtcccagctattgtattcttgtctggtgggcaaagtgaggaggaggctaccctaaaccttaatgccatgaacaagctccagaccaagaaaccatggtcactctcattctcattcggacgcgcccttcagcagagcactctcaagacctgggcaggaaaagaggagaatgtgaagaaggcacaagatgctttgctcgttaggtgcaaggctaacttagaagccactttgggtacatcaagggtgat

SEQ ID NO: 17539 - DNA, 404 bp, Gossypium hirsutum
  Clone ID: uC-gsflnu33B131f08b1
tttgcaaaattggttataactacatatgagggaaaacatgaccatgatttgcctccaactaggactgttacttataatataactggcttaaatgttgattcacaagctcataacagtgaatcaggcaccaaggtagaagaaagggagaccattaattctagttctggagccgagaataaaccgagcgagcaatcgaatggcgagtcaagaactaagttagaagtaagtggtactgttcatgtttgcacagttgatgcacctactttgggtcctgaaagtgggtcaaatgagcagcggagtggaaagttagatcacaatgaagagagtgaagtggctggctacactgctcatagtaaatcaagttctcagaaaacagaatgtgcagatcagcatcaaattcgaag

SEQ ID NO: 17540 - DNA, 450 bp, Gossypium hirsutum
  Clone ID: uC-gsflnu33B131f09b1
tgagacacagaccctgcgatcttttgagattgaattttgaaagataaagaagaagaaaagaaaaaagcaaattagcaatgtcggcctttctcaagcttgaagattcacctatgtttcaaaagcagatatggtctttggagcacatggctgatgatttgaaaaatcgctgtcaaatactgtataaaggaagcaaaaggtttatggcagcccttggagaagcatataatggagacaatagctttgctgattctttagaagcatttggtggtgcgaaggatgatccttatagtttatctataggaggtttccaagggccgatcatgtccaagttcatcaaagcttttcgtgagcttgctagttataaggagctgcttcgttcacaagtggagcatgtgtttattgatcagttaatgcactttatgaaatggtgatttgcaagatgcgaaggag

SEQ ID NO: 17541 - DNA, 399 bp, Gossypium hirsutum
  Clone ID: uC-gsflnu33B131f10b1
ttggagcttggtactttgaaatcaatgtggtgaagttgggggagacggggcatacacggcttgggtggtctactgataaaggtgacttgcaagcgcctgtagggtatgatggtaatagctttggatatagagatattgatgggagtaaggtgcacaaagctttgagagagaagtatggggaagaagggtataaagaaggagatgttattgggttttatataaatttaccagaaggtggatcatatgctcccaagcctcctcatcttgtctggtataaaggccagagatacgtgcgtgcccctgatgcaaaagaggagccacctaaagtggtgcctggaagtgaaatttcattttttaaaaatgggggtatgccaaaggggtgctttcaaggattttgtt

SEQ ID NO: 17542 - DNA, 288 bp, Gossypium hirsutum
  Clone ID: uC-gsflnu33B131f11b1
ttccacgcttccgcccacgcgtccgcccacgcgtccgttgggactctaggaggtgttctggatcagtgtgaaacaggaaaacgcccataggatggtcaccgtgcaatatacaacagatctgactgagaagctcatgcaaaagaaagatgcttaaaacaccattgaaaatggctggctgtccggcaactagtccttgaaaaatatataccctgcttttttctttttggctacccctatgccggtctaatgttagttgtgcttctagtgcttatggaacatgtaaaccca

SEQ ID NO: 17543 - DNA, 244 bp, Gossypium hirsutum
  Clone ID: uC-gsflnu33B131f12b1
tctcagttcgcacctccttttttatttccttctcgcctctgtagtttcctacactctcacacactcacagcaaaaaatgccgttcaagaggtatgttgagatcgggagggtggctctcgttaactacagctaagactacggaaaattggttgccatcgttgatgtggtgaccaaaacaaacctctggttgcgccccaaatatggtcagaggccaaatgaacttgaagaggcttactttgacaga

SEQ ID NO: 17544 - DNA, 449 bp, Gossypium hirsutum
  Clone ID: uC-gsflnu33B131g03b1
gattgtaagcttggtcgctttgttcgtcccaaattttgccgatttcttgtccttgatcggaagcagtgtgtgctgtggtttggggtttgtattgcctgctttattccatttgttggtgttcaaggaagagttggagtggaaaggatggactgtggatgtcggaattgtgaccttgggccttgttcttggagtttcaggaacatggtctgctcttgtggagatgttctccgtaaaggtgtagggatacagcgtcacaaatatcgtgaccttgggctttgttcttggtgttttaggaacttggtctgctctcatggagatttttatctgtgaaagcgtattggtacagtgttgaaatgaaggttaagtttctgaactgcttcatgatatactgtctacttgttttcttgatcgtatttggaaaaattgatattttatatttagattgaaaa

SEQ ID NO: 17545 - DNA, 432 bp, Gossypium hirsutum
  Clone ID: uC-gsflnu33B131g05b1
ttgatttccgagttcaggatgatcgaagtttagggggttgctcgtctcctttactaagaagagaacctccaaatcttaataatcgaaatggtaacctgaaagaagaaatgtctgacaattctgctttccaagaagagcatttttatgtcagaaacagtcatatggatcaagctgatggtgtaacaaggcgagacatgatggatgataaagataaatctattacacctagtggtttgaaagagattgatagagatgtgcagaacgttgaaacaagcgggtcagatacaagttccacaaagggtaaaaatgcagttgataaattagcagagtgtcacagagaaaatgcagatgttcgagaagatgaaaaagttgaaaccggtcaaactgaagaaaagcatagaaggaaaaggaagcgaactataatgaatgatg

SEQ ID NO: 17546 - DNA, 384 bp, Gossypium hirsutum
  unsure (1)..(384): unsure at all n locations
  Clone ID: uC-gsflnu33B131g12b1
ttccacgcgtccgaaaaaatagntatttatgaatttttttctttttctggatttcttttcctttctctgttggagatgaatggagaaggaaaagaaagtaaggaagtgaaaatggacgaagcagctaacaaggagcgcgtggctttcatgtggggatatttgcctggcgcgttacctcaacggacgccgcttttgtcgccggtgaatgtacggattccggcttccgcaggttgttcttggaccgacgtctgcggtggtggctgcggatccgccatggccatttctgattcagggaagctcatcacatggggctcaacagatgatttgggtcaaagctacgtcacatcccggaagcatggggaaattccagagccctttccactt

SEQ ID NO: 17547 - DNA, 351 bp, Gossypium hirsutum
  unsure (1)..(351): unsure at all n locations
  Clone ID: uC-gsflnu33B131h01b1
tttcacgcgtccggtgggaaaatataacttaaaagcaagctccaatggatttggttcagttgcaaaggcagtttgttgactacaaaacctcactctatcatganntttttctggatgaacaatttacccaacttcaagaacttcaagatgaaaacaacccagattttgtggttgaagtggtgtctcttttctttgaagattttgaaagacttctcaatgaactggctagagctctagagcagcagaacatagattacaaaaggattgatgctcatgttcaccagttgaaaggtagtatctccagcattggcgctcaaagagttcataaagtctggatagccctttctcaac

SEQ ID NO: 17548 - DNA, 270 bp, Gossypium hirsutum
  Clone ID: uC-gsflnu33B131h02b1
ttcctttcgtccgggttcctagcagacaatccaggggtttggttcatgcattgccatttggaagtacatacaagctggggattgaagatggcatgggtggttaatgatggaaaaggccctaaacagaaactaatgcctccacctgctgatcttcctaaatgctgaaccattctttttctttagcttgaaattgttttaaatctctacttttgactacagaatgtaagagacaaaaattcatcctttacaaatataatttcattttttctt

SEQ ID NO: 17549 - DNA, 341 bp, Gossypium hirsutum
  Clone ID: uC-gsflnu33B131h03b1
ttcatgcgtacgcatcttttgcatgtcggttcgagtatgtccacaatgatcaatcttgtgagtcaagctctgatggcgcacaaatgctcagacatggtgctccgacaaagccataacacttctttgcagaatacggcatggacagagggttccagaacaaatgaatctcaaatacctcaaaagtgcaagatcaggacactgctgaagctaggagaaaggtctcaaaagcagaatgtatttgataaggccaatattttggagataataccagagcagacaatgatgctcaagttactttgcagaaattctgaggataaacagccatgtgcagtgctgatcta

SEQ ID NO: 17550 - DNA, 531 bp, Gossypium hirsutum
  Clone ID: uC-gsflnu33B131h04b1
tccatgcgtacgcccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattggggggggccttttaaaaaaaaaaatatttttcccccggggggggaaaaaaaaattttttttttttgtggggaaaaaaaaaaaaatacggggggggttttttaaaaaatggggtgtggagaaaaaaatcgtgtgttccaaaaaaaataaaattttttttggaaaaaaacccttttttttaaaaagggggggaataaaaaaaaaaaggagggcaaaaaaaacccttcctcacaaaaatattttagacttttatgggttaagaatgagagacccccctcttttgggggattaataaaggggggggggttgggtgggtgttttttttcaccctggggagattttttattttttttttagggttttaataagggctttttttttttttttttttttt

SEQ ID NO: 17551 - DNA, 350 bp, Gossypium hirsutum
  Clone ID: uC-gsflnu33B131h05b1
tttattagccatttctttagcttgttttttatctaagtttttgctccaatgtctgattctggtggttcagcctctgctaacaggatgttgtgttcggttcctgaaaagctacagctgcatatggccatgttagccttgcagtttggctacgcagggttccatgtggtctccagggctgccctaaacatgggaattagcaaacttgtattcccagtttataggaatatcattgcgttgcttctgctccttccctttgcatattttcttgagaagaaggagagaccttccattactctaaattttcttttacagatcttcctcctcgcttttgttggaataacagcaaatca

SEQ ID NO: 17552 - DNA, 403 bp, Gossypium hirsutum
  Clone ID: uC-gsflnu33B131h06b1
tcctctcgtccgaattttgttgtcaatggatgatgtgcaaggtttctttcttagaatatcaaatgattcaagctttgatagtaatgttgctggtgttttggttgaatcaagggttgaaatccaacataagctaaaaggattctctcctgctcgaaagtttccacaagctgaatttgcaccctatcataacactaattatgagtggaacccaattggatctggaatcatgtggaaatcgtataattttcctgtgtttttactttctgaaagtagcacatcaaccttgcaagagattgcaatgaagaatgagaaaacagagcaagcttatactacaaatgttgcaaaatttgacgtggtgatgcaaacaactaaggttgggacccatgagtcagaatcatgtttg

SEQ ID NO: 17553 - DNA, 99 bp, Gossypium hirsutum
  Clone ID: uC-gsflnu33B131h09b1
aatttataaagaattgttgaattttcttgtttaaaaaaaaaaaaaaaaaaaaaaaaaaaaaaaaaaaaaaaaaaaaaaaaaaaaaaaagggaggccacg

SEQ ID NO: 17554 - DNA, 208 bp, Gossypium hirsutum
  Clone ID: uC-gsflnu33B131h10b1
tttccctctgattcaatcagatcttgagaaaatccctgaaattcacccatctcgtctgtatcatattaatcaatcaatagaaaaaccgaaagaacaaagaaatggcgggggcggcatcggcactattccttctagatataaagggccgcgttctggtgtggcgtgactaccgtggcgatgtctccgctgcacaagctgaacgtttttt

SEQ ID NO: 17555 - DNA, 369 bp, Gossypium hirsutum
  Clone ID: uC-gsflnu33B131h11b1
ttcactggggaaaagaatagagaaaaattgcaatagctttttttgatcgtcataaagaaaaagcgccggggcgtgacctgagatcatcaaaacctaaacacgatcctttgatttccgaaatatgtggagaaggctacttacttcacagttcaaatatctggcaacacttccatgccgatccgcctctaaaacggcgccgcttccattcaaatctcacatttctccttccccttctgcttccctcctcgttcgccatttctccgccgagtcagcggatactgctgtgaagaagagagttgaggatgtaatgcctatcgctacaggtcatgaacgagaggagcttgagtctgagcttcaaggaaagaaaat

SEQ ID NO: 17556 - DNA, 444 bp, Gossypium hirsutum
  Clone ID: uC-gsflnu33B131h12b1
tttattccctgaatctctctcttcctctttaggtccacctcaatcccgattcaaacataaccctgaaggtgatgcacaatttccggaggatgagagcacaaagatttttgctaggaaagtagctgatcattatagtgcaagaactaatcagactttggaagaacgagaagcaagtccaatcattcacttaaagaagttgaataattggattaaaagtgtcttgattcagctttatgctcgtaagggggatgctgttcttgatcttgcctgtggcaagggtggtgatctcatcaagggggataaagcaaaagctgaatattatgttggtgttgatatagctgaaggctcgatagaagattgtcggacacgttattatggtgatgcagaccagcatcaacgtcgcaaaaagttcacttttcctggccgtctattatgggggattgt

SEQ ID NO: 17557 - DNA, 310 bp, Gossypium hirsutum
  Clone ID: uC-gsflnu33B132a01b1
tcttttggacatctctttcaatcaaacggctggtctatctgcactttgctttctggagaaggtttgagtttttggtggatgcatattccaggattagctgaattcatgcatagtgacttgtttaagctaactgattatcttaaagtgtgcattctatcattattttgttctatttgtattttgtattttgtattttgttatatttctggtgtagtatgataagtgcggtattttgtttggcgggatatatttatatcatagattattattcttttcaatagtaaaattaaaaaattaactattttctcag

SEQ ID NO: 17558 - DNA, 470 bp, Gossypium hirsutum
  Clone ID: uC-gsflnu33B132a02b1
tttttgcgttcgcaaaccgcaccatgtgcaccatacttgttatgacaagattcaaggatgcgatttacatgaaggtgaatgggggaaagtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggactttggaatacgagaagctgcacggtgggattgcgcatcctgagactctgctgcaattcgttcaagatatctctaaagacattgacgcccacctcacccaagcaagctaaacagtatcacatgttgctattgttgccgctacttgaagcactgttcatctatttaatgaataaagtgact

SEQ ID NO: 17559 - DNA, 479 bp, Gossypium hirsutum
  Clone ID: uC-gsflnu33B132a03b1
tcctcgcgtccgcaataatcttcctttacaccaaatctgcaaccaaacccaggagctgaattattgaattccctcccttgaaagcgatcatggatctagcgccggaggagcttcagttcttgtcgttgacagatatcctgagggaatccgttgcaatccctaaaagatcccccaaaaccttctatcttataaccttagctctcattttccctctctcttttgccattttagctcactcgcttttcacccatcctatcttaaatcaactcgcttccgatccgctggcagacccgtcccagacccgccacgagtggactctcctcttaacctttcagttctgttacctaattttcctctttgccttctctcttttatcaacggctgcagttgtatttacggttgcatctttctacacgtcgaagccagtctctttcacttcaacgatcttagccatacccaaagtttttaagcgccttttt

SEQ ID NO: 17560 - DNA, 58 bp, Gossypium hirsutum
  Clone ID: uC-gsflnu33B132a04b1
ttcttctaaacgcaagcaagaaaggtccctcggggatttgaccgatagagatgcggtc

SEQ ID NO: 17561 - DNA, 64 bp, Gossypium hirsutum
  Clone ID: uC-gsflnu33B132a06b1
tccacgcgtacatcgaaatgaagaatgcgaggagagttaagggctaattttcgtaaagagcccc

SEQ ID NO: 17562 - DNA, 73 bp, Gossypium hirsutum
  Clone ID: uC-gsflnu33B132a07b1
tcgtccacgcgtgcgactacgcggggggtgcggggcttgttaaaacataaccaccgtatccacccggggtgta

SEQ ID NO: 17563 - DNA, 480 bp, Gossypium hirsutum
  Clone ID: uC-gsflnu33B132b01b1
tccacgcgtccggtttcatttgcttaattagtttcaaaatctctccgcaaaatgggttatttcaattgcattgctttagcattcttgatggctttgtcgttttcaagcattgatgttggcctagcagctcgtcacctttagccaccattgccaacattgcctacaactacactcccacctttgccatctatccctaatctcccgcagccaacaatgccaaggcctggggcgcttccaccacttcctaccatgcctgctttgccctcattgccaagtgtaccaagggccacactgccacctctgccaagcataccctcaatcccaactgctattccctctattccattcctctctccgccaccttctcctgctgctactccttgaaatacccccttttttttctatttattgagagacaaaatctgctgcatactggatttgttttgatgtgtttttagtcgtctttgtctctattgagtt

SEQ ID NO: 17564 - DNA, 467 bp, Gossypium hirsutum
  Clone ID: uC-gsflnu33B132b02b1
tcctcgcgtccggtgaactaaaaaaggagttaaaaatggcttgtcctccaactcacaaagtggtaaaaggtgagcttaagaatggttctgatgactgccttgcgagcttgatgtattcgaattaccaaggtgctccagtaacgattaaaaaagattcattacccactccatttgcgcagaatatgctagtcgacggtctgtacggaggcctggtgtatgatgttgttagggttaagtggattattctttggaccactgattgtaaggtggctactaagatcattccgaccgaaaaccatattgtttgggaggatatagtgagcatccttcagccctacgacagctctgacaacttgcccttatcatgtgggggtgcattttccgccgaagctcatatccatgcaaatggagatggatctctaaacctgacagcacatatcatgtggagcggttgcaagtaacctgac

SEQ ID NO: 17565 - DNA, 182 bp, Gossypium hirsutum
  Clone ID: uC-gsflnu33B132b05b1
tcctcgcgtacgtctcaatgaacatattaacgggggtcaataaatgagtactggggatctcacacaaactacacattgctcgttttaaaatgggaggaggagtattatagggatacccgtggaaattatcaacaaacacaacattgtttatctcagcccagagatgaacgcacatattcttt

SEQ ID NO: 17566 - DNA, 99 bp, Gossypium hirsutum
  Clone ID: uC-gsflnu33B132b09b1
tcgtctcacgcgttcgattacatggagaccctagggaatgttaaaataaaacttgggattcaagacaccaatatccaagactgcaatcagggcacccta

SEQ ID NO: 17567 - DNA, 64 bp, Gossypium hirsutum
  Clone ID: uC-gsflnu33B132b10b1
tcgtccacgcgtccgcccacgcgtccaccggagggggtgttaagatgtaagcgggagacatact

SEQ ID NO: 17568 - DNA, 269 bp, Gossypium hirsutum
  Clone ID: uC-gsflnu33B132b12b1
tcttccacacttacgacctcgcacccatcgtggggttctttaaaacaaacccccgcgtctttccctcttttacttcgtatgcatgggtcatatgcatagccaatttatgggtatttccgcatctgctcttccgtacaaagaactccacctacttggctcaagatctcctctcaagaaacggaggataacatttgcatgtctgtgaataacggtttgacctcatcccaaattgctgacattcttctcaattaacatgggattgctcaagt

SEQ ID NO: 17569 - DNA, 485 bp, Gossypium hirsutum
  Clone ID: uC-gsflnu33B132c01b1
ttataggcaaaggaagtagtggaagcagtagaccctgataagaatttggtcactttcagagtgatcgaaggagatctaatggaagagtataagagctttgtaatcacgattcaagtttcgcccaagagcgagggtagtggcagcttagtgcactggactttggaatacgagaagctgcacgatgggattgcgcatcccgagactctgctgcaattcgttcaagatgtctctaaagacattgacgcccacctcacccaagcaagctaaacagtatcacatgttgctattgttaccgctacttcaagcactattcatctatttaatgaataaagtgacaacttcctttctcatgtattttgatctgaatatgtatgtttagatcaatatgcagtcaaggggagggagctttgtattttcttgcatgtttgtctttttagttctgtatgaattcaatgtatcctatgcttttatttgtgttcaaatga

SEQ ID NO: 17570 - DNA, 338 bp, Gossypium hirsutum
  Clone ID: uC-gsflnu33B132c03b1
atctttgcctcatacatatggatcgggtatgaccttttgagtgatgccgttgaggttaaggccgatgacatcacggcggatgagcagatatcgctttttaaggacaaaatgggggatgagcggggcacgatataaccattttcggagcatgacaactagcgtggataagaacgaaaacggatttgtttgcttggaggacttctccagaatgatggtgctacagcgatcatcatatcaccatgggttcctatccgcatgagcttgacaatcatgtgattagatatacactcgatttgaggatatccatgcctgaaacaccgtggtgattggtgtttaca

SEQ ID NO: 17571 - DNA, 84 bp, Gossypium hirsutum
  Clone ID: uC-gsflnu33B132c06b1
ttctctcgtgcgaccacgtgaacacattaaagggggttaatggaagattattgggaatagcccacctacacaatacaacttata

SEQ ID NO: 17572 - DNA, 64 bp, Gossypium hirsutum
  Clone ID: uC-gsflnu33B132c08b1
tcgttcacgcgtccgtccaatattccttagtggggggggtttaaaggggggtaggttttataca

SEQ ID NO: 17573 - DNA, 150 bp, Gossypium hirsutum
  Clone ID: uC-gsflnu33B132c09b1
tctgtccacacgtccgtataacaccccaatctaccggtcgcttacctggactgggcatagtttctcgggctatagggaatgttaaaccattctaccaccgatttaatgagggggtcgaggggggcgacatctataatcaatccccacatt

SEQ ID NO: 17574 - DNA, 160 bp, Gossypium hirsutum
  Clone ID: uC-gsflnu33B132c10b1
tcttccacgcgtgcggccacgcttccattttgggggttgtttaaataaaactggggtacttacccatcctaaacacagccttctgaaactttattggggttaattcattaatttctttaacgttcatgtataataactacaatctattttctttgaattt

SEQ ID NO: 17575 - DNA, 84 bp, Gossypium hirsutum
  Clone ID: uC-gsflnu33B132c11b1
tcttccacacgtacgacctagccaccatcccaggggtctctaaaatgtatttaggatatatacacaatcaaaacaaaaattttt

SEQ ID NO: 17576 - DNA, 86 bp, Gossypium hirsutum
  Clone ID: uC-gsflnu33B132c12b1
tctccacacgtgcgaccaagcgaccagcgcaggggacgttaaaacgaatctaggtgatttactcaccctacaaacaccttattttc

SEQ ID NO: 17577 - DNA, 481 bp, Gossypium hirsutum
  Clone ID: uC-gsflnu33B132d01b1
ttttctccgactggattgtaccttggtggcacaaaatacatggtgatccaaggtgaacccggagctgttattcgagggaaaaagggccccggaggtgttactgttaaaaagaccaacctgtccttgatcattgggatctatgacgagccaatgactccaggtcagtgcaacatgattgtggaaaggcttggtgattatctcatagaccagggtctttgatcactttggtgtaaccttaattgttgcaattcttcctggcttcttctatacaaaagtgcatctaccaccacctcttgtaatggttggctgcaattaaataatagtattactagtattaaagtcgtgtggaaccttttccagaaacaataggcttggtgtttgtaatagtgataatgcttgtgatccttttgctttgtttctgtgcttgcttgatggatggtattgtcaagattgtggagtgaggtactttgtctaaatttac

SEQ ID NO: 17578 - DNA, 93 bp, Gossypium hirsutum
  Clone ID: uC-gsflnu33B132d05b1
tctcgcgtgcgggtggtggacaatgaaaagggggttgatgggagagtaaggagaatagcactcttacaaaattgaaattataagaaaatcaaa

SEQ ID NO: 17579 - DNA, 72 bp, Gossypium hirsutum
  Clone ID: uC-gsflnu33B132d08b1
ttccacacgtacgttcaactttcctatgtagtaaacgctcaaagatggggaccaaaatgacaatccctaaac

SEQ ID NO: 17580 - DNA, 108 bp, Gossypium hirsutum
  Clone ID: uC-gsflnu33B132d09b1
tccacacgtgcgactaagctaccaatgaagcgaccgcttatccaggaggaccctacgggcccctaatagagggaataatccataattcccctcatgttaataatgggg

SEQ ID NO: 17581 - DNA, 154 bp, Gossypium hirsutum
  Clone ID: uC-gsflnu33B132d11b1
tcgcccacgcgtgcggccaagggtccacagaggggcttgttaaaatgaattaacgttatacacacaatcaaaaaagagaatttaagcattcgacagatacaattaattaatatcttgctctttctaattcaataaaactgaaaattattattac

SEQ ID NO: 17582 - DNA, 94 bp, Gossypium hirsutum
  Clone ID: uC-gsflnu33B132d12b1
tcttccacactggcgactaaacaaccataaccgcaatcgtttaaacgaatctatgatacactctcaatccatatatttaatttttttctttttc

SEQ ID NO: 17583 - DNA, 183 bp, Gossypium hirsutum
  Clone ID: uC-gsflnu33B132e05b1
tcctcgcgtccggcacgggtggcctgtgagggggggcaatcagggccgtactggcggacacatgacatgttcaattaaggtacctatcccgaatgaaagctggatcagagcatctgtgtattacggtgctgaggtttatggttgtcgtgcttatattctagcacagactctttatatttacct

SEQ ID NO: 17584 - DNA, 99 bp, Gossypium hirsutum
  Clone ID: uC-gsflnu33B132e06b1
tcttcgcgtgcggtccggtggacaaattagtgggagtttagggattattaaggggaatagctcgcttacatcaactaaacttagatgtaattcaaagga

SEQ ID NO: 17585 - DNA, 130 bp, Gossypium hirsutum
  Clone ID: uC-gsflnu33B132e07b1
tcgtccacgcgtgcgggcaggtgtacaatgtagggggagatgaggggagattaatgataatagccttcttacataatataattcatataggagcaagaggaatacgactatatcatttgtcctatacttc

SEQ ID NO: 17586 - DNA, 60 bp, Gossypium hirsutum
  Clone ID: uC-gsflnu33B132e08b1
tcgtccacgcgtgcgggcggggggacattgaggggataattaaatgatgatcaacaaata

SEQ ID NO: 17587 - DNA, 364 bp, Gossypium hirsutum
  Clone ID: uC-gsflnu33B132f01b1
ttttttttttttttttttgaaaaaaagctgtgtttagccacctgaataaacgaaacgaaatgaatcccatagaaaagaaaggaacctcagtcataaacacaaatatatacataaatataaagtgtatgtatatgatatgcaataagcatccttcaactctttagagttattcctccaaccagccacccaccctacacatagtagatttcttccacaactgtgttctcaatagtatgcttttcgaggattgttcaggggattgggtctgtatcgatagccaagcatcatacgcttctgttttgtcctcctcccctgttttcgcattctatggctagtggaatggtttctataatatgagaacaag

SEQ ID NO: 17588 - DNA, 126 bp, Gossypium hirsutum
  Clone ID: uC-gsflnu33B132f04b1
ttcttctcgtccgggatgggagacactatggtagggtagagtgtctgatcaaggacgctgtcactcttcctacttcgcatataattgcaaactgaaggaactggaggatttaatcccccttttgcc

SEQ ID NO: 17589 - DNA, 128 bp, Gossypium hirsutum
  Clone ID: uC-gsflnu33B132f05b1
ttcctcgcgtgcgggctgggggacattttagcgggagatcagggctgatcaatgagagtagcatgctttctccttttaatttagatgggattagaaggaataggacgagaacatttttcttttgcttt

SEQ ID NO: 17590 - DNA, 98 bp, Gossypium hirsutum
  Clone ID: uC-gsflnu33B132f09b1
tcgtccacgcgtccggccccgttcacattcgagtgagatttcaaaggtgactatgaccaagaccctcatgtttccactctttgcctcactcacccaaa

SEQ ID NO: 17591 - DNA, 66 bp, Gossypium hirsutum
  Clone ID: uC-gsflnu33B132f10b1
tctgtccacacgtgcgccctaatatccactggggggatatttaaaattctatgaggacacagacac

SEQ ID NO: 17592 - DNA, 416 bp, Gossypium hirsutum
  Clone ID: uC-gsflnu33B132f12b1
tttttgtaatagaggccaaacttgatgcgtggcaatggctggtctgctctgtcaccaccggcaccgagtatgtaccgacatcataggcgccaaaccgcagacttttttcaccatcgaaaacaagttcgactccaacagggagagcatctgaacaggtctgctatgagcgttgatatgtgctctagggctaaactcgatcgttcgttgcgcgttacggcgttctcgaagagccgcttttaagactcccgacaagactgcagtgcgcttgtcgtcaaccgacctgaaaaaaagcgcgtggcggcaaattcctgcggccgtgaacggtaatgagatggatttaacggcctacaagattgttcgatttgattcggcgagttcatggttggagagaaagttaggggcttgcctaaatgtaa

SEQ ID NO: 17593 - DNA, 399 bp, Gossypium hirsutum
  Clone ID: uC-gsflnu33B132g01b1
gtcttgagcatctcaacagccatttctgccggaacagcactggctgtcacctctgctgtgattgatgctggaggtcagacaacaagaatagacacaggcaaagagtattacccatacaccaccaagaaaagacctgccgattcataactcttgcatatcattatcgaggatgcacttccaacttaattcgggataattaatcctttttaggatgcctttgctttctaagatttaatcacacactcagttcccagtttgttgtttgcatttaaagggagaatgttgatttgcatgatttgtcgtgtatcaaaataatggtgtagatgacagtctctgaacctattgaatttggggtacttaagacgagtttcttagagggaaaataaatcaccaatcaaa

SEQ ID NO: 17594 - DNA, 459 bp, Gossypium hirsutum
  Clone ID: uC-gsflnu33B132g02b1
tgttgtccccttcgtattctccgctcataccccaaatccccataccccttctgttcaacagcaaagatggcaactgtgcgagttacctcctctagtatcgttcaagcttcgatcccgaaccgattcacgagtgccattgtcaaggccccgacttctcttggatcttttaagaacatctccaaaccttttggcttgaaatgttcctccaatcacaaaacatttatggcagcttataagattaagcttgtaggaccggatggtgaggtgagcgagtttgaagcccctgacgatcaatacattttagatgcagccgaggaagcaggagttgaactgccatactcttgccgagctggagcttgctccacatgtgcccgtaagatggagttcggttcagttgatcaatcggacggattcttccttgacgaataacaaaatgccgatggttacctgctgacttgc

SEQ ID NO: 17595 - DNA, 469 bp, Gossypium hirsutum
  Clone ID: uC-gsflnu33B132g03b1
tgttttccccagattctccctccccccaacccaaattgaagagagtaaaggaagatcccgtacccgaaactgaggggttcatgaatttggatgaaaaccttttgtacgaggttctgaaacacgttgatgccaggaccttagcaatggcctcctgcgttagtaagctgtgcctcaaaactgccagagacgagcgtctttgggagttgatctgtaccgggcactgggctaacatcggttgtggaacccaaaagcttagatacgtggttttacctctcggtggtttccgccgtctccactcccgttacctttggccgctttccaaaccccaagctgcttcacctttgccttggggtccgcccaagattataaactccaagccgtctgctcggtggggaaaagatgaggttcacctttttttgtctcttttgatctctataccagtattatgagaagatgcatttcacaagca

SEQ ID NO: 17596 - DNA, 476 bp, Gossypium hirsutum
  Clone ID: uC-gsflnu33B132g04b1
tgtcctcgcgtccgcccacgcgtccgataacgttgagttattcacacgaaacaatgaaaacccacttttttcccctggttttcctcctcattttttccttagcccaaggtctgaaccccaaatgtgacatccaagaccatggctcacacctgcaagtgttccatgtttacagtccatgctcacccttgaaaccctcaaaaccactctcatgggaagaggatgtgctgcaaacgctagccaaggaccaagccagggtgcagtttttgtgcagcctcgtggctaagaaatctgtggcgcctatagcttcaggcaggcagattgtgcaaagtccaacttacattgtgaaggccaatattggaaccccacctcaaaccatgcttatggccatggatacaagcagtgatgctgcttgggtgccttgcactggctgcattggctgctcttctactgcttttgactttgcttaatccaccact

SEQ ID NO: 17597 - DNA, 54 bp, Gossypium hirsutum
  Clone ID: uC-gsflnu33B132g08b1
tctccacacattcgaactggtggaaagtgggggggtattttaaccttcacttct

SEQ ID NO: 17598 - DNA, 152 bp, Gossypium hirsutum
  Clone ID: uC-gsflnu33B132g10b1
tcgtccacacgtgcggccacgcgaacaatgaagggatggttaaaatgtgactataatatcaagacctaataataatacacacccagcagggggtagggggattactcgctagtcattaattaacgacttcaaaaaagaaagctaaatactgt

SEQ ID NO: 17599 - DNA, 476 bp, Gossypium hirsutum
  Clone ID: uC-gsflnu33B132g12b1
cccacgcgtccgcgtcgtaatccagcggaacgtttaacatttcaagagttctttaatcacccatttctctctcagggccaaccaaatgaaccattgaggagtcagggaattttaggaaatggttatccattttttgaaagcagacctggaagtactgatgaaagctttcaggaggattgtcttcccttctttctggatgatgattctagtggtcctgaagggagcccttcctttgaaaagaagaggtcctcaatgaaatctggttatggattttctcccaatgcaaaagatactagagaacaaacttctaatcctttgaataaagtcaaatttacatccaaatacagtggtacaagacataaattagatgattccagttttagacatgaaagcagcaaggtttctggtgaaactctgtatgaacctcacaaatccatggatcaaagatctacaagtactcattcaagagttgggga

SEQ ID NO: 17600 - DNA, 484 bp, Gossypium hirsutum
  Clone ID: uC-gsflnu33B132h01b1
tgttctcgcgttcgcccacgcgtccgcgagaaagcgagaagcactgacaaaaccataaatttatatccggggatgtggcatggcttgacagccggagagcccgatgagaacgtggaaatggtgttcgcggatatcataggttggcttgacaagcgctgcaatgctgtaactttagaccaaagtctgggtcctttcgatcaaggttcggaagaatgcagtgataatatagtgatttcgatggcaacggccagtggcggaacacaagcaaacggtagatatttgtgaggtttgaagggaccacgcgcacggcctcactcggcaatgtaagctgatcgtattaagttaactaaacgttgtctctgaatattgcaaaatacttgcaagggggaatttacggaataaaaaaaaaaaagaaagatgtaccctattaacattgggtgccttgtttatccttttcttttcttttttggaatagtattataca

SEQ ID NO: 17601 - DNA, 450 bp, Gossypium hirsutum
  Clone ID: uC-gsflnu33B132h02b1
ttctacgcgtccgctgccttgtacgtagtaacagtagcgggaaagagagaagcctcaccgccgctgccgcagccaccatgggtcgtatgcacagtcgcggtaagggtatttcagcctcagctctgccttacaagaggaccccgccaagctggctcaagatctcgtctcaagatgttgaggaaaacatttgcaagtttgcaaagaagggcttgaccccatctcagattggtgtcattctccgtgattctcatggtattgctcaagttaggagcgttactggcagcaagatcttgcgtatcctcaaggctcacggtctggcccctgaaattccggaagatttgtatcaccttatcaagaaggcggttgccatccgaaagcatttggagagaaacaggaaggattaggatttccagttcaagttgatccttgttgagagccggattcacaggc

SEQ ID NO: 17602 - DNA, 458 bp, Gossypium hirsutum
  Clone ID: uC-gsflnu33B132h03b1
ttttgttctgccttttctgcagtcaagacccaaattcgtcgccgccgccgccatcaccgccattttgtttttccttagatcgattttctgagtttgcacgtctttcttccgttctccccttcttttagcgtcaatagacattgggcgccgcaaccgccattggacaagacagtctgtgggcgcctgcctccccctttccgtccttcattctccacctctctctccattaaatagcccaaaatcaaggggtttggtagatttcatttaccaatctgatctgttgcaggtgttgtcttttgcttaactatggaggacgaaaggataaaggtattatcatttccatcggatagccctccactctccatcattgccgccgcaaagattgcgggaattgctttaccgactcagactttaacatctggaactctccctttgtctttctcaaatgggcttgaatt

SEQ ID NO: 17603 - DNA, 143 bp, Gossypium hirsutum
  Clone ID: uC-gsflnu33B132h07b1
ttctttcacgcgtccggtaaggatggtgttgactgtgtatgatgcatgaatttcaaagatttaaaagttatgatgattcatgcataatcccttccttctccattacgatgcaatactatgagcaatattattgtatttggatc

SEQ ID NO: 17604 - DNA, 492 bp, Gossypium hirsutum
  Clone ID: uC-gsflnu33B132h09b1
ttcagatgcataagtgcctgttatctttcacttctaacacattgcatttacgcctccagcagctgcaccacggagaagagagaaaaactgcaaaaggggaaaaaaagcgtcgtcgtttttgcttcttcttcttctttttcttcttccctctctctctttctcagaagctcctctttcgttcttttgttcactaagtattgtaaaagatggccgacggtgaggatattcaacccctcgtctgtgataatggaactggaatggtgaaggccggttttgctggtgatgatgctccaagggcagtttttcccagtatcgttggtcgtccccgacacactggtgttatggttgggatgggtcagaaggatgcctatgtaggagatgaagcacaatctaaaagaggtatccttactttgaaatatcctattgagcatggtatttggagcaactgggatgatatggaaaagatctggcattatacattctacaatgaac

SEQ ID NO: 17605 - DNA, 478 bp, Gossypium hirsutum
  Clone ID: uC-gsflnu33B132h10b1
ttcacgcgtacgcccacgcgtccgcccacgcgtccgggggattgctcctatgacggaaagaggcgataagatatcgataacggactttggtggtgtcggcaacggacagacgctgaataccatagccttccggaaagctatatatcggattcagcatctgagaaggagaggcggcacgctactttttgtgccttctggagtctacttaaccgacagtttcaatcttactagtcatatgacactttatttggctcgaggtgctgttatcaaagccactcaggacacctcaaattggcctttaattgctcctttgccatcttatggaaggggaagggagcgccctggaggaagatatatgagctttattcatggagatggactggaagatgtggtgataactggtgagaatggcacaattgatggtcaaggagatatttggtggaacatgtggaggcagaggactctccagtttacaaga

SEQ ID NO: 17606 - DNA, 470 bp, Gossypium hirsutum
  Clone ID: uC-gsflnu33B132h11b1
ttcttcacaagtgcttgatactgctgaaccctcaggtgttctgaatctggatatatcggtggtgttagaaagtgagaatgagaacacaagcaagaattgttctactgatacatcagaggatcatgttaatttggaaattgttgctgatcttggtcatgaagcaaaggtagtcgatagcagtatggctgaattcttggaaacatcccaaaatcatttaacaacaacacctaatggtgatggtcaaccgtctactgaagttgcagctcgtgaaacagatgattgtggtgacaaggaacttcttagcaacaaggaaccttttacaactaattctgaaagtgttgaagatggaagatgtgatagtaaggaaattcatgaatcggtgactaatgatcaaaatggtgctgttgatatggaaattgtttcagaagaggctgccattgactttacaatcagtgctggttcttacaaac

SEQ ID NO: 17607 - DNA, 477 bp, Gossypium hirsutum
  Clone ID: uC-gsflnu33B132h12b1
tgaaaaaccaatgaatgaaattcagtggttaatggctgagaaagaaactgatgagtggcttatgtaatttgttggttagatattttcacaaaaaaagtggtacagagatagcccttcaaaaaattttaaaaactcaaaatccaatgccatgattccatcaaatatccaaaactataaaaggtcacacttcaagagaaagtagattaagctttagtttctttttgcagttaataagccaagtaaaacaatgactcttcaagcaagtttctttaactttggaagcatttcttctcttccttgccctcccagaacttcccgtcaacgctttgtaatcagagctaaagtggaaccatcagagaaatctgtggaaataatgaggaaattctccgaacaatatgcacgtcgttcaagcacatatttctgtgtggacaagggagtgacttctgttgtaatcaagggactagctgagcataaaga

SEQ ID NO: 17608 - DNA, 461 bp, Gossypium hirsutum
  Clone ID: uC-gsflnu33B133a03b1
gtttgtttataaaaattaaaagcctcttttttctctctgttcttcgccatttttttcaatcctaaaccaatcccagattttctgctgaaaaacaaaaacaccctctaagtaactttccgggaaaatgtcggggaaaggagcaaaaggattgattacggctggaaaatccaccaaggacaaagataaggacaagaagaaacccgtctctcgctcttctcgtgctggtctccagttccctgtgggtcgagtccaccgactgctgaagacaagggttagtgctaatggaagggttggagctacagctgcagtctacacagctgccatactggaatacctgaccgcagaagtcctagaactggcaggtaatgcaagcaaggatttgaaggttaagcgtattacacctaggcatttgcagctcgccatccgtggtgatgaagaacttgacaccttgatcaaaggaa

SEQ ID NO: 17609 - DNA, 484 bp, Gossypium hirsutum
  Clone ID: uC-gsflnu33B133a04b1
ccctctcgtccgcccacgcgtccgctcttctcttcctctgtgttatttgaagtcttatgtgttatgaaatttttcatgtttgagactcatgtctccggttgttagtgaaatcctccgttctgggtttatgataaattcttcacttagacgaaggactcatcttgttcaatctttctctgttgcttttctttactggatttatgttttctcataaataaattgtcctattttaccatatatacatatatatatataataagtagttatttagcttacaatttagtctctctttttttcttttttaatggcttcttctagtggaaactccatgtccaattcaggatccgaagaggatttgcacaatcaaaggaaacggaaaaggatggaatccaaccgagaatcagcgaggcggtctaggatgaggaaacaaaagcacttggacgagttaaatgcacaagtgactcagttggttaaagatattatc

SEQ ID NO: 17610 - DNA, 404 bp, Gossypium hirsutum
  unsure (1)..(404): unsure at all n locations
  Clone ID: uC-gsflnu33B133a05b1
attttaatatctcccttcttttttctcgtttactctctctttttggttcttaaatttcgtttcttttttcctttgttcttgttatttgttcctttaaccacctttttttgtcaacaagttaatgtttttagatataggatcatatcagaattttacttatgattgttgggttcttgtatttaccttggatgttatcgntttttttttactgtgatcttttatgttagttcagattttctttttcactatgtaaatgctttctttggtatgacttgttgttttagttgctttcctgtttctgaatcagctttgaatggtgacttatatctggcagttaacctttgtattctttactatgatgtaatggctatgcttatggccctatctggttaatgaaagatcct

SEQ ID NO: 17611 - DNA, 400 bp, Gossypium hirsutum
  Clone ID: uC-gsflnu33B133a06b1
gagtatttttgtgataccggatcaggtactcgtgtttgcagcggtttgtattcttgcaaaggggtaactggaattgggttgccacaaaatgcacctacatctacctgttgtgtttatgactccttgatgggaataggatcaggctattctttggatcttccaaaacttcagtgctcatcgtacacatcgatatacgagtttggagatgaagaggatcccatgaaatggaaatttgggatttctttgctgtataatgattcatactacactcctgcatgcaaggactgtgaaaccaatggaggctagcgtggctttaatgttttggatgagtcattctcttgcattgccgagatggtgtgaacactaccacaaatttgttttgcccatggtacaccctgag

SEQ ID NO: 17612 - DNA, 502 bp, Gossypium hirsutum
  Clone ID: uC-gsflnu33B133a09b1
tttttccaaacagtggggagctcagctccattctttctgcgttggcctagagggttcaccagatttgaaggcagcataggaggttgcagactatctgggcaccgtccatcatgaatttcatttcactgttcaagatggaatcgatgccatcgaagatgtcatctaccacatcgaaacatatgacgtcaccacaatcagggcaagcactcctatgttcttgatgtcaagaaagatcaagtcactaggtgtgaagatggttatctctggtgaaggctctgatgagatctttggtggatacctgtacttccacaaggcaccagataaggatgaattccaccgggagacatgccgcaagatcaaggcccttcaccaatatgattgcctgagagctaacaaagcaacatcagcatggggattagaggcacgagtccccttcttagacaaagaaattatcaatgttgccatgtctatagaccctgaagcgaagatgatcaaaaaagat

SEQ ID NO: 17613 - DNA, 358 bp, Gossypium hirsutum
  Clone ID: uC-gsflnu33B133a10b1
tcatagagggagcgaaaagaatggcaagcgaggaagagagttctgtgaaggagcctttggatttgataaggctcagcctcgacgagcgtatttacgtcaagctccgctctgaccgtgagcttcgtggcaagcatccatgcttattgatcagcatttgaatatgattctaggtgatgttgaagaggttgttacaacggttgaaatagatgaagaaaccctatgaagagattgttcggactacacagcgcacggtttcattttgtctttgttaggggagatggagttatattggtttttacacccttacggactgcttgagtatgagaaacaagtttcttaatcactttttatgggaatg

SEQ ID NO: 17614 - DNA, 189 bp, Gossypium hirsutum
  Clone ID: uC-gsflnu33B133b01b1
gtactgtccaccgtgtgagagtgtctgtagcacatgtaatgtaagtggtgatatcattgtcatcatatgttctttcccaaattatgatttggatataatgttagaaattttaagttgtaaacgtttgtttatagttgaatttattgaagttggaacttatttgtaaaaatgttagaaacgtttgtttct

SEQ ID NO: 17615 - DNA, 296 bp, Gossypium hirsutum
  Clone ID: uC-gsflnu33B133b03b1
cgtactcgtagctgctaacgggctctgctaccttcatgatgattgttccgctttgattgtccatcgagaagggtaatcgaacaacgtcctcctggactcggattttgtagcacatgttgctgattatggccttggcaaatctctgcaagattccggtacttgtgaatgcatgtgtgctatagctggatcatatggatacatcgctccataatatgcctacacgcttaaggtggatgacaagagcgatgttgatagctttggtgtagtcctgtcagaacttggtagtggcagaaaac

SEQ ID NO: 17616 - DNA, 343 bp, Gossypium hirsutum
  Clone ID: uC-gsflnu33B133b04b1
cttactcgtacgtagacacgctcgggatcatatacagggagcttaagccggataacatgttgatgagagaagatggtcatataatgctttcggagtgtgacctttctattagatgagcggcgtctaatactatggggggatcctggaactcttccgtggaatcaaaacattgcttgtactgagatgaacccgcatgcagtgggccaacttgtgtgcatccgccggataggtggctgcctgcatggattggaccacgttttgttgtatgcaagccgtataaagaaaagaagaacaaagtaaagatcgaaacgggccatgaagggaagccgttgtctgagctcat

SEQ ID NO: 17617 - DNA, 242 bp, Gossypium hirsutum
  Clone ID: uC-gsflnu33B133b05b1
cctactcgtccgtcagccctatcttcctttttgtttagtaggaaataaagagtagagtttgagttactgaagaagggaaaaaatgggtattgcaggtgcagagtgcattattgcgggttttatctcatcaatgtggatggctgatgcaagaatttcaggagtttaatccgttggggcatggcaaaatgcacatgctaccttgtacagctgttatgatgcttctggcaccatgggaggagctt

SEQ ID NO: 17618 - DNA, 308 bp, Gossypium hirsutum
  Clone ID: uC-gsflnu33B133b08b1
ttctcgcgttcgtgaaagtgctacataaaatgatagcgatgacggcagagactcacctgatgctcgaaggaacgggttgaagttactactacaagctaaccatgatctggggagggagcgcccagaattacacgagggctaatgttgtaactttgcatggaacatcacgaaccggtgcctttgatagagacaagatttggctgtgcatcttcaggcttcctgatcattgtcgttagtgcctcgagcactaccaccgctttcatgcttgtgaaagaatctgaacgaaaattgggccaacataggctaaa

SEQ ID NO: 17619 - DNA, 167 bp, Gossypium hirsutum
  Clone ID: uC-gsflnu33B133b09b1
tcctgtcgtaccgtagagagcgccaaaccaggggggctgtgtttaaaaagagtctttgcttgatataagggaaggactggacgagcgaaaatacgttaagcccgaccatgacggatacgctcagagtgagctcgatgctaatgatctgctctagtatgtcataatag

SEQ ID NO: 17620 - DNA, 362 bp, Gossypium hirsutum
  Clone ID: uC-gsflnu33B133b10b1
actaatcgtacgtgagagtgcgacataatcagagggcggtgacaaaaacgagtgattgattgccagcagagacggctgaaattgactacgacacgtcaaccaggaaaggggagggagcgcccatattaatgcgcgggctcgttgtctaattttgcgatgaacaacacgatacgggtgctcacaaaggcacaacactccgtgtatccatcttcatgcaacctaagcttgtatgatagggcctagcgaactaccaccgttaccaagcttgagaaagaatgtcaacgaaactaggtccatgatcggctaaagaagagcccggtgagagacgctaggtcttcggcaagaaccaacgtggatagaga

SEQ ID NO: 17621 - DNA, 415 bp, Gossypium hirsutum
  Clone ID: uC-gsflnu33B133b11b1
ttatattataatttatattatgtatttttctgagggttctgacctacacgagaaattcgtagccaacaagcatgtggaagattttgttacaatcgacaaactgatagatgcaggtgaagcatcttataatatgtggcggagtcccgatccttagatctgctccttgcgctactggtgcttacaagatcacttgaagccgtgacccaccttctgagatcgtgaccttgtatgattatggtcatgaatataacgactaaaccatgcatgtttaaaactttccacgaaatatagtcgatgctagtctaaaggatcgtccagtgtgtaacgagtgatctttgacagtaactaatgtgcataacttcacttgaaacgagatcaggcttctaatcacatatatggggattgtccattgcgc

SEQ ID NO: 17622 - DNA, 390 bp, Gossypium hirsutum
  Clone ID: uC-gsflnu33B133b12b1
atattctggcgctcgcacttgctcgttcctatgtcagcgaagctctaccatcgacgacaatggttgccgccaagaagaccaagaagactcatgagagcattaacaacagattggttctcgtttgaagagtgggagatacactttgggttacaaaactgctcttaagtcttttagaagctacaaaggtaagttgattatcattgccaacaactgccctcctcttaggaagtcggagattgagtattatgccatgttgggcaaggttggagttcaccactacaatggaaacaacgtaaacttgggcactgcttgcggcaaatactttaaagtgtgctgtctcagcattattgaacctggtgactttgatattataaagagcatgccccggtg

SEQ ID NO: 17623 - DNA, 251 bp, Gossypium hirsutum
  Clone ID: uC-gsflnu33B133c02b1
cccttgttaacggatacacgcgcgcgactatgtccgtggatattattgcgcgtaacctcttgataattaacggtcacggcataacgaatgaggagagaatactctggtatagcctgactctagaaccaacattgtgggacgacttgagaggagtacgatacgaggagaacgactgggtgaactaagataaaccatgacgttacacgttcttctactaatccctcgcactgaaggcgggggaccgcccctct

SEQ ID NO: 17624 - DNA, 96 bp, Gossypium hirsutum
  Clone ID: uC-gsflnu33B133c03b1
cccttgtgaacggagacacgcgccaaaaaatgatgggggggattattaagaataacttgctgatagaaaaccaggaccgcatatagaactacaaga

SEQ ID NO: 17625 - DNA, 103 bp, Gossypium hirsutum
  Clone ID: uC-gsflnu33B133c05b1
cccactcgtacggtaatgcgcgccaacaaatgatggcggggaccttaaagtgtaacttcgtgttttcagacaaagacggcagaaagacacaccagtccacccc

SEQ ID NO: 17626 - DNA, 394 bp, Gossypium hirsutum
  Clone ID: uC-gsflnu33B133c08b1
ttctcgcgtacgctagtgcactccaccttcagagggctgcgtttgcaacgactgcctctatctttccgggcaaggactggataaaaactgacatgtaatacggctagttacggttaaacagaaaatgagtgggagctagccagtctcagccatgacctgatgacacgcaagggaaaaggggacgagtgctggatctggcccgcaagctgaagcaccgtggtcctgactggaggggcctctaccaacatggagactgccaagcgtgccatgaacgctcagccaaaattgatccagcttccggtgacgaacctgtctttaagggaggcaagtttttagctgagaacgaaactggagagagatccactcaatgcataactggtgtcgaagatgcacc

SEQ ID NO: 17627 - DNA, 52 bp, Gossypium hirsutum
  Clone ID: uC-gsflnu33B133c09b1
ttctcgcgcacctgagagcgcgacaaccacggggggcgatgtttaaatcgat

SEQ ID NO: 17628 - DNA, 98 bp, Gossypium hirsutum
  Clone ID: uC-gsflnu33B133c10b1
actaagcgtacgtgatagcgcgtcatctacagggggcggggtgtaaaacgaatgtgtgctcgatagcagaaaagcagcgtagggtgttggacccctcc

SEQ ID NO: 17629 - DNA, 117 bp, Gossypium hirsutum
  Clone ID: uC-gsflnu33B133c11b1
actaagcgtcacttagtgtgcgacaactataaggggcgaggtgtaaaacaaatgtgtgtataagagccgaaaagcggcgcagggtgagagacacgaacatcacgaagaggtaaggag

SEQ ID NO: 17630 - DNA, 313 bp, Gossypium hirsutum
  Clone ID: uC-gsflnu33B133c12b1
cggcgcctgacagtaactgaccgggcgacccctataaggggagctgttttgaggatccgcgtgcttgttaacaggaacgaacagcaggatattggcaccatcggccatgatgagtaccgggacacggattagcagtggccagtgactgagcttgtgtggcactgacatgctccacaaggctcgaagaaaaacaaaaagccgtacgaacgcacgacacactgtagaggcggagacaatggctaccgtgacactagctcggacccacgaaacgcacaaggactccgagatcacttccaatggtgacgcaaccaaa

SEQ ID NO: 17631 - DNA, 496 bp, Gossypium hirsutum
  Clone ID: uC-gsflnu33B133d01b1
caaaactttatgtggctacggagtcgctaccgggggaccattggcttggggtctttgctacaacaaagaaatgagccctagcaaaatatattgcgatgattactacaaatacacctatccttgcacaccaggagtctcatatcatggccgtggtgccttgcctatctactggaactacaactatggggaaactggagaggctttgaaggtggacttgttgaaccacccagaatacttagaagacaacgcaaccttggctttccagacagcaatgtggaggtggatgacgccggtgaagaaacaccaaccctcagcccatgacgttttcgttggcaactggaaaccaaccaagaacgacaccttggccaagagggttccaggttttggaaccaccatgaatgttctttatggggaccaagtttgtggtcaaggtgatagggatttcatgaacaataagatctctcattacctttattaccttggacctttgggagtt

SEQ ID NO: 17632 - DNA, 96 bp, Gossypium hirsutum
  Clone ID: uC-gsflnu33B133d02b1
ccctttttaacggacacacgcgcgccactatgatgggggagattaatgcgcataacctgttgataaataacaaagaccgcataaagcacgacgaga

SEQ ID NO: 17633 - DNA, 89 bp, Gossypium hirsutum
  Clone ID: uC-gsflnu33B133d03b1
ccctcgtgaccggacatacgcgccataaaatgatgggggggactttaaagcgtaacttgctgctaaaaaacaaggaccgtatattgaac

SEQ ID NO: 17634 - DNA, 196 bp, Gossypium hirsutum
  Clone ID: uC-gsflnu33B133d04b1
cccactcgtacgcaaacacgcgccaaaaaaagatgggggggactttaaagagtaacgtggtgttaaaagaaaaagaccgcataaagaaggacgagagaaccccgacaggtaagggtggcccgaaacaaacgacggggggactgtgaggaaccaggaagggatcgcacgaacgggtgcatcaaaatggacaatggtg

SEQ ID NO: 17635 - DNA, 82 bp, Gossypium hirsutum
  Clone ID: uC-gsflnu33B133d05b1
cccactcgtacgcaatggcacgccagacaatgaagggggggactataaagaataactcgttgagagcacacaaagaccgcag

SEQ ID NO: 17636 - DNA, 86 bp, Gossypium hirsutum
  Clone ID: uC-gsflnu33B133d06b1
cccatgcttacgcaaaaacgcgccacaaaatgagggcggggtcctaaaagaataacttggtgattacaaacaaagactgtagaaag

SEQ ID NO: 17637 - DNA, 113 bp, Gossypium hirsutum
  Clone ID: uC-gsflnu33B133d07b1
ttctcgcgtccgatatgactttccataaaaggggggattgtatatagattattggatcttcaaccccaaaggacgacggtaatgataaggttcagagcttcaccagagggttc

SEQ ID NO: 17638 - DNA, 86 bp, Gossypium hirsutum
  Clone ID: uC-gsflnu33B133d08b1
ttctctcgtacgttaagacatgcaagacatagggggctacttcagacaagtatgcatctacaattacaaaaaaggaccgtacataa

SEQ ID NO: 17639 - DNA, 98 bp, Gossypium hirsutum
  Clone ID: uC-gsflnu33B133d09b1
ttctctcgtacgttaatgcgtgtcaaacaatgggggctgtgtttgaaacgtatgtgtggatgatagcagaaaaggaccgcaggtttatggatacgtac

SEQ ID NO: 17640 - DNA, 370 bp, Gossypium hirsutum
  Clone ID: uC-gsflnu33B133d12b1
actaagccccctatataacgcgaccaccactgggggcaatttttacacaaactctggctattactacagaaaaactagggaaaatgaccgaggcagcgataaggaagaagccaggaatggcgagtgtgaaggacgtgcgacttcttcaagatgggtctgcttcggatgggttcgttcccgtcagagacacccgtcggagacccaacacgggcccaagagctacggatatctatctagctgataacggtgccttgtcgtatgggatggaccaagtaggtcaaggaaacaagatccgcagggcactgaaagatgaaaagtttgctgcacgtagagcaatattgcctgcgcttcaagctgaagaagatgaaag

SEQ ID NO: 17641 - DNA, 89 bp, Gossypium hirsutum
  Clone ID: uC-gsflnu33B133e02b1
ccttcttgtccgtctacacgcgcagcaataaaaagggggggattttagagcgtaactctattttcaaaacgagtgagtgcatttggaac

SEQ ID NO: 17642 - DNA, 96 bp, Gossypium hirsutum
  Clone ID: uC-gsflnu33B133e05b1
cctttgtgtacgcaaaaacgcgccacaccaagaaaggggggactttaaagagcaactctgggtctaaaccaccaagaccgcagtcagaaataccac

SEQ ID NO: 17643 - DNA, 265 bp, Gossypium hirsutum
  Clone ID: uC-gsflnu33B133e08b1
tctcgcgtacggaagtcgtgaaatactagggggggagatttagacatgcatgtgtttgtatgaacaaaaagagactgtggaactgcgaatgggtcattaaattagtaatagagcgtccgataaaatttgctgctgcgataacctttagaaatttagggctaatacgtgctgcataccccgaattatgaaaggggtgcacgtaatacataaaagatagacgacggttttggctgatgctctgatgaatcattgataactagacgga

SEQ ID NO: 17644 - DNA, 82 bp, Gossypium hirsutum
  Clone ID: uC-gsflnu33B133e10b1
tcctctcgtacgagaatgcgtgccaaccactgggggcgaggtttaaaacgtatgtgggttcaacagcagaaagacaccgcag

SEQ ID NO: 17645 - DNA, 179 bp, Gossypium hirsutum
  Clone ID: uC-gsflnu33B133e11b1
ttctcgcgcaccataaagcgcgacaaccactaggggcgaggtttaaaacatctctgggtacaattacagaaaggctccgcagagtgacggaggcgtgcattacgatgacgtcaggaggaccgaatgaaaaggaggggcgactaattcgaaacggtactgcttcgaatgggctggttccc

SEQ ID NO: 17646 - DNA, 452 bp, Gossypium hirsutum
  Clone ID: uC-gsflnu33B133f02b1
gcagagtaggatgacgatgtgcaggttcttcactcatgcggtccttctgtcctgatagctgatgacgacgagggcgaggatgttaaagacgatgatgacgacgatgaaggcgaatgcgactgcgacggcgatgacgacgacgacgaccatgatgacagtgatgacgatgaagaaggtgaagaagaggaggatatgggaacagaataccttgtgcggcctgtagtaccagctgaagatgaagaagacgctagtgattttgaaccagaagaaaatggtgaagaggaagaagaagaagatgatgaagaccatgaagaaggtagtgtaaagatcgaagcttcctcaaagaggaagagcacagacagagatgattccgatgacaacgatgatgaccgcggagaccatgagaggccttcaaagcgatagggctaaaagaacaccaccgaatagctttt

SEQ ID NO: 17647 - DNA, 85 bp, Gossypium hirsutum
  Clone ID: uC-gsflnu33B133f03b1
cccattcttacgcacacgcgcgccatcctatgatgggggggactaaaaagcgtaacctgttgccaacacacaaggaccgcagaag

SEQ ID NO: 17648 - DNA, 92 bp, Gossypium hirsutum
  Clone ID: uC-gsflnu33B133f04b1
cctactcgtacggtaaaacgcgccagattatgaagggggggactataaagagtaacgtgcagtttgcaacagagggacggcattaggaacga

SEQ ID NO: 17649 - DNA, 109 bp, Gossypium hirsutum
  Clone ID: uC-gsflnu33B133f05b1
cccactcgtacggaacaacgtgctacagcatgaaagaggggatgataacgtccaactatcaaggagacaaagactaccgcgaacagacaaacctgagaaaaacaataag

SEQ ID NO: 17650 - DNA, 148 bp, Gossypium hirsutum
  Clone ID: uC-gsflnu33B133f06b1
cccgtgcgtacggaaagacgtgctatacaatgaggggggggtttataaagaataattttgtgaaaacaaacagagaccgcagttggattgacgagtccatacttttgtgttactgccgcctcaatcattttgtggggcgacaaatagg

SEQ ID NO: 17651 - DNA, 91 bp, Gossypium hirsutum
  Clone ID: uC-gsflnu33B133f08b1
actacgcgacgaaagacgtgcaatacaaggggggcggttttaaacacgtatgacgtttttacaacaaagagagactgtataagtaacgatg

SEQ ID NO: 17652 - DNA, 254 bp, Gossypium hirsutum
  Clone ID: uC-gsflnu33B133f09b1
actacgcgtacgtaaagacgtgccatctcaggggggttgtttttgacgtgcatgattttaacattgcaaaaagagaccgcagttgtcgcgatgagaccatgacgttgactatcacgccgccctcatgatgtggcggggcgcctcatttgacatgctactggctcgaatgccctggttcccccaaaaggcccatcggggggaagctacctattctccatattgcgctaggttagttcccccgcatatgaatcgtt

SEQ ID NO: 17653 - DNA, 120 bp, Gossypium hirsutum
  Clone ID: uC-gsflnu33B133f10b1
tcctctcgtacgaaaagacgtgctaaaacatggggggggattttaaaaaaaatgttgggtttataacaaaaagacaccgcagagttagcgagatgaccattacgttgccttcacgtcgcc

SEQ ID NO: 17654 - DNA, 400 bp, Gossypium hirsutum
  Clone ID: uC-gsflnu33B133f12b1
atgattgatgtctcaagagataaggccttacatggagggaacttccaaggtactccaattggtgtatcaatggacaacactcgtttagctattgctgcaattggcaaactcatgtttgctcaattctctgagcttgttaatgattactacaacaatgggttaccttcgaacttgtcagcaagccggaacccgagcctggattatggtttcaagggggcggaaattgcgatggcttcgtactgctctgagcttcaataccttggcaaccctgtcaccaaccatgtgcaaagtgctgagcaacataaccaagatgtgaattctttaggcttaatctcagcaagaaaaacagctgaagcttttgacatattgaagctcacgttttcaactttcttggttgcct

SEQ ID NO: 17655 - DNA, 428 bp, Gossypium hirsutum
  Clone ID: uC-gsflnu33B133g01b1
ccctttcttttcgacaagctagaaggcaaggtagccatagtcaccgttggagcaagtggcatctgagaagccaccgtccatcgtttcgccctcaatggtgcccgtatgatcgtgatcgctgatatccaagatgaattaggccaaaaagtagtcgaatccatcggttcaaataagtgttcatacatgcactgtgatgttaccgatgaagaacaagtaaaaaatttagtccagtcgacggtccaaaactacggcagcctcgacatcatgttcagtaacgctgggacagttagcaactcaattcaaaccgttcttgaactagactttgcagcgtttgaccgccttttcaccgtcaatgttcgcggcatggctgcttgtgtgaaacacgccgcacgagccatggtggaactgaacgtgagaggaagcataat

SEQ ID NO: 17656 - DNA, 534 bp, Gossypium hirsutum
  Clone ID: uC-gsflnu33B133g02b1
ccctcgtttccgcccacgcgtccgcccacgcgtccgcccacgcgttcgaccacgcgtccggttctgatgggatccggtgcattagtgctggtatgatcgcaccaatcaattcttgcgcattctatttatataaaggctacccctgatcgcgcttgagcctcgaatttgaatttaaatacgtccaaataacgtttcgagtgatttattccgtaaataactaattagttatacgatgacatataaaaaaatagaaaaaaaaattaatgagatacaaaattggaggggtgcaacacgaggacttcccaggaggtcacccatcctagtactactatcgccaaagcacgcttaactgcggatttctgatgggatcccgtgcattagtgctggtatgatcgcacccatcaattcttgcgcattctatttatataaagggtacccctgatcgagcttgagccttgaatttgaatttaaatccgacccaataacgttttgagtgatttattccgtaaatacctattagttatccgacgagat

SEQ ID NO: 17657 - DNA, 96 bp, Gossypium hirsutum
  Clone ID: uC-gsflnu33B133g03b1
cccactcgtacgcacacacgcgccacaatatgaagggggggactttaaagcgtaacttcctgtacacacacaaagaccgcattaggaccgacccag

SEQ ID NO: 17658 - DNA, 89 bp, Gossypium hirsutum
  Clone ID: uC-gsflnu33B133g05b1
cccttgtgtacgcacacacgcgccaccaaatgaagggggggtttttaaagcataacgtttagttaaccaacaacgaccgcataaggacc

SEQ ID NO: 17659 - DNA, 161 bp, Gossypium hirsutum
  Clone ID: uC-gsflnu33B133g06b1
cctactcgtacgcaaactcgtgcgatagtatgaaggtggagactattaagaataactttaagataaccaagaataaccgtattaggattgacaagacaatgactttgtgtaagagctgcccaaaataaactgtggggggccaaataggacttactagggga

SEQ ID NO: 17660 - DNA, 82 bp, Gossypium hirsutum
  Clone ID: uC-gsflnu33B133g07b1
tcctctcgtacgtaatgtcgtgttatacaaggggggttgtttttaaagtgtatggctttaacaaaacaaacagtaaccgtat

SEQ ID NO: 17661 - DNA, 92 bp, Gossypium hirsutum
  Clone ID: uC-gsflnu33B133g08b1
tcctcgcgtacggaaagtggtgccataaaaggggggtggtttttaaagagaatgacgtttacaaagcaaagagagacggtagttgtagcgag

SEQ ID NO: 17662 - DNA, 99 bp, Gossypium hirsutum
  Clone ID: uC-gsflnu33B133g09b1
ttctcgcgtacggaaacacgtgccataacatgggggcggtttttaacgagaatgatgtttacacaacaaaaagaaaccgtagtggtagcgaggtgacca

SEQ ID NO: 17663 - DNA, 488 bp, Gossypium hirsutum
  unsure (1)..(488): unsure at all n locations
  Clone ID: uC-gsflnu33B133g11b1
ttatgcgtccggcagttcagagattggtgaagtttttccaatgttgtccggagcaacattttgtccacatattggagccattcttgaaaattatcacgaaatcatcccgaataaacacaacattagctgttaatggtttgacgcccttgctaatctcaagattggatcatcaggatgctattgctcgtcttattctacttaaattaattaaggctgtttatgagcaccacccgcgaccaaaacaattaatagtggagaacgatttaccacagaagcttcagaatctaatcgaagaacgcagagatgggcagcgttctggaggccaagtgttagtgaaacaaatggctacatcgttgctcaaagcccttcatgttaacaccgtcatgtaagttattgtgttcaagntctccttcctgtatgtatattttgcctcgttagtaaggcgtgattctcccttaactttgatttctccaaaatttttgcccttt

SEQ ID NO: 17664 - DNA, 99 bp, Gossypium hirsutum
  Clone ID: uC-gsflnu33B133h03b1
cccattttgacgcagactcgtgcgataaaatgaaggggggtattataaagaagaatgttatgataaaaaacgataaccgcattaggaataacgagagtt

SEQ ID NO: 17665 - DNA, 104 bp, Gossypium hirsutum
  Clone ID: uC-gsflnu33B133h04b1
cctattcgtacggattctcgtgcgataatatgaaggtggagattataaaggataacgttaagaaaacaaagagtaaccgcatgaggaacaaggagagaatgcct

SEQ ID NO: 17666 - DNA, 86 bp, Gossypium hirsutum
  Clone ID: uC-gsflnu33B133h06b1
cctactcgtacgcattctcgtgcaatcatatgaagggggcgtttttaaagcataacgtttttttaaccaagagcaaccgtattagg

SEQ ID NO: 17667 - DNA, 350 bp, Gossypium hirsutum
  Clone ID: uC-gsflnu33B133h10b1
gcccttaacggtcattcctactggggaatttttttaataaagtcgggtctatcgatctacttttcaaccttgtagccaagcctactcttggacttggctgcttaacgccaatcccactaacagagccgcaacagtagacgcctatcttactaacccctttggaaggcagttaaatatccattttaaaaaacaaaaaacctataaataaaaatcactgcaaaccattacctgacttcgccgtgttaaaactaataacaggttttgttcttgaaaaccttgggggatagaatgcctttcaacatataatggcttaaatccatggggtttaaaatttcggaactctacctctt

SEQ ID NO: 17668 - DNA, 542 bp, Gossypium hirsutum
  Clone ID: uC-gsflnu33B133h12b1
ttctctcgtccgggccaccttcacgatctcagctggtactggtcaagctatcactggtggcaaagcggcgattgacgtttacttcttcgggtttcatatccatcaagaaactcatgacctttgtgaggaaacatcttgccctattactgttggcaactttgtgctctctcacaatcaagttttacctggttttactccacctggttcctacaaacttaagatgacattatcaggtgcgggaattaaacagttaacttgcatttccttcgatttcaaaatcagttttggtgcttctgaatcttcagtctctgatagctgatcagcccaccaagtatttatatgaaatatggactgcagtaggatgttatatcttgtttattgcgaacagatctcacattctgcaatattttgtacttggattccgtatatcggtcttgtgaagatgtcatgagacaaactacctttacatgtcagtaacttcaatctggtgaatcatggtaacattggtaatttcccttaatataaataatttacatgcttgt

SEQ ID NO: 17669 - DNA, 520 bp, Gossypium hirsutum
  Clone ID: uC-gsflnu33B134a02b1
atttttggtggagaagagtttcaggtacgtcatcctcggtggtggtgtcgctgccgggtatgccgcgagggagtttgccaagcagggagttcagcctggtgagctagccattatttccaaggaagcggttgctccatatgaacgtcctgctctgagtaaggcgtatctcttccctgagggagctgcaagacttcctggtttccatgtctgtgttggaagtggtggagagagattgcttcctgagtggtacaaggaaaaagggattcagttgatccttagcactgaaatagtgaaagcagatcttcctgccaagactgtagtaagcgcagctggagaaacattcaaatatcaaattttgatcattgcaactggttccacagttataaggttgacagattttggcgtggaaggagctgatgccaaaaacatcttttacctgagagaaattgatgatgctgataagttgctggaagcaaataaagcaaagaagaatggcaaggctgatattggtggaggaggc

SEQ ID NO: 17670 - DNA, 499 bp, Gossypium hirsutum
  Clone ID: uC-gsflnu33B134a03b1
ttttctttgtagttgtaggtggtgataggcgaaaggaatctaaagatttggaagagaaggccgaaatgaagaaaatgtttgagctgatcgagaagtacaacttgaacggccaattcagatggatatcatctcaaatgaacagaatccgaaatggtgaactttaccgatacatttgcgacacgaaaggtgcctttgtacagcctgcattgtatgaagcctttggattgacagttgtggaggcaatgacttgcggtttgccaacattcgcaacctgcaacggtggaccagccgagattattgtccatgggaaatctggtttcaacattgatccttacatggtgatcaagctgctgacatactggtcgatttctttgaaaagtgtaagaaagatccatctcactgggataagatctcccaaggaggcttgaaacgtattcgaggagaagtatacatggaagatttactcggagagactattgaccctgaccggagtgtatgg

SEQ ID NO: 17671 - DNA, 280 bp, Gossypium hirsutum
  Clone ID: uC-gsflnu33B134a04b1
tgttattttcgtctctgctggatccgagtgcaagagtccaccattcccgtctattaaaagctttaacagtcttgtacgacagtgaactagttgtatgatcgcggttttcaattttcataaataaaatccgtatgattcaacatatggatatcgagttgatatatatatacacctaatagctgtatagggaccaactcttgaatatatgaagcataatcgaccgaataaactcaaaacatgtatatatatttgaatatatctacttaaattttacttggtg

SEQ ID NO: 17672 - DNA, 418 bp, Gossypium hirsutum
  Clone ID: uC-gsflnu33B134a05b1
ccttcgtgtccgggtttatctggtggtagtggaggtggtgccaatggtggatctgggggtgccggattaggtgcctcggctgatccagccacagaccatttgtttgcaagctcacctgttccaccacactttcttcatccaggtaggggtaattcagagcatttcttaccattcgtgccagtgccagcactgcagcatcaccatcatcaccagcaacagcagatagtggcggctgcagtaggacatccccatttgcagtctcagtatcataggccacaaatggggcactatgggtcatctccgaatagccaatttgagcatcccttcttaggcaggcagacgcagcaaccaatgcataggatcggagggacacccatgcataatcaagcttcaagagttatgtggaagatttggaatc

SEQ ID NO: 17673 - DNA, 343 bp, Gossypium hirsutum
  unsure (1)..(343): unsure at all n locations
  Clone ID: uC-gsflnu33B134a06b1
gcaaatctgtttctccccagcttggacaaggtcattgtatttgactacaaacccaccgttgtacgttgctaagttacaagcatagttctgtctcaatgtagcttttgtcctgctcatgtctgttgttattttgaataaagtttgatgtcttgtactatgaaatgcgcccatccctagtggtcaaggcataagtcggttggttttatcttctataggttttacatacaataattccttgctgagattgtgctttgatgtattcttgagctgagttgagactaagcaataagaagcttgagtttgagataaagccaaaaaaaaaaaaaaataaaataaaattnng

SEQ ID NO: 17674 - DNA, 75 bp, Gossypium hirsutum
  Clone ID: uC-gsflnu33B134a07b1
aatgatatgaaaaacagaaaaacaccaaaaatacaggaggaggtaatatagaaatagacgacgaacccaccgtgg

SEQ ID NO: 17675 - DNA, 353 bp, Gossypium hirsutum
  Clone ID: uC-gsflnu33B134a08b1
ttatcaccatggctgctgcagacaagggggaggatgttattaaagcgtgccacatggatgatagtgatgaatatcagaggcttccacatcaccgtgaacctagggaatatgtatccttggataaactttctgagcttggagtactcagttggcgattggatgctgataactatgaaaatgatgaagagttgaagaaaattcgtgaagaacgaggttactcctacatggacttctgtgaggtttgccctgagaagcttccatattatgaggagaagataaaaaatattctttgaagaacatattcatactgatgaggagacccgccactgtgtggaggaagtggctattttgat

SEQ ID NO: 17676 - DNA, 435 bp, Gossypium hirsutum
  Clone ID: uC-gsflnu33B134a10b1
tcttttgtgtgtgtgtgttattttcacagcaattttctcttattttctttgaatgaaggatctatctgaacttattaaatctctgcaaatgtgaataaactatattctctctctgatccaatcatttttctcatcttttttttggtaaaaatcgtgttataaaagcttctttgattcgctcctttattacttgcataaaaaggacgttgacgcaggttgacgtgaatgtaactaagaaacgtgagcttccggcgggattggatcgggttttttagtgtctcttcgatctctagtgaagcgagagaaatgaaggcgtcagggcttggttgggctgtactgttggtgctattggggcttgtggttaatggaaaagctgagatttacatagtgactgtagaaggtgagcctattattagctcaaaggtggtgaaaatg

SEQ ID NO: 17677 - DNA, 446 bp, Gossypium hirsutum
  Clone ID: uC-gsflnu33B134b01b1
gttgcttttgcgaatcagggcgatccttctcgcacatgcttgtacgctataatgccttagcaaatgccagacatgcggaactagagtcctcggacggcttcactaattatgatggtatatgtgaagggaagtgcatagcccggctatacaaatacttaagaatgaaaacctgcttgctccattcgtaatgcacacgatgacttatatctgtggactctagctagcatctgagagcattcatgtcatgagacttttggagtaagcatgtcgatcatgattcaatgacaggccacgtaacctaaatatatgaagtattgctgctcatacactatttaaataaatgacctgtcactgtcttggggtgctaccaagactcgagtggtctcttttctctttgtctttataagataactaagctactaaaggtgagatgaacgccccgaaaa

SEQ ID NO: 17678 - DNA, 342 bp, Gossypium hirsutum
  Clone ID: uC-gsflnu33B134b02b1
ccttctcttccgctcaaacaagcggccttgttgccggtattgtagttgctgacccctatgaatattgcaaattcactacaccaaccacacacagggatttgaaaggctcaagaggcgaaatgatcttttttaagaaggaccctgttcttggagattttgtggaatccaatatcaagactactggtaatccaggtttacagggggggcctcatagccacacaattgcacgactagcagttggcttgcagcatgcgcagtcacccgagtacaaggcttaccagaatcaggtagtgtctaagtgtagagctcttgcagggcgcaagggtgaactgggatatacac

SEQ ID NO: 17679 - DNA, 205 bp, Gossypium hirsutum
  Clone ID: uC-gsflnu33B134b03b1
ccctcgtgttcgcccacgcatgcggtattctgtgcggaaatgaaacttaggaccgccaaccatctggcaacttcactatgccggccgcggaagtagatgtggctcgaacaagcgtcgcaatgatcattcttatgcacgaacccatcatcgacgatttgccgcaatcgcagagtaagatcaacggtcatccaggggtacagaggtg

SEQ ID NO: 17680 - DNA, 484 bp, Gossypium hirsutum
  unsure (1)..(484): unsure at all n locations
  Clone ID: uC-gsflnu33B134b04b1
gtttttacaagacgggaagcggagaactcgaaaaaatttgcaattcagaatttcgcaaagggcttacttgatgttgcggacaatttaggaagggcttctacacatgttaaaggtagtttctctaagatcgacgaatccaatgacacttctggagctgtaccgctccttaaaacactcttagaaggagttgaaatgactgagaagcagcttggagaggtatttagaaagtttggagtggaaaaatttgatcctacaaatgaaccattttgatccacacaggcacaatgcggtattccaagtaccggataattccaagcctcctggcacggttgttcatgttttgaaggcaggttacatgctctatgatcgagttattcgaccggctgaggtcggtgttactcaagcaacggatgatggtgcaaccgagaataacacgggcgacaaagtctctgatgctggattgtaggntaagttgagtttttaa

SEQ ID NO: 17681 - DNA, 403 bp, Gossypium hirsutum
  Clone ID: uC-gsflnu33B134b06b1
ttttgttggcctccactatgatgctttggctatgtctccgtttgaggatgctcccgaggagtttgatcagactatattttccgtacaaaaggatagaaccatcgggccggttgaaggcctagcactgaatctggtcaaggatcaacaaagtaagaggagatacaccgacacagccaacttcactttgcgttgtggagtatgccaaattggcgtcattggccagaaggaagctgctgagcatgcacaagcaatgggccatgtaaactttcaagaatatagatgatagaaatctgagaggttagtggcattttcttaagctcagctccttcataccctacctagttcatcggacttgtatcatttggttgataaatcatcttattgaattctcggataacaaaat

SEQ ID NO: 17682 - DNA, 213 bp, Gossypium hirsutum
  Clone ID: uC-gsflnu33B134b07b1
ttttgatcagacacatggcttctgttaactgagtgattttggtgtaccagtcattacatcatgtaatttttagcctctttcttgaagcttttgggaaactgaagagattttcttggaaataatagaattgcacgggacataaatcagtgaacccgtatgcatcttttgaaacagtttttattttgtttaaattggatttttattttgattgtt

SEQ ID NO: 17683 - DNA, 512 bp, Gossypium hirsutum
  Clone ID: uC-gsflnu33B134b08b1
tcttcgcgtccgggagtttgcactgcagttgttcgatgcacttgctcgaaaacgaaacattcatggtgattccatcgataaggctcatctgaaagagttttgggatcagatctcgaatcaaagcttcgatgctcgccttcaaactttcttcgacatggtggataaagatgcagatggaagaataacagaacaagaagtcaaagaaattattagtctcagtgcatctgcaaacagactctcaaacatccagaaacaagctgaggaatatgcagctttgattatggaagaattagacccagaccgcctggggtacatcatgataaacaacttagaaatgcttctgctacaagcaccaaaccagtcagtacgaggcgaaagccggaaattgagccaaatgctaagccagaagcttaagcctacatatgacggtaatccagttaggagattctgcaggaacaccaagtatttcttgcaagataactggcagagagcttgggtgacggttttatgga

SEQ ID NO: 17684 - DNA, 492 bp, Gossypium hirsutum
  Clone ID: uC-gsflnu33B134b09b1
tgactatttgctgatggcaaactggaaagactgtatggacttggccctgcctgcagatgcttgaccaagagagaagatggaggaactctttacggcctcagactcatgaatgaagacaaggcccttatggagagctgatactacttgaaagatgacgtgctggaaggaggaattcccttcacaaagctatggatgaccgcattcgagtatcatggcacggatcctagattaacaaggttttcaacaggggaatgtctgatcactctaccattaccatgaagaagattcttgagacctatgatggctttgagggactcaaaacactggtcgatgttggcggcggtactggagctacgcttaacatgcttgtcaccaagcacccttctataaagggcatcaactttgatttgccctaagtcattgaggatgctcctgcttatactggtgtggagcatgttggtggagacatgtttgaaagtgttccaaaggaga

SEQ ID NO: 17685 - DNA, 456 bp, Gossypium hirsutum
  Clone ID: uC-gsflnu33B134b11b1
tttatacatataaactgtaattccacaaaaccaacttctttttatacgtagaaaaaggagaatatgaaggcatcatatattgcattgtgtgcagtgatggtgatcctcttggcagaagcagtaggggtgtcaacggcggtgacatgcagcccaacgcagctgagctcctgcgtgagcgccataacatcttcatctccaccatctcaactgtgctgtagcaagatcaaggagcagaagccatgcctttgccaatatcttaagaaccctaaccttaagaaatttattaacactggcaatgccaggaaggttgcttccacctgtggaactccttttccaaagtgctaagctagaccctttgcttaaggctttctttctctctattttcactgcagaatggatagagaggaaagtactataattattaatattatgtagttggggggtgtggaatatata

SEQ ID NO: 17686 - DNA, 376 bp, Gossypium hirsutum
  Clone ID: uC-gsflnu33B134b12b1
ttttctacgcgtccgtccacgcgtccgattatcgtaagtggctcgatacacagtcccataggttccatgagccacaacgtgtcttaaatctagcttagccaaatcaatctcccactcctctgcaggcctttggttatcaacgtttctagaccaaacccggctcaggtgcttctccagctgtatgtctaagctttttaaatcaattttatcagctctaaaaatcatatctttgctactaaaacttccagtacccttcagcttacgatgcctgcttcctccctgatcatctgatttctttggtgtcttgacaccaccacctttcgactccacttttcaaatccatatttatagtatggccaaaaacaaaaaaccaacc

SEQ ID NO: 17687 - DNA, 186 bp, Gossypium hirsutum
  Clone ID: uC-gsflnu33B134c01b1
cttcggtgatcgcccacgcatgcgggattctgtgcgggaatgaaatgtatcactgctaacgaactttcaacttcactatggcgggcgagtacttagatatgggacgaacatgcgtacgaatgagcctgcttatgcacgaaccgatcatcgccgatttgtcgcaatgcatgagtaagagtaacggta

SEQ ID NO: 17688 - DNA, 187 bp, Gossypium hirsutum
  Clone ID: uC-gsflnu33B134c02b1
ctttctcttccgcccacccaggcggcctcctgggcggaattgaaacctagaaccgcaaaccaattgccaactcaaatatgccggtccagaacggagatatggcccgaacaggcgccgcaacgagcatgctggtgcacaacccgatcatcgccgatttgccgtcatgcaagagtcagatcaacggtca

SEQ ID NO: 17689 - DNA, 145 bp, Gossypium hirsutum
  Clone ID: uC-gsflnu33B134c05b1
ccatgcgtccgcccacgcatgcggtattctgggcgggattgaaagctaaaaccgccagcgatctcgcaactgcactatgccgggcgcggaaggagataaggcacggacatgcgccgcaacgaggatgcttgtgcacgaaccgaac

SEQ ID NO: 17690 - DNA, 187 bp, Gossypium hirsutum
  Clone ID: uC-gsflnu33B134c08b1
ctacgcgtccgtccacgcatgcggtattgcgggcggaatttaaagctaatactgcaaaccatctggcaagttcactatgcaggtcgaggaatgagatatgggaaggacatgcgcagcaatgaggattgttgtgtacaaagaaaacaatgacgatttggtgcaatggatgagtatgatcaacggtaat

SEQ ID NO: 17691 - DNA, 327 bp, Gossypium hirsutum
  Clone ID: uC-gsflnu33B134c11b1
tgcactagcctctggtgctgacaaggatgaagaagatgcagaggggaggacggcattacattttgcatgtggttatggcgagatgaaatgtgcacaaatcctagttgaagctggagcaagagtggatgctttggacaagaataagaatactgcacttcattatgcagctggttatggaaggaaagactgtgtggcccttctactggagaacggggctgctgtcacactccaaaacatggatggcaagacccccattgaagtagccaagctgaacaatcagcatgaggtagataagttgatggagaaagatgcgtcttttgtgagtgg

SEQ ID NO: 17692 - DNA, 205 bp, Gossypium hirsutum
  Clone ID: uC-gsflnu33B134d01b1
cctacgtgttcgcccacgcatgcggtattacgggcggaaatgaaagctaagactgcaaaccaaaacgcaagttcactatgccgggcgcggaaggagaaatgggacgaacaagcgtcgcaatgaggcttcttgtgtacgaagcgaacaatgacgatttggcgctattgaagagtaagagcaacggtaatgaaggggtaaggaggtg

SEQ ID NO: 17693 - DNA, 210 bp, Gossypium hirsutum
  Clone ID: uC-gsflnu33B134d02b1
cgctctcttgtccgccgacaattgggttattctgggcgaaatttaaacttataattgcaaaaaaattcgcaacttaactatgcaggtcgagtaaggagatatgtgcaagaacatgcgccgcaatgatcattcttgtgtacgaaccgatcaatgacgagttgccgtcattaatgagtaagatcaacggtaatccaggggtaaggaggtggt

SEQ ID NO: 17694 - DNA, 188 bp, Gossypium hirsutum
  Clone ID: uC-gsflnu33B134d04b1
cttacgtgatcgcccacgcatgcggtattaagtacgggaatgaaatgtatgaatacaagggatatcgcaagttaaatatttaggccgaggaataagaaaagggaaggacaagcgtagcaatgatgattcttgagcacgaaacgaactacgacgagttggcgatattgaagagcctgataaacggtaat

SEQ ID NO: 17695 - DNA, 203 bp, Gossypium hirsutum
  Clone ID: uC-gsflnu33B134d06b1
cttacgtgttcgcccacgcatgcggtactatgggcgggaatgatacttaatactgccagggctatgccaactcaaatatgccggccgaggaatgagatatgtcctgatcaagcgccgcaacgatcttgcttgagcacgaagcgaactacgccgagttgccgccattgatgagtttgatcaacggtcatccagcggtatggagg

SEQ ID NO: 17696 - DNA, 228 bp, Gossypium hirsutum
  Clone ID: uC-gsflnu33B134d10b1
tctacgcgtccgaccacgaggactgtcacagcgagggtgttaaagacacgtgggccagacatactgggatgcaggcttgatagaacgaggggcaacaaaagacaacggagcagccagctaccaggcattctagggacaagtacaacaaaaaagactggatttagtgacccatcccaagaaacccacatcgaggggaccagaaactgacgagggggtgatagaagaaac

SEQ ID NO: 17697 - DNA, 476 bp, Gossypium hirsutum
  Clone ID: uC-gsflnu33B134d11b1
tatttatttatttatttatttaagtttttgttttttctttttctttttgaatctggttctttttctttcaaagtggatcaactgaattttgatccagtttcttcatctaggtccttttttattttcaatccaaattcagtccctttttttttcaatcttggttaactttggcagtttcaagtaaaaccagatatgggtggttgcctcacaaaaaacaaagatccaatgccccaacataatggctatagatcaggagcaacaactacagctgctgttcatcaacaaagataccaggaccctgttaggcctgcaccaattcaaccccaggtctaccacatccctcaaaagccagggactcaaacaccatggaagcctgctgttccagcaccaagtcccaagcctgcccctaatattgacacaatcctaggcaaaccatttgaagacataaggatgcattacacaattggtaaagaact

SEQ ID NO: 17698 - DNA, 184 bp, Gossypium hirsutum
  Clone ID: uC-gsflnu33B134e02b1
ccaatgcgtccgcccacccaggcggcatcccgggcggaaaagaaacggaaaaccgcaagcaaaatcccaactcaaaaatgcagggccagaaaggagaaaggacccgaacaggcgccgcaacgagcatgctgatgcacgaaacgaacaacgacgagttgccgcaatagatgagtcagagcaacgg

SEQ ID NO: 17699 - DNA, 144 bp, Gossypium hirsutum
  Clone ID: uC-gsflnu33B134e03b1
ccctcgtgatcgcccacgcatgcggtactatgtacggaaatgaaagctaagactgccaatgctatctcaactgcaatatgccgggtgaggaacgagatatgggactgacatgcgccccgacgtggttgctggtgcacgaaccga

SEQ ID NO: 17700 - DNA, 226 bp, Gossypium hirsutum
  Clone ID: uC-gsflnu33B134e04b1
cctacgtgttcgtccacgcatgcggtattatgtacgggaatgaaacctattactgcaagggatatggcaagttcactatttcggtcgaggaattagatatggcacggacaagcgtcccaatgaggattcttgtgcacgaaccgatctacgacgagttggtgtcattggtgagtaagagtaacggtaattaaggggtatggacgttgtctcacggagcatcgaagaa

SEQ ID NO: 17701 - DNA, 207 bp, Gossypium hirsutum
  Clone ID: uC-gsflnu33B134e05b1
ctttctttccgcccacgcatgcggtattatgtacggaaatgaaagctaatactgcaaacgaaaacgcaggtgaaatatgcagggcggaatatgagaaatgggactgacatgcgtcgcaatgaggattttggtgtacgaagcgaacaatgccgatttggtgtaatggctgggtatagattaacggtaattaaggggactatttgtttt

SEQ ID NO: 17702 - DNA, 157 bp, Gossypium hirsutum
  Clone ID: uC-gsflnu33B134e06b1
cttactgtccgcccacgcatgcggtactatgtacgggaatgaaagctaataatgcaagggatatctcaacttaaatatgtcgggcgaggaatgagaaaagagactgacaagcgtaccaatgaggctttttgtgtaagaaccgaattacgccgatttt

SEQ ID NO: 17703 - DNA, 111 bp, Gossypium hirsutum
  Clone ID: uC-gsflnu33B134e07b1
ctacgcgtccgtccacgcatgcgggattgagggcggaatttaaaggtaaaattgcaaaaaatcaggcaagtgaaatatgcagggcgaggaaggaggaaagggaaggacaag

SEQ ID NO: 17704 - DNA, 169 bp, Gossypium hirsutum
  Clone ID: uC-gsflnu33B134e08b1
gctacgcgtccgcccacgcatgcgataataaggggggaatttaaagctaaaaccccaaaacctcacccaactacaatatgcagggtgaggaacgagaaaagggaaggacaagcgcaccagcgaggcagctggagcacaaacacaaacatcgccgattaggtgaaatgac

SEQ ID NO: 17705 - DNA, 180 bp, Gossypium hirsutum
  Clone ID: uC-gsflnu33B134e09b1
tcttcgcgtccgcccacgcatacggtactaagtatagaatttaaagttaaaattgcaaacgatctgccaagtaaactgggcagggtgaagaatgagaaatgtaaaggacatgactaacaatgaggcatctgaggtacaaggaaatgaacgaagatttgcagtcatgactgagtcagataa

SEQ ID NO: 17706 - DNA, 276 bp, Gossypium hirsutum
  Clone ID: uC-gsflnu33B134e10b1
tctacgcgtccggcgactcgatcctatctagagcgagatactcatcctaaacttgcccagcatgctggagctttgtgtggtgggccatattatggcgatcgtagctgggataataagcttgctggtgctcaggtgactacgagccgattgagaaagctcttgagttctcgagcataatatgcggaaatatcatgcccgtttcatcagctagcgagcataattataggctcattacttccggtcttcactacagttgcacagaactgaatggggaat

SEQ ID NO: 17707 - DNA, 326 bp, Gossypium hirsutum
  Clone ID: uC-gsflnu33B134e12b1
tattcatgtttcttccccaaattctacacggtgagttgttgtgaaactagctgctttgaaatggtgaaaaagctttgtcaattgaaaactagagttcagcgtatcaaccttgattcttttttcccaattggaatgaatttgtttttgacataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaagggggcgccccttttaggggacccaagttttcctccgcgggctggcaaggttaaattttttt

SEQ ID NO: 17708 - DNA, 478 bp, Gossypium hirsutum
  Clone ID: uC-gsflnu33B134f01b1
agttccttccaaacatcagtatgactgggatgctgcaacaacacttaacttcttgcataaatatgggctgcttggagaattcaaacttaacattgagtgtaaccatgccacactctctggtcacagctgccatcatgatcttgagactgcaagaatcaatggaatgttaggaaatattgatgcaaacactggggatcctcaagttggttgggacacagatcagttcttgactgatgtcggggaggcaaccatgattatgctaagtgtgataagaaatggaggattagcaccaggaggcttcaacttcgatgcaaaattacggagagagagtacagatgttgaggacttgttcattgctcatattagtggaatggacaccttggctcgtggactccgaaatgctgctaaactgattgaggatggttctttggctgagcttgtttcgaaacgatattctagctttgacacagaacttggt

SEQ ID NO: 17709 - DNA, 85 bp, Gossypium hirsutum
  Clone ID: uC-gsflnu33B134f03b1
ccttcttttccgcccacccatgcggccctctgtgcggaaatgaaacttaaaattgcaagcgatatgccaacttaaatattcaggt

SEQ ID NO: 17710 - DNA, 189 bp, Gossypium hirsutum
  Clone ID: uC-gsflnu33B134f05b1
cccatgcttccgcccacgcatgcggtattctgtgcggaaatgaaacttaaaactgcaagcgatatcccaacttcactatgccggtcgaggaaggagatatggctctgacatgcgccgcaatgagcattcttgtgcacgaaccgatcaacgacgagttggcgtaatggctgagtaagagtaacggtaatc

SEQ ID NO: 17711 - DNA, 195 bp, Gossypium hirsutum
  Clone ID: uC-gsflnu33B134f07b1
cctcactcgtccgtccacgcatgcggtattgcgggcggtaattaaagctaagactgcaaaccatctcgcaacttcactatgccggtcgcggaatgagaataggcactgacatgcgtcccaacgaggcttcttgtgcacgaagcgatcaacgccgatttggcgcaattgcatgagaagagtaacggtaatcaaggg

SEQ ID NO: 17712 - DNA, 246 bp, Gossypium hirsutum
  Clone ID: uC-gsflnu33B134f08b1
cctactcgtccgctcacgcatacggtactatggggcgtatttaaaaacagtgttggatacaatctgctaagtatacttggcagatcgcaggacgagaaaagtaaatgacaagcataccaaggacgcatcttatgtacaagttcacgaacgaagatttgatgcagtgacatggtccagagtaagtgagatctaattgtccagacgttgtcgaagggaggatagtacaaactgtaaagcaagaaactg

SEQ ID NO: 17713 - DNA, 485 bp, Gossypium hirsutum
  unsure (1)..(485): unsure at all n locations
  Clone ID: uC-gsflnu33B134f10b1
tctacgcgtccgggacgacataccaatcagagtgttcaaaaactgcaaagatttgggagtgaggttcccattcaaccaaccaatgaagatatactccagcttatggaacgccgatgactgggccacaaggggtggtctcgaaaagaccgactggtccaaagccccattcatagccgcatacaagagcttccacatcgacgggtgcgagtcgtcggtggaagccaagttctgcgccacacagggaaaggcggtggtgggaccaaaaggcattcgaggacctcgacgcctatcagtggcgcagactgcgttgggtccgcaacaagttcactatttacaactattgcagcgatgggtggaggtaccccacaatgtcgcccgagtgcaagagagacagagacgcttgagtcatttncatcaccaccgagtcccagttccccccttatattcttcactaccatatgagatccgtcattgtcctttagatt

SEQ ID NO: 17714 - DNA, 503 bp, Gossypium hirsutum
  Clone ID: uC-gsflnu33B134g01b1
ccttctttcccaaaaatggctattctcaaactgatcttcatcaccctcactctaccccttcttttccttcattcttatgttgctgtctcaattttagagctccaaaatgcactgaaaaccagtgaaattgatgccacggtgagaagggcttgttccaaaaagcttgaagattgtttggaaagtgaagatatggaatcagagacccaaaggaggttgcttttgatgcaaagaaggtacattagttatgaaacattgaggagggacatggttccttgtcaaaaaccaggttcttcttattatgattgtggtgctgctcaagctaatccttatagtagaggttgtgagattattacaagatgtgctagaggtatcaaaggtactaaaacctgaagaagaagaagaaaaaagaagacctaaatttgatgtcttttttttaactgttaacagcttgtttctgcaaatgctaatgtgtttgagctggtttttattgtatattagagaac

SEQ ID NO: 17715 - DNA, 421 bp, Gossypium hirsutum
  Clone ID: uC-gsflnu33B134g02b1
gggctcgttagagcttcgctggcccgtatatattccctttggaatgctacatctttggcaaatattgctgccgctttcattgggggcattattcattatggattttcttcttctgcccctgacaagggaaatacttgaaatactagaagcgaagacaacaaatggtggcttttgccaaccatccttctgatattcaagtcaatacaagctcgatttgttgattggcacattgcaaaccttagaagtccaagatttcttcctcttctgtccggatccagatgctttttgggctcatgagcctactgcttgaatttaaagtgaagactgactgcacctccatcatcttcttccatggttctagctgtgatgcttagctttccaccatcatctttttccatggatctggctgggatgcttagct

SEQ ID NO: 17716 - DNA, 183 bp, Gossypium hirsutum
  Clone ID: uC-gsflnu33B134g05b1
ccttctcgtccgcccacccatgcggcctcctgtgcggaaatgaaacttaaaaccgccagccaattcccaactcaactatgcaggtccaggacggagatatgggccggacacgcgccgcaatgagcctgctgatgcacgagccgaacaacgccgatttgccgcaatggatgagcaagagcaacg

SEQ ID NO: 17717 - DNA, 188 bp, Gossypium hirsutum
  Clone ID: uC-gsflnu33B134g06b1
cccatgcttccgcccacgcatgcggtattatgtgcggaaatgaaacttaaaactgccagcgatctgccaacttaactatgcaggtcgaggaaggagatatgggcaggacatgcgtcgcaacgatcatgcttgtgcacgagccgatcatcgacgatttggcgccatggatgagtcagatcaacggtaat

SEQ ID NO: 17718 - DNA, 502 bp, Gossypium hirsutum
  Clone ID: uC-gsflnu33B134g08b1
ttccttctgtgaataagtgaattgatatccaagcgttccattccatttccgtatagttcgaaaacacttaagtaccttcgatcatattttagtgtcaaaaaatggccgaggagcataccagcaaggcccctgagttggagagcaacgttagcggtgaaggagcagtggagagcaaggagcgagggttgttcgatttcatggggaagaaagaagaggagaagcctcaagaggaggtgatcgtaaccgagtttgaaaaggttaatatcgaagagacaaaggcagaggaagaaggtgaggagaagaagaagcatggtctcctggagaagcttcaccgatcagatagcagcagctccagctcttcaagcgacgaggaagaaggtgaaggagaagagaagaagaagacgaaaaagaaggagaagaagggactggaagaaaagattggagagaaattagaggggaaaagaaagaagaggacacctcagtttcagtagagaagtgcgat

SEQ ID NO: 17719 - DNA, 301 bp, Gossypium hirsutum
  Clone ID: uC-gsflnu33B134g09b1
tctacttgtccgatggcgcttacggggctgagtaggatatttaagggaggagggctctacactctgcatggggcatttgcgagagtaaatgtgcacaaaatctaatggaaggcctaccaagaatggatccgtggtacaagactgcgaatacagcactgaattatggaacaggatagggaaggacagactgtctggcccttctactggagaacgggggatatgtcaaactgtaaaacatggatgggaaggcccgcatggtagtatccactctgaacacgcagtataaggtacttacgacctt

SEQ ID NO: 17720 - DNA, 497 bp, Gossypium hirsutum
  Clone ID: uC-gsflnu33B134g10b1
cctctcgtgcgaacgcccttactgtattatctatggatgaaaatccctttgcacaagacactctgcgtgcctcttttggaggagcaactgaaagcagaccatgccttcatgccaaacaagtagggatagttggaacacctgtgagaaaagagacggggtttacatcgtcagaaagctctgaccagagaaactggctggacagagcaccacagttgaatagatccaaggttccaatagaggcggagaggctaatggactacgatctggtcttagcgcagtatctacctccatcttcaccattgcttgctggagtccgactggatgcttttaatgcaataaaacctcgaattacccattcgcctacttcagatacagatatctgggatacgtcagagcatttttagaggatagacatatctctccagctgttctatatattcaagtatctgcacttcaggaagggataggatccaacatggtgactattgcagaataca

SEQ ID NO: 17721 - DNA, 504 bp, Gossypium hirsutum
  unsure (1)..(504): unsure at all n locations
  Clone ID: uC-gsflnu33B134h02b1
cgtattacagnncactctaaatatgcctaaagatctcatggtttccaaaatggcaggggggactacggtggtcaacccatttaccaagtatgcattaacaatgtcaccagtggcaatgagtcttgaagagttgattccatcaacccatcttaagtctcatatctatgcaatcataattagaacatcgcttgtgatctcgaccttgattgttggtctcaccatcccattctttggattggtaatgtcattgatcggatctttgctcacaatgcttgtgaccttaatacttcctcctgcttgttatttaagcatcttgaggggtaaagtaactcgtattcagagaacactttgtattatggttattacagtgggagtagtttcatcagcttttggaacatactcagcactctccaagattgttgagaatttgagaagctaaaagttctttcccattttaatttttttgttaccttatttaaatcgacttgttgagcttcgttgttt

SEQ ID NO: 17722 - DNA, 185 bp, Gossypium hirsutum
  Clone ID: uC-gsflnu33B134h06b1
cccactcgtccgcccacgcatgcggtattatgtgcgggatttaaatttaatattggcagccatctcccaagttcacttttccggtcgcggactgagatatgaaccggacatgcgtcccaatgatgcttctgatgcacaagacaaccaacgacaagttggtgccattaatgagtcagagcaactgt

SEQ ID NO: 17723 - DNA, 505 bp, Gossypium hirsutum
  Clone ID: uC-gsflnu33B134h12b1
cttcaactatcttttctcttcaaagatttcaactcttttctcagaatgggaagtaccgatgggaccagctatggtgcttacacctatgatgccctggagagggagccttactggccatccgagaaacttcgaatttccatcaccggtgctggtggcttcattgcttcgcacatcgctcgacgtctaaagagtgaaggacattacatcattgcttctgattggaagaagaatgagcacatgacagaagatatgttctgtcacgaattccatcttgtcgatcttcgagtgatggaaaattgcttgaaggttaccaatggagtggatcatgttttcaacctcgccgctgatatgggtggcatgggcttcatccagtccaaccactcggtcattatgtacaacaacacaatgaataagtttcaacatgctcgaggctgctcgaatcagtggaggtaagaggtttttttacgcctccagtgcttgtatctatcctgaatttaagcaattg

SEQ ID NO: 17724 - DNA, 339 bp, Gossypium hirsutum
  Clone ID: uC-gsflnu33B135a02b1
aatacattaatatcccatttcaaagaaagtcacatagctttaagagataatgatgaatggccacaaaacagagccggcaccgccaccaccaccgccatctgcaacgccgaggcagctgacggaggccaaggtgatggcggaggagaatggtcggcaagttgaaccctgtgtaaggtccaagactggaggaaccttgacgaaaggggatggtggtggtgcctgacactcaggctgatgtgcatggctacttcagttacagccatgtcgttcatggtcaccgcccgtcagatttcttgatggagtaacagtgactgcaacagcttactctttgcttcaatt

SEQ ID NO: 17725 - DNA, 451 bp, Gossypium hirsutum
  Clone ID: uC-gsflnu33B135a03b1
cttacgcgttcgcccacgcgtccgcccacgcgtccggtttcttctggctttcgattcaaatcccttttggaatcaattgaaaacaagcagccaacatggggaagacacgaggtatgggagctggacgtaagctgaggacccaccgaaggaggcaaaggtgggccgataagtcatacaaaaaatccaaccttggtaatgaatggaagaagccatttgctggttcttctcatgccaaaggcattgtccttgaaaagataggtattgaagctaagcaacctaactctgctatcagaaagtgtgctcgagttcaattgatcaagaatggaaaaaagattgccgcattcgttccaaacgacggttgtttaaattacatcgaagaaaatgatgaggtgttgattgccggatttggacgaaagggtcatgccgtcggtgatattcccggtgttagatt

SEQ ID NO: 17726 - DNA, 433 bp, Gossypium hirsutum
  Clone ID: uC-gsflnu33B135a04b1
tcgcttacgcgtgggggagagttgcgtttgcacaaagatatttctgagcttaacctacccaaatcttgtgctataacatttccaaatggaaaggataacctgatgaattttgaggtttcaattcgccccgatgaaggatattatttcggtggcacattattattctcctttcaagattctcccgtctatccacatgaggcacccaaagttaagtgcaagaccaaggtctaccatccaaatattgatttggaaggaaatgtttgccttaacatcttacgtgaagattggaaaccggtgctcaatataaacactataatctatggctcatatcatcttttcacggcaccgaattatgaggatcccctcaatcatgaagctgctgcattgttgcgggataatccaaagatgattgaatgcactgtgaggagggcta

SEQ ID NO: 17727 - DNA, 506 bp, Gossypium hirsutum
  Clone ID: uC-gsflnu33B135a07b1
tcgagtatgtatcaggtgccaggtggggttttgaaaaggaaggaacctgagggaggatgggatggatacaagcaatcttcatggcagtagcatccttagatgtcactgtttagtggcccattaaagcttttcttcaaggatgggcattggctaacccccagaggtcttctgtcctgtgtttgcttagaggatgggtggtaagtgagccatttgatgtttgttcatagtctccaaccccccaccttttcagcgtatcgactgtaccgtaaaagaatctgttcggggtgtattcaagctttgtttcttgaatttgttctggacacagatcattttccctttgtagatattataactgttggaaatcatgcccatatgttgcccagacattagaaattggtgcccatactgctttgtagtgcatatctttcttgacttttttttttctttcactttttaattttctttttcattttcttttccaattaaagtggtcaccgaattttgat

SEQ ID NO: 17728 - DNA, 437 bp, Gossypium hirsutum
  Clone ID: uC-gsflnu33B135a08b1
tcgattagctcaaaaaagcttccaacattttgaagaaacaaagaatcaaacatgtcgaaggaagtgagtgaagaagggatgagccgaaaggactatgtggatcctccaccggcaccgctcatcgacgtggctgagatcaagctttggtctttttacagagctctcatcgccgaattcatcgctactctccttttcctatacgtcaccatagccaccgtcatcggccacaagaaacaacacgatgcatgcgatggtgttggtcttttgggtattgcttgggcttttggtggcatgattttcattcttgtttactgcaccgccggtatctcaggtggtcacattaactcggcggtgacattgggtctgtttttggtaggaaggtgtcgcttataggggcggcggcttacatggtagctcaatgttgggtgctattgtgt

SEQ ID NO: 17729 - DNA, 461 bp, Gossypium hirsutum
  Clone ID: uC-gsflnu33B135a09b1
tcgcttatcgcgtccgcccacgcgtccgaacgaatccgaaaaattggtggtggttgatttcactgcttcatggtgtggaccctgccgtttcattgcacctttcctggctgaactagccaagaagttcccttctgttacctttcttaaggtggatgtggatgagttgaaggaagttgctaccgattgggcagtggaggctatgccgactttcatgttcctcaaggaggggaagattgtagacaaagtggtgggagcaaagaaagaagagcttcagcagactctgtcaaagcatatggctgtccccagtactacttcagcttgattttatgataattattagttcaactgtttttaatctttcatgtttggaggaacttgacctcatgattatgtcctgctacatctcttatggtattagaccttaagtttctttatctatggatctttcattttctttaaaa

SEQ ID NO: 17730 - DNA, 435 bp, Gossypium hirsutum
  Clone ID: uC-gsflnu33B135a10b1
gatatccttaccaacttggtcccttacccaagaatacacttcatgctttcttcatacgctccagtcatctctgctgagaaggcttaccatgagcagctatcagttgctgaaatcaccaatagtgcctttgagccctcatctatgatggccaagtgtgatcctcgccatggcaagtatatggcttgctgtttgatgtaccgtgtgatgttgcgcccaaggatgtcaatgctgctgttgccaccatcaagaccaagagaactattcagttcgttgactggtgcccaactggattcaagtgtggtatcaactaccagccacccactcgttctggtggtgatcttgctaaggtccagagagccgtttgcatgatttccaactcaaccagcgttgctgaggggttctcccgcattgaccacaagtttgatctcatgtatg

SEQ ID NO: 17731 - DNA, 221 bp, Gossypium hirsutum
  unsure (1)..(221): unsure at all n locations
  Clone ID: uC-gsflnu33B135a11b1
gatgagattgaatttgttttcttgggtaaatgaatcaacttactcaagcgtctctgaataacatttgtataagcattgctattttttctattattatgttctcttctttattgttttttggaatgaaataaaaattactgtngaaaaaccaaagccgatcatacccaagcgaggtcgttcgctcttgaggtccccaaggttaacaccctttggtgcaagga

SEQ ID NO: 17732 - DNA, 347 bp, Gossypium hirsutum
  unsure (1)..(347): unsure at all n locations
  Clone ID: uC-gsflnu33B135b02b1
cctacgttatcgcccacgcgtccgcccacgcgtccggggttttctaaacgaagagaaagtttatttgtgaacagccaggttgtggatgacaacagttaactgttaaaaaccagtttccattaacttacatttcaaggtgggttgcttttaagttgtcctttgcccttccataagatattatgaaagccatttgagcttgccatgttgtatttttaatttttagcaacataaacgaagaataattgcagaagtttttagcnttnaaaaaaaaaaaaaaaaaaaaaaaaaaaaaaaaaaaatggcatcacatttaaaagaatccaagtttacattcttntgccttgcta

SEQ ID NO: 17733 - DNA, 375 bp, Gossypium hirsutum
  Clone ID: uC-gsflnu33B135b03b1
tctattctacgttgaagcagaggccatactttcaactacgattttttcatccgccaaaaatattccaactcaagaaaaatggtaatatatgagttgaaaatggccaaccatgctgctgttatgtttttgttaaaatgcatggtaccatgatgattttgttgagtgcatacagcttgtatgcatgctgcagcatttgtgcatgtttcagcaacatattttctgttttagttgcaatgtaattaagtttggttgagaatgaactttgatgctgatgttttgatgggcctgattgagctgataagtcagcttatccatgtgtacaagcaatgtttatcaagttactaggctacttagtggtagtaggtagtatttggt

SEQ ID NO: 17734 - DNA, 536 bp, Gossypium hirsutum
  Clone ID: uC-gsflnu33B135b04b1
tcggttaatttgattggaattagggttggaaggagggttgacgatatcccaccaaaggcattggctttcaacccttccactggtgctgggaccatctttgattctggtactgttttcacccggctagtagaaccagcctacgtagcagtccggaatgcgttccgaaggcgagttaaggtggccaatgtgacatccctgggagggatcgacacatgatacacggaccccatcgaggcgcccaccataactttcatgttcactggcatgaacgcaacactgccacaagagaacctactaatccacagcacagcaggcagcataacatgcttggcaatggcgtaggcaccggacaacgtgaactcagtgctgaatgtgatagccaatatgcagcaacagaaccatcgtgtgcttttcgatgtgcccaaatcgaggttgggcgtggcccgtgagcgctgcacctgaccagactgaacctacttttgggaatgtgagactggaggcagtactagattatcttaatgttgggtttaatgata

SEQ ID NO: 17735 - DNA, 299 bp, Gossypium hirsutum
  Clone ID: uC-gsflnu33B135b05b1
tcgatttctcctgtactaaactactgccactgaaaagcaagttagctagctagggatttgtgagccagagagatgggtacaaaatgaacggcgtcactagccctatgatctgcactcaacatcctattgttttgcgtggagagtgcttgtggtatcctgctccttcccacatccgcaaacctaaacctaaaccaaagccaaacacccactacctcctcatgttatggtggcaagcgccctagagacgctctcaaactaccggtatgtgctgacttgctcggcggcttgctcaacggcac

SEQ ID NO: 17736 - DNA, 51 bp, Gossypium hirsutum
  Clone ID: uC-gsflnu33B135b06b1
tcgactacgcgtccgcccacgcgtccgcccacgcgtgcgcccacgcgtccg

SEQ ID NO: 17737 - DNA, 349 bp, Gossypium hirsutum
  Clone ID: uC-gsflnu33B135b07b1
atctgataaagggaggaggattagggaactgacctctgttgttcaaaagcgattcaagttccctgaaaatagcgtggagctttacgctgagaaggtcaataacagaggcctttgtgccattgctcaggctgagtcccttcgctataagctcctcggaggtctcgccgtccgaagggcctgctatggtgtgcttagatttgtcatggagagtggagccaagggttgcgaggttattgctagtggaaagctaatggcacaacgtgccaaatccatgaagttcaaagacggatacatggatttttctggtcacccagtgaacgagtacatttgcctctgctggtcgacatgt

SEQ ID NO: 17738 - DNA, 460 bp, Gossypium hirsutum
  Clone ID: uC-gsflnu33B135b08b1
tcgactttcttcaaagagatgcatccgggagaataccttatgtagttgctctaaagcacaaacatggggcatgtgcagctctgctaaatccttcatcagcagaacctattgtctggccggcacctttaaagtttattagtgagcttaatgaggaggcaaaaacactattagaacaagccttaatggatgcaaaccgggaaagagaaaagaacatcctgaagggaacagcttactcaattccatcaccttcacaatctgattctgggttagatgacaatatctctgaggctagtgatactgaactatgctgcatatgctttgagcaaatctgcacaattgaagttcaagactgtggtcaccagatgtgtgcacaatgcacactggcattatgctgccacaacaagccaaaccctacaactgcaagtctaacaccccccgcatgccccttttgccggagcac

SEQ ID NO: 17739 - DNA, 158 bp, Gossypium hirsutum
  Clone ID: uC-gsflnu33B135b10b1
catgtgttagttttgtatgttgaaagaccgccgacattatctgtaaacccctgactatgattgtattaatcctgtgtgctgctgctatgcgtgttaaaaacaaatgataaaggaaaaaaaaaaaaaaaaaaaaaaaacaaagaaacaatatgggcttt

SEQ ID NO: 17740 - DNA, 86 bp, Gossypium hirsutum
  unsure (1)..(86): unsure at all n locations
  Clone ID: uC-gsflnu33B135c02b1
tctagttttcctccgccaaacgactcgcgaggngcaggataagttttacctgtcggtgcgaaattgtaataccactacttttaacg

SEQ ID NO: 17741 - DNA, 519 bp, Gossypium hirsutum
  Clone ID: uC-gsflnu33B135c03b1
cttacgctaccggcgcctctcccgatttcttcttcttcactttgaggtttgagcagatcgtatggcaccaaagaaagacaaggcccctccaccttcttccaagccagcaaagtctggtggtggcaagcaaaagaagaagaagtggagcaagggaaagcaaaaggagaaggtgaacaacatggtgttgtttgaccaggctacttatgataagcttttatctgaggctcctaaatataagctcatcactccctcaattttgtctgatcgtatgaggattaatgggtcccttgctaggaaggctataagggaattgatggcaagaggatcgattcgtttggtgtctgcccattcgagccagcagatttacactagggcaaccaacacctagatcctttgttatatttttgcttaaattagttctatgtagtatttgcctttcttgactttctatacatgatttttccttttgctaaagacctccatctaaattgtgtgagctacagtttcttggtgtactgg

SEQ ID NO: 17742 - DNA, 363 bp, Gossypium hirsutum
  unsure (1)..(363): unsure at all n locations
  Clone ID: uC-gsflnu33B135c04b1
tttcggtttttattctctagagtcttcccttggccctggtaaaatctgtcactgtgatcattaatggccaccgctgaacctgaagttccagtcactgagcagcagcccgcggcagcagaggagccaaagccggcggaaaagcctgtgaaggagaagagacccagagctccaaaggagaaaaagcctaagcaacccaaatccgcaggacatcctccttattttcagatgatcaaggaggcgcttttggcttttaaagagaagagtggatcaagtccgtacgctatagcgaannncatgggagagaagcacaaggcggtgctttcagcgaatttcaagaaaatcttaggtcttcagcttaaaaac

SEQ ID NO: 17743 - DNA, 515 bp, Gossypium hirsutum
  Clone ID: uC-gsflnu33B135c06b1
tcgcgtataacgagggacaccctgacaagctttgcgaccaggtctctgatgctgttctcgatgcctgccttgcccaggaccctgacagcaaggttgcctgtgaaacatgcacgaagactaacatggtcatggtctttggagagattaccaccaaagccaacgtagactatgagaagattgttcgtgatacatgccgctccattggatttgtttctgatgatgttggtcttgatgctgacaattgcaaggtcttggttaacattgagcagcagagccctgatattgcccaaggtgtccacggacactttacaaagcgtccagaagagattggagccggtgaccagggtcatatgtttggttatgccactgatgaaacccctgaattcatgcctcttagccatgtccttgcaactaagctcggtgcacgtcttactgatttaggaagaatggcacctgcccctggctaaggcctgatggtaaaacccaggtcactggtgagtactacaatgacaatg

SEQ ID NO: 17744 - DNA, 383 bp, Gossypium hirsutum
  Clone ID: uC-gsflnu33B135c08b1
tctgtctggttcgtgttacgaggaagactttgcaagctgtgctggaacagtgccaaagagctatcgaatcgattagtaacagcgaaggtggaattgacgatgacgacgaggatgataaagatgacatggatcctcaaggggaagccagtggcgccggtcttcaaagagatcaagaagtcgacgagttgtgcgatcttctgaaatctagagttcaatgttctgattttctagaaaagctagtgtgtgctcgggtgccaatttcagaaaacgtttcagaagaaggttgtttttggaactgagaattttacaattgtctatttttaaatcaatttaaaatcgtaaacatgtttaaaaaaaaaaatatttttatgtttatcttcaat

SEQ ID NO: 17745 - DNA, 200 bp, Gossypium hirsutum
  Clone ID: uC-gsflnu33B135c11b1
cttacgctatcgaaaaaacatgcaggaacactggtggggcttaagtacaagctgagagcggaagcaagcgcaaaagcgatgctgtctgtagccactcatacagcaccagcggccactaatccaacatagaaccgcgaggcaggatagcatcgcatatctggggacctgagaagtgaatttactgtcgaagaatatggggc

SEQ ID NO: 17746 - DNA, 93 bp, Gossypium hirsutum
  Clone ID: uC-gsflnu33B135c12b1
cctacagtaacgaaggaaccagcggtgtaacttgtggcgcttacctagaacctggtaagggaaacaagcagagatgcctggccttgaataaac

SEQ ID NO: 17747 - DNA, 423 bp, Gossypium hirsutum
  Clone ID: uC-gsflnu33B135d02b1
ccctacgcgtacgcccacgcgtccgcttgaaagggtctccaaattagagcaggtgattgaaggagatgagacaaatctgaataaggaagaagagaaagtgatatgcctacctcagctccgccccttagtgcttgatgagctaccaaacctcgtgagcttcagccctgtgggttatcattttgttttccaacctttgaggtgtttaaaagtaaaaggttgtcccaacataaccacaagatttagtgatgattcaaagcaattagtgcatgccaaaacacaggtacactatccttccaaacttaagtataagctctagaacaaatttcatccattgaattattttctttatgtattctcccaaactctatatttactaagctgtaatttctatgcattaatgcaatatttttattttggatgcct

SEQ ID NO: 17748 - DNA, 143 bp, Gossypium hirsutum
  Clone ID: uC-gsflnu33B135d03b1
cctatgcgtatgttcacgcgtccagttgaaatggtgtcgcttaaagataagccgagagcggctgaaagcactaaaagcaagcattcgctgaagactgttacaggtgtaacagcacgtcattgtttattgctggctgaggcagg

SEQ ID NO: 17749 - DNA, 380 bp, Gossypium hirsutum
  Clone ID: uC-gsflnu33B135d04b1
tcgtaatggttagcccagatttatatggagacagccacactagactctacacttattggactagtgatgcatattaagccactggttgctataatctactttgctcaggcattattcagatcaacaatgaaacagcaatgggtgcaagcatctaccctgcatctagctatcatgactcccaatatgatataagcttacttgtgtggaaggatcctaaggaggggaactggtggctacaatttggtaatagctatgtgttgggttactgggcagctttcctatttacctacctatcagacagtgcctccatgattgagtggagaggagaggttgtaaacttagaatcagatggacagtatacattcacacacatggggagt

SEQ ID NO: 17750 - DNA, 488 bp, Gossypium hirsutum
  Clone ID: uC-gsflnu33B135d05b1
tttccgatcaaatggagccactaatactaatcaaaatgatcaaaaaccaaccccggaccagcttgttcgagttgactcagaatgtctatcttccattgtcacaaacctagataaaaacgatccaaaaagtgccaaaaccattgaaacccatcacagcttgcatcaccatcaccatcatcatcaacaacaaagctttgcaacttatggtgccatggaattggacttctcttcctacaatcatcatcaagcagcagcatctaacggtggaggtgtgtcattgacgttagggctacaacaacatggtgggaataatggggtgagcttagcattctccccaacttcacaaagttcattgttttaccctagatcggaccaaattgaagattgtcaaccggttcagtactcacttttagatggtgaaggacagcatttgccttataggagctcgatgggcgctcaattgctacatgatttggctggttagcaat

SEQ ID NO: 17751 - DNA, 448 bp, Gossypium hirsutum
  Clone ID: uC-gsflnu33B135d06b1
tcgcttacgcgtccggcacaattaggagttccttagttgtgttgtaggagccaaagataaaaaaatggtgaagatagcttttggtagcattggtgattcttttagtgttgggtctctcaaggcttatttggctgaattcattgctactttgctttttgtgtttgctggtgttggatcagctattgcttatgggaagctaacgtcggatgcagcactagacccaccaggcttggtggccatagcggtagctcatgcacttgcgttgtttgttggggtagccattgcagccaacatctcaggtggtcatttgaacccagccgacacctttggtttggccatcggaggaaacatcaccatcttgaccggccttttctactgggttgcccaatgccttggctcaattgttgcttgccttcttttcagtttggtccaacggattgagtgtacc

SEQ ID NO: 17752 - DNA, 115 bp, Gossypium hirsutum
  Clone ID: uC-gsflnu33B135d07b1
catactcgtccggacaagcgtgcgcttgcatttttcgctcttacagagcgaccgagagcggcaataagggacacacgcatgcgttcgctgaacacgggttgaagaggaagagcat

SEQ ID NO: 17753 - DNA, 468 bp, Gossypium hirsutum
  unsure (1)..(468): unsure at all n locations
  Clone ID: uC-gsflnu33B135d09b1
ttatcgtttggagaagatctattttgcgggatttcgatggctgctccaccagcaagagctagagctgattacgattaccttattaagcttctattgatcggcgacagtggtgttggtaagagttgcctacttttacggttctcagatggttcctttacgaccagctttatcaccaccattggtattgattttaagataagaaccattgagcttgatggcaaacggataaagctccaaatttgggacacagctgggcaggagcggttcaggacaatcacaactgcttactatcgtggagccatgggcatcttgctggtctatgatgtcacggatgaatcctcgttcaacaatattaggaattggattcgcaacattgaacagcatgcatcanataatgttaacaagatattggtcggaaacaaggcagacatggatgaaagcaaaagggctgtgccaaccttaagggac

SEQ ID NO: 17754 - DNA, 75 bp, Gossypium hirsutum
  Clone ID: uC-gsflnu33B135d10b1
catactttttcggccacacgtccaggatcaatggcggggcatattgataagcccacagcggtaccaagcagccaa

SEQ ID NO: 17755 - DNA, 322 bp, Gossypium hirsutum
  Clone ID: uC-gsflnu33B135e01b1
cctactcgtccggaccagccagactagagctgcttgtgggtgataagtggggtggtgagaaccaagttggaagactgaacttagttattgatgactgtgatgccaaacagtctgtgtatatttatggatgcaaagattctgttttgcagattcaggggaaagtcaacaatataaccattgacaaatgcactaagatgggagtggtatttaaggatgtgtgtggctgtttgtgagggaggtaactgcaacggcgaggcggtgtaatgttagggatttgctcaccctgtttgagggggccacacaattgtgtgagaggtgttct

SEQ ID NO: 17756 - DNA, 100 bp, Gossypium hirsutum
  Clone ID: uC-gsflnu33B135e04b1
cctatgctatcggccacgcgtacagttgaagtgggcaggcttaatgataagttgatagcaggaacaagcacaaaaaggataatttgggtgaagaaggtta

SEQ ID NO: 17757 - DNA, 117 bp, Gossypium hirsutum
  Clone ID: uC-gsflnu33B135e05b1
cttatgtttacggtcacgcgtgcagtttattttgtgtagcttattggtaagttgatagcgtgagataggagtgaaaggataatttggctgaagactgttacaagggtaatagaatgt

SEQ ID NO: 17758 - DNA, 352 bp, Gossypium hirsutum
  unsure (1)..(352): unsure at all n locations
  Clone ID: uC-gsflnu33B135e06b1
ttngtttacgcgtccggccacgcgtccggattacagaaactggtacctaattcaagcaagacagacaaagcttcaatgttagatgaagtgattgaatacttaaaacaattacaagcacaagtgcaaatgatgagtaggatgaacattaccatcgatgatgttgcaacaccaacttcaaatgtcgatgatggcaccgatgggaatggggatgagtgttatggacatgaatttcatgggccgaccaaacatcattgggatctcacctgttttgtctaagccttttatgacaatgaatacaccttgggatggttctaacaacaatgatcggttacaacaaggtgcttcaatgaca

SEQ ID NO: 17759 - DNA, 221 bp, Gossypium hirsutum
  Clone ID: uC-gsflnu33B135e07b1
tcgcctattcgtccggccacgcgtccagttgggttggtctagcttacagagcggccgatagctgcatttaggggcataagcatgccttcgctgacgacgggttcgggcggaacagcatggcatgtgctattgctgcctttggcaggcatgtaaatcagacgaaagatcttgacaggatactgatcttaccagggagaaagagcttaatatcaagttgggag

SEQ ID NO: 17760 - DNA, 474 bp, Gossypium hirsutum
  Clone ID: uC-gsflnu33B135e09b1
tcgaatgatcagaacggagaatatgctacctagctttcccagctgaaaaatctacaggtactcgatttatacaacaataacatgacggcggagttgccggtttccgtcacggagcttcccaatttgcgtcacttgcatttgggagggaactatttcagcggtcagatcccgtcaagttacggccgttgggagcatcttgaatatttagccgtttcgggtaacgaactcagcggtaaaatcccacccgaaatcggcaacttaacgaagctgaaggagttgtacattggttacttcaataattttgaaggtggtttgccgccggagatcgggaacttgtcggaactcgttcgttttgacgccgctaactgcatgttatccggtgaaataccgccggagatcggtaagttgcagaagctcgacacgttgttcctccaggtgaatgcactgtctggctccttaacttccgagctggga

SEQ ID NO: 17761 - DNA, 407 bp, Gossypium hirsutum
  Clone ID: uC-gsflnu33B135e11b1
tcgcttacgcgtccggccacgcgtccggattacagaaactggtacctaattcaagcaagacagacaaagcttcaatgttagatgaagtgattgaatacttaaaacaattacgagcacaagtccaaatgatgagtaggatgaacttaccatcgatgatgttgcaacaccaacttcaaatgtcgatgatggcaccgatgggaatggggatgagtgttatggacatgaatttcatgggccggccaaacatcattggtatctcacctgttctgtctagtccttttatgacaatgaatacaccttgggatggttctaacaacaatgatcggttacaacaaggtgctttaatgacagaccctagatctacattgcttgttagtaaatcacaaccgatgactatggatgcttat

SEQ ID NO: 17762 - DNA, 93 bp, Gossypium hirsutum
  Clone ID: uC-gsflnu33B135e12b1
catatgtttacggtcaagcgtacagtttaattggtgaagcttaaaggtaagttgagagcgggagataggggtataaggatgatttgggtgaag

SEQ ID NO: 17763 - DNA, 101 bp, Gossypium hirsutum
  Clone ID: uC-gsflnu33B135f01b1
cctaataatagtagaaagcaggatagtgaaggatggcgaatgattagtcttggggtttagagaaagcagcagcactcacctgggtgagaagattgggttga

SEQ ID NO: 17764 - DNA, 316 bp, Gossypium hirsutum
  Clone ID: uC-gsflnu33B135f02b1
cttattataacgtccacgcatgcagttgaagcggtcagggtcaatggtaggcaggtgaatgcaacaaacacttaaacaaaaatctggcttgggaaccgtacggctataacgagaggcgattgtgaaccgctcgccagaccagacaatgaaacacatgatgccagagcgtaggagacccttctctccaagaccagtgggctgcaaacaagatgattgtggatgatgaaaacataataatgggggctgccaacagcaaccagagatccatggatgaggctcgagaccttgaaaaaggcatgggaggctctcaaccatc

SEQ ID NO: 17765 - DNA, 90 bp, Gossypium hirsutum
  Clone ID: uC-gsflnu33B135f03b1
cttattctatcgtccacgcgtccagtagaagtggtcaagcttaaaggtaggccgatagctgcaacaagcaccgcaaggaaaatttcgctg

SEQ ID NO: 17766 - DNA, 67 bp, Gossypium hirsutum
  Clone ID: uC-gsflnu33B135f04b1
cctattttaccggccacgcgtccagttgaactggccgggcttaatggtaggctgatagcggcagcaa

SEQ ID NO: 17767 - DNA, 516 bp, Gossypium hirsutum
  Clone ID: uC-gsflnu33B135f08b1
tctgaatattgtccgttcacacctccactctggttggccatcattgaaaggagggaaaggttttaacatatacaaaaaaaaacactgtctctgtttctttgtttctcttgtaattgcctggaatacccagaactgcaccacctctaacattaaatccccttctttttctttgtcaatatcatcatttcattatagataaacagttaaaagcgcgaattgaatcattgatttaacagcaaaaagcacaggaaacgcccatgtctcggatctcctggaatcactttcctataatcacgttcttgagcttcgttctcgtcgtttttcttcatggggttacggctgcaaccttcacattcatcaacaaatgcgattacacagtatggccaggacttctagctaatccaggaagtccaaccgtggaaagtacaagctttgaactcaggaatggcggctctcgttacttccaagcccctaccggctgggccgtcgtttctggggaagaacaagctgcagttt

SEQ ID NO: 17768 - DNA, 359 bp, Gossypium hirsutum
  Clone ID: uC-gsflnu33B135f11b1
tttattatcagcccgcagtggaaccaggagttccagctggcggtcaaggacccacagcacgacctggtcaggttcagggtctttgatgcggacaccatcaaggacgacctgatcggtgaggcctcgtaccccctcttccagatcgccaacggccagccggtcgacacctggctctcgctgaaccccgacaaagccggcgcgatccacttccgcgcgcagctgaccggcccccagcagggcggcgcgcacggggctccccagggccagccccagccccagcccggctacggccagccgtcgcccggctacggccagccgccacccgggtacggccagccgccacccgggtacggccagcc

SEQ ID NO: 17769 - DNA, 295 bp, Gossypium hirsutum
  Clone ID: uC-gsflnu33B135f12b1
tcgatgattcttcgaaaacttcatcatgcaaggtctccatgttgaccaaatcgaaaagggtcgagttctttgctccatgaaagtccctcctcgtttgctgaacgctggtaatttcttgcacggtggagctactgcatcactggtggatttggttggatcagcggatatttactcctacggaggtagtaccagtggagtttctgtcgaaatcagtatcacttacttggatgctgcttatgttggcgaggaaattgtgatagaggctaaggcattgcctgttgggaagactgttgtc

SEQ ID NO: 17770 - DNA, 301 bp, Gossypium hirsutum
  Clone ID: uC-gsflnu33B135g02b1
gactaaggacccatgatcattgtattagtttatgtgagaacaccagaaagctgcctcctcgcccgggatctgttccctagtcaatcattctcacccgttatggctcgaatggtgtgatacacatggagggctttcagcaacagctatggaagtgttgtggaacggaaataacgccttgctttgcgagttgagagatctaacctgtgtggatcacacatcacagcgcatgtgaacaggctctcacggtctgtatatttattcaggggaagaagatgttggaccaagagtataaaaaagtgca

SEQ ID NO: 17771 - DNA, 106 bp, Gossypium hirsutum
  Clone ID: uC-gsflnu33B135g03b1
cttttgttttcggccacgcgtccagttgaactggtcaggcttaatggtaagccgatagctgcagctagcactccaaggaagaattggctgaacattgttatggggg

SEQ ID NO: 17772 - DNA, 107 bp, Gossypium hirsutum
  Clone ID: uC-gsflnu33B135g04b1
cctatttgtccggccacgcgtccagtttaactggtcgggcttaatggtaggtcgatagcgtgagctagcactataagcaaaatttcgctgaacagtgttatgggggt

SEQ ID NO: 17773 - DNA, 98 bp, Gossypium hirsutum
  Clone ID: uC-gsflnu33B135g06b1
cctatttttccggccacgcgtcctgttgacttggtcgggcttaatggtaggctgagagcggcatataggactatatggaaactttcgctgaagattgt

SEQ ID NO: 17774 - DNA, 95 bp, Gossypium hirsutum
  Clone ID: uC-gsflnu33B135g07b1
ttgccttctcgtacggccacgcgtacagttgaggtggggtaacttaaaggtaggctgagagctgcaacaaggggcaaaaggatacattggctgaa

SEQ ID NO: 17775 - DNA, 386 bp, Gossypium hirsutum
  Clone ID: uC-gsflnu33B135h01b1
aatgccttttcctctcctcctcctcctcccctccttcctttgctgttcctaaagtttcgttctcttttagctgcctgaacgtcctattttttccctctctcgtgactcgttcatcaggaaaaacttgttcgagtgagcatcaatggatccacaacctgaacctgttacctatatctgtggagactgtgggcaagagaacacattgaagcatggagatgtgatacaatgccgggaatgtggttatcgcattctttacaagaagcgaacccgaagaattgttcagtatgaagctcgctgaaagtggtgtttggagaaggggaggggtatgagcaaacaatctcttagtcaggagttatgtgtttttgatattggctgaatatattaag

SEQ ID NO: 17776 - DNA, 373 bp, Gossypium hirsutum
  Clone ID: uC-gsflnu33B135h02b1
aaccctactatggaaagctggacgcctgcaggaccggtccggcaggcccggcgccagacccacccggtcgccttaagctataaacctagggattacaggcttagttgaggaaagacctgctggatcatgactaactggcattatggacactgcgatcgtgggagacgccatcgaccgtcggatccgtacccttctgagacctgctgctctagccgcttgcattgaggaagctggccttatcatctttaatcaaaagtgagatagatatggaacgtactggggacagtatgacatggctagttatgctcgcagcattggcactactagtggttgatcgagtctagtctgcacatgcttgtgggcaacctcacta

SEQ ID NO: 17777 - DNA, 107 bp, Gossypium hirsutum
  Clone ID: uC-gsflnu33B135h04b1
cttacttgtccggccacccgtccagtttacttggtcaggcctattggtagcccgatagctgcagctagcacttcaagcatgctttcgctgaccagtgttacaagggt

SEQ ID NO: 17778 - DNA, 91 bp, Gossypium hirsutum
  Clone ID: uC-gsflnu33B135h05b1
cctatttttccggccacgcgtccagtttatttggtggggcttaatggtaggtcgattgctgcaacaaggagtgaaaggaagcattcgctga

SEQ ID NO: 17779 - DNA, 427 bp, Gossypium hirsutum
  Clone ID: uC-gsflnu33B135h07b1
tcgccttaagtcaaaactggaggtcttaatggccgccctgagaaactccctgatgtttgctactcatggggggttctatctagcttgatcatgattgacagagttcactggatagacaaggaaaagcttgttaagttcatcttggactgtcaggatgtggaaaatggtggaatttcagatagacccgatgatgctgttgatgtctaccacacatatttcggagttgctggactctcacttctcaattatccaggactgaaagccattgatccagcttatgcattacctgtcgatgtcgtaaatagaattttctttagtggataattggtatttcctttcgtccctctcagcaattccttgccttttcgtcatttctcctgttaaatgccaaaatgtattgaactttgtactgtgagaatccatgccc

SEQ ID NO: 17780 - DNA, 375 bp, Gossypium hirsutum
  unsure (1)..(375): unsure at all n locations
  Clone ID: uC-gsflnu33B135h08b1
ttgatgtaaactgcatacactggccattgctgttttgaatgtttggaaacatgttttttttgtgtaagttacatttcagggtttttttattaccaaagttggcttgaggatcncanannaaaaaaaaaaaaaaaaaaaaaaaaaaaaaaaaaaaaaaaaaaaaaaagaagaaaaaaaaaaaaaaaaaaaaagagngcgaaaaaaaagagctaaaatatagaaaactaaaaataattaaaatgaaaaattaaatacagggggggggcttttaaagggataaaattttcctcccgcgatggtcgaaaagttaattttttttttggggccaccaaaatatattgggggccccgttataaaaaactttgctattggaaa

SEQ ID NO: 17781 - DNA, 235 bp, Gossypium hirsutum
  Clone ID: uC-gsflnu33B135h09b1
ccctcgcgtccgttagcttctggtttcttcttctcaaactcttttcttggggggtgggtttaattattaactcaaaggaggaggagagacgatgagaatggaattactcggaaaatcatttgaaggccaagttttgaagaaagattttaaatttacattcgagtcatggcctatataaaaaatttgcagcaaattaagaagaaggtgatgatgctgatgacgacttcgaggaggg

SEQ ID NO: 17782 - DNA, 367 bp, Gossypium hirsutum
  unsure (1)..(367): unsure at all n locations
  Clone ID: uC-gsflnu33B135h10b1
ttgcttacgcgtccggtgggatgcagatcttcgtcaagactttgaccggtaagacgattactttagaagtggagagctcggatacgattgataacgtgaaagcgaagattcaggacaaagaaggaattccaccagatcagcaaaggttgatttttgctgggaaacaactggaagacggaaggactttggctgattacaatattcaaaaggagtccactcttcaccttgttcttcgtcttcgtggtgggttctaagccttaaggtctcccttaatgtgggttttctggttttacgtgaaggactgtgccctgtaatggccttttaaataatttctagtctttgtttacncggntgcatctatgtatgg

SEQ ID NO: 17783 - DNA, 472 bp, Gossypium hirsutum
  Clone ID: uC-gsflnu33B136a01b1
ttgggtttcatgttgtaggtttttttcttttttagaattcgagtcgtcgttaagaagggagatgataggtgtcatgatgctaggtggagccatggggctaccggggtaattgctgctactagtaatctggttcccggtttgatgcacgaactcatgttcaatgggaaaaacgcttcacttaatgcgaagctcttacctttgattcaatggctctttgaggaacctaaccccattggtcttaacacagcccttgcacaactcggggttgtgaggccggtttttaggctaccttatgcacctcttccgctggaaaagagggtcatatttgttgaactggtcaatgaaatcgggcgagagaactttgttggagaaaaagatgttcaggttcttgatgacaacgatttcatcttggctggacgatattagtttttctttttttatgactatgcacacgactcgatgcccgtgtctc

SEQ ID NO: 17784 - DNA, 479 bp, Gossypium hirsutum
  unsure (1)..(479): unsure at all n locations
  Clone ID: uC-gsflnu33B136a04b1
ancttccatttgtccgaaaataacatggaagacagggaacaaaatgaagattcgaaggcagctgatgcaaatcatccacaagttgaatgtagcaatcgccgtggcagaagcagtaccaacctgagtgattcttggaaggaggtatctgaagggggccgactggcttttcaagctctcttctccagagaagtactaccacaaagcttttctcctcctcatgacagaaagaataaggagaagcaaaagggaagtgtaggtgcagatgagcaaaatccagatcagaataatggagagacatcaattttacacttctccagcgaggcatgccaatcttgttctgaccatcaaggagtcgagaaaaaagtgttgtcaaaagctaagaacattgtggacgagagcttgctgacgattgggctaggacatgaaaagcttaaggcccgtcaaacaagatttaaaccttacaaaagtgttctgtggag

SEQ ID NO: 17785 - DNA, 96 bp, Gossypium hirsutum
  Clone ID: uC-gsflnu33B136a06b1
tccactctccggagaaaaaaaaaccaaaaagaaaagtgcatttttgatgggggtagaaaaacccacccgaaccaaacacgaaccaaccaggttggg

SEQ ID NO: 17786 - DNA, 502 bp, Gossypium hirsutum
  Clone ID: uC-gsflnu33B136a07b1
gaataatgcaaatgttcgagcacacctgcacttacaaaccaagtatttcattagcaaatcaacgaactttctaagcaagcaggtattattgcgtccacacgtcacggagagaattgcgtcagactcccttatacaatggtgaccacattaatttaactacgggccaacaaaaatgtgctactactattcttatttgatatatagaagggatataacacccaaaagaatgtaaaggtacatgcacatagaaattctgctcatttacaaatgcacatttttagacagggaacaacactcggaccaaagttgacctataataagcatttgaatgaagtcaactaccttacacaatcatcctgcgttaaatgatccaaaccccagatccaattactattcggtttgctgtttgcaaagtaaaacgagaaaaaaagttgagcctactataagacataccccaacctacgtgaaacctatattcacccgcttaagagtgactatcctc

SEQ ID NO: 17787 - DNA, 444 bp, Gossypium hirsutum
  unsure (1)..(444): unsure at all n locations
  Clone ID: uC-gsflnu33B136a08b1
tcctctcgtccgagaaattgctgaaatcgagaatggaaaggctgatatccacaacaatgttcttaagggagctcctcatccaccatctttgcttatggcagatgcatggacaaagccgtattctcgggaatacgctgccttccctgcttcctggcttcgaactgctaagttctggcctactacaggacgtgttgacaacgtatatggtgatcgcaacgtcatctgcacccttcttcccgtatcgcagatggttgaagaggctgctgcagccaattcgtaggcctaggcctcatctatgttgtcattgaagccaacattttctttttccttcaacaaaaaaggggtgggggggggngggtcccaatgtctttcttgttcatgtacataaactattcaccatttgcatatgttctaagctgtgactttcattttattggtccaatt

SEQ ID NO: 17788 - DNA, 338 bp, Gossypium hirsutum
  Clone ID: uC-gsflnu33B136a09b1
tcctttcttgcgccaatgggatcgtttacaagggggttaggtttgcaaagacagctacattttcatttatcatcaagcaccggttcagacccttctagcacattaagggatgcatgcatagatactgtactcatctgccctgaggggataggggtcaagctcagaccactcaatgcccaggcaaagatggaaattggaggtgtgtagctgctggtgcttattaatcttacacgtatcgaaagtcacaaggcaggaactgtgaacgacattttaatgctattgtatgagaccgtaaaatacgctaagaggctcggcaggatagatactgtgattgagat

SEQ ID NO: 17789 - DNA, 455 bp, Gossypium hirsutum
  Clone ID: uC-gsflnu33B136a10b1
tctttctttctcgtcgaagggagtgctattctacggccctcctggatgtgggaaaacccttctggccaaagctatcgcaaacgaatgtcaggcaaatttcattagcgtcaagggtccggaattgctcacaatgtggttcggagaaagtgaggccaatgttcgtgaaattttcgataaggctcgccagtctgctccttgtgttcttttctttgatgaacttgactcaattgctactcagagaggaagcagtgtcggagatgcaggtggtgttgccgatagggttctcaaccaacttcttaccgagatggatggcatgtctgccaagaaaactgttttcatcatcggagccaccaaccgaccagacattatagatcccgcacttttgcggccaggtcgtctcgatcagttaatctatattcccctccccgacgaggactctcgtcatcaaatcttta

SEQ ID NO: 17790 - DNA, 473 bp, Gossypium hirsutum
  unsure (1)..(473): unsure at all n locations
  Clone ID: uC-gsflnu33B136a11b1
tttctctcacgcgtccgctaatttttttcttattcattcattctttttcccccttgtgtcttttatttcttccttttttcctacgattttgcttctattttcctagacattatattattaacttgatcaccaaaaatcgtctctttttgttgtccattattgcccctttcctccacttgtggtggtgccggttaggtctcatttctcctattttcctttcccttttgtgtctatttttgttgctattttactgttgttttccaccctaaaatcgtcccttccgctgtccacaaatctccttttctgccgctcaagctagcctcatttgttgctgtatgtggagccgtctgtcgccctttgaacatcacctttggttgctgaaattttttgcttttgttgcccttttaagcacaatttctcttcattattccactagtanaaaagcctcttacttcgctaatttgagtgcattc

SEQ ID NO: 17791 - DNA, 523 bp, Gossypium hirsutum
  Clone ID: uC-gsflnu33B136a12b1
tttctttgtagaaaaggatcgaaacctaccaaacctatctgatgtggaaaaaagctgaaattacatcttcagctgacatagcacccatggtatcagcaagtccacgtgtgcgccactctctgtcacagatgctgcaagaagaaagtagcgaaggttatattactgactggggaaatgctgaaagtttgcctgcaatggtctaccaaaaagatgcacccaagggattgaagaagctgttaaagtttgctcggaagagtaagggggatgcaaatataactggttggtctagtccgtcagtcttttctgaaggagaggatgatgcagaagaatcaaaagtcaataataagagaaattctgataatctactgcgaaaggcagcccttcacacaaagaaccatgggcaagaaaagacattgctgtctgatggatttgatcgtaatttgaattctcatgagcttccatctgctcaatcaggcattagaacgtttaatacccacaaatggcacaatgggcagcgttcagc

SEQ ID NO: 17792 - DNA, 470 bp, Gossypium hirsutum
  unsure (1)..(470): unsure at all n locations
  Clone ID: uC-gsflnu33B136b02b1
ttctctcttcttgccagattgtaatcctggtgacagggttatgtttaatattaggtgtctaaaataattgtttgaatttatttgctcatccactcttgccttatatattgaattaaccgctctttatttaaatacaaagaggataaaggaaaataaatggcacaattttgcataaaatacatgttctgaagattgataacatttgaagcaatagacaatgttattcctggtagaatcatagctacggttcaatttaatttgatttagtgtagcatagtgattaaaataattctattttcaacctgttcttattttttcactatgttatgattgagcggncttgaaaaccagaactttaaaattgtaaatggaaaacacttgctattttagattttgttcatgacaaggcgggttttatacaccctatcaactaatgtcagggaattccagctgactggccattggacata

SEQ ID NO: 17793 - DNA, 435 bp, Gossypium hirsutum
  Clone ID: uC-gsflnu33B136b03b1
tctcacgcgtccgcccacgcgtccgagatgtcaaccaacatggctgccattaccaccaccacaaccaccgctaccaccggcgcagtcatcaccacctcctaccaactaaacccataattaactgcaaaaaattctagcttttgggggtattgcagcaaaacgaaaaaagggaaaaaaaaagaagaaatatcctttttttagtcccaaaaaaaaaggtttttttttggtcctggtaaatggggggaggtcctgcaagaccctgttgattttattactgaatcaaacctggatggactgatggttcctagacccagatttaaaaccaggccggtcaaaactctaggtgcaaaaaaatggcaggctgcttttcccttgaatgggcattgggatatgggaaaaactttccatggattccaccggggggggattcatcca

SEQ ID NO: 17794 - DNA, 65 bp, Gossypium hirsutum
  unsure (1)..(65): unsure at all n locations
  Clone ID: uC-gsflnu33B136b05b1
ttcctttcttncgattaagttcactttttggggagttagctttgaaaagatataaaatagtcttt

SEQ ID NO: 17795 - DNA, 451 bp, Gossypium hirsutum
  unsure (1)..(451): unsure at all n locations
  Clone ID: uC-gsflnu33B136b06b1
tcctttttcaactctgggtcttgtggggaggctatttttaatgacactttgcttacccggaagaccttgggaagttaatatcaaaagtttgaaggagataagaggtacctaatggagcgtacgctttggggacatctacccttgttagtaagagccaactccaaagaatcggtggaatatattcttcaaaccctttggagaacccggaagactggtctcgacgccgatgaccgtcgactcatctgccaaatgcttcagctccaaaacgagtccgaccttgacccggtaattatccactccctcactcaaatgctcatcgntgntagtaaagattatagtatttggtttttgctaaacattttgttgtacttcctattgccgttgttatttctgtaagatgctagcttttaacaatagtactactctttacaacaatgttgattaaagtagc

SEQ ID NO: 17796 - DNA, 294 bp, Gossypium hirsutum
  Clone ID: uC-gsflnu33B136b08b1
cactcactatatggaaagccggcacgccggcccggaccgggcactaactgccgggtccacccaagctttcttcttgttggcccgatggcgctccggcgacggggagctgcataaatgttaggggcaaaaacactaggaggcgtatctctggccaaggcctctttagcgtaataaagggataacctcgccctgtactttaaaaaactatagcttttgggggaattgcagaataccaaagaaaggaaaaaacagagacgaaatacccgtttttctggtccaaaacagaaagctttt

SEQ ID NO: 17797 - DNA, 486 bp, Gossypium hirsutum
  unsure (1)..(486): unsure at all n locations
  Clone ID: uC-gsflnu33B136b09b1
tgtattcttcatgctggacgtttggttgctatccttgaagcttatgcactttacgaccctgtaattggctactgccagggcatgagtgatctcctttctgcaatagtttcagtcatgcctgaggattatgaggctttctggtgttttgtaggcttcatgaagaaagctcgacataattttaggcttgatgaggtgggaatcagaaggcaacttaatattggttgcaagataataaaatgtaaggactctcacctctataggcatttggagaagctgcatgcagaggattgcttttttgtttataggatgtgggaggttctctctaggagggaattgacatttgaacagacaatgtgcctatgggaggtaatgcgggcagatcaggcaaccattagagctgggctttcgaaatccacctggagtnggataagacagaaggcaccccccacagatgatctattgctgtatgcaattgcagcttcagtc

SEQ ID NO: 17798 - DNA, 517 bp, Gossypium hirsutum
  Clone ID: uC-gsflnu33B136b10b1
tttttatcaggtcacgggcatcctagctgaagctttgaggctggtcttaactcaagtcctactgcaaaagaagggcttgactctaaatccaatcaccagcttatactacatcgcaccctgcagttttgtgtttctttttgtgccttggtgtttactggagaagcctgggatggaagtttcacagatacaattcaatttctggatctttttctccaatgctctttgtgctttagctctgaacttgtccatattcttagtaattggaagaactggagctgtcaccattagggttgctggtgtcctaaaagactggatactgattgccctttccactgttgttttcccggagtctacaataacagggctcaatataattggttatgcaatcgctctttgcggtgttgtcatgtacaactacataaaggttaaggatggtcgtacacctcagctcccttcggatagtattcctgagagattaacaaaggattggaagttggagaaaaagtcatctgacata

SEQ ID NO: 17799 - DNA, 434 bp, Gossypium hirsutum
  Clone ID: uC-gsflnu33B136b12b1
tttcctttgcttattaatgctgcaaaaggatcatcgaacagcttctcgatcaagaagatagatgaaatcgagagggttgccaaggccaaccgttgaggcattagacgagattattacaccgtgggcggggagaatttcaattgttttaatcaggactctatgggctatcttttatttttggtgtcctggacatgcaatgagtgttgcgtttgctatctaagttgacaagttagcttatgtttaaattggagtttttcagtagatattattaaaatgatagaatttttgctgattgatttgatgaaatgcatgtctcattgaattaaaacattcacttttaacttgcttgtgatttataatgcagcaacaattcatgtttccttcaaaatgttgagggataatccaaagatgtttgaatccaatgtgaggagggc

SEQ ID NO: 17800 - DNA, 125 bp, Gossypium hirsutum
  Clone ID: uC-gsflnu33B136c01b1
tccattatgaaggtgtaattttgaaaactcttatatatttccatggatgttggaacatctatctttattgttcaaaaagaaatctatccttgagacttgctcaatcattttaaattttttgaact

SEQ ID NO: 17801 - DNA, 339 bp, Gossypium hirsutum
  Clone ID: uC-gsflnu33B136c02b1
ttgatcacattctttacgataagctggttcgtatgtctgacatataaaagcctttggggtccaataagatgttataatctgttttgcatcaaatgaggcattcccattcaaggtgcgactcataggagctaaacttgagtcactgacgttcaaatagagggttttagcttctcttagtgtataagctattggtatatgcaagggattgtttgctcatggcatatatcatgtcaagagattagtccaatgtggtctgtggtcttaggccttagtgaatgttcttaatctatttgttttcattttccttatttgaattgagatcaactgtattttagccca

SEQ ID NO: 17802 - DNA, 315 bp, Gossypium hirsutum
  Clone ID: uC-gsflnu33B136c04b1
tggaatagaacaaggagttctttgaggcatacacaaggggaagccatgagagagccactgaaatagagaaaagacaaaggattcagaggagtctccatgcttacataagggacaacaatggcaacgatcaactccactactaaatatcatcatattgttccaaactatttgttcttcctttttggtgttgaaagtgtattgtaaaagtaggcatgaaagttgaggcaatatcccttgcatgataccatggttgagtgtaaggttaccttgctatattcctaagcaataaactcactaaacaattttaattgcttc

SEQ ID NO: 17803 - DNA, 508 bp, Gossypium hirsutum
  Clone ID: uC-gsflnu33B136c07b1
tcctttcgtccgatttttgtttacatattagagccattgagccaatagctcgtaaaacatctacctgaatctacctatagcataagtattggttcagtactcggtatgttctttagtattaagtaaaaactgagcatgatggcatgatcaaggcttcggtttcttgatttcttcatgttcttccggtccttatatctttgcattgctaccgtttttctccggtttttcttcaagtaaacctattcattctagatgttaacaaataggtttccatacttcaggtatacgaagatgaaccagtgcttcaggcctttaagctaatgaggaaaaagagaatcggaggcatacccgtcattgaatgcggagggaaaaaagctatcggtaacataagccttcgagatgtacagttccttttaaccgcaccagatatataccgtgactacagatcaatcacagccaagaacttcctaatagcggttcgaaactacttggagaaacacgagaagag

SEQ ID NO: 17804 - DNA, 510 bp, Gossypium hirsutum
  Clone ID: uC-gsflnu33B136c08b1
tttccttgcgtccgcggacgcgtggcttgtgggaggtgtagatattattgcagcaatggcttctttgcaatgccagaaaaccactgagaaaggcttggctcaaggatactatggtggcggctctagttggggaagccaggccactaaaatggagaacaaataccagaatggctatgcaatgtcttacagcgaacaagaacgccatagccaaatccgccgccccacctatggaatgagcgaatcctacactacttacggccaatctcatggcacccacaacggaaacgcaatgtcgaaaccccaatttcatggtcatgggaacggctacggtagccacatgagcaacgggatggctcacactcaagcatatggctctaaccatcacaacagccctggaaaacaccatggctctgggtatggcagtggctctgggggctaccctcccaaaaccatggaatgccgcatatcccaccgcaccacggcggcaaactgtcaggccaaggcaacggg

SEQ ID NO: 17805 - DNA, 428 bp, Gossypium hirsutum
  Clone ID: uC-gsflnu33B136c10b1
tctcttgtccgatgggaggtggccatggagggagcacaacttacaaaggtgtaaatttgcaccacccaaagagatggcacgtcgccaccggcaagggcttgtgcgctgtcatgtggttttgggtcctgtacagggctaagcaggatggtcccgtagtgttgggttggcgacacccttgggagggccatgatgaccattctcatggccatggagacaagcattagctgcagcctgaagaagcttatctgcttatgggtgcgtggcacagatgctgttctggaatgtcttctgtttattttcttcggtgtcaataaagtgatggtgaaatgggattgtaagcataatgaaatgaaaactgaaacttcatttatgcattattggtttcctgtaaaaggcggatttttatggccgaatgcatttggtttatt

SEQ ID NO: 17806 - DNA, 480 bp, Gossypium hirsutum
  unsure (1)..(480): unsure at all n locations
  Clone ID: uC-gsflnu33B136c12b1
acttctctccacgcgtacggaaaatgcatcattcaggcatgtttttgatatagctgccattatcactggaactgctaggcctaaattcaacatccctttaggcttgattgaagcttatggatggatttctgttctttttgcccgaattacaggaaagcttgctctcattagtcccccgactgtgcacgtcttaagacatcaatgggcatatacttgtgacaaggccaaactggagttggattatagacctagaagcttgaaagacgggcttgaagaaatgctcccctggttgaagagcttgggcgtgataaaatactaattactaatatgaattatgaagatgtacgaacttgatctcattctttaggccattgagaagtattccattaaatgctgagaggaatctatgttgctccttctgtttcatgcttgatgtagctntagccggtaatggcagtaataagaaactggctggctcgt

SEQ ID NO: 17807 - DNA, 453 bp, Gossypium hirsutum
  Clone ID: uC-gsflnu33B136d01b1
ttctctctacttccaaacttaccagtttgaggacctttttgcgaagcgtaacacgccggtagcacatgcggttgggttctgggattaccattccttcattactgctgctgctcagtatcagcctcatggatttggtaccaccggggaaaagctccagaatatgaaggaagtcgctgcttttcttggacatgtcggcagcaaaacttcatgtggctatggagtcgctaccgggggaccattggcttggggtctttgctacaacaaagaaatgagccctagcaaaatatattgcgatgattactataaatacacctatccttgcacaccaggagtctcatatcatggccgtggtgccttgcctatctactggaactacaactatggggaaactggagaggctctgaaggtggacttgttgaaccacccaatatacttagaagacaacgcaacctt

SEQ ID NO: 17808 - DNA, 198 bp, Gossypium hirsutum
  Clone ID: uC-gsflnu33B136d02b1
tccgtctaactcattccgcgagtcagaggcggtgctagtgctagatacccggaccaggggcaggctgcattgacagaaaacaggagggggctcagtgaatgggctgtagagccgttgagagatgaacaatattacgagattagggaacctccctacataatgtcggttgggaaaagcccaatgggtctcatggtggga

SEQ ID NO: 17809 - DNA, 456 bp, Gossypium hirsutum
  Clone ID: uC-gsflnu33B136d03b1
tgcatcctgaaaaatttaaaaaccagttggttaatcagagcacttatgcaaagcttggctgtacccaggggtggtttgctgcttctgtttttcatccctcttcaaagaatgttgcccagcttgcaaaagtgaaaatcatgaagaaacatggtcaatggcaggacctccacataccacagagcataaggtcgatcatatgcctcaacttgcccagcttttctggtggtctaaatccttggggaacaccaagtggcagaaaaaagaatgaaagagacttgactgcaccttatgtagatgatggccttctggaagttgctggctttagagatgcatggcatgggctcgcgttgctggctccaaagggacatggaactcgcctggcacaggcacaccgaatccgctttgagtttcacaaaggtgctgctgaccatacatatatgagtatcgatggggaac

SEQ ID NO: 17810 - DNA, 492 bp, Gossypium hirsutum
  Clone ID: uC-gsflnu33B136d04b1
tctcctttggtatgatcgcacccatcaattcttgcgcattctatttatataaaggctacccctgatcgcgcttgagcctcgaatttgaatttaaatacgaccaaataacgtttcgagtgatttattccgtaaataactaattagttatacgatgagatataaaaaaaatagaaaaaaattttaatgagatataaaatttgcgggtgcaacacgaggacttcccaggaggtcacccatcctagtactactctcgcccaagcacgcttaactgcggagttctgattggatccggtgcattagtgctggtatgatcgcacccatcaattcttgcgcattctatttatataaaggctacccctgatcgcgcttgagcctcgaatttgaatttaaatacgaccaaataacgtttcgagtgatttattccgtaaataactaattacttatacgatgagatataaaaaaaatagaaaaaaatataatgagatataaaat

SEQ ID NO: 17811 - DNA, 504 bp, Gossypium hirsutum
  unsure (1)..(504): unsure at all n locations
  Clone ID: uC-gsflnu33B136d06b1
ttcnctgtccaaccccttcccccattgaatttgatattttcgaagataaaaaaggatggggctgtcttttgctaagctgtttagtcgactgtttgccaagaaagagatgcgaattcttatggtgggtcttgatgctgctggtaagactaccattttgtacaagctcaagctcggtgagattgtcactaccattcccaccattggctttaatgtggagaccgtagaatataagaacattagcttcactgtttgggatgttggtggtcaggacaagattcgacctttgtggaggcactatttccaaaacactcaggggctaatctttgttgttgatagcaatgaccgtgaccgtgtggttgaggccagggatgagcttcatcgtatgctaaatgaggacgagctgagggatgctgtgcttcttgtgtttgcaaacaagcaagatctgccgaatgctatgaatgctgctgagattactgataagcttggccttcactcccttcgtca

SEQ ID NO: 17812 - DNA, 90 bp, Gossypium hirsutum
  Clone ID: uC-gsflnu33B136d08b1
aaaacccgggccaaaaacacaaaaaaaaaaggcagaaaaagggggggcccccttaaaagatccaaagttaccgccccgggcatgccacct

SEQ ID NO: 17813 - DNA, 465 bp, Gossypium hirsutum
  unsure (1)..(465): unsure at all n locations
  Clone ID: uC-gsflnu33B136d09b1
tccactcgttncgccacgcgtccgaaggttcatgattcaaataatatagccttcacttgcaaggcccgggggatcaaaaccactgatctgaatcaaggagtgggttatgggggtaagaccgatgagacttcaatggatgaacagctggggaacaaggtagaatatgatggggtatttggaacagcattgaatcgggtctgtgttcaggctgctggcggtcattctctaacagtctatgggaaaggaggccagactaggggttaccttgacatcagagatacagctcaatgcgtggaacttgccattgcaaatccagcaaaacctggggaatttcgggtgttcaatcaattcaccgagcagtttttcgtcaatgaactggccgcccttgtaacaaaagcaggacagaagcttggacttgacgtgcataccatatttgtggccaacccaagaattgaggcagaggaa

SEQ ID NO: 17814 - DNA, 510 bp, Gossypium hirsutum
  Clone ID: uC-gsflnu33B136d12b1
ttatcttcaaaagccaaggtcaaacgaaggcaaaaataaggttttccatggaaggggaagctggttcatacgaggacgttaagccaaacgtcgtcgctaaacaaagtaatggcgatgttgtcggggataatggtgttggaaatctgggatccgttgaagcccctgattttctttccaagaaaaatttccagaactgttccgtggcaactcctgcatctggactgaattccactggccctgctccatctcaactaaccatcttctatgatggacacgtttgtgtgtttgatgcaattcctgtggaaaaggtgcgggagattatgcttattgctgcaactggtgctgctaactctgttgacatgaagaaagttgcaactgattgtgccaccacctcacctgttcttacgaggtctccttcgcttcaaagtactgctactgcaactgctctggcttcaccacaggcacaggtgtttcctactaacaggacccctttctgcatactgaaagaac

SEQ ID NO: 17815 - DNA, 484 bp, Gossypium hirsutum
  Clone ID: uC-gsflnu33B136e02b1
ttcttttttttttctcgactcatccaacctgcaagacactagttagacaacaacaacttgacgacaaccacaatagccacacagcctcaacccggcaatgagaacctgtgaatgcataggtatcaaacgcataccaattccttcttccatgccctcaccaacataccaatgcacgaaagctctcttcgagtacatgagatcgaatttgtgttcaatgctgtcggtggcggaactggctctggtctgggatctttgctgttagaacgctcgccggaggattatgggaaaaagtcaaagcttggcttcaccatgtacccttcaccacaggtctcaacagctgttgtggagccttacaacagagttctgactactcattcccttgttgagcacaactgatgtggctgtgctcttggataatgaagcaatttatgacatatgccgtcgttgccttgattttgagaggccaactacactaacttgaacc

SEQ ID NO: 17816 - DNA, 484 bp, Gossypium hirsutum
  Clone ID: uC-gsflnu33B136e03b1
cccacgcgtccgcaaagatccaagacaaggaaggcatcccaccagaccagcaaaggctcatatttgccgggaaacaactcgaggacggtcgcaccttggccgattacaacatccagaaggagtccaccctccatttggtattgaggcttcgtggtgggatgcagattttcgtcaagacgttgactgggaaaaccataactttggaggtggagagttccgatacgatcgacaatgttaaggcgaagattcaggacaaagaaggaattccaccagatcagcaaaggttgattttcgctgggaaacaattggaagatggaaggactttggctgattacaatattcagaaggaatccactctccaccttgtcttgcgtcttcggggtggtttctaagctctcctatgaaaatgaggtttctggattttatgtgaatgactgtgatgtctggcccctgtaaggcctcataaataaacctaaacctattt

SEQ ID NO: 17817 - DNA, 423 bp, Gossypium hirsutum
  Clone ID: uC-gsflnu33B136e05b1
ttcctttcaacttcgaaggaccaactcgacaatgacatcgaggaaaacaataatctcgatgtattgacccctctcaaccagtccgggatcaccagaacagaagaagaaacatccctagaagggaacgaagatccctcgatgctggagaatatgaattcggacatgggaataaattggtctgccctcgaaggggtgtctcgtgtcaatacgctcgttaatctcccgaggtttattccggaaaaggaggagaaggctgggaagtaagaaggtaccttgcttttcccttggattaaaatttttgtaactctttttttccatgcattttagtgcgggtagaattggaaattcctgtttatcccgctctatattatattttatctctttctcttaactctttatcatcttcaccaccacatggcttat

SEQ ID NO: 17818 - DNA, 449 bp, Gossypium hirsutum
  Clone ID: uC-gsflnu33B136e07b1
tcccctcctttgacaagaggatctcacaggaagtcagtggtgatgccctcggtgaggagtttaagggctatgtattcaagatcatgggaggctgtgataaacaaggttttccaatgaagcaaggagttctcactcctgggcgtgttcgtcttttgcttcacagaggtactccctgcttccgtgggtatggtaggagaaatggagagcgtaggaggaagtcagttcgcggatgcattgttagtcaggatctttcagttttgaacttggctattgtgaaaaagggtgaaaatgatcttcctggactgactgacactgagaagccaagaatgaggggtccaaagagagcatcaaaaatcaggaagttgttcaacctgtctaaggaggatgatgttcggaagtatgttaatacttatcgccgaacctttacaaccaaatccggtaagaaagtc

SEQ ID NO: 17819 - DNA, 515 bp, Gossypium hirsutum
  unsure (1)..(515): unsure at all n locations
  Clone ID: uC-gsflnu33B136e08b1
tctctttctagcgcgtggtacactgaaaccaagttatgccaagggtcaatgccaaaattctaccaaggtcaccgaaacaccacggtgctggttttgcctttgtcaggacaaatccaaaacggtacaggtttgatcatggcggtgcaagagcagcaacagcggacgggaaacatcccattgagactgcgggtgagtcagcctgtgagggttaagcttgggaagttaaagctcatgaaagtgaagttctcggttaggtgcgggttagtggtagatgctttatctgctaacaacaccgtcacaattcaaagtagtagctgcaaatttaggcttagcttgtagagttcctaatttctaacacccgccatattttttacatttatgttcgagaaataaggagggttttaatatatgcggttttgttctcctccatgctatatacttcagtttgttgtatatatttgtaatggngattttattctataatattctttttcttcttttgggaagattatggt

SEQ ID NO: 17820 - DNA, 509 bp, Gossypium hirsutum
  Clone ID: uC-gsflnu33B136e10b1
tcctctcgtccggcaggcttctctatctggtaggatgtctccacgaaacgtagaacctatctcgccaatgagctctcgggtttcaatgttagttcaacgtgagaagcagcaacagttccgcagcctaagctctagggagcttggttctggctcctctgccaccgttggttccccagtaaattcttggtggggatcctccaatgggaaaccggactgggcagtcgatgcagatggctcaggcaagcttcgcaggtcatcttcatttgagcttggcaatggagacgagcccgatttatcatgggttcaatcccttgtaaaagaatctcccactgaggtcaaagagaaaacaggtgtgcctgtttcaggtgtaacacttaatgcttctacaggtctaggttcaagcatgaactctcgaattgatccggtcgatactgcagtgttgggagcatggattgagcaaatgaagcttgatgagctcgtggctcagcataactgaaaaccagtttcac

SEQ ID NO: 17821 - DNA, 482 bp, Gossypium hirsutum
  Clone ID: uC-gsflnu33B136e12b1
tctccctcttccggttcaaggtcatgtgtgaacgcgtattgggtgataaagaacttggtgcagtcacacgcccggtcatagagcttttggattcgccgggcgatggtgggtcaatgaaattcgttagttttcaggcgaggaaaccgtcagggaaacctgaagggacacttgacttttcttacaagtttggggacaaagtttcggagcccgtcggaaagaataagggtgacgatcatcctcatcatcagtctgttcctgcgtatccagcggcgcatgtggcggctggatcgagttctgctgttccgtatggtggtccgggggcttatccaccaccaccacaaggtgctgggtacggttaccctcctccggcgccgcatgcagtggcggtttatggtgggtattcaccgcatgggccgtctccccctggatatggatatcctcccccccaccgtgtattagtattctcctccacccctgggctt

SEQ ID NO: 17822 - DNA, 451 bp, Gossypium hirsutum
  unsure (1)..(451): unsure at all n locations
  Clone ID: uC-gsflnu33B136f07b1
gtccttcttccggtttgctcaggcactttggtttgagatcaaccgggcttttgctgtcctacgggatattgcatcaggaagagatctcaagaagttcctatctgtgatcgccggcttatgggtcttgtctattgtcggaagttggtgcaacttcttaacactgttttacatagtctttgtacttcttcacacagtacccgtgctttacgagaaatacgaggacaaggtggacccatttgctgagaaagcaatgcatgagattaagaagcagtatgcagtgtttgatgcaaaggttctaagtaagattccaaggggaccattaaaggagaaaaagaaggattagatttaccggccaagagggtttctgacatacatttggtagctgccttccgtgaaaatgtgttatttactatatatcctgtatcagntagaacccttgttgaatattttt

SEQ ID NO: 17823 - DNA, 512 bp, Gossypium hirsutum
  Clone ID: uC-gsflnu33B136f08b1
tttccatgcgtccggattgctgtaaaacaatggcggattaccatttcgtttacaaagatgtcgaaggagcttccactcaatgggatgatattcaaagaaagcttgggaatttacccccaaagccaccagctttcaagcctgacccttttgaacctgcacctgacccggattccgtccctaaggacaagtcttggatcgatgaaaagactgaagaagaacttgaagaaatcgaagatgatctcgatgatgatagattccttgaagaatacagaaagaagaggctggctgagatgagggaagctgctaagatttcaaagtatggatcggttatgccaatttccggatccgatttcgtacgggaggtttcgcaagctcctcaggatgtctgggttgttgtcattctctacaaagaaggatttctggagtgtggactgcttttgcagtgtttggaagattggcagttaaataccctgcacaaaagttgcaagatatatctacagattgcattctac

SEQ ID NO: 17824 - DNA, 502 bp, Gossypium hirsutum
  Clone ID: uC-gsflnu33B136f11b1
ttcctgcttccggattattaaggttttaggtaccccctctagggaagaaattcgctgcatgaatcccaattacatggattttaggtttccacagatgaaagcgcatccgtggcacaaggtttttcacaaaaggatgcctcccgaagcaattgatcttacttcacgactcctgcaatactcacctagtcttcgctgtacagctcatgaagcatgtgctcatcctttctttgatgagcttcgagaacctaatgctcgcctaccaaatggtcgacctttaccaccacttttcaacttcaaacaggaattatctgaggcttcaccggagctgattaagaagttgattccggatcatgtgaaacgacagatagggctccaacatttcatgcatccagccagaacataaaacttcaaaattgatacaagactcggtatctcctagtcgacatgggacacaaaggaaagtactatcattggataaccaccatcgatctgagcctgtctc

SEQ ID NO: 17825 - DNA, 454 bp, Gossypium hirsutum
  Clone ID: uC-gsflnu33B136g02b1
tcctccaagacaaagcttcatattatcttttttagttccgacaaaagaaaacgaaaaaaaagaagaagaaatacaatcgttttctttttgaagtcgggttttagtttttggggtgaaaaaaatgttgggagtatttagcagtgcgatagtgtctccgccggacgagctggtggcggccggttgccgaactccatcacctaagataacggcggacgctctggtgaaacggttccttgagacgaactcctccggcgtgtccatgcacatcggagaccatgtccaattcgcttattctcaccataaagagtctcctttacagcccagatcatttgctgtgaaagacgaaatcttctgcttgtttgagggagcccttgataacttggggagtctaaagcagcaatatggtctggcaaagtcagcaaatgaagtgatattggtcattgaagcttacaag

SEQ ID NO: 17826 - DNA, 409 bp, Gossypium hirsutum
  Clone ID: uC-gsflnu33B136g03b1
tgttagtgatggtcctcattggcgtcctccgctacttcgtctccaagcttatgcgctcctttcaatttcccgatcttaagatagtcaaagaagggcaagtaatcgttagggctcggaatctacgaggtgctgcaaattttatccctcccaagtcttttcgttctcgcagggcttatttcagcaatgaggaaaatggattactgcttgtccccaagggccaggctcagaatgcacaagcacaaatgttctctgaccctaacatggctatggacatgatgaagaaaaacctttctatgattatacctcagactctcacttttgcctgggtcaactttttcttctctggatttgttgcagccaaaatacccttcccattaacccagaggttcagatcaatgttgcagaatgg

SEQ ID NO: 17827 - DNA, 371 bp, Gossypium hirsutum
  Clone ID: uC-gsflnu33B136g04b1
tccctttgaaaccacaagctgtaaacacaatgtgataccatttggatgcatggtaattattgaacagtagtaattctgtggtcatatatagtaacatgttttattcagtttgcctcatttgtttgtgttgtcttctgggtgatcatttctgttttttaaatgttgctgctatctatggatacttgttttgaaatctccctgtgctgtaaatgtgttctataatttgcaataatgtattatgcaaaaataaaaaagaaaaaaaaaaaaaaggaaaaaaaatataaaaagaaccaaataatacatacaaagaaataaacgaccgaggtcgtctatagaatgaccttcaccaacattaccggctgatgtttcac

SEQ ID NO: 17828 - DNA, 472 bp, Gossypium hirsutum
  Clone ID: uC-gsflnu33B136g07b1
tcctttcttccgaaaaaagttgtagcaggcaggcaggtaggctcactcagatgtctaagtcaaggttggaaggtaaggtagctcttatcactggtgccgccagcgggattggtgaggagacggcgaggttatttgtggaacatggggcttttgttatcattgctgatgtccaagatgatctcgggaacaaagtcgcggcatccatcggcctagacaaggttagttactgtcactgtgacgtaagagacgagaagcaggtagaggcaacagtgagttacgcggtggagaaatatggaaggctggacattttgttcagcaatgctggtgtctatggaccgttacctgggatcttggaacttgacgttaatggcttcgacaacaccatggccacaaatgttcgaggtgttgcagccacgatcaagcatgccgctcgtgctatggtggctaaaaacatacgcggatccatcatatg

SEQ ID NO: 17829 - DNA, 457 bp, Gossypium hirsutum
  Clone ID: uC-gsflnu33B136g09b1
tttcctcttgctcaagaggaccaaattctataacctcggagatattgaaaccagacatgattgctccaggggttaacattttagcagggtggtccggtgcagtaggtccaacggggctggctacggataccagacgagtggattttaacatcatttcaggaacttcaatgtcttgcccacatgttagtggccttgcagggttgctgaaggcggctcacccagattggagtccagcagctattagatcagctcttatgactacagcttatacggaatacaaaaacaagcagaaaatgcaagatgttgcaacggggaaaccatccaccccgttcgaccatggtgctggacatgtggatcccgtttcagcgcttaatccagggcttgtgtatgatttgacagcggaagattatctgggtttcctttgtgccttgaactacacagagttccaaatcagatc

SEQ ID NO: 17830 - DNA, 374 bp, Gossypium hirsutum
  Clone ID: uC-gsflnu33B136g10b1
tccatgcgtccgggaaaatcatgggtgccaaagttctcttcttctttgctttgctttccttttcagctgtgtcggcatttgcacaggatgaggaagaccaaggtcttgctatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagcttgtgaaagggaatgtcct

SEQ ID NO: 17831 - DNA, 476 bp, Gossypium hirsutum
  Clone ID: uC-gsflnu33B136g11b1
ttgtgttaagaacttaaccggactcgtcgggtgggtacggcatgaacgcaaagttgcgtgagttggctaacctcgtagttgtaggtggtgataggcgaaaggaatctaaagatttagaagagaaggctgaaatgaagaaaatgtttgagctgatcgacaagtacaacttgaacggccaattcagatggatatcatctcaaatgaacagaatccgaaatggtgaactttaccgatacatttgcgacacgaaaggtgcctttgtacagcctgcattgtatgaagcctttggattgactgttgtggaggcaatgacttgcggtttgccaacattcgcaacctgtaacggtggaccagccgagattattgtccatgggaaatctggtttcaacattgatccttacatggtgatcaagctgctgacatactcgtcgatttttttgaaaagtgtaagaaagatccatctcactgggataaga

SEQ ID NO: 17832 - DNA, 370 bp, Gossypium hirsutum
  Clone ID: uC-gsflnu33B136g12b1
ttccatcctccttatctggaaagacaaggggaacagcctagggaaggtttcctgctgcttgtaaatcttcttgaggaccagatgggcggtactgttggttacgtggattggataatgcaaatacatcgacaagtccaacaaaatgcatgatatacgggagttcatcatcttacgtcataaaactcatctgtattgtccggtttcctctggagcttgtgtgttgaaccgatggaaccgatcggtctgaagatttgcaggaaagaattttttgttcattacgaaattcaataactaggaaaagagagaaaacagctgtgcttctagctatttgctatttgagtgcttgagaattcaagttgaaaacaaacga

SEQ ID NO: 17833 - DNA, 505 bp, Gossypium hirsutum
  unsure (1)..(505): unsure at all n locations
  Clone ID: uC-gsflnu33B136h01b1
tccacgcgtccgcccacgcgtnccaacctcgccgagcaagccgagcgctccgaggaaatggtcaggtcatggagaacgtcgtctccgccgtccctgcccccgacgaactcaccgtcgaggaacggaacctcctctctgtcgcctacaaaaacgtgatcggcgctcgccgtgcctcttggcggatcgtttcctccatcgagcagaaagaggaaggacgtggcaacgccgaccacgtctctgtcatccgtgagtccagggccaagatcgaggccgaattgtccgagatttgcgccggaattttgaagcttctcgccggagaatctttttccgcccgcggcacccgttgatcccaggtcttttacctgaagatgaagggagattcccctatggccctggtttgtttaaaacatggccaatcacaggaaagcgtctgccgataacccgctcactgcgtataaatctgctcaggacattgcgaatgctgagctggccccaactcatccta

SEQ ID NO: 17834 - DNA, 464 bp, Gossypium hirsutum
  unsure (1)..(464): unsure at all n locations
  Clone ID: uC-gsflnu33B136h02b1
ttgccgagccgagccacgctttccttcctaccataggnccagaggaaaaaggggcggtgtgaattttcccaccacgggtaagtttaagactccaccgagcaagggtcatatggtactggccgccgcagttagatacctaccatggggtgccacctaggccttcttcaggttatgagctcaggtcctatagtgcttcctatgcacagtctcagatggctaacaacagggacttcaagttgaagaaagggaagagcacttctgcttcatcttcaaaatcatggagctttgctgaccctgagttccaacggaagaaaagggttgctagctacaagatgtacagcgttgaaggtaaggccaaagggtccttgaggagaagctttaggcggcttaaagtgaagtacacacaagtcgtttatgggggcggtgattatggcagcttttgttcatcttatgcttatctttgc

SEQ ID NO: 17835 - DNA, 344 bp, Gossypium hirsutum
  Clone ID: uC-gsflnu33B136h03b1
ttccacgcgtccgcccacgcgtccgatcgctgtcatggctgggttcgcgcagcgagtaaaggtgcgagccaaggagctcatggttttcttcaagaagggtgtgaagatcgtgggagaatcatgcacgaaaggctggtacaaagtcaagcacatgagaggctgatgctttcgactcacatcatcttgtgttcttctcgatttccatgtagagatctttgtgagtcatcttgatttggagggttttctttaatttattgaaggattgtaccctagtttctgcttaagaaaagggttgctagctacaagatgttcagtgcagaaggtaaggtcaaagggcccttgag

SEQ ID NO: 17836 - DNA, 373 bp, Gossypium hirsutum
  Clone ID: uC-gsflnu33B136h04b1
ttttatgctatgggtgatcatgggagcaatgagttgtacgcccctctatcgctatgatgaactactagatagcgaaaaagagaggaccctagcctttggcttagtgcgtggcagatgaagaagctacaacatctaccatgcatattataattcaacatagcacccctgtgtgaacaaaggtaagatactactacacagctaatgtatcacatgtatacgccaggtatctcaatactgacccaagatgataatcatagcgagtgctcactgatgtcattgtcaccatcaaggcaacatatactggactaatatctcatgagatccaaattagaacctatacgcactcacaacatgattacatcattccatatta

SEQ ID NO: 17837 - DNA, 514 bp, Gossypium hirsutum
  Clone ID: uC-gsflnu33B136h06b1
ttctctttccttatcattcattttggtctcccaagtttcaccaaaagaaaccccgtttcacattcaaagcctttgatgcactcatagtaaggtaacatcacgtctacctcttcattcatctcagaccaatccgattcgccgctatgtcaatcaaaaccaaccatttccatcctctatttctatttctgaccatatgcttcctaatcgccactgttgcataccccatcgacgctttggaatcaaggaagcttgacgagagcacggtaccaggtgatcaaggcatcaagtgtaccccatcatgcgtacaaagtcctccaccatccgtctgccgtcttcaccatgccctccaccaccatcaccgcctgctcttccgccgccaccaccaaaaaagtcgccatcccaatactgtccaccaccacctagtccgccttcctttatctacataactggtccaccggtgaacctgtaccctattgaccaaaatttcggtgctgcaagccgcacatttgagatg

SEQ ID NO: 17838 - DNA, 267 bp, Gossypium hirsutum
  Clone ID: uC-gsflnu33B136h07b1
tccactcgtccgcccacgcgtccgaactcgccgagcaagccgagcgctacgaggaaatggtcaagttcatggagaacgtcgtctccgccgtccctgcccccgacgaactcaccgtcgaggaacggaacctcctctctgtcgcctacaaaaacgtgatcggcgctcgccgtgcctcttggcggatcgtttcctccatcgagcagaaagaggaaggacgtggcaacgccgaccacgtctctgtcatccgtgagtcagggccaagatcga

SEQ ID NO: 17839 - DNA, 323 bp, Gossypium hirsutum
  Clone ID: uC-gsflnu33B136h08b1
ttcccaccattttccttgaggaatatgtgtttgagatcttgccacaactttcactggaagactacaacagatcaaggtcatatggtactgggatgatgcagttagatacctaccatggggtgccacctaggccttcttgaagatatgagctcaggcgctatcttagttgctatgcacagtatcagactgttgacagcagggacttcaagttgaaggacgggacgagcccttctgcttaatcttcgagatcactgagctgtgatggccctgagccctagcgggagacatggagcgctagggacgaggtggtcactggcaaaggt

SEQ ID NO: 17840 - DNA, 391 bp, Gossypium hirsutum
  Clone ID: uC-gsflnu33B136h09b1
ttctttcgtccggctgccccaagacccaaatacaatcaaggaccgagaaacacacagagattgccccccgtaccaatatctgaaccatgttcgaacttatccgacattcatgttcggcggatctctgggagcacatgttgctactgtcgcattcgtacggaactaaaggtaactgaaggctaggtctttgggattggtggttgacccacataacaccatagatagataatatgtatgtatatatttaattgcacaatcatggtctgtctcccaagtggctctgcacctttggtttattgttgctgaaatgctttaatgaaattgatctccttttgctggcaaacaaaatagcaccctctaattacaatttatatcctatattaaaaacatg

SEQ ID NO: 17841 - DNA, 416 bp, Gossypium hirsutum
  Clone ID: uC-gsflnu33B136h10b1
ttactgcttccttagggtttcttcaacccccaaatggccgccgttcagccttatgccagagccccaatcacgacgaagccggcaacaactaggtgactccaacgaaaggtactgtgtgcggggaaggcgcgagattcgcggcggcgaggggcgcgatgtgcgggatcgacgggcgcaacgcgagggagcagttgcagcaccagctgctgcgacactgaggcaggggctgttagggtttctgaaattctgatgctctttgggctaaggtctaaaaattagttgttgggcctgctactggtttgggcccgtttattggtttgtgcctgggcattattgggtttggacagcatgttagatcaaagaacaaattgattcttttgcgaaaaatctcatccctttttactgttaaaactgat

SEQ ID NO: 17842 - DNA, 301 bp, Gossypium hirsutum
  Clone ID: uC-gsflnu33B136h12b1
tcgttctggtggtgagaatttaataatacccgaactttttgtaacacaatcacgagggcacttcagcgctgctggtaaatgttgttccggcttgttgtcaaagcccacataccattgtgtggcacatagtcctcattgatgttgttggttcagacacattagggctgcctctgctcattctggaaacgcaatcaccggggcctgcttatctgacagaggcactggcagtgaccttgcatagcattaatcatggggggttgctgaccctgagttccaacggtagaaaagggctgctagctac

SEQ ID NO: 17843 - DNA, 468 bp, Gossypium hirsutum
  Clone ID: uC-gsflnu33B137a01b1
ttctatgcgttcgtccacgcgtgcgcattgctatatagagtatgcagatgcgaatattgcacgtactgtgcaccacaggtgggagggtgctgagacccctaactctggcgctataggtatgccactacaatatacccagaatgctatcggtagaaggaaagactccaatcatcccattgcttctgctgacgccaatggggctccactagctatgacttaccactagatgaggggctgttatctttatatgctccaacaaagacaactgctacatgctacgatgcatcatgcagctattgcctgcacccaatacataggcaccatggacattatcatcccttctcatgtctttgaatgcacatagcggtatcatgaacacaccatgagctcatgtatattcgaatatacctaacacatgcatgtgtctgcagcacgggatgataagcgtgatccgacacgaaaatgctg

SEQ ID NO: 17844 - DNA, 490 bp, Gossypium hirsutum
  Clone ID: uC-gsflnu33B137a03b1
ttctcacgcgtccgcccacgcgtccggaaactggtcccaattctctcattttctaaattcagggtttttgaagttttggattttttttcaatggaaaaagaattagatgggttagggtatttacctctccgcataattctatcaaaattatctccttcagatattattaaagtttcttgtgctaataaaaggcttagaggttcagcttctgacgattccctttgggctcaaatttgttatcaagaacttcagctttcaacccctcaagatgatcatggaaaccctctaccttgttttatgttagcttatcagttgtggcgagaggctttctcgatgtatccatggccgctcgttaaacgagttaaaagatgttgggataagcttaagaaatggtttaacaacaatttcccggaggctgaggcgacacttagaaggggtgcatcggaatctgatattgaacaattacaacacttttaaaatcaaattgccg

SEQ ID NO: 17845 - DNA, 385 bp, Gossypium hirsutum
  Clone ID: uC-gsflnu33B137a08b1
tcttagagagtgggtcgatgatctttagcgatgaggtgttgatagaggtgagtggattgaagaaaggaagagattttatagaagtcacatgtgggtgtaccagtcatagatatggtgacgctgttggcaagcttagggttttctctaatggtgaccttgaaatcacctgtgaatgcacccctggttgcaatgaagacaagttgactcctgctgcatttgagaagcattctggaagagagacggctagaaagtggaagaataatgtttgggtgatagttaatggggagaaaggtttattttatcaaagaactgcattgctgaaaaactactaccaagcgtttaaaaatgccaatggaactaacaggatcccataatggtagagttt

SEQ ID NO: 17846 - DNA, 456 bp, Gossypium hirsutum
  Clone ID: uC-gsflnu33B137a12b1
tgtgatctgcagaatcagagtgtaaaaaaggaaggaaaaaaaggctaaaagaatgtttttgcgaatgatatcgcggccgttgttggctaaggtgaaggagacaacggggatcgtcggattagacgttgtacctaacgcaagggaagtccttatcggtctctacaacaagactctgaaggagatccaggccgtacctgaagacgagggttaccgtaaggccgttgagagcttcacgcgccaccgtctgaaggtttgccaagaggaagaagattgggaaatgattgagaagcgccttggatgtggccaggtcgaggagctcatcgaggaagcgcgtgacgagctcactcttatcggaaaaatgatcgagtgggatccatggggtgttcctgatgactatgaatgtgagggtatcgaaaatgatgctcctattcccaagcatgttcctcagcaccgacc

SEQ ID NO: 17847 - DNA, 296 bp, Gossypium hirsutum
  Clone ID: uC-gsflnu33B137b01b1
ttatataaaaaaaaaaaaaaaaaaaaaaaaagaaagaatatttaaaaaaaaggatcggaaatcaaaaagaaacacaacttaagggccggccccatccaacgatatagcaatcctagggggtgccctcagggggtcccactcttcctggccctccaccgccctcgcttgggatgtccctctgttgttcccctaatttaactggcttgtcctccatctccctctggttagcttgggtaatccccacgaggctccccccggttgccctttcaaacatctgcgcctcccccatggccttt

SEQ ID NO: 17848 - DNA, 321 bp, Gossypium hirsutum
  Clone ID: uC-gsflnu33B137b02b1
ttggtattataaagagatttcttaaattaagtgcttgactttcattagctctcagtatctgaatcaggaaaaccattggtggtcctcgagaatcaaagggaaaactccaaagaatattgaagaatatgcaagctgaataagtggtgattcataagaatttcccatttgttttaaatatttcgtttctttagatagtaaagtttgtcatgtaaacaatcatgataaagtaaaaaaaaaaaaaagagcaggtactaaagcaagcactattcttgctactagtaagttgcatatgtgtaaatacatcagcaaaagcaagtgcac

SEQ ID NO: 17849 - DNA, 521 bp, Gossypium hirsutum
  unsure (1)..(521): unsure at all n locations
  Clone ID: uC-gsflnu33B137b03b1
tcctacgcgtccgcaccgtttcaccgttaactaattgttctaaccttaaactagtttatctttctgataatgatttctccggagacatcccaccggaaatttcgcgtctcaaaaggttgctccgacttgatttatcaaacaacaacatacgaggcaatgttcctaaagaaatctctggtttgaaacggcttattactctcaggcttcaaaacaatgcattaaccggcgaaatcccagatttcttttcttcttttaaaagcttaaaagaacttaatttaaccaataatgagtttttcgggcggttacctggaagtttactgaaaaaattcagtgaaaaaagctttgtaggtaacgaaggtctttgtggatcaaacccatttccggtttgttcttttacaggttctcctccgttggatacgccgacccaaacagttccatcgaacccaagttcaatgccgagaacacctataattgaacangagagacccaaagcacataaagggttaacccctggtgctata

SEQ ID NO: 17850 - DNA, 409 bp, Gossypium hirsutum
  Clone ID: uC-gsflnu33B137b04b1
tcattttcgtgcggaccggagaggcgatgactagttcatctatccaccaactggtacaggtgattgagaatgcatgattccgagacaccggaccgacaagttgaggtcttataaggtggcgcatgcttgtgttatctgacaccagcatgcgcaggaatgacactaacgagacgtttggaccgaaacggctaacaactataacgctacaaacccatgcgttatctgtgaagaaaccgaatggccattctgcttataaaggcttattacatcttaatttaacccatattgagaatgagggacggtgacctgttagtttactgttaaggttcagtgaagaaagctttggttgtaactggagtgttggtggatcaaacccatttccggtttgttcttttacaggttctccttc

SEQ ID NO: 17851 - DNA, 474 bp, Gossypium hirsutum
  Clone ID: uC-gsflnu33B137b06b1
taccttcactccgccatcttcaataatttcttccgttgatctttgttagagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacgtacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcgaagaaggttatcatttctgctcccaagtaggatgctcccatgtttgt

SEQ ID NO: 17852 - DNA, 535 bp, Gossypium hirsutum
  unsure (1)..(535): unsure at all n locations
  Clone ID: uC-gsflnu33B137b09b1
tttgaacggccaattcagatggatatcatctcaaatgaacagaatccgaaatggtgaactttaccgatacatttgcgacacgaaaggtgcctttgtacagcctgcattgtatgaagcctttggattgacagttgtggaggcaatgacttgcggtttgccaacattcgcaacctgcaacggtggaccagccgagattattgtccatgggaaatctggtttcaacattgatccttaccatggtgatcaagctgctgacatactggtcgatttctttgaaaagtgtaagaaagatccatctcactgggataagatctcccaaggaggcttgaaacgtatcgaggagaagtatacatggaagatttactcggagagactattgaccctgaccggagtgtatggattctggaagcatgtttccaaccttgaacgccgtgagagtcgtcgttaccttgagatgttttatgctcttagtaccgcangctggctgaatcagtttcattggcagaggagtaaaattaagctgttaaataacatt

SEQ ID NO: 17853 - DNA, 305 bp, Gossypium hirsutum
  Clone ID: uC-gsflnu33B137b11b1
tactttatcgagtttgtactgaaggcaccgaggtagtttcatagcctcgtgatcggcggcccttctctatttagatcttaattttcccaaaaggaaagaaccgttatacttgtatgattgttcttggtttttatttaggtttgccattagaagaaatgcctgaatgactgtttctcaatggcggaatcatttgtgagaattaggataggttaaagttttaccattttctcgttgtacatcgcacacattttaaccttgtcattttgtcacgcttttgaatatccaagtccacttcttcttctttc

SEQ ID NO: 17854 - DNA, 366 bp, Gossypium hirsutum
  Clone ID: uC-gsflnu33B137c01b1
tttaatttttattttgcatacaagcattgggcgtatttagctctttcttctcccctttaatctatatttcttttcagttctttggggtggtacattcaagaaaaaaaaaccagtgaaaaattaaaaaaaaaaaagtggttatttgttattagatggaaatttttcagacaattattgtaattacaacatctctgatgctgctgagttcgggcgtttcttcagacaacaccatcaccacttcaaacacgacatcgaagtaccagatcgagtgcaccatgtgttcatcatgtgaaaatccatgtcagcaaactccattcgcgccaccaccatcttcaccgccgcctaaccattttaccaccacctaca

SEQ ID NO: 17855 - DNA, 536 bp, Gossypium hirsutum
  Clone ID: uC-gsflnu33B137c02b1
tcctcgcgtccggtctttgcaaggtcatcaaggatgtgctgggtgacaaggttgaaaaggttgtggtttctgatcgtgtggttgactcaccttgctgtttagtgactggcgagtatggttggactgcaaacatggagagaatcatgaaggcccaggctttgagggataacagcatggctggttacatgtcaagcaagaagacaatggagatcaacccggagaaccccatcatggaagagctgagaaagagagccgatgcagagaagaatgataaatctgtgaaggaccttgttctccttctcttcgagactgctctcctcacctctggcttcagccttgatgagcctaacacctttggcaacagaattcacaggatgctgaaactcggcttgagcattgatgaggatgcaagtgaaggtgaaggtgatgctgatatgcccccattggaggatgctgatgccgaaggcagcaagatggaggaagttgattaagccttacatgtttttataagatcagtagatttatcttactttttg

SEQ ID NO: 17856 - DNA, 440 bp, Gossypium hirsutum
  Clone ID: uC-gsflnu33B137c03b1
gttgtgccacatagggtgttgggcccacctattggtgccaccccttttaatcctgatgtctatagggaacccatgttgtcatcttcaccagcagtgtcatttccatcaactcctttccagtatcctgttttcccctttggaacaacatttcctcttccttctagtagcttttctgttagctcaactacttacgttgattcatctacgggtgggaggttttgttttcctccagttcattcgcaattgttacgacctgctggtgctgtaccatcccattacccgaggtcctatgttgttagccttccttatggtagcaatagtagtggtgctgagaacggtaggcattggggaaggcaaggtctagacttaaatgctgggcctggagttccagacattgaaggaagagatgagttcgcacctcttgcataaggcaactgtct

SEQ ID NO: 17857 - DNA, 462 bp, Gossypium hirsutum
  unsure (1)..(462): unsure at all n locations
  Clone ID: uC-gsflnu33B137c04b1
tcccacgcgtccgggagagccttttttgtgtagcgattctcagttagtcttttctttaagcttacagcttctctccagagttttataatgggtaaggagaaggttcacatcaaccttgttgtcattggccatgtcgactctggcaagtcgaccactaccggtcatttgatctacaagcttggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattacccgtacctcacaagctgactgtgctgttctcattattgactcgaccactnngtggtttgagctg

SEQ ID NO: 17858 - DNA, 113 bp, Gossypium hirsutum
  Clone ID: uC-gsflnu33B137c05b1
ttcctcgcgtccggggacgcatggacggaggcggggtttaattaatatatcgtgagttaacttccagatgagacgaaaggtccaatacgtgtagaaattgtaaggagaaaagc

SEQ ID NO: 17859 - DNA, 418 bp, Gossypium hirsutum
  Clone ID: uC-gsflnu33B137c06b1
taggtcgcgtgggcggacgcgtgggtgcgtgaatgtctattgaatgctatccttcactttctcgagaaaaacaaatgggttcaggttgcaattgcggatctagctgcaactgcggcgacagctgctcatgccccaggaaccttaaccttggatactcggcgaggacacccagcactcagaccatcatcttccgaggggccccagtgaagatcacctgtgagggaccagacatgagcactactgaatcaggacatggatgcacgcgtggatcacactgatcttgtgagccatgcaactgttgaaaagcttgacgaaggccctagactatgaaaaaagaaggctggacagtaacaggcctctgcaacgatttatcactaaggatgaatgcctgcaagggctatgactataattatgactc

SEQ ID NO: 17860 - DNA, 458 bp, Gossypium hirsutum
  Clone ID: uC-gsflnu33B137c08b1
tctcacgcgtccgcatgccagcacgggggtgcgttgaacttagccaatagtgaacccaaacccaagtcccgtaacttgaatcagaacccaaacccaaacgcgaaccctactgttttggctcccagagatgatggaggcaaagtaagctcaatggtgggccctgagaacacctatggctgaggcaaccaatgttgaagcatagaaagaatggaagactgctgcagggtatgcatctgatagaaagagagaaacgaggaaagctaaaggtaggccattgggggtacagtttgtatgttgctcatgtgccaattaggattataaatgatttgggacctatgttactcatgtcttggatgagtatggagatataatatgttagtaggcaaaacttgaaaaagatcttactggaatgggatttctacacttgaatccgagtccaagttacataggttaatact

SEQ ID NO: 17861 - DNA, 282 bp, Gossypium hirsutum
  Clone ID: uC-gsflnu33B137c09b1
tgagggaatacagttttatattccaagtatgcagggaatgacttcaaagggaatgatggaactagttatattgctcttagagcatctgatgtaatggctgtgctttcttagttgtctgataaaacatatgctgctaggttcacaactgaaatttatggatgagttttcgatgaggcacaaggattttgtatttttcttttaatcttcgatataaatggtgctagctttgttgtttgccctggtaaaaaaaaaaacataaaaataacaaaaatatataaaaca

SEQ ID NO: 17862 - DNA, 495 bp, Gossypium hirsutum
  Clone ID: uC-gsflnu33B137c10b1
ttcttcccacgcgtccgcggacgcgtgggttcaccgggagtctctttttcagatggcaagcatgcaaatgctgctgagtttgcttcaggtgccagagcatttacggaagggcttgaagctcaagaaatatcttctgaggagaaagctcttatgacaaagctgactgaggagaaaaataaggcaattcaacaaagtaacaagcttcgccatgaactggatctgttcaagcgcgaaggcagcaaaagcggtggtggtgtgtcattcatgtttgtcatgttgatcggcttgctcggcataattatgggatatatcatgaagaagtggtaagcgaccctggtccttctgaatattttccctcaacttaccttcctctggacaagcatgatgaaggaaaaggaagaggaattagtagtcgttggactgcttcaccttcaattggttgttacttggtagctttgagcaaattagcagaactttttatggttggttcctatt

SEQ ID NO: 17863 - DNA, 423 bp, Gossypium hirsutum
  Clone ID: uC-gsflnu33B137c11b1
tacttggaagaggccaaggccacctatgaaaagaaccacaagcatgacagagatcacttttgatctaaacaccaccaccaccaccaacgccgaacctccaccctctgatccacataacccttttaacaactaccccaaacaggcttcccctttcggtggcgcagcaccttctgtagctgttgctggcggtggtgttggacttgaagggttggatcaacggttgttggcgacggtgtcacctagagttcatagaaggcattcagctgattttatggaaacacctcatttcttaaggtcttgcggtctttgtagacgtcgccttgttcctggccgtgacatctacatgtataggggggatacagcattttgcagcttagagtgcaggcaacagcagatgaaccaagatgaaaaaaaggataaatg

SEQ ID NO: 17864 - DNA, 111 bp, Gossypium hirsutum
  Clone ID: uC-gsflnu33B137d02b1
taaatataaaaaaaaaaaaaaaaaaaaaaagaaaaaaaaaaaaaaaaaaaaaaaaaaaaaaaaaaaaaaaaaaaaaaaaaaaggaaaaacgaatttaaaaggataaggggg

SEQ ID NO: 17865 - DNA, 342 bp, Gossypium hirsutum
  Clone ID: uC-gsflnu33B137d03b1
tcgttcgcgtgggttttttttttttttaagataaataaatagcatgtaataaaaagacaatttgttcatcaaaataaagagttaaagtcacgaatgagacgttatgatgatatgagactgctactcaaaacactactaaacaaaaccagaaccaaaacgctttcgaatacaaaagaacactaccacttaaaagcaaaataaataaaaatagaaagagatagggaaagggaaggggatgggaaaatgatggggaatttggtctcttcttgtttgaagatgaccaaatggtttgaaataaaagtgttttgagggatgtgtggaagaatatatagtatttgcctt

SEQ ID NO: 17866 - DNA, 413 bp, Gossypium hirsutum
  Clone ID: uC-gsflnu33B137d05b1
gcccgcacggtaccggcccggcctgactggctggacccacccagcgcttcctttcgtccgatcctatactcaacttcttccacttaaaagcaagttagctagctagggttttgtgagccagagagatgggttcaaaaagaacggcatcactagccctcttctttgcactcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctcttatccaaggtcttgctgatcttgaagct

SEQ ID NO: 17867 - DNA, 479 bp, Gossypium hirsutum
  Clone ID: uC-gsflnu33B137d08b1
tttttcaagcaatgaatatgaaccatctcatcgagatatcctttatgctgaagggatcacccaagggaatggtttggcattcatagagttttctcttgatgatcgtagtccaacgtctgaaacctacactgacaatttggaagctccatccctccccctgaccaagtatcaacttataagggtaaatgcaaaggggatgaatgagggatgcaagtgggtggaaatgtttgaagatgtgcgatctgtagtcttctgcgtggcccttagtgattatgatcagatatcgatatcaccagagagcagtggcagtggaacgctacttcaaaataagatgttgcagacaaaggagctatttgaaacaatgataaggcatccttgctttaaggataccccatacgtgttgatactaaacaagtatgatctgtttgaggacaaagtcaatcgggtgccgttaagtacatgcgagtggttcatggatt

SEQ ID NO: 17868 - DNA, 463 bp, Gossypium hirsutum
  Clone ID: uC-gsflnu33B137e02b1
tgttccttgaaggaattagacctggatgtgcaccacgctagtgtatcagtagtgaaagacttgatgatccaacaagccaatgtgaagatggggagccggtttttcacgcaggagcaattaaaatcagccctaacaaccaaacttggagatgcaagatagagagtattgagcagagcttgattgaaagatcattgtttaaaatggctgcagggttctgggatattttaaggctcctggtagcacgagctctgtaaaataatgttctattttggtcttattactgtttagtgtagttaataatagtttgagaggtggtgttaatgaatcaggagcttaactggttagcaggtggtgggttgatttcccaataactttaaaaacactggtttaacaatttgttgagctccaatcaagtgaaaatagcccccccccccccttttttttgtggtaaatcttgtagtat

SEQ ID NO: 17869 - DNA, 447 bp, Gossypium hirsutum
  Clone ID: uC-gsflnu33B137e03b1
ttcctttcttcactccagtttctcctttccctcttcgaagaaaaaatgcgtgagatccttcatattcaaggtggccaatgcggcaaccaaatcggagccaagttctgggaagttgtttgtgctgagcataggatgatgctgactttctcggtcttcccatctcctaaggtctctgatacggtcgtggagccttacaatgccactttgtctgttcaccaattggttgaaaatgctgatgagtgtatggttcttgacaatgaggccttgtatgacatctgtttccgcacacttaagctaaccactcccagcttcggtgatttgaaccatttgatatctgcaacaatgtctggagttacatgctgcttgcggttccctggtcagctcaacttcgatctcaagaaacttgccgtgaatctcattcccttttctcgtcttcactttttcatg

SEQ ID NO: 17870 - DNA, 431 bp, Gossypium hirsutum
  Clone ID: uC-gsflnu33B137e04b1
tcggtactagctaccatcatacatgatcttttcccacacaccgaagattattatttctgaaagagatgacatgatgctggagtgggtaggagatcatcatgtaagcctgtttttgttctactgaaaaaagtcgtatccagtgcgtaaggctaccgctataagcaagaactagaaattcccattgtaggcacaaccattgtcggtgtttgtagcgaataaacctgttagtctacattaagttataaaaccttcctagtcctagcgtttgtgagtaactttaagattctatcagtcatgagtccgaacgagtccctgtttcaaagcatgatctttttagtttgtaaagtgcattgcttgttgaacttttatggtgcgtgtttgaatgatgaaagacctcgacatattatctatacagtgtgtgacttgcttgc

SEQ ID NO: 17871 - DNA, 495 bp, Gossypium hirsutum
  Clone ID: uC-gsflnu33B137e05b1
tgtttgtgttttttttttgtgatctaatctaaattttacagactcatgcctcaatgatgaacactgctaacatgccatttacacgacatggagtgacaccagcaaccaattcgatgaattttcaagggggagggttctcaattgaaaaacttaagcctcatatgatgattggtgccaagatgagcatcgctagcacttcatcccatgaagctatctctaaaggacaagtgaactactcggatcaagagagtgaagggttgcttaatcgtaaccggatgaatgattcaaggcggagtataggtattaaaagaagctcggaagctagagaaaaaggcacagaggaacaatcactagagccgaaaaataaaaaattaaccctcgaagagcttggagagagagatgggaagcaaataaacaagataatgacagatcggcttaacagacagatagagcaagacattaagtcagatatggaattagtgcacaccaagaaat

SEQ ID NO: 17872 - DNA, 464 bp, Gossypium hirsutum
  Clone ID: uC-gsflnu33B137e07b1
taagggatctcatggccaccactggaaacaagaacatcaatgctaaattagttctacttggggatgttggagctggaaagtctagtcttgttttgcgcttcgttaaagggcaatttgttgaatttcaggaatcaaccataggtgcagcttttttctcccaaacattggctgtgaatgatgcaactgtgaagtttgagatttgggatacagctggtcaagagaggtaccatagcttggcaccaatgtattacagaggagctgcggctgctatcattgtgtatgatattacaaatcaagcatcatttgagagagccaaaaaatgggtccaagaacttcaagcacaaggcaatcctggtatggtaatggcacttgctgggaacaaagttgatttactagatgcaaggaaggtggcagcagaggaagcacaaacttatgctcaggagaatggtcttttcttcaggaaa

SEQ ID NO: 17873 - DNA, 269 bp, Gossypium hirsutum
  Clone ID: uC-gsflnu33B137e09b1
tggagagtcaaaaacccagctgccgagaaaaacagaatgccatgcagcagatattaagtgttgaatggtagtattgaaaaggaatgtctgcaacagatgtcattttggcctatacttcctaacatgctcaacatggtactagaggtaaagtagatatattttaatcttgaatgcgattccatccgttctcattgttaagcatatagatatagtaataacagttctgtagtgatattactgataataataataaacatcaagtcatattt

SEQ ID NO: 17874 - DNA, 319 bp, Gossypium hirsutum
  Clone ID: uC-gsflnu33B137e10b1
atccccacgcgtccgggaggccaaagggatgaccctatgcctttgtgtattgtacatagatggtaatgttggagagatgattttattaatgtttgaaggccaaagggcttctatttgtatgttattgttaatcgtcggtggaaccaaaaaaaaaaaaaaaaaaaaaaaaaaaaaaaaaaaaaaaaaaaaaataaataaaaaaaaaaaaaataaaaaaaaaacaaaattaataacaaaaaaagggggggcccgttttaagggatccaagtttccttcccctggcttgcaacaaaaaagtttttttttggggtccccaaaa

SEQ ID NO: 17875 - DNA, 479 bp, Gossypium hirsutum
  unsure (1)..(479): unsure at all n locations
  Clone ID: uC-gsflnu33B137e11b1
ttattttgcccccttaaaaagctctcaagtctctcccttgaatccaattccttcaaagcttggttctcagacattcaaacccgtaaattttgagatcgaagaggtggaatttagcaatgtcagggctggaatcaggttcaggttctcggtatgttcatcagctactcggaccagagcttcagctgcaaccccaactgagggacaccaagcactcaccggacaaagaaggaaccgatcatggtggtaccaccaccagttctggtggtggagaaagaaggcctcgaggtcgtccagctggctctaagaataaacctaaaccaccgatcatcgtcactcgcgacagtccaaattcactaagatcccatgtgcttgaaatatcttctggttcggacatagttgacttggtagcaaactacgcacggtggcgcggtcggggtgtttgtgtgcttagtggaaccgnggccgtactaatgtacatt

SEQ ID NO: 17876 - DNA, 429 bp, Gossypium hirsutum
  unsure (1)..(429): unsure at all n locations
  Clone ID: uC-gsflnu33B137f02b1
ttctgtcgcgtggggatcgatatgtcccgagtctggaagaggatggacgaagagattgaagcgaccctaatgccggaggattaccgatataagaaggtttggattctatgcaatgactgcgacgacactaccgaggtttacttccacataatcggacagaaatgcagtcactgtagatcttacaacacccggacgatcgcccctccagaactccctcagtgatgagatcatgatcgaagaaccgaagccggtgagctccggacttctaaaggtctgctcgttaactgtaaaaacggagatgaattcttcgaatttgcatatcatgtctcgatcatctcgatccatcatcgtcattggatttgattatatgattcagtgtattattattcaaatgattgngccatttttatgtcttctctcataaacatt

SEQ ID NO: 17877 - DNA, 531 bp, Gossypium hirsutum
  Clone ID: uC-gsflnu33B137f06b1
ttgtatcctgtgatgagatgtcattgctgaaagtgcaatgtatttacagagaccccatatcaaaagaaatggtgtccttggaagaagccaatgaagtaaagatccagaggcccacaataattggacaaacagtagtgtcaatggaagtagacaggcaacgaaacaggctccgcactgctgaggctatggctgaggctagatctgctgctgaacatggtgatctaactgctgctgtctcaatactagagagttgcggcagggctttatcggaaaccatttctgcacaagctggtgacaggttatgcattgcactatgtgctgaactaaaggagatgcaagaaaggatggcaaaccgtcgagtttacgagtcatctggtagggcttatgtgttgtcgggtttgagctcgcattcctggcaaagagcaactgcacgtggtgattccaccaatagtacaagccttgttcaagcatatcagacccctacaatgacagacatggtgacgcgttctcagaccatgttctttggcaacc

SEQ ID NO: 17878 - DNA, 457 bp, Gossypium hirsutum
  Clone ID: uC-gsflnu33B137f07b1
ttgctctctctcccaaaccaaaccttcaaatttcagcaagagagagagagagaacttacatagctcagacttcgatcatcaatctagggtttcttaattcgattccccgattacccgataccccaattttacagatcaggtctgagtgttctagttgttcggctgtttctatccgctaagtttcatgtctgatcttgacatccagattcctactgcctttgatccgtttgctgatgcaaatgctgaagacgctggtgctggtgccaaggaatacgttcacattcctattcagcagcggaacggtaggaaaagcctgaccactgttcagggattgaagaaagaatttagctataacaaaattctcaaggacctgaagaaagaattttgttgcaatggcaccgttgttcaggacccagaattaggaaaggttattcaactttcaggagatcagaggaag

SEQ ID NO: 17879 - DNA, 439 bp, Gossypium hirsutum
  Clone ID: uC-gsflnu33B137f08b1
tggtgggggaaaagagcagagaagaagaaacaaatatgagcagcatcggaactggttacgatctctctgtcaccactttctctcccgacggacgcgttttccagatcgagtacgccgccaaagccgtcgataacagcggaactgtgattggaattaaatgcaaagatgggatcgttatgggagtggagaagctgatagcatcaaagatgatgttacctggttctaatcgtagaatccactcggttcatcgacattccggcatggcggcggctggattagcagctgacgggagacaaattgtggtccgtgccaaatctgaagctactaattaccaaagtgggtatggtgaacccattcctgtcaaagaacttgctgaacgtgttggcagttatgcgcatttatgcaccctttactggtggcataagccccttgggtgggg

SEQ ID NO: 17880 - DNA, 227 bp, Gossypium hirsutum
  Clone ID: uC-gsflnu33B137f09b1
ttctttaagttttgagcaattttgtattgtttgaaatgaaaatggttgccctgtattatttattttttgagtcttgttacaccatggtcaatgattttggtttgaaatggagaaatgaaaaggattgtggatcttcttgagcttaaattcattttgtgtgtgtgttgaaatatttgtttacttggcatggacgttagatctttatgaatctttcttattgacaggtt

SEQ ID NO: 17881 - DNA, 518 bp, Gossypium hirsutum
  Clone ID: uC-gsflnu33B137f10b1
tgctgaaaagtaccgagcagataaccccgagcacgtggaggttattcaaggtatcgaaagaggcgatgctttgcctggcctcaggagctactccgatattgccgaggctgcaaaaaaggtaggatttgagattgtgaaggagaaggatctggccaagccaccgtctctcccctggtggactaggcttaagatgggtagaatcgcctactggaggaaccacattctcgtcattgtgctggctgccataggcatagctcctaaaggaaccgttgatgttcacgatatgttgttcaagaccgctgattatttgaccagaggtggggattctggaattttttcccccatgcacatgagtctcctcagaaaacccaagggggcttcttcaaaatcctagacaatttttggagggaacaccatgttgcagcattaattgtgttccacctcttgttactttacccttcttaatattttttttccttaaatttaattttcaaaagttctttttttccccccctact

SEQ ID NO: 17882 - DNA, 354 bp, Gossypium hirsutum
  Clone ID: uC-gsflnu33B137g01b1
gcgttcttatgttacatggtgctgacgcaaggccttggttcatataagcgacttgatgatcacatcttattgtatcgatatcgctatctttaatctaattgtgattattcatgtcagtgccgattctaaatagttattgttattttaatctttaggataacttgacttctaacttttatatttcaattgtgctgtcaatttaatattttaaactgtaaatttgaattacttaactgtcgtatttagctttaaagttaaaattgtaatagagaattgttatatttatatccgagatattattcttctcaatactgtgatagtgaactttagatgttttatatctatcatgacctt

SEQ ID NO: 17883 - DNA, 456 bp, Gossypium hirsutum
  Clone ID: uC-gsflnu33B137g03b1
tttttcttcttatcttccaagcgccggcgccatacccatctcccccactccccaaatcctgcagccaaccagtgccccgacgcggccgtacgtccgcagcctctcgtttggttgaggccgtgagttgacaagatccgtcgaggatctctcaggacccggcgatttctccaacattgcctgaatttattggacttgtcaaagatcggaacagtttagctgtttaggaagtcggaaatggcatcgcctccaattttatccttggctcttccatcaaataccggtagagttctcagcattcaatcttacacagttcagggatatgttggtaacaagtcagcagtttttcctctttaactattaagatatgaggtggatccaatcaattcagtacagttttcgaatcatacagggtacccaacttttaagggttaaggtctaaacgggcaacaattattg

SEQ ID NO: 17884 - DNA, 391 bp, Gossypium hirsutum
  Clone ID: uC-gsflnu33B137g04b1
ttcttacgcgtccgcccacgcgtccgcaagaagaataggatcattccaaggcatgttctattagcagtgagaaacgatgaagagcttgggaagcttttagctggtgtgactattgctcatggtggtgttttacccaatattaacccagttcttttaccaaagaaaaacgagaaagcggctgcaaaagagcctaagtcgccatctaaggctacaaagtctccaaagaaatcacctaagaaggcttagttgtttgtctattatagggtttgttttgatttatctgttaatgtatgtaggttccttttgtgtactttggttgtaggaaaatgttggtaatgttgtttagaatatgttttgtttgaaatgaatgaactgaaattcagattaaaaa

SEQ ID NO: 17885 - DNA, 486 bp, Gossypium hirsutum
  unsure (1)..(486): unsure at all n locations
  Clone ID: uC-gsflnu33B137g06b1
ttctatcgcgtccgccatctcctgcctccttttactcaaaaaaaaaaaaaaaaaaacatccccataatccatggcttaagtgcacgtgtagtatacaggcaatgaaccatgggtcttttccggcgactctttggagccaaaaagtccgacaaaacccgatccgataaagaacggaggcgttggagctttgctagatcttccaatcccacgtcttcaacttcccatatagatcatgctcttactactgctccatgcggtgacaccttggatgccagcaagcacgcaatagcagtagcagccgccactgctgctgtagctgaggctgctctcgcagctgcgcatgcggctgctgaggttgttagactgacaagatggtggtggtggccccgctgggaacaaccgacgactcgtacaggaggtagcggctgttaggatacagaccgctnttcgaggttatctggcacggagggcactgagagctttgaa

SEQ ID NO: 17886 - DNA, 463 bp, Gossypium hirsutum
  Clone ID: uC-gsflnu33B137g08b1
tgtcctggctcgccgccgcccgtcaaacgccgacgaaaatggctttcgagggattagttctccgcggcaccatgcgagcccacactgacatggtcacagccatcgccactcccatcgacaactccgatatgatcgtcacttcctctcgcgacaagtccatcatcctttggcacttgaccaaagacgaaaagacctacggtgtcgctcgccgccgtctcaccggccattcgcactttgttcaagacgttgttctctcttctgactcccagttcgctctctccggttcctgggacggtgagcttcgtctttgggatttgaacgccggaacatccgctcgtcgtttcgtcggccacaccaaagacgtgctcttcgttgctttttcaattgataaccgtcagatcgtttcggcttctcgtgatcgaagcattaagctctggaacacccttggagagtgcaaatacac

SEQ ID NO: 17887 - DNA, 447 bp, Gossypium hirsutum
  Clone ID: uC-gsflnu33B137g09b1
ttccacgcgtccggtcatggaaaaagacaaagcttttatatctgaagagctgaagaacagaacaacaacacgacaacaacaaccagcttggaacccttgtggttttatgacagaaatgtcagcaaatgagctgaattgtggaacagaacaagttgggaactattttttcaatccaaattgggataattcaatggatcagagcgatccctttgaatcagcattaagttccatggtgtcttctccagctgcttccaatgttggttccggtgaaaatgtaatgatgcgggaattaattggaagattagggaatatatgcaattctaaagatatcatcaccaacagtactaatgtttcatgttatagtacgccattgaattcacctccattttcaactgatcctggatttgctgaagagctgctagattttcttggtttggtggcttaaat

SEQ ID NO: 17888 - DNA, 536 bp, Gossypium hirsutum
  Clone ID: uC-gsflnu33B137g10b1
tctttttctctcaaaactcaacctcccaaatcctctgtacctttttttttcttccaatccagacagcacccaattccatggccacctcttccccacgtgaggataatgtctacatggcgaagctcgccgagcaagccgagcgctacgaggagatggtgaagttcatggagaccgtcgtctccgccgtcccctcctccgacgagctctccgtcgaggaaaggaacctcctctctgtcgcatacaagaacgtcatcggcgcccgacgcgcctcctggaggatcgtttcctccatcgagcagaaggaggaaggacgcggcaacgccgaccacgtctccgtcatccgtgagtacagggccaagatcgaggctgagttgtccgagatttgcgccggaatcttgaagctccttgacgagaagctcgttccggcagccaagaccggggattccaaggtcttttatctgaaaatgaagggagaattccataggtacttcgctgagttcaagactggcgatgacaggaaagccgttgccagaata

SEQ ID NO: 17889 - DNA, 535 bp, Gossypium hirsutum
  Clone ID: uC-gsflnu33B137g11b1
tctggtagacaaggaaaaacaaaagcctcttccttagctaactgtctaagcggctactttataccgcatctcaaccatgatcatcccagaaaagaaccgccgcgagatctccaagtacctcttccaagagggcgtttgctatgcgaagaaagactataatttggcgaagcaccctgaaattgatgttccaaatcttcaagtaataaagctgatgcaaagcttcaagtcaaaggaatacgtgcgtgaaacttttgcttggatgcattactattggtaccttacaaatgatggcattgagttcttaaggacttacctgaaccttccttctgagattgttcctgctactttgaagaaacaagctaaacctgctggtcgtcccatgggccctcccggtgaccgtccacgcggcccaccacgctttggtgacggtgagaggagatttggtgacagagatggctatcgcggtggtcctcgaggaggcgggtgatttggtgataaaggaggagctccagctgattatcagccttcattaggg

SEQ ID NO: 17890 - DNA, 480 bp, Gossypium hirsutum
  Clone ID: uC-gsflnu33B137g12b1
ttttaatcaccttatgttgcctgcaaagctagattcagccgggatcatgcaacaatccatctgctacgacaaaacgagaagttggaccatatcggtttcgtggggtttcaccattcaagtttttagaggaatcttttctccaagggagatagaaatgccttcgagaacgttcttgaattggtataaaagagcagattacacagcgtattcattcaacacccgccctgttagccgaaacccttgccaaaagcctttcgtgttttacatgtcgagcgtcggaatgcattccaaactgaacacaaccgtgagcaaatatgatcgacaccgtgttcctcatcctccttgccgatggaaaatggctgatcctaacaatctttaaatggtgatcgtctacaagaaacctgacccgaatctatggaatagatcaccgagaagaaactgttgtagggtgatgaaaacaaaggagccaggaacaatgga

SEQ ID NO: 17891 - DNA, 292 bp, Gossypium hirsutum
  Clone ID: uC-gsflnu33B137h01b1
ttcctcgcgtccgataaaaaaaaaaaaaaagggagatatttttatataaaaaggggaattaaataaaaataaaaaaaaaaaataaaatttttaaatggttaggtccttttagagtttttcaattttttagtttcttttgtttttatatgggggggggctttttttggggttccaatttttcttcccctggcttgcgcgtttttattttttttttggggtccccttattttttttccttggccgtggttttccaccttttgttttgggaaacccttggggttccccctttttt

SEQ ID NO: 17892 - DNA, 411 bp, Gossypium hirsutum
  Clone ID: uC-gsflnu33B137h03b1
ttcgcaagttatttggtgatcaagatttgagtacatctttattggacttgggtctgcttaacagacaagcactgatagtggttccacgtcagagaagcactggcttccaagggcaaagatcatttgctgaccaaagaaattctacaccttctgaagctactgcaggaagcaatgggggatattttgcatacgttagaagctttatgtcctatttcaatcctttttcttatcttggtggtggtactggtaccagctcttcaactactggaccggaatctcaaagtggcatctgggaatacagtccaaaccctacactgcaaaataacttggctggagcaaacaggacatattcacctaactcgacaaacagaaacagttcgactgacagcaggaacagacgacccacaacat

SEQ ID NO: 17893 - DNA, 422 bp, Gossypium hirsutum
  unsure (1)..(422): unsure at all n locations
  Clone ID: uC-gsflnu33B137h05b1
ttcttgaatcacttctacctcgggaagccaaaaaattgtggaagggacagacaaccaggttttgattatcggaaattgcgattaaaacttgtagctactttgttgatggtaagcgagatatgaatgttgacgagttcaatggatggttaaagggatttaatgaagacaacgatagaaggataagcaaatacgagcttgccaacaccgagaggatggtttgctgggagaagagcaagcatggaagtgatgtcaatggcaatgggtttattcatgacaatgagagattttgtttcttcttctaaagtgttttgattcgagtccacatccctttattccttccattcctttcttcttctttgatantgttatctatctatatgttgagttgaacaagttaataatccaaaatatcgactagtctt

SEQ ID NO: 17894 - DNA, 356 bp, Gossypium hirsutum
  Clone ID: uC-gsflnu33B137h07b1
ttttatcgccaaatcaagaacaagccatacccaaaatctcgatattgccgtggtgttccggatcctaagatcagaatttatgatgttgggatgaagaaaaaaggtgttgacgagttccctttctgtgtccatcttgtcagttgggagaaagagaatgtctcaagtgaggcattggaggctgctcgcattgcctgcaacaagtacatggccaaatatgctgggaaggatgcgttccttttgagggtaagggttcatcccttccatgttctgcggatcaacaagatgctttcatgtgctggtgctgataggcttcagactggaatgaggggtgctttttggaagccctaggaacatgt

SEQ ID NO: 17895 - DNA, 475 bp, Gossypium hirsutum
  Clone ID: uC-gsflnu33B137h09b1
aagctcgcccgccggcacgcgccgggacggactggccggatcgacccacgctttcttcggtgcggacctgccagcgcaggacgctggtgttgaagtccggcttgatgaccaccagctacggggcctagagcgcgatcgcgacggtgatggtggtgtccgtggccagcaccttcttctcgcaggcggtccagtccagggcgtaggcctgacggaccaggtccgcgacctcgggcgtgacgccgtcggtcggcggttcggcaccgagccgggccagtacgccgagggactcgtcccgggcgtcgtcgtacgtgcgcctcggcggttccggctcgacgacggccttcgtctgcccgctgaacgtcggcatgccgtgcagcagcaccgaggtgatcgagacggcccggagcttcgcgcggatgtgttccgaccgggcgctcacgacttgctccagcggacctggttgcccgtgatgctg

SEQ ID NO: 17896 - DNA, 408 bp, Gossypium hirsutum
  Clone ID: uC-gsflnu33B137h11b1
actataaaaggagagacaatttgcatgttgaaggaaaactaaggatttagtttgtttaagagttgtatcctcaagctcgagtttgctatatttgttgggtaatcgcactaatattggattaaagagaacgggagagcttgatccaaaggcttttaatgacacttgtaagttacgatttcctactgacgaagcggaaattcaggccactactctatgctcatcatggcaggagaatctgaagaatccagattgacatccaattttcaggagaaactaacaaatctaaagctggaatggggtgaagagatttataatgcagtggtaacagctttgaaagaacacttttgtagtaacttattgtagtatgcttgtagttgaagttttttatagtggacattatgttgttta

SEQ ID NO: 17897 - DNA, 485 bp, Gossypium hirsutum
  Clone ID: uC-gsflnu33B137h12b1
tcttaaaaaaaaaaaattctcttgaatggtaggtaagctaaagctaaaacaaccccatcatcccatttcttcattgttcatgctttagagacctttgacatgttcatatggccttgtttggtagtccaggaaagttaagtggactattattaagaattgggcagtgtttttctgcagctgcttcaattggtttcatggtttctgctcatggctttttttaactccactgctttctgctatttgattgcgtcaatggggattcaagttttatggagctttggacttgcatgtctcgatttccatgctttgaggtcaaagacaaacctacacaatcctgtcttagtaagcttgtttgttattggtgattgggtaacagccacattatcacttgcagcagcatgttcatctgcaggtgtaacagttctttattcaagagacttgggttactgcagatcaccacaaataccatgctcccatttcaaagc

SEQ ID NO: 17898 - DNA, 485 bp, Gossypium hirsutum
  Clone ID: uC-gsflnu33B138a02b1
gtcttttactagtagaccatgcattgatgaatggtgacagagaaaaagactccaccacttcaatcttccaaaagattggagtctttgaagaagagctgaaaacccaattgcctaaagaagtcgaaagcgcccgaaccgaattcgagaacgggagtccggctatcgcgaacaagatcgaagaatgcaggtcctacccattgtacaagtttgtgagggaagttcttgggactcatttgttaacaggtgagaaagtgatttcaccaggagaagaatgtgacaaggttttcacagcaatgtgtgcagggaagttgattgatccgttgctggattgcttgaaagactggaatggtgctcctttgcccatatgctaaaaagggtgtttcttttctcaaagtttgagagcgacaacaaagccacactgttctataagttctttaacctgtgctcatatataaagacatatatatagcttgtttaagttttca

SEQ ID NO: 17899 - DNA, 520 bp, Gossypium hirsutum
  Clone ID: uC-gsflnu33B138a03b1
ctttcttttgcggtactacgcacccacctacaggaggggcaactacttgtgcggctccagcttgctctccttcttctacttgatcaccaccaccaggttgcactcctcctgcagcgactcccccgcccgttagctccccaccaccagcttctcctgccgcgggtactccacctgccgcaactcccccaccggcttctccacctgcgggtaccccaccacctgcttctccccctcctgctactcctgctccagctaccccaccaccagctcctttggcttctcctcctgccacggttccagctccggcccctagcaagaccaaagctaagtctccagcactatcaccttcggcctccagcccaccgtctccatcaaatgaggcccctactcccagcctcggcgcttcttcaccaggccctgctggaaccgatacgagtggagtagagaaaacatggtccataagaaagatggtgtggagcttggtgattggatggggtatcctcagtttaatgctttaaac

SEQ ID NO: 17900 - DNA, 211 bp, Gossypium hirsutum
  Clone ID: uC-gsflnu33B138a06b1
ccctctcttccgcggacgcgtgggttttgcttttaaaaaggttcgctaaacccgggggagggctgggtcagggtgaggacaatgaagggaaggtggtgatgaaagcttgtctatacatgatattcataattattgaatggtactttgttttgtgtgataagtcttaaccatatttattattttctgacacgatttttttggttggattttt

SEQ ID NO: 17901 - DNA, 272 bp, Gossypium hirsutum
  Clone ID: uC-gsflnu33B138a07b1
gttgtctctaacaaataaccaaagcaccaggggagggtttaaccatatattgggggcattaacgaatcaagtgaagagatatctaccacctaaaagggcaggtatcggtgccctagactgctagtatctccaatctcttggatgatggcactaggtatttacttaaaaatcgtggtgtgataaacttaaggatatacttttagcaagctgatttatttattctgcattcttgggagttaaaaagcaaacttcaatttaattcataaacattt

SEQ ID NO: 17902 - DNA, 479 bp, Gossypium hirsutum
  unsure (1)..(479): unsure at all n locations
  Clone ID: uC-gsflnu33B138a08b1
ctatttagcccctttcattagcatcaaaatcactccagttttctttatcactgaaaaatgtcttgctgtggtggaaactgtggctgcggtactggctgcaagtgtggcagtggctgtggaggatgcaagatgtatccagacctgaacgctgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagaggcgcctttgtctttaagaaataatatngtttgttgcttatgtgtttttagaataaagtagccatggcttgtcgtacgttctgcctgttgccgccacggttacttggtgcttgccaatagatagagtgaaggactaatatttacttggttt

SEQ ID NO: 17903 - DNA, 509 bp, Gossypium hirsutum
  Clone ID: uC-gsflnu33B138a09b1
ttttaattgcattgactggtattgtttatattgaagatcactttggatatagagtaggctttggagttccagcaatcttaatgttgctctccgctcttgtgtttttccttgcttctcccttctatcttaagcagcaggcaagcaagagcttgcttactggctttgttcaagtaatcatcgttgcttataaaaaccgaaatctgacatttccacttccaaactcaactgcaagttaccatcataaaagggattctaacgttgttgcaccaacggacaaattaagatttttaaacaaagcttgcatcatcaaaaaccccgaacaagacattgctctggatggctcagccgcaaatccatggagtctttgcacggtagagcaagtggaagagctaaaagcgctgattaaggtcttaccattgtggtctactgggatcataatgtccataaatttaagccaaaactcatttcctgtgcttcaagctagctctatggacagagaccttacaaaa

SEQ ID NO: 17904 - DNA, 196 bp, Gossypium hirsutum
  Clone ID: uC-gsflnu33B138a10b1
gttgaatttagaaactggccttggagacctatgggtttcttgggatgatcatatcgtgggtgattgatttttgtttttgtaatttacgattagtttctttgttttctttcctcttatttttttggtcaattatttaggaatggtggggtttatttcagtgcttaaaacaagaaatcataataacttataaaaaccg

SEQ ID NO: 17905 - DNA, 512 bp, Gossypium hirsutum
  Clone ID: uC-gsflnu33B138b01b1
acctcctcagtaagtctggctcaaataaaccagacgactcaatgggggaggaaccttcatggtaacttctgcaatttctatctccccagttttcaccttcatactccaaaattataaatccccgcttccccaattcctctttctccccaaattcaattttcgtctttccttaacctctctcatcttccaaactaaaaccaaacaaccagctcaaagcttgcaaccatggccttccgccttagcaacaatcttgttggaatcctcaacttcataaccttcctcctctcgatccccatcctcggagccggcatctggcttagtcgagaaggcgtgacggaatgcgaacggtttttggacaagcccgttatcgtaatcggagtcttcctcatgctcgtctcacttgcgggactaatcggcgcgtgctgtcgcgtcacttggctactctggctttacctagtcgtcatgttcctcctcatcgtgctcggcatcgtcttcaccatctttgctttcgc

SEQ ID NO: 17906 - DNA, 419 bp, Gossypium hirsutum
  Clone ID: uC-gsflnu33B138b02b1
cttcattgcctcgatccctgatttccttcaagacagacgttttaatacttctcctacttcttcttcagcttcgttaccaagagacaatggactccttcaggatattgttccaacacagatgaggaaagaggcaaaggaacagtaagacagtatgggttctttttttatatataattatatgattgctggtatgttgtttcctaatcctttactaactgataaaaaacccaattcactatatctttttttattcaatctattatcatctgtataaaatcacctgtctttttatagtgtttttgcaggagaacaagtggttttgtacttggcttttcttgcggctattattctttgcatttaaggagaattcaattatggaaaattggggtttttttattattaatttcttccaattgtgc

SEQ ID NO: 17907 - DNA, 511 bp, Gossypium hirsutum
  Clone ID: uC-gsflnu33B138b03b1
ttctttttccgcccacgcgtccgctggagttggtgcttgtgctgatatccttggtctgtctgctagagaaggcatcgtttcgttgggaggcccttacattcctctcaaaactggaagaagagacggtagaaggagcagagcagatgttgtggaggagtatcttccggaccacaatgagaccatctctggcgttctcgacaggtttgccgccatgggtattgacacccctggagtcgttgccctcctaggagctcacagtgtcggcagaactcactgtgtgaagctggtgcatcggttgtacccagaggttgaccctgccctcagccccgaccatgttccacacatgctccataaatgccctgatcaaatcccagaccccaaggccgtccagtatgtgagaaacgatcgtgggacacccatggttttcgacaacaactactacaggaacatactggacaacaagggtttgttgattgtggatcaccaactggcttacgacaaaaggaccaga

SEQ ID NO: 17908 - DNA, 403 bp, Gossypium hirsutum
  Clone ID: uC-gsflnu33B138b05b1
cttacgtgtccggaaaatgaaaaaaaagaaaaaaagaggaaaagaaaaaaaaaagagtattaaaagcaatggcaatgggttgtctcctcgttgaagcacacataccttaagttgcttaactgcttgctgacgcttcttgttgttggaaaacaccgtagtagtgatcggcttaggaccgcgtacgaaagtaaacattgggtcttccgatgaatcgaagcttcaaacatgtaaagctgacttgtttgacaggagaacaaatcggtaatgtgaggatttggcttagttaggattgatgcatttacatgcttaaaaaacatgctaaattatcatataacactcttatgagatacttacagcttgagttgctagtgtttcctaatgggactaagcactggttgctttc

SEQ ID NO: 17909 - DNA, 511 bp, Gossypium hirsutum
  Clone ID: uC-gsflnu33B138b09b1
tttctcatttcaagacaagacccttttgcagcagcatcaaagatggcaagaacaagaagaagaacaatatcgacattgttgatggcaagattgaatcaaatgtgagcactttcaatgagtcgtatcgtcagcttgacaatcttgacttcttgactgctgctaagatcctcttcactcatcctccaaagaaaaagaaatttgggctagatttccatttggtgcagctcttctttgcgtgcatgccttcattggctctgtacttggtagctcaatatgctcgctatgaaatgaggaaaatggaagcggagctagaggagaaaaagaagcacgatgaagaagaagaaatgaaaaggaagcaagaagaagaggagaaagataaagaggtgtaccaaattgcgcctaatccagagcttttcgaggtaaaaaggagactaggtaagctagaggaggcagtaaaggaaatcgctgctgagtcaaagaaacaatcggcagttagaataactaaaactca

SEQ ID NO: 17910 - DNA, 475 bp, Gossypium hirsutum
  Clone ID: uC-gsflnu33B138b10b1
cttacgcgtccggaactaacctaaacctaaagagggacagaagagagatatggagtggagatcatgctatttggacatggttttagtgccgctaagcttagcaatgagtttagcttatcattggtggctatggcgtaaggttcggtctcaaccgctcacaaccatcatcggaaccaatgcccgtggtcgacgcttctgggcctttgctatcatgaaggacaacgagaaaaagaatatcctagcagtccaaacgctacgaaacaccataatgggatcaaccctaatggccacaacctccatccttctttgcgccggtctagctgccgtcatcagcagcacatacagcatcaaacgaccgctcaacgattccatcttcggagctcatggcgagttcatggtgtctctcaaatacgtcaccatcttatccttctttctcttctctttcttttggtactctttttcgatccgatttatt

SEQ ID NO: 17911 - DNA, 499 bp, Gossypium hirsutum
  Clone ID: uC-gsflnu33B138b11b1
tttctctcgcgtccgcccacgcgtccgggtgaatgctgatcttggtaggatcattaactccgacgaggttcagtcggttgttaagccgattaagaaggagatcaagagggcacctttgaagaagaatccactcaagaacttgaatgctatgctgaagttgaacccttacgcaaagactgctagaaggatgtctcttttggctgaggcacagcgtgttaaggccaagaaggagaagcttgacaagaagaggaagcctatatctaaggaggaagcaaccgcaatcaagtcagctggcaaagcatggtatcaaactatgatctccgacagcgattacacagagttcgagaacttctccaagtggttgggtgtgtcgcagtaaattttagtttctgcggagtggttgtatcagttttggtttcggtgtttttgacatttttatttcatttgatgatgtttggagttttggaagtaaaattagtggaatggcatggaccctatt

SEQ ID NO: 17912 - DNA, 500 bp, Gossypium hirsutum
  unsure (1)..(500): unsure at all n locations
  Clone ID: uC-gsflnu33B138b12b1
tgttacgcgtgcgatggagaagccccgactttgcgttaagaaatcagtgaatatcgtaagcaagtgcttggcttacgttagctccggcaacaataacagtcggaataacatcatgtacgagattgaaggctcgtattcgcaacgaaattgcgctgttttcgatgataagaggcgggtagtagccgaaatcaagcggaaagaagctgttggcggtgtcgcctttggaaccgacgtttttcgccttattgttcggccgggatatatcacaacggactccggcatggctctacttatccttctcgatcaaatgttcggatcttctagacgataaaaactttctttttcttcaaccgaaaacatctttggtttctatgaactttctccggtcgtccncagtaaatcatttcacttttgtaagaataaacaaaaagaacaaaaagaaaaaagaaacttgagctggtttattgatcttggggcttggttttttgtttagataaaaa

SEQ ID NO: 17913 - DNA, 435 bp, Gossypium hirsutum
  Clone ID: uC-gsflnu33B138c05b1
gttactttcacgattaacactcttttacaacggggggttcttctttacggtggagggaggtactgccgcctcagccaaagaaaactccatggctaatcctgttgctgcttcctccttggctctcactgccatctccatggttaaacctccggttatggcaccacatggacatggtggacaccattattataacaaacgttatggtcctggaagtcccaagtcctaccaatgtccatctcagtgcacacggaggtgctgccagacacagtgccatacaccatgcgtgtccttctgtcagaaatagtttcatgacatgcctctgtcgtccctccagggtattatgggatcgcacatgattgcccttggtacaacgactggaaaaccagggcaggaggccccaaatgcccttaaattactcaaaagaagacccttttt

SEQ ID NO: 17914 - DNA, 302 bp, Gossypium hirsutum
  Clone ID: uC-gsflnu33B138c06b1
cttactcttccgacaaaaaatagaaaaaaaacggggggtcatctttaaaccgagaggagggttataaccacaaaagcaaagcaagccagccaacgcagtccaatagcaactacatcattttgccttactttggggtcgatagctagaagacccggttttacgcaccttgagacgggagggaaacctgttttttatatggccctaagctccggccactccctgtgtagaaaaactgcacaccgtgaatggcctgcgggatccccaacctcagtgggaaaaaaaaaaagcccccttctgatgcg

SEQ ID NO: 17915 - DNA, 487 bp, Gossypium hirsutum
  Clone ID: uC-gsflnu33B138c07b1
ctcacgcgtccgggaaaaagggggaaaaaagggaggatcttgcatagatggaaaacatgggagttctaggcaaggtggtggattaccttctattgttatcattcttcagcatcacattaacagctcagttggacatcccctagtccatcctcccccacgcctacaatcccttctatcaagtttataccacgttaacccaagattatttggtgcttgagcagcctgctttttttcaaggcacttatgacgttggaacttgtttaccaactccctctcgctttgcttaacatctatgggttgttatactctaagccctggttcaacaccacctgcctcctctttggtgcctctatcgttgcctctacgacagctatggtgggagacattctcaattcccagaaggcatcagccaatttgatggccatgtattatccaccgtttcttccattaggggttctggctatagtgcgaggggtggctggacaat

SEQ ID NO: 17916 - DNA, 509 bp, Gossypium hirsutum
  Clone ID: uC-gsflnu33B138c08b1
tggtagcaacagctgaaagccgtttcagattcaaagcacctccgtctcacgctaatcaaaacaaacaaaaaccagccaaaattcatcaccgttatcaaagagagaatcaacagagcaaagggattccgattttctctttttcttcttttttgtgctttcacagtctctacgttgtcgttcttttttggcttagcatttggaggaggagaggagaggagaagatgagaaaaatggcggatccttacgtgttggcgtggatctcggtttttgtaacgacgcttcttgctttgtgcggtgtcgttttgaagagacggaaagtgaacgggatctcttcctcaaggactatgtcggtgacaagcgtatcggctgttgacggagaatgtagatccgctgatggttgtgatactgacgtcatcattgttggagctggtgttgctggatccgcactcgctcacactcttggcaaggatggacgtcgagtgcatgtgattgaaagagatttatcagag

SEQ ID NO: 17917 - DNA, 456 bp, Gossypium hirsutum
  Clone ID: uC-gsflnu33B138c10b1
cctacgcgtccggttgaaaggggatgatgttgatggtggtcttaacctggaagaagaatctgaaaagacggttctgaagaaagaatatcctgttgatatatcgttgcctgatatcaacaacgggatatatggaaccgatgactttaggatgtatacctctaaggtgaagccttgctcgagggcatactctcatgattggaccgagtgtcctttcgttcatcctggtgagaacgcgaggaggagggacccgaggaagtatccatacagctgtgtgccttgtccagagtttcgtaaaggagcatgccctaagggtgatgcttgtgaatatgcgcatggtgtgttcgagtcatggcttcatcctgctcaatatcggactagactttgcaaagatgagactggttgcacacgtaaagtctgtttctttgctcataaacctgatgagttgcgccctgtata

SEQ ID NO: 17918 - DNA, 411 bp, Gossypium hirsutum
  Clone ID: uC-gsflnu33B138c12b1
tttatctcccgttctacagggattcctacggtgcgggctcggtggacttcatatttggcaatgcagcagtggtgttccagaactgcaaactcgtggcccggaaacccatgaactcacaatcaaatatggttactgcccaaggaagattagatccaaaccataacactgggacttcgatccaaaactgtaatatactagcaagtgctgatcttgagcccgttaaaggctccatcaagtcatatttaggccggccctggaaggagtattcacgaactgttgtgatgcaatcctacattggtgaccatattgacccttcaggttggtccgtttggagtgaggatttcgctttgaagacattgtactacggggagtacatgaacaggtgaccagaagctgacactagcaagagag

SEQ ID NO: 17919 - DNA, 470 bp, Gossypium hirsutum
  Clone ID: uC-gsflnu33B138d03b1
tttgttagagcacccggacgagaaattggctgacaataccgaaagcgcttcagagttgcaggcatgaatggatgaaagatgctttagagaatggtttttgtaagtggcttgcacaaaacaagtgaagtcccaaggtttcaatcggaaattttaacttaaatgcagaagcatttgcataaaaacaaaatattagagatgtacactcagaagtgcttactttgtgtcaacttatttttccttcttaaattagaagacatctggtgtctgactgcacttttaatgtgttttcatttatgttactcgaacttgaattgtgtgatgtctaaacctttcaagatatcctgtatttgaggggttttggaggattatgtcatttatacttatgtctggataagtgtcggacataggtgtcgagacagcatttcagaaatatgaaaatgaagactcggagtactacccaccatctttgg

SEQ ID NO: 17920 - DNA, 184 bp, Gossypium hirsutum
  Clone ID: uC-gsflnu33B138d04b1
cttactcgtacgacaaagagtcctctcaaacggggggttttgacaaccctagggaaaggcaagaaccgccgaagccgtaataacgaggatgccaggtccaataccaacaacatcattgagggttacaacgtagcgcgggctggaagtcacggcatttaaacacgaatgaggggtaagactccac

SEQ ID NO: 17921 - DNA, 154 bp, Gossypium hirsutum
  Clone ID: uC-gsflnu33B138d06b1
gttatctcgtacgacttagagtgttctcccacgggggattttggtttcccgagggatgagtgagagccacctaagcgtttagtgcccaccttcttagtactataagtactccctcatggtcgcttacatcctgatccatgatagaacacccggt

SEQ ID NO: 17922 - DNA, 145 bp, Gossypium hirsutum
  Clone ID: uC-gsflnu33B138d07b1
gttacgcgcacgactaagagtgttctaccaccgagtatcttgggttcccgagaaaaaagggagagccatctaagcgttgagtgcggcccttgtaaggacgatgagtgcgccatgcatggtcgctcacatcctgatccacgataga

SEQ ID NO: 17923 - DNA, 231 bp, Gossypium hirsutum
  Clone ID: uC-gsflnu33B138d08b1
ttgtcatcgcgcacgattgagatgctagtgacacagtgtatcttcgtttcctgagaaaacactgagagccattggagcatattcttcggactttctatggacgatgaggataccagcatggacgcttacattgtgaagtacgatagaggatacggttctgcgacccgtaaggagcgagggatgcttcatttcatggggacgaatgtgtaaggtaagtccctggaggaggtg

SEQ ID NO: 17924 - DNA, 305 bp, Gossypium hirsutum
  Clone ID: uC-gsflnu33B138d09b1
tgtcttagatagggttaggggtcgaaattaagtggtattttttacaatagtgaaaaaatgcaatttttcaccattttaatttcctatatttttatagtttctaaaggattaaatcaaaattatttatcattttaatggggccaaaatgtaattttacttttaccaatttagaattttaaaagacctaaatgaaaatttttctattttagggggtcggatccctagcccccgagctttgcccttggatggatacaaacatgatgctgtccatcgcttaaatataaaacacaaaacaatataaaatt

SEQ ID NO: 17925 - DNA, 510 bp, Gossypium hirsutum
  Clone ID: uC-gsflnu33B138d10b1
tcggttaaaatccctaaatttttttttcttttaggtgcaagacctttgcttcaatggctgatgcaggtggttcagccgtctctaagaggatgtggtgctcggttcccgaaagactccagctgcatatggccatgttggccttgcagttcggatatgcagggttccatgttgtttctcgagctgcccttaacatgggcgttagcaaactcgtcttcccagtctacagaaacatcattgctttccttctcctcctcccatttgcatatttcctcgaaaagaaggaccgaccagccattacactaaattttcttttacagttcttcctcttagctcttgtcgggataacagcaaatcaaggtttctatttgcttggtttggataacacatcaccaacctttgcatctgcaatacaaaactcagtccccgccattacttttctaatggctgctttgcttaggatagaaaaagtgaggcttgatcgaaaagatgggatatcaaaggtaataggaa

SEQ ID NO: 17926 - DNA, 505 bp, Gossypium hirsutum
  Clone ID: uC-gsflnu33B138d11b1
tttcttacgcgtgggcggacgcgtgggcggaggcgtggggatggtattcaagatttaaacaaagctgctggtaccttaagaggtgcaaaagaggaggatatatgatataaccaatgtccttgaaggaattggtcttatagaaaagaaactcaagaacagaattcagtggaagggggtttatgtctcgaggccaggggaggttgatgagaatgttgctgctttgcaggcagaggttgaaaaccttcataatcaggaacgagattagatggacaaataagagagatgcaagaaagattgagggacctaagtgaagacaaaaattaataacaagtggctttttgttaccgaggaagatatcaagagcttaccctgtttccagaacgaaatgttgattgccattaaagctccgcacggaaccactttggaagtccctgatcctgacgaggatgatgattctctccaaaggagataccggattgttcttggaagttcaaattttcaatgg

SEQ ID NO: 17927 - DNA, 465 bp, Gossypium hirsutum
  Clone ID: uC-gsflnu33B138d12b1
tttctcatattgtcataaccgtaatttctctggtctggcttttgcttaatcaatcgatcctcggcaatggccaacagtaatctccctcgaagaatcatcaaggaaactcaacgcctactcagagaacctgcacctggaattagtgcttcaccatcagaggataacatgcggtatttcaatgtgatgatccttggtccaacacagtcaccatatgaaggtggggttttcaagatggaactatatttgcctgaagaatatacgatggctgctcccacggttcgatttcttacaaagatatatgatcctaacatcgacaagcttggaagaatatgccttgatattctcaaagacaaatggatggcagctctccagattcgaactgtactttccagtattcaagcacttctgagtgctgcaaatgccgatgatccactctctgaatacattgctaagcactggaaaacg

SEQ ID NO: 17928 - DNA, 404 bp, Gossypium hirsutum
  Clone ID: uC-gsflnu33B138e01b1
ccacgcagtgcgtgttgtttagatctcctgaacggaccctagtatggacttacttatgaagatcaagtcctacactggcttcctgggcaccatggtcctggggagaggggaaccgcctctggtgagcgactgagggtcctgacctgatcagaggctattggcctagatccaagactcttggttgaaggagttctcacgggccattactctcctctgtgatagcaactactgtaagtgtagcaagggtgagagcacgatgcatagcaatcttgctagcaaggttcactagaaatgccttgtcaatgagaaagccgagtgtggacgaataaaaagagtgtgtactcaggcacttttccaagagacgtgtttgttaatgtgcaggtgagaaatggtgcactggtact

SEQ ID NO: 17929 - DNA, 492 bp, Gossypium hirsutum
  unsure (1)..(492): unsure at all n locations
  Clone ID: uC-gsflnu33B138e02b1
ctttcttgaaaattacccgctcggtaaattccttaaaaacccacatttacgggcattggccagtaagttcaatggcgttgataccatcaacgtaatccttacttccaaagacgtcgccgtagaagggttttgtatgaggtgtgggactcacgggtcaacccgggttggacgtggtcctgttcgtgggacttatatttgggtcggaaactcggagactcagtgtccgggtcaatgtgcttggccttttcatcaacctatttacggtccacaaaccccccctttggttgctcctaacggagacgttggagttgacgggatgattattaatttggctacgcttttgggaaacaccgttacgaacccgtttaacaatgggtattttcagggcccggcgaatgctcctttggaagcggtttcggcttgtacggngatgttcggttcgggttcgtacccgggatatnccggtaaggtgttggtggagaaaagacaggg

SEQ ID NO: 17930 - DNA, 493 bp, Gossypium hirsutum
  Clone ID: uC-gsflnu33B138e03b1
tttgatgctcccttgcctctcgattgatggctcgctctgcacccagggtagaaagctacatgcagattgtttttgtgatttcctctgcctctctcctgcttcccattataaccaatttcttggtagcaccttctaaagtgaaaggcggaagcatctcgtttgcaggttgtctccaacttctcggcttctgtactttcgaggcttgtgtagggatattctggccgtccattatgaaaatgagatcccaatacatcccagaggaggctaggagcacgattatgaactttttccgtattccactcaatatctttgtctgcatcgtgctgtataatgttgacgcatttcccatcaccattatgtttggtatgtgctcgattttcctcttcgtggcatctatcttgcaaagacagctgatggcaatttccgacaaaccaaagatggaaagttggacagcaatggaccctgaggccgagccattgaatgattgagtgat

SEQ ID NO: 17931 - DNA, 483 bp, Gossypium hirsutum
  Clone ID: uC-gsflnu33B138e04b1
ctacttgtccgattttgttttttctccctccggggggatgcagatcttcggtaagaccctgaccggcatgaccatcaccctcgaagtcgagagttccgacacgatcgacatcgtttaggctaaaatccaagacaaggaagggatcccaccagaccaacaacgtatcatgttcgccggaaaacagctcgaagatggccggaccttggccgattacaacatccagaaggagtccaccctccatctcgtcctccgtctacgtggtggcatgcagatcttcgtcaaaaccctgaccggcaagaccataactttggaagtcgaaagctctgacaccattgacaacggtaaggcatagatccaagacaaggaaggcattccaccagaccagcaaaggctcatatttgccgggaaacaacttgaggacggtcgcaccttggccgattacaacatgcagaaggagtccaccctccatttggtattgaggct

SEQ ID NO: 17932 - DNA, 151 bp, Gossypium hirsutum
  Clone ID: uC-gsflnu33B138e05b1
gttacttttacgattaagagtgttctaccacggggggtcatcctttcccgaggagagagggagaaccacctaagcgttttgtacgccccttcttagtcctataaggtctccatcatggtcgcttacatcctggtgcatgatggaacacccg

SEQ ID NO: 17933 - DNA, 153 bp, Gossypium hirsutum
  Clone ID: uC-gsflnu33B138e06b1
gttactcgcacgactaagagtgttctcccacggggggtcttgatttcccgagggaggagggagaaccaccccagcgaagcaaaccacccttcctaggaccatgaggtctccagcatggacgcttacatcctggtgcaggatagaggacccggt

SEQ ID NO: 17934 - DNA, 164 bp, Gossypium hirsutum
  Clone ID: uC-gsflnu33B138e07b1
tctgttacgcgtacgagtaagagtgttctgggggggtgttttatggattccggaggaaaaagggagagccgtcgcagcattgtgtacgggcgttcttaggacgatgaggtgtccagcatgggggcttacattgtgatgcatgatagaacctccggttttgaaac

SEQ ID NO: 17935 - DNA, 155 bp, Gossypium hirsutum
  Clone ID: uC-gsflnu33B138e08b1
tgtctcgcgtacgactaagagtcttctaacagggggtattttggtttcctgagggataactgaaaaccatcccagcaaagagtgcgacccttcctggtaccatgagtgctccagcatgggagctcacactgtgaagcaggatagaacacccggtt

SEQ ID NO: 17936 - DNA, 355 bp, Gossypium hirsutum
  Clone ID: uC-gsflnu33B138e09b1
tcggtaaatctgatgcagtgtttattgtaacaccaattaatttttttttcttttaaaagattgttgcaacttgcaagtgtgtttctgtatcttccacaaaaaaaaaaaaaaagcaatcaagaattatatttgtctttggtcaaaaaaaaaaaaaatatacaaaaaaaataaaaaaaaaaaacaacaaaaaaaaaaaaaaaaaaaaaaaaaaaaaaaaaaaaaattaaaaaaaaaaaaaaaaaaagggggggcccttttaaggggcccaattttacctcccgggggattgaaagtttaaattttttttttgggggacccaaattaaatttacggggcggggttttcacaagcgggt

SEQ ID NO: 17937 - DNA, 423 bp, Gossypium hirsutum
  Clone ID: uC-gsflnu33B138e10b1
tgttcgatctccaatttgttagcaaccccgttggaacccaagctggtgaggatttgggcctcaacgtaactggcctgaacaaccaggttaacgtctcaagcggggttgtcgagactcagattaacaacgcattatatcaaaagaaacctctggcaatttatcaagcggacaaggtgttgttgcctgaggagttttttgaagctaaatccccagcggctgcaccttcaccggcgacaaagaaatcatcaacagggtctaaatcgaactcaagagcatcagcaaccgcagatgagccagcttctgctgataattcaggatcaaccggaaggaatatggggttgggattcgttgttgggcttgcattggcttgcattggatttctctcatgagcggatatatatgaagtttgtctgcattttttac

SEQ ID NO: 17938 - DNA, 499 bp, Gossypium hirsutum
  Clone ID: uC-gsflnu33B138e11b1
tttcttaattcaaacactaccaatggaggagggaatggtgcaccctcctttttgaccatggatcaataacaatggaaggcactgatcagtgttcaccccatcacaacaaaaaagaaaaaatgtaccatatgtaccccccgtgtgtgcagaagctgaaccaaaataccctaacaaatgtgtgctttttccccatttatcagtcctttacctcgtataccctttcttttcaaaccatttcatttcaataattcagtatcaccttcttcatgaatctcctcattggtttcaaattagctccagtcccattagctgacattggcagagacgcatttccacttttgcatttattgatttgatggagaataaggaaaatcccgttttcaaaggaaaaaaacgggatcagagattgaattgagcagcgagaacaaaaaaaaaaaaggcttgggtaaattaccagcatcaccaccaaaaaagaaaaaggcacaaacaaagcatagag

SEQ ID NO: 17939 - DNA, 558 bp, Gossypium hirsutum
  Clone ID: uC-gsflnu33B138f03b1
ccggcccgtccttacttgctggacccacgcagtgcggtggatctctcagaacaggactaaaattgccgagagttgctccgctaccactccaccaagagtggtgatgagatgaccagcttgaaggactatgtgaccagaatgaaggagggtcagaatgatatctactacatcactggtgagagtaaaaaggctgttgagaactctcccttccttgagaagctgaagaagaagggttatgaggtcctttacatggttgatgctattgatgagtatgctgttggacagctcaaggaatttgagggcaaaaagcttgtgtcagctaccaaggaaggtcttaaacttgatgagagtgaggatgagaagaaaaagaaggaagctttgaaggaaaagtttgagggtctttgcaaggtcatcaaggatgtgctgggtgacaaggttgaaaaggctgtggcttctgatcgtgtggttgactcaccttgttgtttagtgactggcgagtatgggtggactgcaaacatggagagaatcatgaaggcccaggctttgagggataacagc

SEQ ID NO: 17940 - DNA, 163 bp, Gossypium hirsutum
  Clone ID: uC-gsflnu33B138f06b1
gctacttgcacgacgaagagtgtactaacacgggggatcttggtttgccgagggatgagtgagaaccacccaagcggagaaaacggccctgctaaggcccatgaggtgtccagcatggacggtcacatcgtggagcaggatggagcacacggttaagaaaccc

SEQ ID NO: 17941 - DNA, 404 bp, Gossypium hirsutum
  Clone ID: uC-gsflnu33B138f10b1
tcctcatcgcgtccgcccacgcgtccgctttcgtggttgtctattgaattctttccttcactttctcgagaaaaaaaaaatgtcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatg

SEQ ID NO: 17942 - DNA, 483 bp, Gossypium hirsutum
  unsure (1)..(483): unsure at all n locations
  Clone ID: uC-gsflnu33B138f11b1
tgtttcgcgtccgcggatgtttagtgagaacaagcgctaatacaataggagagtacgtgagatagtcgagcagagttggactgctgattgatctctcatgttggatttccatagtcagaacaaagcgtggatacattaggagagcatgtgagactgtcaagcatagttggactgctgattgatagctcaacgtttggtttggtttctatggaacgtcaaaaatagtccaatgtcgtgtctaaataacattgaacaccgcaaatgtgttgcaaactactttgtctttattatgttgtttgtgttaagaaaatgaacgctgttccttgggcagcatatttcatctagtactccaagcataaataaaccctaagtcccaagtaaatcaaacttgaaacttccattgggaagcttcttggtgatgatttgtgtaaatactaagtttatttttgctacagttattaaaactatactgctatatantgg

SEQ ID NO: 17943 - DNA, 511 bp, Gossypium hirsutum
  Clone ID: uC-gsflnu33B138f12b1
tgtttaattctctgatttttaattagcatatgacggtttggaccgtcttattggatctcagtttgctgctgcatagaccataaggtaccaatcatgttagtctccttcactttgtgcaagcaaacattgtctttaccacacaaacctcctggggagctcaaatccaatttctttaggccaaggctagaaaaagagaaggttgtgatcataatgggagcgactggaaccggcaagtcacggctttccatcgaccttgctacccggttcccggccgaaataataaattcggatgggactcgacataacgaccaagaagatcccgaggaagaacggtgtggggttccacaccatctgttaggtgaaataagtccctacacagatttcacggcaacggattttgttgacatggcttcacatgccatggattcggctttgtccggcggccgtgttccgatcatagcccggggctggaattcatacatcgaggccttagttgacgatgagggacttt

SEQ ID NO: 17944 - DNA, 448 bp, Gossypium hirsutum
  Clone ID: uC-gsflnu33B138g01b1
ctgttatctcccgtcaaaaatcagggttcatgcggatgatgctggtcttttagtacaacaggagccttggaaggagctaactttttggcaactgggaaacttgtgagcctcagcgagcaacagctcgtggattgtgatcacgagtgtgatccagaagaagcaggttcatgtgattctggatgcaatggggggttaatgaatagtgcttttgagtataccctcaaagctggtggacttatgcgtgaggaagactacccttacaccggcactgatcgagggacctgcaaatttgacaacaccaaggttgctgccaaggtggccaacttcagtgttgtttctttagatgaagatcaaatcgctgctaatcttttcaagaatggtcctcttgcagtggctatcaatgcggggttcatgcagacctacattgggggagtttcttgcccatata

SEQ ID NO: 17945 - DNA, 507 bp, Gossypium hirsutum
  Clone ID: uC-gsflnu33B138g05b1
cttcttcggatactgtaaaaaggatgaagctttatggggagtctcttgcccgttttgaaggtggatctccgtacatatatccactgtatggattaggcgagctgcctcaggcttttgcacggcttagtgctgtttatggtggaacatatatgttgaataaacccgagtgcaaggtggagtatgacgatgaaggcaaagtttgtggcgtcacatctgaaggtgaaactgccaggtgtaagaaagttgtttgcgacccttcctacttgccaaacaaggttaggaagatcggcaaggttgctagggcaattgctattatgagtcacccaattccaaacaccaatgattctcattctgtgcagattatcctgccacaaaagcagttgggtcgtaaatcggatatgtatgtcttctgctgttcatattctcacaatgttgctccaaagggcaaattcattgcatttgtttcaacagaggccgagacagatcaccctgagagtgaactaaagc

SEQ ID NO: 17946 - DNA, 419 bp, Gossypium hirsutum
  Clone ID: uC-gsflnu33B138g09b1
ttgctctgacaagcttggccttcattctctccgtcagcgccactggtacatacagagcacatgtgccacttccggtgaaggactgtatgagggactggattggctctcaaacaacattgcgaacaaggcttaaatgaaacaattgaaccgacggtcacactaacaatggccccattttgatgttctggatgtccatctcgttcaagtgttctggctttctttttttatatttcttattccctgcaaacattacccatttgtcacttgtagtttaaagaataatttgagtaaatttcgatttcctttgttgtattacctccatagctgcaaaaggaaagaaaaaggttttctcctagtttggggcagtttctacgttgtggcaaaattatatacataatctagtacaacttatgttgaag

SEQ ID NO: 17947 - DNA, 455 bp, Gossypium hirsutum
  Clone ID: uC-gsflnu33B138g12b1
tggttgtttgaatctatgcagcagctttcaaacaagaagagtaatgatgaggtcttcatcaaattgggatctgataaagataagagaaaagaggcttatgagaaagaagagagagcaaaaaagtctgtcagcattaatgaatttctgaagccagctgaaggggagaggtactataatccaagtggacgtgggcgcggtcgtgggcgcggctcaagaggatttggtggaggcagtgccgcaagagatgtggcagcgccatccattgaagaccctgggcacttcccaactcttgggggcaagtgaagaagtgagattcttttagagccccacatatgatatccatgggttttattggaattttaggtacttttaaatttcgggctgggaataagataaaaaaataatctggtttcctgtcgccaaagcatctccgaattttatgttgtaaaatgtat

SEQ ID NO: 17948 - DNA, 74 bp, Gossypium hirsutum
  Clone ID: uC-gsflnu33B138h03b1
attatattaaaaaaaaaaaaaaaaaaaaaaaaggaaggaaaaaaagggaaggggggaggaaaaccacagcttaa

SEQ ID NO: 17949 - DNA, 507 bp, Gossypium hirsutum
  Clone ID: uC-gsflnu33B138h06b1
ccggacgcggagggcagtgatgacggtggggaaccgtacgagaacaacccggcagcacctccggaagcactgaagaaggacaagaagaaggacaagaaagacaacaagaagaagaagcacaagaaggataggccgtacctcccctgcaaactcgcctccgcggtgcccatatcgccggacaccaagctcttccgctttcaggtgccggccgaccatgcccaccttgtccgcgccctaccgagtcccgtggcccacatcaggtcgcaggtgaagttaccgcctctgcctcatgaccctaccaccactgagttgctcaagggacgcccctacacggtcttgcgtcagttcccggagcctaccggcgagacgatgtcggcagcggaggagaaggatcattatctgcaagtgatgatcaagcgttatgacacctttggtgtgagagcgcacctgcatttcctcaacgaaggcgacacagagcagatgcagcttatcgatcatgacaagcac

SEQ ID NO: 17950 - DNA, 345 bp, Gossypium hirsutum
  Clone ID: uC-gsflnu33B138h07b1
tagcttaggaggacataaatgaggatatgtttaaccacaggagcgatttacttttgaaatacaataacagttcatatgaaagagcgagttcttctttacaacggaaaatcaattgtagagtctgttgttattcttgaatacattgaggaaacttggaatcataatgtctatttgccacaagatccttatgacaaagctaccgctagatactggatcaagttcatcgacgaaaagtgctgtcctaccctgtggctagctgcatggagccccgagaatgagcgagagaaagtgacgaacgaagcttgcgagtatatgaaaacgcttgaaagtgcgcttaatggaaag

SEQ ID NO: 17951 - DNA, 404 bp, Gossypium hirsutum
  unsure (1)..(404): unsure at all n locations
  Clone ID: uC-gsflnu33B138h08b1
tgttacgcgtacgaacctacaaaatcatggctggtgctccacagaattaacagtgacaccccagcacataactccaccacctgtacacctgataattccttcatgctttgccaaaagcgctaccctttaacatgcaatatgcccgtccctgacaccgttgctcgccaccacacccacccagttggtcccaaccagtgctgctctgccgttgtccaacagatcgccgtccccgtctccaccgtctggtctgttgtacagcgattcgataatgcccaggcttacaagcacttcgtcaagagctgtcacgtcatccgtggggatggtgaagttggtacccttcgagaagtcagcgtcatctcgggcctccccgctgccaggagcacagagcgcctngagatccttga

SEQ ID NO: 17952 - DNA, 316 bp, Gossypium hirsutum
  Clone ID: uC-gsflnu33B138h09b1
attgatctgagagaaagaagggaaagacgctgatggaaaaatggagaaagcactcaacacacaacaagttttgcttaatcatttacaaccctcttctcagtctcatcaatcacctgctgctattctatttgcttccaactgcgcggcgggggatagcgctgcttatcaccggacggccgcttttggggatgatgatgtgactgttgcggcacgtcacactgcaatttgcaaagcacagcgtggaggcttcaaagacacactcgctgatgatttggttgcccctgttttcaaggctgagattgatagcacaaaggtg

SEQ ID NO: 17953 - DNA, 510 bp, Gossypium hirsutum
  Clone ID: uC-gsflnu33B138h12b1
tgtttcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctgtcgatgttgacattggtgccaatccttcagccgaaggtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagaaaaacattgagggagcaaccaagtttttgctttcaaaattgaaggaccttcaatttttcgtaggagagagcatgcatgatgatggatgcttggtgttcgcttactac

SEQ ID NO: 17954 - DNA, 575 bp, Gossypium hirsutum
  unsure (1)..(575): unsure at all n locations
  Clone ID: uC-gsflnu33B139a01b1
acctatttaaatatatccccttgtattgcaaattccttcatatattctctcttcaatgaaaagaaaaaccccactttgaaaaacatgcataatctcaagaagattgttctacttttgttcttggtttcaacttttcttttatcaacttcaatggcaggtcgccaatctaagttcgtcaatatgttggctgaggaagttgatgcagcttttgaggagataagtgtcgaaggcgaagcaatccatgaaaggctgcttagagcaaatactaaagactatggaagatatgatccaacaccagctcttgtgaagcctcctttcaagcttatacctaattaatcaatcatgttggtgcatcatgtagcaatatatatgggtataaatgaagctttgccctatgcttcatttgcgtacttgaagaaaatgaagcaatatatatatataattagatataatatatagtatttagcaataaacctatatatagagagataatgtattatatatatatgncatatattataatactaagcttccaggcttaatgcttcatgcatgtaaaagacaatgaaagacac

SEQ ID NO: 17955 - DNA, 453 bp, Gossypium hirsutum
  Clone ID: uC-gsflnu33B139a02b1
agtgatttacagagtgatgatgagcggagacaaagatcgatactctatagcagctttcgtcattccaaatgagggtactataatcaagacacccaaagagtttatagatgaccaacatcctcggcttttcaaggacttagatttcatggagttcttcctttatgccttttccgatcctgcaaggcacatcgacaacggggagttgctccatgtctttgctggcctctcaccaccagtttccaattaaaatcatgctcatatagacaagtaaaagtttggttttggttttaaattaatgttacaaataataaattgagtcctatactcgagatctacgttctcgaactgtattaccatgttatattttgttataattgtgtactactaaatctactatgttgagtaatgttggttctatgaaatcaataagattgcagttcatggactgtttaa

SEQ ID NO: 17956 - DNA, 76 bp, Gossypium hirsutum
  Clone ID: uC-gsflnu33B139a03b1
cctactcgtccgcttgtttgtcagcggtaagtgtttaaagaaacaccaatatatataatcagttagggcttttatt

SEQ ID NO: 17957 - DNA, 278 bp, Gossypium hirsutum
  Clone ID: uC-gsflnu33B139a06b1
cttcttttccggttcttgaattctcccaaagccaaggacaaagccttccctttcacacttttcaagtttcaatctaaaaagaacatgggaagcagaatctagggtttgacaacaccaagtcttaacaaggtctgtttttttcttttcttttgggggtattttcccttttgtttgctcattgatcctttgcctgtttctgttcttcttcgccttctagggaaaaagatttgtcccttaaagctaaattcggcttggaatctgtttgaaaaaggcccttg

SEQ ID NO: 17958 - DNA, 423 bp, Gossypium hirsutum
  Clone ID: uC-gsflnu33B139a07b1
cttatcgcgtccggaagaacttgaaggtgctgagttggaagaacaacttctccagcctgcaacaactgctcctgcagctccagtgcaggtgcctgctggtaggcaaccagctcgtcctattcctcaaaagcgcactgctgaggaagatgaacttgctgcattgcaggctgagatggcactttaaggcatgtagtagagaagtgattttgttgatgggagtaccgcaggtcatgttgcaaaacatgaagagaggccatgttgtattattgaatcgtctacttcaaaatttgtgtggatttaagatttgacaatgtacataaagatttgcatgaactaaatgaagctccccctatcttttgttcgttcaataaaatatttatattctgaaaaaaaagccctgcaaaaccaggaaatagcccaaaa

SEQ ID NO: 17959 - DNA, 447 bp, Gossypium hirsutum
  Clone ID: uC-gsflnu33B139a08b1
gtttttctaaagaacgaaacaatactatagaatggaactattatagataacgagccacaccttatctatcaggttcataaaccaagtcaacatcctcataaacgctggcaggaccccacctgcattgatacccctcactacctgtccgacttgctcgaaatagggttcctctcgaacactgtgggcaacaggctcttctacgctgcgcttcctctgctgctatggatctttggccccgagcttagctttgttggctccatcaccatctgcactgtgctttacaaccttgacttggcgtttgggtttaggagaaacaagcatattgatgttggagactgtgaatgagggcgatcctactcgtacatgtaagctttaatgccctagcaaatgccatgcatgcggcactagattccttgggtcgcttatctaaccataagtatacgtgtg

SEQ ID NO: 17960 - DNA, 338 bp, Gossypium hirsutum
  Clone ID: uC-gsflnu33B139a12b1
cttacgcgtccgcccacgcgtccgcttttccattaatatttggaaagagagcagtaaagggaagcatgacagggggtatgaaagagacgcaagaaatgatggatgtgtgtgggaagcacaacatcacgtgcgatgtagagcttatcaagccagataaaatcaaccaagctttggaccgccttgccagaaacgatgtcagataccgttttgttatcgacattgccggaacctctaagctttgaagatcgaatcagtgttcccttgcatgttccttggcaatcgattcatctatatccaatatggttacactctacactacaacgagttttattggtcgt

SEQ ID NO: 17961 - DNA, 551 bp, Gossypium hirsutum
  Clone ID: uC-gsflnu33B139b02b1
ctttcgtttgggcgacactccatcctctcctggtagaactgtgggggaagaatcctcaccatcaattactcctataccttctgctgaagctgatcaacagtccacattggcatctggctccagtgttcttttggtcgataatcaggggaattccttgaacaataggtctcccaatcaatctcctaatagtcaagatagagcaggaccttcagaattccagtcgttttcagaatcattaaaatcaaggtttaatgctgcttcaatgagatacaaggagtcgatttcaaagagtacaagggggtggaaagagaggtttttctctcgcaacacttccatgtcagatcttggttctcaagttaggagagaggttaatgctggcattgcaacagtctcgcgtatgatagagcgtttagaaaccagagatgatagaacaaacacggctactgtatcaaacagttcggaagacagctctaatctagaatcaaataatcaccagacttctgatgctggtgaagggaactcctcaattgaaaccagtgcacaagctccat

SEQ ID NO: 17962 - DNA, 514 bp, Gossypium hirsutum
  Clone ID: uC-gsflnu33B139b03b1
cttcatcccttgttttccttcaacccaaacaaaacctaatctttttgaaaaaatggcaccaaaagctgaaaaaaagccagccgagaagaagccagccgaggagaagaaagccgtagctgagaaagccccggcagagaagaagcctaaggctggtaaaaagcttcccaaggaaggcggagcggctgccggagacaagaagaagaagagagttaagaagagcgtcgagacctacaagatctacatcttcaaggtcctgaagcaagttcaccctgacatcgggatctctagcaaagctatggggatcatgaacagtttcatcaacgatatcttcgagaagcttgctcaggaagcctctaggctcgcgaggtacaacaagaaacccaccatcacttccagggaaatccagaccgctgttaggcttgtacttcccggtgagcttgccaagcacgccgtttctgaaggtaccaaggccgtgaccaagtttacttcatcttgaaaaggctattagttgatc

SEQ ID NO: 17963 - DNA, 489 bp, Gossypium hirsutum
  unsure (1)..(489): unsure at all n locations
  Clone ID: uC-gsflnu33B139b04b1
ccctattaaacaaaaagcttaaatcaaaccccaaaatccagaatcccacatcctctaaatccccaaaacgggaaaaaaaagaataaagaagacatgaggacacagaagaggccgatgcatgcggtgtcgatgtgggtaagacgacagccgccgaaggtgaaggcttttttggcggtggtatcggggatggcggcattggttcttctccgagtcattgtacatgaccacgataacctcttcgttgccgccgaggctgtccattctatcggaatctctgtcctcatctataagctcaccaaggagaagacttgtgctggactatcactcaaatcccaagaactaacagctatctntntagctgttaggctggactgcagncttgctatggaatatgacatacacaccttacttgatttagccacattggctacaacattgtgggttatttatatgaatccgttcaaactaaagtccagctacatggaagac

SEQ ID NO: 17964 - DNA, 437 bp, Gossypium hirsutum
  Clone ID: uC-gsflnu33B139b05b1
ctttgttatcacataccaaaatggtgaaggccggtgccgtccttggcagcaatgaagtgtgttagcggaactgttttcttctcccaagaaggagatggtccaactaccgtgactgggaacctttctggtcttaagccgggactccatggcttccatgttcatgcccttggggacacaactaacgggtgcatgtcaactggaccccattttaatcctgctggcaaagagcatggtgctccagaagatgagaaccgccatgctggtgatctagggaatgtcactgctggtgatgatggctgtgcaagcttctccatcaccgactaacagattcctcttacaggcccaaactccattattggaagagctgtagttgcccacgcacatcctgtcgaccttggcaagggcggccatgagcttagcttaagcacaagaaattg

SEQ ID NO: 17965 - DNA, 234 bp, Gossypium hirsutum
  Clone ID: uC-gsflnu33B139b06b1
gctatgcgtccggcaaactatgtttttacaattgctgcaagcatgcacatgctagcctgacccaaaacttaaaactaaatttacaggtatacccaagatacagtcattcaagttgtcaacttattttgggtgttagcacaaatttgatgcaggcatcagggtttgtgactgacccaaactttgcatcagtggcagaaaaacgctcgcaaacatatatatagacttttatatttg

SEQ ID NO: 17966 - DNA, 530 bp, Gossypium hirsutum
  Clone ID: uC-gsflnu33B139b07b1
ttgatacgtttgccgaccccattaccttagagaacaacttgcattcgaaaccagtgggtcgagcccaagggttttatatctacaacaagaaagacatattcacagcttggttgggtttgtccttagttttcaattctacccataataaaggaagtataaacttctccggtgctgatccgttgatgaaccacacgagggatatatcagtgattggtggaacaggtgatttctcaatggctcgaggagtggctactttgatgactgatgcctttgaaggggaagtatattttcgtcttcgaactgatattaattagcatgaatgttggtgaaccattgaaagtctaattttggatttgaaactttttttagttggttacatcttgaagagtgtcatctatgaacaagcaccgtttgagactgttatttgtggctaataaaggacccttaatgtttggcttctcattgatttgtgatatgcatcttgtggatgtcgaacacaagtttatatattgtacatctttattttatgg

SEQ ID NO: 17967 - DNA, 99 bp, Gossypium hirsutum
  Clone ID: uC-gsflnu33B139b09b1
tgattttcctccggagaagccacggttgggggtgcattttaacttacacgtgcttgcaccagcacagcggccccatagcggcacctaagatcaaatcac

SEQ ID NO: 17968 - DNA, 87 bp, Gossypium hirsutum
  Clone ID: uC-gsflnu33B139b10b1
tgatgcgtccggcgaacccatggaaggaggggggtttttataaaaaatcggttgattcaacccaacagttcaataatggcagcaata

SEQ ID NO: 17969 - DNA, 278 bp, Gossypium hirsutum
  Clone ID: uC-gsflnu33B139b11b1
ttctacgcgtccggccacgctatcggtggggggggatttttataagcaacaggttgttctaccacaataggtcaatattgaaaccaataaggacgtataccgagctagtgatactacgaaaataatcctacatgatttggaatgtataggacgagtggaactcttacgcacagactgttggagcaacgacaagaatgagtagggcacactgcgctcaggccaaacacgagcaactctgacggaacaacaaattgtattttctgggggaagaaaccgga

SEQ ID NO: 17970 - DNA, 362 bp, Gossypium hirsutum
  Clone ID: uC-gsflnu33B139b12b1
tcccacgcgtccgcccacgcttccgctagggtgggagttgctttaaattcttatgcttgcttctaaagagggttacgattgcaatggtgagcttatcatatgttctttctcatcttacaacctatattgccttctttctgatcaaaaagaatgattgtgctggtgaacgaactttgttcatctctgatatatactgaaagaaacataatatatgatctggccaaaaaaacaaatttttccccaaatatttattgcacgggttttttggcaacaaactcagacatggctttgattatccttatagggcaatgtgccaatgtggttgcacgctaacactctcttttttttaaaccaaaaacatt

SEQ ID NO: 17971 - DNA, 488 bp, Gossypium hirsutum
  Clone ID: uC-gsflnu33B139c03b1
aattgttctcagtcggtattggtgcagatcgaattgtctgtgggggtgaagaaggtgttgttcgtatctggaacttctcagaagctctagaaattgagcagagggcacgggcactaagaggaatacgtttggagaataggatgaggcgacgcagacttcaaattgagatgaataataagggtggtcgaactgatcaatgttctgttgcagccaagaagaaaacagtcaatggtgataggaatagtgtctggcacagtaaacgtagcataagctccaaggtgaagacataacggctgtcagatgatttatgattatacttactttatgcctttaggcttccaacatattcatcttttttctattatgacaagattatacacaataactttgtgactgtatggtaactatgatatcttttagttatccatggattttaatctcatttgtatgatcttgtatttcaatcgtttagttcttgtgatattttt

SEQ ID NO: 17972 - DNA, 426 bp, Gossypium hirsutum
  Clone ID: uC-gsflnu33B139c04b1
aatatattctcgctttaccatgtaaacgggcgggcatgatctgatatgaatggcacacatgatacatcgggaggtgtaatctagatccacggactccaactgactgaacagatggtatgaggcccctaacggcggacgcctgaggtactgatgggtgatgcaccggtggaccgtagcaatgcaagcggtgcatgagggcagaaggaggcaccagcgggttgaccaggactacctgcagcgctggcaccattggcagactgcattacaacacgctggcctcgagctgattgcaattggatcggaggccctgctagggtagagagagagcctcgtctcatggattcttaccgtagtgtgcctgctgctgagaaacactctggaacggcaatggtgggaagacagtgcgtgacctgagtgattgcaaac

SEQ ID NO: 17973 - DNA, 196 bp, Gossypium hirsutum
  Clone ID: uC-gsflnu33B139c06b1
gatacgcgtccggagaaccgaaggttggagagggaggggtttatgcaaccggcggattgagcccaaagggggaacatcggcagcaagaaggacataagcagagcgaggggggcacggaagatactgcgacattgtacgcacaatagaggaacgatggacttgcccggcgcggaggcgaggaccaaccacacgcggg

SEQ ID NO: 17974 - DNA, 210 bp, Gossypium hirsutum
  Clone ID: uC-gsflnu33B139c11b1
tgttacgcgtccggcaaacccaaggaaagggggggctttaaaggaccaaccggtggatcccacccaaaggccgaaaaacggaaaccaaaaggccgacacaagaaccagcggaacacggagaatattggtacaataatcgcaccacataggaacaatggacattccacgaaaggagccgagggccaaccacaagcacgagcaggcaaacca

SEQ ID NO: 17975 - DNA, 314 bp, Gossypium hirsutum
  Clone ID: uC-gsflnu33B139c12b1
tattacccgtgcgacaaagaaaccgacggggggggctttgaagacccaagaggtggctacacaccaccggcgcaacatagcagccaacacggcccccgccagcccaagagctgccagtcaaataaggcaacagcccagggaagataaaagccaaaccaaaacacagggacttcaagccagaacagacataaaccagcaggagccaaccctgcgcgcggccaaggctcaagcaaggcatatggaagcagcccctggaaggggtacgcacaaacggcagagatgcagtcccacatcggggaccaaaaagacccacc

SEQ ID NO: 17976 - DNA, 293 bp, Gossypium hirsutum
  Clone ID: uC-gsflnu33B139d01b1
cttcgtttccgcccacgcgtccggttagctatgaagggaattgaaactggactccgtatccagggtaagctcgatgtaaagtctatcgatgtgccataatattgagcatccctgtagtatatgcagaactttctcatcatgatacgttctttatgtacacccaataatgataataagggtggaactttgtaaatggggttggtttatgtttatttgaagctagaatgctggcttgcactaaacgaccaatacctctataagataaatcaagaggccaagtcttgtttatctct

SEQ ID NO: 17977 - DNA, 480 bp, Gossypium hirsutum
  unsure (1)..(480): unsure at all n locations
  Clone ID: uC-gsflnu33B139d03b1
tctacttttccgtccgaatccactttcagttaagaagaaataaagccatgaaaacctgaatcgagcatctgggaaggaagttaagggtgatgatggcaatggtgaaaacaagaggaaaaggaaacggtctcgcagaggtaaaactgttgctggggcagatgtgtagtgcattaaggtacgagagacaaaaaaaaaaaaaactttattgtaactatgatggtacccattccccccccaaaaaaatatatatatatatgatggtaccctaactgcaacgcaatcaattgaagagatgctactgtggttttatgaggttttctctctccaaaaagacttgataacattttagatactctctagggggagttgagttgagctgagctaagagggatcaattttgtgtgtacttgcttatctcttttttcatggngtgttcggagaatgtaagcatgccgattcatcatttatttttttcacttt

SEQ ID NO: 17978 - DNA, 203 bp, Gossypium hirsutum
  Clone ID: uC-gsflnu33B139d07b1
tggatattcgtccggtgaacctttcggtaggggggggtttttttaaataactggttgatttagcccaaaggtgtaatatcgacaacaagaaggacatatacagagcaagtggtgcacggagcatattggtacattcttcgcataataaaggaacgatggacttctccgacagggaggcgaggaccaaccacacgcgggagata

SEQ ID NO: 17979 - DNA, 105 bp, Gossypium hirsutum
  Clone ID: uC-gsflnu33B139d09b1
attattacccgtccggaaaacccaacaaaagagagggatttaaaaaaccaaggggttgaaccaacccaacagcacaaaaacgacaacaagaacgacacccaaaga

SEQ ID NO: 17980 - DNA, 226 bp, Gossypium hirsutum
  Clone ID: uC-gsflnu33B139d10b1
tgattacgcgtccggaaaacccaaggctggggggggattttattaactaaatggtgggttcaacccaaaagaaccatatcggaaagaataaggacctagaaagagcagagagtacacggacaataagcctacatgaatcccaaagtagaggaggattggacttctccgacgcagatgcgagaaccaaccatacgcacgagcaatcatttctgcgctggacacaaaa

SEQ ID NO: 17981 - DNA, 110 bp, Gossypium hirsutum
  Clone ID: uC-gsflnu33B139d11b1
tgaatacgcgtgcggagaacctagggcaaggggggggtttaaagaaccaagcggtggattcagcccaaaaggacaatatcggaagcaaaaaggacgtaaaaagagctgac

SEQ ID NO: 17982 - DNA, 85 bp, Gossypium hirsutum
  Clone ID: uC-gsflnu33B139d12b1
tgctcacgcgtccgaaaaaaaaaaaaaaaagaaagagattttgtcgaacgatctggtggttccaaacaaacagaaaaaaagcaaa

SEQ ID NO: 17983 - DNA, 446 bp, Gossypium hirsutum
  Clone ID: uC-gsflnu33B139e01b1
ttttgtattgtaaaccctttgccaacgccgtcgcagtactctctgaaccgatggcggaccaatctcctgcggatcagaccccaccgttctccggcatgcagtctctctccgtcgattctcaacctccctcctcctcttcaactccacagatgagtttagaagaaaagtttaagattataagaagtgtaggggaagaatgtattcaagaggatgaactgctaaatcttctaaatcacaaacctgaacccatttgctatgatggcttcgagccttctggcagaatgcacattgctcagggagttatgaaggcaataaatgttaacaaactgacctccgctgggtgtagagtaaaaatctggattgcagattggtttgcacagctaaacaataaaatgggtggtgactcgaagaaaatcaaagtagttggacagtatttgattgaaatc

SEQ ID NO: 17984 - DNA, 432 bp, Gossypium hirsutum
  Clone ID: uC-gsflnu33B139e03b1
gatatttttccctgcaaccattagtaaccatcggtcttcttcttactcctcggagaggatttgaaagggggcttaaaaggcaagtcatttgaggcacagggaaggccatgcctttcttcctatttttactttattgtgcctttatcttcatttctgcatctttgttttcaatcagagttcagatcaaaatgagcataaaacacatgaagaaagtccaaatttgtagcagattaattggttgttccaagctgttttatgttgtttcccctcaaagtttgttgaacaaaaatggttggttatacgcctgctatttcatctgaataattagtgcttcattgcttgaatttctttcagctgacaaaatgggtgggtttgaaatgtttcacattatgaataaattgttttcatcaaaataaaaaaacaagggcggcc

SEQ ID NO: 17985 - DNA, 115 bp, Gossypium hirsutum
  Clone ID: uC-gsflnu33B139e04b1
gatacttttccggtgaaacataagttaccatggggcgtgtttttataaatgggggattcttcccaaggggaggatatcgccaagagagcagacctagacacagcggggggggtat

SEQ ID NO: 17986 - DNA, 156 bp, Gossypium hirsutum
  unsure (1)..(156): unsure at all n locations
  Clone ID: uC-gsflnu33B139e09b1
nttggtttttcgtccggcaaacctaacgcaagggggggttttttttaaataagtggttgattcaacccaaaggtgcaatatcggcaacaatagtgacataaaaagagctggtggggcacggacaataaggctacattgttcgcatagtaaaggagg

SEQ ID NO: 17987 - DNA, 242 bp, Gossypium hirsutum
  Clone ID: uC-gsflnu33B139e10b1
tggttacgcgtccggagaaccaaaggcaggggggggatttaaacatataagtggttgattcaacccaaagggaggatatcggaagcaataatgacatataaagagcgggctgggcatggacaatatggctgcattaatcgcacagcagaggaggattggacttcaccgaagcaaatgcgagaaccaaacaaacgcacgagaagtcaatcctgcgctggtgcaaaacttgcgcataggaaagg

SEQ ID NO: 17988 - DNA, 448 bp, Gossypium hirsutum
  Clone ID: uC-gsflnu33B139e12b1
aatgattacccgtacgctaaacacagggaaagggggggtttttaatggctatcctgttgatgccgctcgaaagctcaacatcgcaagccataaggccactttccgctccatctgtgcaacaaagatattccaagattattgccactcttggagacgagtgcacatgccgcgaacgaagtggaggcgaatgctacagcactaggacccaaccctgctctcaggcttacctcaagtgcctacctgggaaactacattaggattgttgccccaacataactcgaatgtgtggtttctaactctgggtcgtcctatgtatatatatagatatgcacactaatggagtgctagaaacttaaagggtagaaatgatggattctctaagctcacaacagtgatcaatgagaccttgaaccccaaaaaatcacgtacactacgatattgacaaggc

SEQ ID NO: 17989 - DNA, 145 bp, Gossypium hirsutum
  Clone ID: uC-gsflnu33B139f03b1
gctacgtttccggggaaacattacttaccatgggtgttttttttattggatggatcggcttcttaagggaaccaaaactgcgagggatctgaagtagacgcctgggggtgtgtatgtaccagatgctacactattatgcgacgat

SEQ ID NO: 17990 - DNA, 250 bp, Gossypium hirsutum
  Clone ID: uC-gsflnu33B139f12b1
atgattacccgtccggcaaacccagcgcaagggggggcttcaaacgaccaagcgggggatcccacccaaaagcacaaaaccggaggcagaaaggacgccaacggacctggctgtgcaccgaagaaaatgcaagctgatacacacagcagaggacgagcgcacatcacccaaaggaaggcaagggccaaccaaaagcactaggaggcaaacctgcgatgcagccgaacacaggaaacgacaggggaaacaa

SEQ ID NO: 17991 - DNA, 448 bp, Gossypium hirsutum
  Clone ID: uC-gsflnu33B139g01b1
cctacattctttggcacttaaccaaggacgaaaagacctacggtgtccctcgtcgtcgtctcaccggtcactctcacttcgtccaagacgttgtcctctcttccgattctcagttcgctctctctggttcctgggatggtgagcttcgtctctgggacttatctgccggtatctcagctcgccgttttgtcggccacaccaaagatgttctctccgttgccttttcaattgacaaccgtcaaattgtttctgcttctcgagatcgaactatcaagctatggaatacccttggagaatgtaaatacacaatccaagaaggtgacgctcataccgactgggttagctgcgttcgtttcagcccaaatactcttcaacccaccattgtttcagcttcatgggacaagactgttaaagtttggaacctgaccaactgtaagattcgtaacac

SEQ ID NO: 17992 - DNA, 118 bp, Gossypium hirsutum
  Clone ID: uC-gsflnu33B139g04b1
cctacttgtccggtgaaacttagcttagaagagggggtgtttttatagatgggatcaacttctcaaaggtatcatatctccaacagaccagtcctagacacttcgggtgatgtatgca

SEQ ID NO: 17993 - DNA, 105 bp, Gossypium hirsutum
  Clone ID: uC-gsflnu33B139g05b1
ccttcgtttccggtgaaactaagcttacacgggggggggtttttataaatgggatgttgttcccaaaggaatcatctttccaacaggccggtcctagacacctcg

SEQ ID NO: 17994 - DNA, 141 bp, Gossypium hirsutum
  Clone ID: uC-gsflnu33B139g06b1
cctacttgtccggtgaaacgttggttacacaggggggggtttttataaatggggggtttatcccaaagagatcatctctccaacaggcgtgtcctagacacctcgggtgagggatgcacaagatgcttgaattaaacgcac

SEQ ID NO: 17995 - DNA, 136 bp, Gossypium hirsutum
  Clone ID: uC-gsflnu33B139g08b1
tcgcctacgcgtccggagaagcataggttagggggggttttattgatataggtggggggttcaacccaaagggatgatctttccaacagtaaagacatataaagagcgggctggggatggacaatatggttgaatt

SEQ ID NO: 17996 - DNA, 157 bp, Gossypium hirsutum
  Clone ID: uC-gsflnu33B139g10b1
tatttcgcgtacggtgaacacaacaatggacggggcttttattatctagatggcggcttcaaaccaaagggatgatatcgcaagcactaatgacatagagagagagggcgggacatggactatatcggtgcatgaatgccatatcagaggagaatta

SEQ ID NO: 17997 - DNA, 288 bp, Gossypium hirsutum
  Clone ID: uC-gsflnu33B139g11b1
ttgttactcgtgcggaaaagccagagcaggggggggctttgaatatacaagtggttgcttccacccaaaggtacaataacggcgggacaagggaccgtcacggagaggtcgggacacggagtataacgtaagctgaaatccgtagcaaaggagtattagaattcactcaggccctggcggggatcgacacattccacagtgagtgaactgtgccattctgaaaaatctgggaaaggataagctgcaatagcatgaatattatgctagagccatgaattgaaaaggtgg

SEQ ID NO: 17998 - DNA, 279 bp, Gossypium hirsutum
  Clone ID: uC-gsflnu33B139g12b1
tggtttcatccatgaaaacacgcgctagtgcgggcttcttatttgcgggttgttgttcaaaagctatgggctaatactgggcatgcaaatgagatcaaaggacctagttttgtatcttcgaagttaatatcttatttacattggtatttaccgggctctttcacccataatgtattaaatattaactcgatattctatgtttaatatctatcatcgagcctaatatattttattttaggttacaaaatgacaatattagtttaaaagtctaagtacact

SEQ ID NO: 17999 - DNA, 477 bp, Gossypium hirsutum
  Clone ID: uC-gsflnu33B139h01b1
gttaattgctgaggaatggaaaccaaagctgggtgctcttgacatggatgctagtaacggtaactcattggaagctcatgcttttctgcaacttatcgatacatttggtattgcttctggtttcaacgaagaagaactttcaaggctgataccaatggtctctcgtcggcgacaagcagctgatctctgccgttcccttggtttatctgagaaaatgccaggtgtaattgaagttctggtgaaaaatggaaggcagattgatgcagttaacctggcttttgcattcgagctaacagagcagttttcacctgtgccattactgaaatcctacttgaaggaggctagaaaagcttcttcacctgtaaagcctggaaatgcctctcccactgcccagactgaagttagtgaacgggaattgactgctcttaaggctgtgattaagtgcattgaagacataatctggaggaagcataccct

SEQ ID NO: 18000 - DNA, 485 bp, Gossypium hirsutum
  Clone ID: uC-gsflnu33B139h02b1
aatagattttgtcttcctcgtatactctgaagtcttctggtaatagcagctgttgtgaccctgaaattaagcgactgaaaatgaagaaaatggtgaaggttctaaggggaatcgttccgggtgctgatgagatggatactgctgctgttctcgatggagctgttaggtacctcaagtctctcaaggttgaagtacagaagctcggagttgggaatttcaaatattaagattgaacccacatcatagtaatgaagttctcacctttgtatacctctccataactggcctctctctgatggtttgcagcctagaaataatgaagacaggtatttagaatcaatatttgtgttgtatgcatgaactctggttgtgtaatatgaataccaccaagtaccaagtttctagctgcctggtatatcattatgggacaagcagttgctatgaatgttattgcactagtagtttctactgtcaactctgtctta

SEQ ID NO: 18001 - DNA, 302 bp, Gossypium hirsutum
  Clone ID: uC-gsflnu33B139h03b1
cctacgtgttcggtgaaccaaaagtcaaaaaggggctttgttctatgataaggaggtacgtaacaaaaatatcactcctgctgtagaccataactagagccctcgggggaggtatgcaacagagggtcgactaaaatgcccccatggggccggaaaagagtgcgagatcagctgcggaatagatatctgactgatgtgaaccaggttctccggagaccgcgaatgtggattaggggacgggaaccagactcaggacttggcattcgtttactggccgaaacgaagatgcttcaaggtggggc

SEQ ID NO: 18002 - DNA, 107 bp, Gossypium hirsutum
  Clone ID: uC-gsflnu33B139h04b1
cctacgtgtccggtgaaacgatacttatcaaaggggttttttctatggatgggatgggcgtctcaagggtatcacctctccaattatcaagtcctagagacctcggg

SEQ ID NO: 18003 - DNA, 136 bp, Gossypium hirsutum
  Clone ID: uC-gsflnu33B139h05b1
cttacgcgtccggtcaaactttgcttataaaggggcttttttttatagatgggatgagtggcccaaaggtatcatccctccaactgtcctgtcctagagacttcgggttatgtatgcaccatatgcttgcatcaaa

SEQ ID NO: 18004 - DNA, 121 bp, Gossypium hirsutum
  Clone ID: uC-gsflnu33B139h06b1
ccttcttgtccggtcaaacgttggttacataggggcttgtttttataaatggggggttcatcccaaagggatcacccctccaactgaccatacatataaagcgcgggtgaggtatgcacaa

SEQ ID NO: 18005 - DNA, 112 bp, Gossypium hirsutum
  Clone ID: uC-gsflnu33B139h08b1
tgctttctcgtccggacaagcatacgcaagggggggtttaaatcaaataggtggggggttcaacccaaaggggggatctctccagaaaacatgacctaaaaagagcgggcag

SEQ ID NO: 18006 - DNA, 317 bp, Gossypium hirsutum
  unsure (1)..(317): unsure at all n locations
  Clone ID: uC-gsflnu33B139h09b1
ngttgcttactcgtccggaaaacagcaggctggggggggtttaaatcaactaaggggttgcttccacccaaagagacgatatcgcaagcaatcgccacctatcaagagcggacaggagctggccaatatgcgtgcactaatcccatcgcagagaagaataagaaatcaccggcgcaaattcggaaagcatcactacgccagacgaagaatttctgcgattctggaaaacttgcgcaaggaaaaggggctcttcagctgacttagcttactggcatagctagtaaaccggacgccaaatctaagaagtctgacgccgc

SEQ ID NO: 18007 - DNA, 471 bp, Gossypium hirsutum
  Clone ID: uC-gsflnu33B139h11b1
tgttacaggtgcggactatatccatgggcagggcgccataaatatgtaagaggcggctgcccagctaacatacaataatgttacaacatggcatcgggagggaggcagagtgagtcagaatattcctataggtctatgtggaatcaaggttgaagtaaagaacactcaggccaaggcaaaacacgacacattccacaggaagaagaacctgctctactatgaaatttcggacaagagtaactacaatttcgcgaaacctttcttgtaccttgctaggaagctgggaggcgatcctaatctccactgcggggagtctcctgcacttgctacttcggaagtacacattgacttggctgcacagcaacaggatgaggctgaactagcagcgggagtcagacaaccccttccagatgatgacgatgatgcatatagatagaggggattcccttgccacacagctatcaacaaatt

SEQ ID NO: 18008 - DNA, 493 bp, Gossypium hirsutum
  Clone ID: uC-gsflnu33B140a01b1
ttagaactccacgacacagatccaaggagtgggggaataccctcacacaaattctctctctaaatcttaaccgaaaaggtctccaaaaaagactaccctttttgcccatttactctccttattcaacaaattcagcatcacatccccaaaatagtcgcttttttatctcttgctttcttcatctgcttcaagtcatggctggtttagcacctgaaggatcccaattcgatgctcgtcaatatgatcagaaaatgagtgatttgctccaaacagacggagatgattttttcacttcttatgatgaagtttatgacagtttcgatgcaatgggacttcaagagaaccttctgaggggcatctatgcatatggttttgagaagccctcagcgattcagcaaagaggaattgttccattctgaagggtcttgatgtgatacaacaggcacagtctgggacccgaaagactgcgactttttgctctggaattttgcag

SEQ ID NO: 18009 - DNA, 173 bp, Gossypium hirsutum
  Clone ID: uC-gsflnu33B140a04b1
ttttcagctgtctcggcatttgcacaggatgaggaagaccaaggtcttgttatgaacttctacaaggacttcttgctctcaggctgaagacattatcaaggagcaagttaagctactgtacaagcgacacaaacacacttgatcttctgggttgaaaaacattttccatgact

SEQ ID NO: 18010 - DNA, 475 bp, Gossypium hirsutum
  Clone ID: uC-gsflnu33B140a06b1
tagaaaattttgtctcgtctttagggagggaaaagaaagtcaatattttttactaaatccctgtaaattcgccaaaaagactcagaactccataagaagttgtcttcccgtaatggattttagtcagcctccagttgaaaactatgccaaccccaagacttgtttctttcatgttctgtcaaaggctgcagcattggctttttacatcctgtcagctctctttttgaacaactatgtgatcatatttgcggtgactgttgttgtttacgcccttgatttttgggtggttaagacagttagtgggcgtatattagtcggtttgaggtggtggaacgaaattaacgatctcggcgagagtgtacggagatttgaatgtctcgaccaagaagtcgtggctaggatgaacaagactgattcatggctactttggtggaccctctacctctcagcggcggcatggattgtgcttggaata

SEQ ID NO: 18011 - DNA, 513 bp, Gossypium hirsutum
  Clone ID: uC-gsflnu33B140a08b1
ttcgtctttccacgcgcccggtggagacctggtccgagtacccacccttgggtcgttttgctgtgagggacatgcgtcagaccgtggctgttggtgttatcaagaatgttgagaagaaggacccaaccggtgccaaggtcaccaagtctgctgctaagaagaagtgaaccgtgctggctaaacctaatgaagtttccgcagatggagtattttattatgataataatagtttgatagactttatcatttatgatatagttggtcttttgcttggttttgcatgttatagtgtggtgccattgttgtctggtaactgttctcagtattgggtgcttgacagacggtggcatagctatggcaggtggtctctagcgttatctggttttgtttaatttactactgtatcttgtcattgtcaagagggtgccccctttggttttccaaggtggctcgaaacttttatgattctcgttgaagctgcggaattatttattatgaaatcatgctgtattt

SEQ ID NO: 18012 - DNA, 514 bp, Gossypium hirsutum
  unsure (1)..(514): unsure at all n locations
  Clone ID: uC-gsflnu33B140a09b1
tttttaaaagacataaggccttatggcatcaaagagaattctcaaggtgctgagggaactgcaaagagaccctccaacttcatgcagtgcaggtccggtggcagaagacatgttccagtggcaagcgacaatactcggccctggcgacagcccctattgcggtggggtttttattgttaacatccacttccctacggactaccctttcaagcctccaaaggtcgtgtttagaaccaaagtgttccacccaaacataaacagcaatgggaatatttgtttagatattcttaaagagcagtggagtcctgcactcaccatttcgaaggttttgctatcgatatgttcgctgctgacggacccaaatgcagatgatccacttgttcctgagattgctcatatatacaagactgacaaagtcaagtacgaaacgattgctcgtagctggacttacangtatgcaatgggttgacccacacttgcccgtgtattttggtgtcactctactctcccccac

SEQ ID NO: 18013 - DNA, 480 bp, Gossypium hirsutum
  unsure (1)..(480): unsure at all n locations
  Clone ID: uC-gsflnu33B140a10b1
ttagatgaggaaaatcatgggtgccaaagggcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgctctgtctgctagggaaggcatcgtttcgttgggaggcccttatattcctctcaaaactggaagacgagacngtcgaaggag

SEQ ID NO: 18014 - DNA, 347 bp, Gossypium hirsutum
  Clone ID: uC-gsflnu33B140a11b1
taaaaaaaaaaaaaaaaaaaaagaaaaaaagggaaattttaaaaaataaaaagataaaaaaaaaaaaaaaaaaaaaaaaaaatagataagtcgaagacataccgtattgtaataataatacaaagtataaggggggggggctttttgggggccccaggtttccttcccgggttctggccggttatagcttttttttggggccccctagtttaatttcttgggccggggttttccactcgtgggtggggaaacccctggggtttccccactttaattgcttgggggaaatccccctttttgccggtgggggtttttggaagggggcccgccccgtgcgtttttcccaa

SEQ ID NO: 18015 - DNA, 429 bp, Gossypium hirsutum
  Clone ID: uC-gsflnu33B140a12b1
catttctcgagtctttttcggggttctctgtttttttttttcgtcggatcttcaacccttttttcaaaaatggctgagcacgaagagaagaagcacgaggaatcgttgatggacaggatagcagagaagatccaagctcatgattcgtcgtcatcggattccgataatgacaagccatcggaatcgtcgatcaaggccaaggtcttccgtctttttggaagagaaaagcccgttcaccacgttctcggtggaggcaaaccggctgacattttcctttggaggaacaaaaagatatcggcaggagcgctcggtgtcgcaaccgtgatatggattttgtttgaaatgctcgaataccaccttctaacactagtgtgtcatttgttgatacttgctcttgcattactcttcttgtggtcaaatgctgctacc

SEQ ID NO: 18016 - DNA, 497 bp, Gossypium hirsutum
  Clone ID: uC-gsflnu33B140b01b1
tgtaaatttgaggaagccttggagtttgctgaggaagtgcttgcaccgaggggagaagagaaccaaacctttctagaagaattagagaggaccgtttcgctcctggcgtttgaagatgtttcaaactgcccgcttggagagcttttggacatatcacaacgcattaagacagcaagcgaagtgaatgcagccattcttactagccagtctcatgaaaaagacccgaagcttccaagcttactaaagatgctgatatgggctcagaatcaactcgatgagaaagctgcttatcctcgcataaacaatttgtcaaatgccacgctcgaagatcccacggtttgaaacaaaggttcgaaaaacactatggatgaatctgtagttgctttgaaattgaaacatagatagaactgaatggaatccagttaggaatttggtggatgcattgctattttgctatgacgtatttgacgtatttgatgtcttatcttcatttttag

SEQ ID NO: 18017 - DNA, 444 bp, Gossypium hirsutum
  Clone ID: uC-gsflnu33B140b05b1
ttgattgctcaaaaccaaatcatctttgctgtgctattttggttcgttttgctaagaactggctaacgcacagcaaaaaatcgtggaggaaaccaacaagaaccaagcggtggttcttgccctctatgaagccttaaacacacgagacgtcaacaccgttcaccaaatccttgctcccgatctagagtggtggttccacggtccacccactcaccagtttttgatgcgcttactcaccggcgcttcatccgacgatcctttccttttcgaggtcgaccctgttttagtcaccgcctttggatccaccgtcatcgtcgaaggctgtgacaacagccgttcgatctcctgggttcacgcttggactgttcgtgatgggacaattaccccagtgagggagtattttaacacttttctcaccgttactcgccttggagactctccacc

SEQ ID NO: 18018 - DNA, 413 bp, Gossypium hirsutum
  Clone ID: uC-gsflnu33B140b06b1
ttaaataattgatctgatatgcacccttgtgttctccatcattgtgctgggaacaaccatcaggatgctacgaaacattttggaagttcttatggagagcacaccccgagaaattgatgccacaaggctagagaagggtttatgcgagatggatgaggttgtcgccatacatgaactgcacatttgggctataactgttggtaaggtgttattagcttgccatgtattaattaagcctgaagctgatgctgacatggtattgaacaaggttatagattacatcaagagagattacaatatcagtcatgtgactattcagatagaacgccagtgtgaatccatggcgcagtaagttttgtagttttaccgtttttggcttttggtatattttcaagatttcttcatattcctct

SEQ ID NO: 18019 - DNA, 366 bp, Gossypium hirsutum
  Clone ID: uC-gsflnu33B140b07b1
tcccacgcgtccgcccacgcgtccgatcagaatcagttgcaaataagatagagagagagagagagagttggactagaaaaaggaaccatacaacgggatggtttgattgtttgtttttactaaaatttattgatgatttgtggttagatggttagattttgattttgataggagtttgcgtgtgggatggatggtaagttttggtggaaaagaaatgaggtctctgcttgaagaagaccaaatggggtctgaataaggtgatggggattgtgtgggagatgatattttgtcattggtgcagttcagctttgctgtttgtgattctctattaattgattaaaaaaaaagaggattttcactttctaa

SEQ ID NO: 18020 - DNA, 492 bp, Gossypium hirsutum
  Clone ID: uC-gsflnu33B140b08b1
tgtttccacctccaagaccgggaagcatggtcatgcaaagtgtcactttgttggaatcgatatcttcactgccaagaagctcgaagatattgttccttcttcccacaattgtgatgttccgcatgtcaatcgtactgactaccagttgattgacatttctgaggatggatttgtgagtttgctgactgatagtggagacactaaggatgatctgaggctcccaactgatgagaacttgctgaaacagatcaaggatggttttgctgagggaaaagacctggctgtgtctgtgatgtctgcaatgggggaggagcagatctgtgctctgaaggacattggtcctaagtaatttgagattttattttcggactttaattgcaattttagattaaagctttttatttttttcaagaactttaatagctttgcgtcttggaatttgggtgtttcttttttttatatatatctggatacgagagaaacaccattgct

SEQ ID NO: 18021 - DNA, 405 bp, Gossypium hirsutum
  Clone ID: uC-gsflnu33B140b09b1
tttgccgccctttttttttttttttggtttttttttttttttttttcttttttttttttttggaaaaacaaacattggaaggacttaacatagcactatattgtcacctcaaaccattttcgtaacaacaactaaatgtcattatttgcattgctcgaagaatgtaaaattgatgatgttaagctcaaaaagaaagagacagacatggaaagttaagttcaacatatatttggggcataatatttgggtttttgtctaaaatattagtgtcaggggttcccccgggaggggcaccaaggtcgaatactcataggggaactgtgacaggccctcaagaaagaggtgaattctagaaccttccgccaaccggtttagagctttgacctccgccattgacgctgtgaa

SEQ ID NO: 18022 - DNA, 300 bp, Gossypium hirsutum
  Clone ID: uC-gsflnu33B140b10b1
ttccacgcgtccgcccacgcgtgcgaaaatgggaaataaaaaaaaatttaaaaaaaaaaacaaacaaaaaaaaaaaaaaaaaaaaaaaaaacaataaccaggggcggccgtttggccgcccccaagcttctccaccgggggcgggcgcctttggggcctctttcttggggcccccgggcccacaaaccgcgggccgtcgttctgcggcgtctcgacggggacaccgggggggcccccccgcttccctgccttggggctcccccgcttttcccccgctggctttctggggaggaggccccc

SEQ ID NO: 18023 - DNA, 502 bp, Gossypium hirsutum
  Clone ID: uC-gsflnu33B140b11b1
taatggctgcaggtgaagagggagaattcgtctacagaattagcactgctgaggaatgggaagcattgcaaaagaatggatccgcttttggcggtgacttagacaaatgctgtggtttcattcacctcagctcccttcatcaggtgaagccgacactgcagaattttttctccaacgtcaagctggatttgtaccttcttcaaattgatgctaagaagcttggagatggattgatatatgaagttgtagatggttccaacagcttcccgcacttctacggctcatctcgaagctttgctcctcttccattagatgcagttacaaaagctgagaagctatcggtagtagatggccaattcagctgcagtttactgaattagcgctgatgcttccaacagcttcctgcacttccatcgtgtggagataatgtacgcattggatttggatgtaactatacaatgtgatgccactgtaatactacactcgctataatagccatgat

SEQ ID NO: 18024 - DNA, 521 bp, Gossypium hirsutum
  Clone ID: uC-gsflnu33B140b12b1
cgtttttattctctagagtcttcccttgtccctgttaaaatctgtcactgtgatcattaatggccaccgctgaacctgaagttccagtcactgagcagcagcccgcggcagcagaggagccaaagccggcggaaaagcctgtgaaggagaagagacccagagctccaaaggagaaaaagcctaagcaacccaaatccgcagcacatcctccttattttcagatgatcaaggaggcgcttttggctttgaaagagaagagtggatcaagtccgtacgctatagcgaaatacatggaagagaagcacaaggcggtgcttccagcgaatttcaggaaaatcttaggtcttcagcttaaaaactcagctgccagaggcaagctgataaagatcaaggcctcttacaagctctcctgagccggcaaaaaagagagagcccctgttacgaaagctaagatggagaagaaagctaagccagcttcgaagccgagaaagctgaggcgacatagagccaacaagagagtc

SEQ ID NO: 18025 - DNA, 230 bp, Gossypium hirsutum
  Clone ID: uC-gsflnu33B140c03b1
tgccacgtttccggaaacaaagactcacagggacgggttcaatttgcaggggattgctgtccctaaaccagcagctgagggactaactcctcggaagagaaacagggacaacgacgaagaaggcgggcacagcacacatttcctgacgctcacagaagagaaagcccgtataaaaacccaacagcctagggcaaggacgagcccagcgagagcaacaaggccatgccggg

SEQ ID NO: 18026 - DNA, 465 bp, Gossypium hirsutum
  Clone ID: uC-gsflnu33B140c05b1
tgcacgattccatggaatggaaaatcaagaggaagaggaggatgtcaacttctatatctacaaagacagaacctaaaaggcagagattatttactcactgcttcctccccatgattcttttgctatctgctgccttcttcattggaagtgcatttataatcacagactataaagagaaaattctaggatgggggtcagctatggttttgcagtactcaagatctaagatgtgtgagactcagtgcagggcttacggaagtgaagcattacctagaggaatcatttctgaaacatctgacttggaaatgcggccattatggggtgcgcagaataagaagaagccaaagctgtcaatgaacttgttagccatcgcagtcggaataaagcaaaaagaaaatgtcaacaagatggtcaagatgtttccagagagtgatttctgtgtgatgcttttccattacgatggca

SEQ ID NO: 18027 - DNA, 434 bp, Gossypium hirsutum
  Clone ID: uC-gsflnu33B140c07b1
tcccacgcgtccgcccacgcgtacggtcaggattgctttaacacttattggggacagagggattccaaagggcgcaaccactgaatcactctagaaagaagccatacatgttgtcagctgcggatatgaagataaaacagattgtaggaaggaagatggggggatatatggctcagttactgaggatatattaacaggcttcaagatgcactgtcatggttggcggacagtgtactgcattccaaaaaggcctgcatttaaaggttcagatgcaatttacctctgagatcgtgtgcaccaagttctacgttgggctctgggatccgttgaaatcttcttgagcaggcattgcccaatatggtacggctatggttgtggatagaaattcttggaacgcttttcatatatcgcctcagctgagtaccctttgccat

SEQ ID NO: 18028 - DNA, 515 bp, Gossypium hirsutum
  Clone ID: uC-gsflnu33B140c08b1
tgagaaacggcgcctccgcccaacaacaatggttcacgtctccttttaccgcaactatgggaagacatttaagaagcctcgtcgtccttatgaaaaggaacgattggatgctgagttgaggctggtgggagagtacgggctgcgatgcaagagggaactctggagagttcagtatgctttaagccgaatcagaaatgctgctagggatctattgaccctcgatgagaagaacccgcgtcggatctttgagggtgaagctcttcttcgcaggatgaatcgatacggactcttggatgagagccagaacaagcttgattatgtattggcgttgacggtggagaacttcctcgaacgtcgtcttcaaactcttgtgttcaagactggtatggctaaatctatccaccatgcccgagttctcatcaggcagaggcatatcagggttggaaggcaggtagtcaacattccatcattcatggtgagggttgattcacaaaagcacattgatttctcgctga

SEQ ID NO: 18029 - DNA, 402 bp, Gossypium hirsutum
  Clone ID: uC-gsflnu33B140c09b1
tcccacgcgtccggacaccacagatgatgaatttaatatttacaaaacggtatactacgaatccaacttcagctgaaaaatatgtcaggggaagaaggtgcgggtgcccaacccgaggcggcgcctgcactcggtgagccaatggacattaacacagacttgctccttgtggttaggaagtcacgtgctcacggtgggctcgcacggggattacatgaagctgctaaggtaattgaattgcacaatgcacatatttgggttatagctgatgactgtgaccaggcggattatgctaagctggacaaggcacttagtgctgatcataatgttaaagtgctacgagccaagagtgcaaaataacttgttgagtgatctggattgtgtaagatagactttgagggt

SEQ ID NO: 18030 - DNA, 449 bp, Gossypium hirsutum
  Clone ID: uC-gsflnu33B140c10b1
ttctcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccaagttggttgggagcaaatttccttttggccaaa

SEQ ID NO: 18031 - DNA, 455 bp, Gossypium hirsutum
  Clone ID: uC-gsflnu33B140d01b1
ttttatgttgagaatgcgagtactaaggcgtttgcttggtaagtacagggaatccaagaagattgacaagcacatgtaccatgacatgtacatgaaggtgaagggtaatgtatttaagaacaagcgtgtcttgatggaaagcatccacaagtccaaggctgagaaggcaagagagaagacactctcagatcagtttgaggccaagcgagctaagaacaaggcgagcagggagagaaagatggccagaagggaagaacgccttgcacagggacctggtgtgaaagcagcacctgcagctgcaccgcaacaggccgagggagttaagaagtcaaagaagtgaatgaagtaatgttttgtttttctctgtaggagtttgaatgcaaaactcggttttcattttgtgttttagatcttttagtttatataattatagaattttgatgaaaccactgagc

SEQ ID NO: 18032 - DNA, 96 bp, Gossypium hirsutum
  Clone ID: uC-gsflnu33B140d02b1
tgccacgtgtccggcagccaaaactgacagtagcggggtcaatataaagagcaaagcggtcattaacagagcaaatgccagatatactcctgggac

SEQ ID NO: 18033 - DNA, 149 bp, Gossypium hirsutum
  Clone ID: uC-gsflnu33B140d03b1
tgccacttttacggaagcaaaaactgtcagtgacgggttcaattagaaggggaatgcggtcattaaaagggcagttgaaagatatactcgtgggacacaacacagggaagatgacgaagaaggtgggaacaaaaaacatttatagagac

SEQ ID NO: 18034 - DNA, 156 bp, Gossypium hirsutum
  Clone ID: uC-gsflnu33B140d04b1
tgccacttttacgggagcaataactgtcggggtcggtttcaattacaagcaccgattggggtgctgagccggcaagaggtgaaatatactcttgggaaaaaacacacggaaactgacggagaaggcggatacatcagtcttttccagccacagcac

SEQ ID NO: 18035 - DNA, 503 bp, Gossypium hirsutum
  Clone ID: uC-gsflnu33B140d06b1
tcataatcatcagcaacaaggaactggcgggagtgaaaaccctcagcttccaccaccacctactcatgttggagctggtggtggaaccatagccattagacccagctcgatggcggatcgagccaggctagccaaggttccacaaccagaagcagtcctcaagtgtccaaggtgtgactccaccaacaccaaggtctgctacttgaacaactacagcctctcacagccacgccacttttgcaaggcgtgccggcggtattggaccagaggaggtgctcttaggaacgttcccgacggtggaggttgccggagaaacaagaaaaacaaaagcagcaccagctcaaaatcaccagcttgcacccagaaacaagctgaagtgatcactggtcataatttgccacagcaaacacctcatttacccttcatggcttctctgcaaagctttgctcagactggtttgggtaatatcgggttaaactatggtggaggcgggcaagctgata

SEQ ID NO: 18036 - DNA, 492 bp, Gossypium hirsutum
  Clone ID: uC-gsflnu33B140d07b1
tgacacacatgggaagatgactgaggcagtgttaaggtagaagccaggagtggccagtgtgaaggacatgccaattttccaagatgggcctcctccgggtgggttcgcccctgtcagatacgcccgtgggatacccaacaagggcccaagtgctatggctatgtttctagctgcttttggtgccttctcttatggaatgtaccaagtcggccaagggaacaagatccgcagggcactcaaggaagaaaagtttgctgcacgtagagcagtattgcctgttcttcaagctgaagaagatgaaagatttgtcaaagagtggaagaagtatctcgagtatgaggcggaagtgatgaaagatgtccctggttggaaagtaggcgaaaatgtatacaattctgggagatggatgccctctgcaaccggtgagctccgtcctgcagtttggtgatacctttttcttttatctactctctgtccactgatgagctgttt

SEQ ID NO: 18037 - DNA, 272 bp, Gossypium hirsutum
  Clone ID: uC-gsflnu33B140d08b1
tcccacgcgtccgattgatccaatgctggaatgtcttgaggaatggaatggtgcctcttccaatctgctagtttgctttattttttatagttgagatgtgtaatccaaatctttcgcatttgttgttggaatttccttgtaaaacaagttacttaactaaatgaatccattttcacatctcaacaaaaaaaaaaaatacatacaaattaataaaatatgcaaaaaaaaaaaaaaagaaaaaaaaaaaaaactaaactaaaacacataaaatg

SEQ ID NO: 18038 - DNA, 520 bp, Gossypium hirsutum
  Clone ID: uC-gsflnu33B140d09b1
ttcccacgcgtccgatgggcttgtggacgttattagaaggatttttgcttcttgcaaatgctttggcaatattaaatgaggatcgttttcttgctcccagaggatggagtttctcggatttctctgcagggcgtacaaagtcatttaaagggcaacttattggtctcatttacgccactcaatacatgagagttcctctcatactacttaatgcaatctgcatttttgttaagctagtttctggttgatgctgcgctagaacgcatgaagtcgaatatggagcataggaatttgccgaaggttgtgtaagacggaagcagtcagttcaaaaattaggtgatgtatctgttttacacttaagtttgtatcccacctccttttaaaattgaatttgaggtttcatgatgggattttatcgaacctggaaatgtgataacttgatagctctagcatttgtataatttggagactctacgctgtcattttgaaatataccagttattgtgcctggaattctatt

SEQ ID NO: 18039 - DNA, 429 bp, Gossypium hirsutum
  Clone ID: uC-gsflnu33B140d10b1
ttccacgcgtccgcccacgcgtccgcccaggcgtgcaaagcctttcactattcaacaagctgaaacggagcaatgtgatgacaagtgcgagcaacgtgtgactgctctgacaagagccagtgcgacatgaacggaaacagcatggacattgggactgaaaagagctacgttagtactgtagcggttgcgggtggggctaagaacgaaggcaagggctagagtggcgacagctgcagttgtgcaaactgcacaggaggagctcattaagaagacatagcaccatgagggaggagctcatagaactattgggagctagaactaatgaaattgagtggaataaatgggtgctatgctgttgttggtggtgacattgagtgtgttttcatgtctgtctgtcttatgtctgagtctcattgtacacaatgatgg

SEQ ID NO: 18040 - DNA, 429 bp, Gossypium hirsutum
  Clone ID: uC-gsflnu33B140d11b1
gccccacccgaccctgcgtccttccacgcgtccgctttcttctcttctttcaactcaaaaactcccaagtaatattagaatcatgggtgttgtcacttataactatgagtctacctctccagtcgcccctgccaggcttttcaaggctttttctcttgaagctgacaaggtttggcccaaggctgctcctcaggcagtcaagagtgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacaagcttgagaaaatcagctatgacaacaagtttgaggctgctgccagtggaggaagcctttgcacgag

SEQ ID NO: 18041 - DNA, 353 bp, Gossypium hirsutum
  Clone ID: uC-gsflnu33B140e01b1
ccctgattattctccttatgacgatggcgaatggaggttgtatgctctggctttccgttgcttatgtggtatcctttgtttcattggctgcttcagtaggcttattgatacaagattctctggtgaaatctggtccttcagtgtggaccggtactgcaggtgtcttacagtgcgtgtttgtcttaataagtgggttgatatattggacttctcattctgagtaatattaatccctcaaatctggcgcctagacttgggaacctggaagctggatccaccagtaaggccacaccccgagcatggctcaactcaaccggtgctcaaatcgcgacgacagctcggatttaacaaaa

SEQ ID NO: 18042 - DNA, 250 bp, Gossypium hirsutum
  Clone ID: uC-gsflnu33B140e03b1
tgccacgtgtacggccgccaagactgacagtgacgggttcaatatgaaggccaaagcggtcctcaaaggggaagcatatggatatactcctgggacaagacacaggcaagctgacggcgactgtgggcacaaaaaacatgtccagagactgacaaacgtataggacgaaagaaaaacggagagacttgcggagggaggaatcagtgagggtcaaggaaggcaatcaggggatccaacacttgtttgggta

SEQ ID NO: 18043 - DNA, 148 bp, Gossypium hirsutum
  Clone ID: uC-gsflnu33B140e04b1
tgccacttttacggaagcaaaaactgtcagtggcgcgttcaataagaagaccagagctgtcatcaaaagggaagcttatggatatactggtgagacataacacaggcaagctgacggcaacggtgggaacaaaaaacatgggcagaga

SEQ ID NO: 18044 - DNA, 518 bp, Gossypium hirsutum
  Clone ID: uC-gsflnu33B140e09b1
ttgaaatcggatccgggtctagaaaataccgggaaacgagctaaaactgagtcgtcgtcatcatcatcttcaacaactactcgtcctgttgtgttgattgactcacaagaaactggggttcgactcgttcatacattaatggcttgtgctgaagctgttcaacaagataatcttaaactagctgatgcattagtgaaacatattgggttacttgcttcatcacaaactggtgctatgagaaaagttgctacttattttgctgaagcgttagctcgaagaatttatagaattttcccaccagattcacttgatccatcatataatgataagttacaaatgcacttctatgaaacttgtccttatttgaaatttgctcattttacagctaatcaagccatattggaagctttttcaatggctaatagagttcatgttattgattttgggctaaaacaaggtatgcaatggccagctttaatgcaagcacttgcattaagacccggtggacccaccggcgt

SEQ ID NO: 18045 - DNA, 85 bp, Gossypium hirsutum
  Clone ID: uC-gsflnu33B140e10b1
tcccacgcgtccgctgagctgttataagaaatggaagatggaacatgtttgtccccttcccccccacaccaaccaactactccct

SEQ ID NO: 18046 - DNA, 523 bp, Gossypium hirsutum
  unsure (1)..(523): unsure at all n locations
  Clone ID: uC-gsflnu33B140f01b1
tttagatttcctgaatgcacagcaattgctgaccctaaatactcaatgtgccaacttgcattgaaaggtttgccaagtgaagtttatgagatgaaatgggacttgataatggtagatgcaccgaccggatactacgaggacgctccggggaggatgaccgccatatacaccgcgggtatgatggcaaggaataaagagaaaggagagactgatgtgttcgtgcatgatgtgaatagggtggtcgaagataagttctccatggcatttttatgccaagggtacatgaaaaagcaagaaggaaggcttagacacttcagaatccctagccataaggatagcttggaaagacccttttgccctgagtgatcttacaaatttcttgcctaccattttcccttcatcaattctttgttatattgttgattgatgctgtttcacggnggaattatcctatttttttggtcttctgctttgtttgatcaaagcaaaataggaaagcgtagcactattgcattggcaaatt

SEQ ID NO: 18047 - DNA, 476 bp, Gossypium hirsutum
  Clone ID: uC-gsflnu33B140f02b1
tgtcacgtctctgaccgccaagacgatcactctcgaggtcgatagatacgatacgacggtcaacgagaaggccaaaatccaagataaggtaggcatacctccagaccagcagggtgtgatctgcgcgggaaaacagctggtggacagacggaccttggcctagtacaacattcaaaaggagtgaactgtggacctagtcctccgtctgcgccatgggatgcaaatctttgtgaaaaccttgactggctagacaaacactctcgaggtcgagagctccgacacgatcgacaacgttaaagcgaagatccatgacaaggaaggcatccccccagaccagcaacgtctcatgtttgccggaaaacaactagaagacggacgtaccttggccgactacaacatccagaaggagtcaactcttcaccttgggcttcgtttgcgcggcgggatgcaaaatcttgtaagacgcttaccggaaa

SEQ ID NO: 18048 - DNA, 97 bp, Gossypium hirsutum
  Clone ID: uC-gsflnu33B140f03b1
tgccacgtgtacgaccaccaaaactatcactcactcggtcaatattaaggtgagaacggttctctaagcggatgataatggataatctcttgggaca

SEQ ID NO: 18049 - DNA, 79 bp, Gossypium hirsutum
  Clone ID: uC-gsflnu33B140f04b1
ttccacttttacggccgccaaaactgacactggtgggttcaataagaatgtcaaaactgtcctcaaagaaggagattat

SEQ ID NO: 18050 - DNA, 114 bp, Gossypium hirsutum
  Clone ID: uC-gsflnu33B140f05b1
ttccacttttacgaccaccaaaacgatcacgggggcgttcaataaaaaggaaggaactgtccttaaagaaaaagattttggattatctgttgtggcaaaacacagcaaaactaa

SEQ ID NO: 18051 - DNA, 300 bp, Gossypium hirsutum
  Clone ID: uC-gsflnu33B140f06b1
ttccacgtctacgaacacaagaacgataacacgggagttgatgaataaaacaccaagagtactgctaacaatcagaattagtgaagctgcggctgtaatacaaggcgaagctgacgcaaaatgcgagcaggagaagccagtgcttatagatgaagtggaagggcggccatgcgtagaaggaagaagctcggagtaggatagatcttgacgagggtatgtaccaactatgcttagatggggcatggtaaggaactaaaccctcccatttctcgcattctaagtcatgaaactcgatggaga

SEQ ID NO: 18052 - DNA, 509 bp, Gossypium hirsutum
  unsure (1)..(509): unsure at all n locations
  Clone ID: uC-gsflnu33B140f09b1
tcgacagttccaggacagttgatttgggaggtggtgaagaagaacaattgttttttggtgaaacaatttggaagaggaactgctggcgttcgattcagcaaagagcccaacaatctctacaatgtcaactcctacaaacactctggtttggcaaacaagaaaaccgtcaccattcaacctgcaggcaaagaccagtctgtgctcttagccacaaccaagtctaagaagcagaacaagccttcgagcttgctccataagtctgtcatgaaaaaggagttccctaggatggccaaggcagtcaaaaaccaggtgacagacaactactacaggccggatttaacaaaagctgccctagcaaggttgagtgctgtgaaccgaagcctgaaggttgccaaatccggtgtcaagaagaggaacagacaagcattgaggatccatggcaggaagtgagcttttttacacaacttcacaatcattttgctgcaattnntcgtggttctgacactttt

SEQ ID NO: 18053 - DNA, 356 bp, Gossypium hirsutum
  Clone ID: uC-gsflnu33B140f10b1
ttcttctttccacgcgtccggctggccgtggcacaacagtcgggagaggtgttgtgccatctattcgtaggtaacttggtattgtgaagtgctttgtaatctcttctgtcagaagcatcagtcatcattgcagaccacttgagatgcaaaaaaggattgactcttttcgtattgtactcttcataattgatgtaaaaggattgactcgtttcatttcgttgaggaaaaagaaattagataaaggtgaagtcactttgcctgaatcaaaaatgactgctcaatttcagtgtgaatgtttaaaatgctttaatgacttggcagtacttttcggaaaatgatagatattggagattttt

SEQ ID NO: 18054 - DNA, 363 bp, Gossypium hirsutum
  Clone ID: uC-gsflnu33B140g01b1
tcccacgttttcggatggcttcaaaaagaacagcatggtttgccctcttctttgccctcaacgatctctacttttatctagacagcgcttgcggctcttgcccttcccccaacccaaaaccaaagcctactccttccccatccccctcaggcaaatgcccccaagatacccttaagttaggtgtctgtgctgaggcgcttggtttagtcacatgtaactgttggttcgcccccagtgcaaccatgctgctcccttctccaaggccttgctgatcttgaagctggggtttgcctttgcacagcactcaaagctaacgttttgggcatcaaccttaatatcccaggttccctcagcttgcttctt

SEQ ID NO: 18055 - DNA, 521 bp, Gossypium hirsutum
  Clone ID: uC-gsflnu33B140g02b1
tttaaggttaaattctaatacaaaccatcgtttgtgtttgtctgttgtcatgcacctcattcgtgagaatctatttattggaaacataggggatgctgcacaagttcttcaaaatggtagctcggagatcacgcacattctatcagttttgagctctgcgtcaatatcgtttttctctgaatggcgtagtggtatcacaatcccagccgaggaaatcaaaaaggtttttgtaggtgggtctggtgatgctgctgcagctcctgagggtcattccgatgatggttctaagagttgtttgtcaccccagaagctgttgtacttgttggaatatgctgggaaggatttaaagctggtgagaatggcggtgccgattagagatatggagagcgagaatttgttggattacctagatgcgtgtattgatttcattgatcgaagcaaaaaagagggatctgttttggtgcattgctttgctggagtgtcaagaagtgcggctataattatggcatatttgatgagaa

SEQ ID NO: 18056 - DNA, 453 bp, Gossypium hirsutum
  Clone ID: uC-gsflnu33B140g05b1
taatgcttttaaggtcacctacataaatccaagtaaagctcaccaaaattcaaattcctgccaagtttgatttagaccttgaattctttcactcttttatttttcccaattttcattcaattatgttggtttgtttcctttaaagtcattcctcattaaagtagagtctttgatcattattactaagtaattgcgtcatagattattatttcttacgaccttaatttccaggacggttttattattttgaaggagatgaacccatcaaacgcactacctcagacatcacctccatcagatgcggtggacacgtcacccctcctgacccattccatattcgaccaccttcttcggaggcgccgaattcttcgtcgttgacctccacctttgcctggcacagccgctagggttctccgacacgttagcagatcgtgtttgatgcttcgtgagcca

SEQ ID NO: 18057 - DNA, 507 bp, Gossypium hirsutum
  Clone ID: uC-gsflnu33B140g06b1
ttccacgcgtccggccaatttgagcattccttgggctattattggtcattctgagaggagacttattttgatggagtcaaatgagttcgttgcggataaggttgcttatgcactttctcaaggcttgaaggtgatagcttgtattggggaaacacttgagcaacgtgaagcaggatctactgtggcgggtgttgctgaacaaactaaagcaattgcagcaaaaatatcagactggactaatgtcgttatgcatatgagcctgtgtgggctattggaaccgggaaggttgctactccagctcaagctcaggaagtacattttgagttgaggaaatggcttcaggctaatgttagtcccgaagttgctgaatcaacccggattatttatggagggtccgtcactgctgcaaactgcacggaactagcagctcagcctgatgttgatggtttctcggttggtggagctttacttaagccggagttcattgatatcataaaatcagctgag

SEQ ID NO: 18058 - DNA, 327 bp, Gossypium hirsutum
  Clone ID: uC-gsflnu33B140g07b1
accgagcccatgcgggctcccacgcgtacgcccacgcgtccgaccacgcgtccgtccacgcgtccgtttccagtttcaattttatcacaacaaaactgaaaatgtcttgctgctcaggaaaatgagggtgaggtgctgattgcaagtgtggcagtggctgtaacggatgcagtatgttccctgacataatggagaagactacgactgaaactattgttcttggtgtggcaactcagaaaatgcactttgagggatctgagatggagtggctgcttggggggattacgatgatggttctaagagttgtttgtcaccccagaagctggt

SEQ ID NO: 18059 - DNA, 391 bp, Gossypium hirsutum
  Clone ID: uC-gsflnu33B140g09b1
ttcgtctttgctgattgtcttgcgttcctggaggtttggtttggatctatctacaaaagcacattgaattttgggatgggggcataatacaaagtattttcaattaagcgttccagttatgatattagattcttggccttttgggtttttagcatatatatattcttttttttttctgaggcattttggtccaagattttttattgtgccattgtgaatgtagaaagaacttgagaatcttagtgatgatttgatttaaccaaatcgagttgagcccattttatgtttggttttaaattttaggtacactatttgcctaattgcctcgctcaatatcagaacttgtactgtaaaacatatctacataataataaataaaaaacattatgtc

SEQ ID NO: 18060 - DNA, 516 bp, Gossypium hirsutum
  unsure (1)..(516): unsure at all n locations
  Clone ID: uC-gsflnu33B140g10b1
ttcttggtggtggtgcaaacaccgtggcttgtggctacaacaagggaactgccttgggagctgagattattggaactttcgtacttgtctacactgttttctcagccaccgaccccaagagaagtgcccgtgactcccacgtccctgtattggctccccttccaatagggttcgcagtgttcatggttcacttggctaccatccccatcaccggtactggtattaaccctgcaaggagtttcggtgctgctgtaatctacaataacgacaaagcctgggatgaacactggattttctgggttggtccatttgttggagcacttgcagcagctatatatcatcagtacatccttagagcagcagctatcaaagctttgggatccttccgcagcaaccccaccaactaaaaaaaatcaacccaaatagctttgtctccacttcactctntttctatnttctccatttggtcgtttgtgtgtatgagaagattattatgaatgatgaatgatgatgacc

SEQ ID NO: 18061 - DNA, 425 bp, Gossypium hirsutum
  Clone ID: uC-gsflnu33B140g12b1
tccacgcgtccgcccacgcgagcgatcaaacaaagctattatgtgggttgagagcagaataaggtgcataatacacaatgccgaatgcatacaaaagattgtgagagaatatggagcttttagcagctgaatgtggggatatatgaatcataaacgccaaagtaacaaatacaagtgcccaagaaaggtacctcttagaaccccaaaagctgaagccattagcaaggacctattgaaacgaggattgcgattcgtggggccaggcatcgcgtattcattcacgccagctggcgggttgactatcgatcattatatctgatgtttcagacacaaagaaagcggcgcccttgccgagagaccttggagacacactgaataatctaggagtattcggataaggtatgtgtgcgacaagtgtacggata

SEQ ID NO: 18062 - DNA, 376 bp, Gossypium hirsutum
  unsure (1)..(376): unsure at all n locations
  Clone ID: uC-gsflnu33B140h02b1
ttgnccttccacccatgcacataaatgctggaaatggaggatttgatgctgcactaaaagatttgagattatagtgctgaatgaagtcccaagggactctccagaaacgcttcccataatatatgaaagaggtctattaggcatgtatcatgattggtgtgaatcgtttagcacctatccaaggtcttacgatcttctccatgccgaccatctattctcaaagctcaacaagaggtgtaatttggtggccattgttgcggaggttgacagaatactaagaccagaagggaaacttattgttcgagacaacgttgagaccatgaacgagctagagaatatgttaaagtctatgcagtgggaagtgcgtatgacatac

SEQ ID NO: 18063 - DNA, 248 bp, Gossypium hirsutum
  Clone ID: uC-gsflnu33B140h03b1
ttgcgtgctcccacgcgtccgttcacatcatgctagaaccaaaagggtctagagtggaacatcttcggccaatagctgtgccaccgaccggcctcctctatccatatctcattggaggggtgcccacgtatttcaggtctctggtgacctacacgcgtgggctttggcccatgaaggtcacccactgtggctttttttcgggccatgtccccctacatacggatgccgtcttcctctaggaaacccct

SEQ ID NO: 18064 - DNA, 489 bp, Gossypium hirsutum
  unsure (1)..(489): unsure at all n locations
  Clone ID: uC-gsflnu33B140h04b1
ttccacgtgtccgcccacgcgtccgttcatggtcaatggcttccctttggtcaccatggggaaacttgttcatgtttttaatggcttatttttcttcactacccttatcttcatcatctcagcaatatttacatgtacaatactcaactatatcagctgcaccggcattccttccaagtgcacctcttgcttcttctccaagtttaccccctgacattgagcctttgttccctactccgaatggtgtggcaccttctcctactcattcgtcgatgcccacaattccttcaagccccagtcccccgaatccggataacatcgtggcccctgctcctggtttcgcattttcaccgtctaacagccctttgccgtcatccacttcggtttatccgacttcagctcgagctttaaaaccaacattngttcttggtttgctagtatttagtatattgcagaagctctctggtgtgtgaatttctgctgatggca

SEQ ID NO: 18065 - DNA, 475 bp, Gossypium hirsutum
  Clone ID: uC-gsflnu33B140h05b1
gaaacgctgggccggctcgcgggccccggtccccggttcgacccacgccgccctttggattggaagggaaaggaatcaaagatggggggaggaatggaggctagcaacgaacaggctcattgtaaataggagcagcgccagagagaatttggagcataactttcgctggactcgccgcaacttcgctctcgtcggcatattcggcatcgctatccccgtccttgtctacaagggcattgttcgagaatttcatatgcaggatgaagataatggtaggccatacaggaagttcttgtgagtttttctccgcaaagctgggtaataaatgttgacgagtacaactgggttttatcttggacaacaatttctgttatttacttggttttggaacttgccatgttgttatttgctcgggtttgaaacaaattctgtgctctgcttcttttaagtttctggtgtagattatgcatatttg

SEQ ID NO: 18066 - DNA, 498 bp, Gossypium hirsutum
  Clone ID: uC-gsflnu33B140h06b1
tcccacgttttcgatgaaattgctccactcggtcaggtagaaggcacacagaaggaactcaacattgcattgagcaagtatccaaaagctcttgagaaaacccttaatcctgatatatccaaggcttatcgaaatatcgagtttgattctcatacagttaaccaaataattgccagccatttctatcggcagggcatgtttgatgttggtgattgttttataactgaagctggggaagcaaaagctgttgctgctatgagatcgctttttcaagaaatgtatcaaatacttgaagccatgaagagtaggaacctagagcctgccctgaaatgggcagccacaaactccgataaactgaaagaaaatggctcagaccttctgttggggctccatcagttgcagtttgtgaaaatactacagaagggaagcagagaagaagcactcaagtatgcaagaactaacttcgttccttatgccggaaaccatatggccgagatc

SEQ ID NO: 18067 - DNA, 506 bp, Gossypium hirsutum
  Clone ID: uC-gsflnu33B140h07b1
gagcgtactcttcattcgcacgcatgcactataattgaggggatgggtttattttatactgcattaatagtaatgagatttttattgctatgttgaagatatgtggtctttgtattcattgggaaattttaacatcgtgcaatggttgtgacagatcgaggaggatttggaagcctaatgtacaagagaagcgtgtatttagttatatcttagatcgccatattcgagtcaaagtaaccactcatgccctccgttgcattgacaaggcaggcgggatcgatgagtacctgctgaaaactccctaccacaagatggatacagaaatgggtctgttctggaaagctaaaatcgagaaaatgtatgaagagcttgggcaaatggaggtagtcttcttttcgccggaggatgaagcaaagtttgagcaaggattcacagaactgaagctagcggagagagcaactcgaagggatgctagaagacagatgtatggatggtcagggaaactg

SEQ ID NO: 18068 - DNA, 528 bp, Gossypium hirsutum
  unsure (1)..(528): unsure at all n locations
  Clone ID: uC-gsflnu33B140h08b1
ctccttccacgcttccggcctcactgaacatcagggtcagagcgtaagggtctagagaagaacatctccgccaaaaggaagacccacgaccaaccccgatacccctatcccattggaggggtgcccacgtacttgaattcctccgggacctacacgcaggggcgaaaacccaagtccatcacccactgtgccctttctttggccaccctaaccctacagccccatgcccttgtcctctccgacacgcttggggaaggcctcgatgctctcatcgggtcgcctccgttgccgactaagaggaacacggaggcaagcctgaagctaacccctatggtgctcgtgctgttaggctttacctacgtgaagtccgtgattcacaggctaaagctagaggcataagctacgagaagaagaaaaggaaacgtccccctcataatcctgcatctcttccaccaccaaatcagtgagcacaaaaaaaccatatatatatgttcaagtatcaacangagctgcatgggaacaaaaatg

SEQ ID NO: 18069 - DNA, 421 bp, Gossypium hirsutum
  unsure (1)..(421): unsure at all n locations
  Clone ID: uC-gsflnu33B140h09b1
cacataccagcatgattctatgcttctgcagtctgcactccacgtacaatgacaccgagcgaaggccgctgacacctagcgacctgagggctgatggacctacccttagaaacaggttcacccggatttgaaaggcataacacggcacaccctcctggttccaagcatgggtgtaataggatctaggggatgcctttggagggacctaatagagcccctgttgccacacccaaagaatcccctcatcattcggcggtcccaccaaatgtacacccatcagcactggcacccaaacctaaacacagaccaattacctacttagctccacatccagtccgctgccaaatgtagcgtttgctcatgccaagcctncatcaaagagtgaaccaaataagaggatcctgataggataccttcagtt

SEQ ID NO: 18070 - DNA, 258 bp, Gossypium hirsutum
  Clone ID: uC-gsflnu33B140h10b1
tttttagcatggatgctttttcaccgatatgtactttcgtttttagacgcttgtgttttgatgatgatcatgatgtactacaatcgacattgcgttgaacttttttatacatctcttatcttcataaaaaaaaaaaaaaaaaaaaaaaaaaaaaaaaaaataaaaaaaaaaaaaaaaaaaaaaaaaaaaaaaaaacaaaaaaaacaaaaaaaacaaaatagaaaaagattagcaaggataaaaaataataatccgggg

SEQ ID NO: 18071 - DNA, 490 bp, Gossypium hirsutum
  unsure (1)..(490): unsure at all n locations
  Clone ID: uC-gsflnu33B140h11b1
ttcgtcttgttaatcgtgagcactggttcttagacgctcttaacagtggagccaatgcatctggtctcgaacgcggccgttccgagatttcctcgattgtatcggaggtacccgattatttattcgggttggataactccgatgaggtccaaccccgtggcccgaaattaagtatacgtcagctcttgcatgagaatgtctcggtttcggacccgggttcgccggccccggttgtttcttcatcgcccttttgttccacctcatcagctccagttgttgtaccttcaatgccagatctgccaccggttaagactaaaccagataaccccgaaccgggttttgagtcaaagcagaatcaaacagagagcttggtggagcaacccgttttgcagccaacgacatattcgggtagtcctatgtggcactatattccgggttctcattactctgtacctnccgctcacaaatacctgtatattatgttccgggt

SEQ ID NO: 18072 - DNA, 517 bp, Gossypium hirsutum
  unsure (1)..(517): unsure at all n locations
  Clone ID: uC-gsflnu33B140h12b1
atacgttgtggaacgcggagtatagggtttcactgatgaggaatctggaaagagcagcaccgggcgaggaggtggcgggggagacagaggaagctattaggaagcggcagggagaggtgtttgaggagaaaagggaggagagagcgagtcaaagtgatggctttcaagaattcgagaagattaggccgagggtttccggggaattgtcgccagaggctttgaagtatattgaaaaactgcaagcggagttatctgatgcggtggaggaactgaatgtggagaaggagaatgtgcaaatagaatgtgaaaaggaaaacaggaatgatttgttggagtatttaagatccttggatgccgacatggtcactgagttatcccaaccatcatcagtacaagtccaggaaacaatccaccagcttgttcaaaacatattgcaaaggccctctaagaatgagcttaagagggactcanggatagtgaacaaaggaaatcatcatcaagatgttgccgatgaaac

SEQ ID NO: 18073 - DNA, 223 bp, Gossypium hirsutum
  Clone ID: uC-gsflnu33B141a01b1
gtgaatcttgagtgattttgcgccgcggggccttgctctttgatagatctggcttgttcttttcctcttcaggtgtgggattctgctgaggagggtttgcttctgttctgtgccgctgagaatatctcctgctacaagaagagaatgggttttgcggctatggttggtggatggagggggatggtctccaagccatgtatgcttgagcacctgaaggacccca

SEQ ID NO: 18074 - DNA, 425 bp, Gossypium hirsutum
  Clone ID: uC-gsflnu33B141a02b1
ttcacgcgtccgcacggtttgaagagaaagggggcaatttcagagatgtggaagagcaacgagaaatgatatgggaaaaactagcggatgcagcagcggaaagaggtggagaccatatggttacagtctaaccgattagtcggagttggattcaagcagactcctcaattttaatggtattctttctcttaaccctctctaataattattcttttcttctctccaaatttttattcaatttgatcattgaaatattgccagattaaggtggcatttgagtccttatcatgtcctagtttcattagaatgtgattaccgggaatctgattgctgtatattaaaatgttagaatcataaactttacagcaattaaagtaggcatttggtaccttatcatttcctcattttaatggaatatgattact

SEQ ID NO: 18075 - DNA, 497 bp, Gossypium hirsutum
  unsure (1)..(497): unsure at all n locations
  Clone ID: uC-gsflnu33B141a03b1
ttcacgcgtccgcccacgcgtccgcccacgggggcgttttcgcgtccggaccatttccaccatcaccatccccatccgcatccgcatccgcatccgcatccgcatccccaccagccaaccccttcccctactaagcccccaactcacccacctgtttaccccccacccaaagcacccaagattgctccagtttatccaccacccaagtcaccaagcaagccgccaacttacgctcctcctcccaagtcacccagcaagccgccaacttacgctcctccacccaagtcacccagcaagccgccaacttacgctcctncgcccaagccaccgaccaagccaccaacttacgcccctccacccaagccaccagtttatcctccaactaagccgccaactgcgcccccgactaagccaccagtgcatccaccgacatatcctccaccatcggcttctccagctaagccgnctacttatcctaaaccacaaaggagcctagt

SEQ ID NO: 18076 - DNA, 464 bp, Gossypium hirsutum
  Clone ID: uC-gsflnu33B141a04b1
ttgggcttgtcatctggctaaacaagcattggaggaggttattgccgagcttgatagccttaatgaagaatcttacaaggatagcacccttatcatgcagcttcttagggacaacctcaccttgtggacctcggatctgccagaggaaggaggtgagcaatcaaaagcagatgaacctcaggttgagagttaattggatggaagagtattcttttaagactgggcttgtcgaggtaggaaaggggcttgctgctagagtgacctgctttcaactcatggtagtagtaccaggatttgttacctatgacatggttcgatttgtttatcagatgttttcggactgttgttctgtgttctcttctgtttaaacataattgaatcggttactttatagtctttatgacttacttccttatgttcaattttttgttgtcttagcttcttgtttttccatgtgtttctga

SEQ ID NO: 18077 - DNA, 126 bp, Gossypium hirsutum
  Clone ID: uC-gsflnu33B141a06b1
ttgcccacgcgtccgaaaaaaaaaaaaaaaaagaagattttaaaaaaaaattccttttaatacgggggggcgctctcgaggggcccagttttcgcccccgtgcgtgtgaggtaatatctttttttt

SEQ ID NO: 18078 - DNA, 485 bp, Gossypium hirsutum
  unsure (1)..(485): unsure at all n locations
  Clone ID: uC-gsflnu33B141a09b1
ttccacgcgtccgcccacgcgtccgctcgggtgtggtctaacacctgttgcagtcatcctttatatcgngaatctgagcttatttcggagaatcatcttggggtgaggaatgctgcccaaaggaagcttttggatgagctcggtattcctcctgaagatgttcctgttgatcagttcgtcccactgagccgcatgctgtacaaggcaccttctgacggcaagtggggcgagcatgaacttgattacctcctattcattgtccgagatgttaacgttcatccaaaccctgatgaggtagcagaggctaaatacgtgaaccgtgaccaactgaaggagttactgcgtaaagctgatgctggtgaagatggtttgaaactgtcaccatggttcagactcgtcgtggataatttcttgttcaagtggtgggatcatgttgagaaagggaccctgaaggaagtaagtgacatggaaaccattcataagct

SEQ ID NO: 18079 - DNA, 105 bp, Gossypium hirsutum
  Clone ID: uC-gsflnu33B141a12b1
tcccacgcgtccgaaaaaaaaaaaaaaaaagaagattttaaaaaaaaaagccttgtaaaaccggggggcgctctcgaggggcccagttctcgcccccgtgcgtgt

SEQ ID NO: 18080 - DNA, 489 bp, Gossypium hirsutum
  Clone ID: uC-gsflnu33B141b01b1
atgaattgaaaagcatcttctacccctctgggcaatttttcttttcttgcattaagttatacctgatcattgagttgagttggagtatgcctcggaagtcctctggtgcccgctaacattatccctttctctacagacgtccttgaagtctccatagtctgagatcaacctgatcatctcccgagagtctaacttagtcgatccgctacgctgggagaagcctagccacgttgacatcatcattagaagccaagttagttgatcctctatgctgggaaaagtctagccacgttgagataatctccataggctagcttagtggatttgctaccccaagggaagcctagccatgttgagatcatatctagaggacaagttagttgatttgctatgttgggcatggttttcaagatcaaactattagttaaatcgatcaaatcaggaatttttttggctgcttattcaatagggttttaaaccttatttaat

SEQ ID NO: 18081 - DNA, 455 bp, Gossypium hirsutum
  Clone ID: uC-gsflnu33B141b03b1
gtaaatgtcggcccttggtgttgatgtcagggatccttttaccgggcacatcatttccacaacgattggaggcaaaaatggagagcctaaacagaccatcagttatatggctgagcgtgtagttggcactggatcttttgggattgttttccaggcaaaatgcttggaaacgggtgagaccgtggctataaagaaagttttacaggacaggagatacaaaaatcgtgaactgcagttgatgcgtgtgctggatcatccgaatgtgatttccttgaagcattgcttcttttccacgacaacgaaaaatgagctttttcttaacttggttatggaatatgtaccagagagcatgtatagggttttaaaacactacagcagtgcaaatcaaagaatgccgcttatatatgtcaagctttacacataccagatattcagggggcttgcatacctacaca

SEQ ID NO: 18082 - DNA, 534 bp, Gossypium hirsutum
  Clone ID: uC-gsflnu33B141b04b1
ttgacatctgctgtcaagtatattgaaagaggacctattttgcccaataccttgatatccatggcgagaaaggcatcttcttttaaaaagaaaaagaaaaagaaaaatagcttaatttcttctataaaagggtcataggttactactgaaaggggaagagggctaaacaagggtgcaagaaggaaaagttttttctctgaaaagagtataccgtctgcaaaacatggagggtaatggcaatgaacaaccaaaatgtcaaagaagttttgatcatcgtgggaggaagaataattgctgggagttagttatccagattttatgtatgatactggatgataacactattccgaatatacggtcttgggacaaaaaaaaagaagagaaattagaagaggccttgacgcagctggaagatattatgatgaaaaatgacttgctagagagaaagagaaatggctggaagtaatgaaatcaacctcaacgagtgcaagtcaagaggctcaactagagatggtaccggagttcatgacagca

SEQ ID NO: 18083 - DNA, 480 bp, Gossypium hirsutum
  unsure (1)..(480): unsure at all n locations
  Clone ID: uC-gsflnu33B141b06b1
gttangggacttttgactataaaggagctggggttgcttttgatggatttgctgcatgccttgctggaactgcaatctcaaatgggttgatcatgatgaggaagaaaatggatcccagctttgaaacacctaacaagccacctcctaccttgttgaatgccttcacttgggctactcacatgggggttagcagcaatttgaggtaccaaaccttgaatggggtcgagtttttgttggctaagggacttcctcccctggcatttaagtcatcagtggtggttctgagatgcttaaataatgtacttggaggaatgacatttgtaatactagcaaaatttactggatctcagagtgttgaacagaagccaccaaacataaacaaggagaagaagtcggtggacggtgacagtttggacaacagtcagtcgactttaagtgattttacccccttttgttacttttttgtcgagcttttctctg

SEQ ID NO: 18084 - DNA, 421 bp, Gossypium hirsutum
  Clone ID: uC-gsflnu33B141b10b1
tgtagggtgtaccattagcccatcaaactggatagcttatgaaggtaaactctactgcaaacatcaccatatccaactcttcaaggagaaaggaaactacagccaactcgagaccgaacgagagaaacaagccgccaccgccgccaataaggttcctgcccctgctgcaacatcaaccacaaccacaaccacggagattgcagctgagtcgtaatgatctcagtgtgcatcactgctgcttcaatgaaaaaaactttgtaaaacgatccaatgtcattgctgtgttgattttctgcaatggggttctttttattttttttctttgatccagatattattcttggttcataatatgttacataaatttcccactttcaaagatgggattgaggtgatatgttccaagtggattcagcttttg

SEQ ID NO: 18085 - DNA, 488 bp, Gossypium hirsutum
  Clone ID: uC-gsflnu33B141c01b1
cctactcgtccggaaagctgagcaatatttgggtcaatttttgcgcgggtgagagcagtacaccgcacatgctgcaccgattccaatttcatggctgctaccgtgcccgtccacaagtgggctcagaagaccgtaactcttcctcctcttcggcgaggctgccatctcgttacgtctcagatatggaaggaaattagaccagagttatcagaattgaagtgcggcctcgctcatctattcctgcaacacacgagtgcttttcttactatcagtgagagttatgactcggacgtgcgtgactactccgagacgctccttaacacaagagctcctgagggaagatctgcaccttggaagcatacgcttgaaggccctgaggacatgccaggccatatcaaatcatcaatgtttggctgcgccctcaggattgccattacagatggacagcttaacaagggaacattggaggggatttggctttgtgagca

SEQ ID NO: 18086 - DNA, 517 bp, Gossypium hirsutum
  unsure (1)..(517): unsure at all n locations
  Clone ID: uC-gsflnu33B141c03b1
atantggtggccgacaaaggaaagaagctgaaagtattattagaaagtagaggaagagaaccatgaacaaatagatggagacctcgtcatttccattgagaagcttcaagagatccaagatgagcttgaaaagatcaatgaagaggcaagtcagaaagtcttggaagtggagcagaaatacaatgaggtttgcaagccggtctatgataagcggaatgaaatcatcaattcaattcctgatttctggttaacagctttcttgagccatcctgctcttggtgatcttttgactgaagaggaccagaagatattcaaatatattaactcacttgaagtggagggattttaaagatctgaaatctggatacaccatcacatttaacttcaatttcaatccatactttgaaaatacaacacttacgaagacctttaccttcctcgatgatggaaccaaaattacagctaccccaataaagtggaaagagggcaagggcttgccaaatggagttatcatgag

SEQ ID NO: 18087 - DNA, 381 bp, Gossypium hirsutum
  Clone ID: uC-gsflnu33B141c04b1
tcacgcgtccgcaacaaaacatccaaggagtagactatataagtgtgtgtatatatatattgcttgctgagatttgcctggtctctattctgagcttgccttagtgaatttggaactgtggattcattaggttcaactatgacagtttatatcaatggatttgtttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacataaaaaaccaaaaaaaaccaaaaaaaaaaaaaaaccaaaaaaggggggcccttttaaagggtcccagttttcctcccccggtcgggcctgttaaatctttttttttggggccccc

SEQ ID NO: 18088 - DNA, 514 bp, Gossypium hirsutum
  unsure (1)..(514): unsure at all n locations
  Clone ID: uC-gsflnu33B141c05b1
ngtaaatttgagtcccaattttacatgatttctgacacatacaagcgtgtatatgcaatgggtgattgttatccagcctcttcacaacttccaaagggtgaatacacactgcgactgtatttaaggcatgacaatgtccagtacttagaaaaaatgaagcaattagttctgtttctggaaaggaatttggaggaaaaggacgttattccattgaactttttctctgaaccagatggccctgtgatggggaatggtacctttaaatattctattttggttccagggataaaggaatcattttatttaagcccaccaaacaaagataagcttccaaagtgttcctcacaaggatctgtattgctgggagcaatatcacatgggaagctatcatatgctgaagaggggaaaaatccacagaagaatcctgtatcatatcacatatcttatgtggtgccacccagcaagattgatgaagacaaaggcaaaggttctttttcagttagcactaaaccta

SEQ ID NO: 18089 - DNA, 310 bp, Gossypium hirsutum
  Clone ID: uC-gsflnu33B141c06b1
ttagacattgttgacactttcaggcttcaggagcaatttcctttcgacaagatgcagtttgccgcgttcatcaagaagttcatcaagaacttgacaccaaaactggatgcggaaaagcaagagtccttcaagaaaaacattgagggagcaaccaagtttttgctttcaaaattgaaggaccttcaatttttcgtaggagagagcatgcatgatgatggatgcttggtgtttgcttactacaaggatggtgctgttgacccaacatttttgtactttgcatatgcattgaaggaggtcatgtgctgaggtt

SEQ ID NO: 18090 - DNA, 510 bp, Gossypium hirsutum
  Clone ID: uC-gsflnu33B141c11b1
tggaggattgagaacttctccagtattaaagactacatgctctgctctgaaagtttcactgtcgatgacagtaaatggcaacttattatctacccacgggggaacaatgtgggttttttgtcaatttttttacgtgttgcagattctgcagctttggcttccggatggactagatatgcccatttcggatttgcagtcatcgaccaattcgatcgtgaaaattccaaaacaatagccactaagaaagagttcaacgcgaactaccctattcggggcttcggttcattcttacctcttactgaattacgcaaccctaaaagaggctatctcctcaatgatgcatgcttggttgaagcctacgttttcactggtcggactgtagatatgatttcacatgaatttatagtcaaaactgatttggataaacgtaagaccaaggaaggtgattgttttaaggcagccataggcaaccagaaaactacaaccaccaaaccagtagaagtcattaat

SEQ ID NO: 18091 - DNA, 511 bp, Gossypium hirsutum
  Clone ID: uC-gsflnu33B141d01b1
atttttctcagcatacgatcacttgctttcggttaaatttggcaatgattcctaccatctttggcgacaacaggcgcagcagcgttttcgacccgttttcgttggacttgtgggatccctttaaggagttcgatttcccaacagtcacatcgtttgcttcactttcccgagaaaactccgctttcgtcaacacgcgcgtggactggaaggagacaccggaggcacacgtgttcaaggcggacctcccggggatggagaaagaggaggtgaagggtggagatcgaagacgatagggttctccaaatcagcggagagagggacgtggagaaggaagacaggaacgacacgtggcatcgagtggagcggagcagcgggaaagtctcgcgggggttcaagttgccggagaatgtgagaatgggcgacatgaaggctttcatggaaaatggggttttttctttcactggtcctaaagttgggatgaagaacctgaaatcaaatcccgtgaaatttt

SEQ ID NO: 18092 - DNA, 242 bp, Gossypium hirsutum
  Clone ID: uC-gsflnu33B141d03b1
ttgactcgtgggtgtggctgctagggtccccaagaaagttttacagtttgcagggatctaccacgctctcactacttccaggggatccactaagactcttggcaacattgtcaaggccaccttcgagtgcattccgaaaactaacgagcgtaagaactcccgatttctggaaagagacacgcatcacaaggactacttaacaagagattactgatcagatgtgataaccagcatacaccctt

SEQ ID NO: 18093 - DNA, 226 bp, Gossypium hirsutum
  Clone ID: uC-gsflnu33B141d04b1
ttcatttcagtgtttttgggattgattgggggccttttgttatggacaatatttgaatcacgagataaccttgggggcggcggcggagggagaggaacatctctgaaattactttcacttttgccggtgggtgtaaaatgagcgcatcaacggatcatcaaatgtgtcactgaatggagacggagccgtcggcaagacttgcatgtctatttcttacaccagcaat

SEQ ID NO: 18094 - DNA, 352 bp, Gossypium hirsutum
  Clone ID: uC-gsflnu33B141d05b1
tcacgcgtccgcaactgttgaaaagcttgatgaatgctatagattatgaaaaaaagaacgcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctgctgctgttaaaagcttataaaaatatattatcggttgctgctcttggtttgaatcaaatcatttgtctgaaaagatatggcat

SEQ ID NO: 18095 - DNA, 442 bp, Gossypium hirsutum
  unsure (1)..(442): unsure at all n locations
  Clone ID: uC-gsflnu33B141d09b1
tgntatctcctctctcttttctggtcccggcatgatccctccactctcaatcgtcagggtggagatgtgggagcacaatatagatcagggatatactactataacgaaaaccaagctcgtcttgcaagagagtcaatggaagctaagcaattagagttgaaagataagaaaattgtaactgagattctgccggcgaaacgtttttataaggcggaagagtaccatcagcaatatttagaaaaaggtggaggtttaggggctaaacagtcttctgaaaaaggttgcactgaccccattagatgctatggctgaagaaagcccttttgaatatgtttttttttaatatcatgatggcacttaagcttcttgtctggtaataaacaagttatcatggtttccttttgttgtgttctgaagacatatatatatatcaatggagtct

SEQ ID NO: 18096 - DNA, 476 bp, Gossypium hirsutum
  Clone ID: uC-gsflnu33B141d11b1
tcccacgcgtccggctgtttatcaaatagatggagttcttcagcctttacagatattcgatcctagacctccggcaccagcgcctgctccggcgaaatcgaagaagaagaaagatgatgatgtggctgatagtcctgctgatgattctactgataattctaaagctgtgaggttcactatgggaaacaatgttggtttatttggggttactgccatagtacttattgcattaatttctttgtgattatagtaaaataaaaattttaaatatgggattttgaggggaaaaatatggtgagattgagtgcatgtttttttgtttttgtttttttttatattttgcgtttttaaaaaaaatattattatcctttaaatttctgttttttaccatatttgtatcatataaatagtactgtcacaagagttaattgttaactaagtaatcactgacgatgagatcacggctcaaattaaat

SEQ ID NO: 18097 - DNA, 527 bp, Gossypium hirsutum
  Clone ID: uC-gsflnu33B141d12b1
ctgccagatgccgccaacttagctgtgcccgccatgagaaatgtcgtttcagcgttgaaaaaggttggcctgcaggataggatcaaggtttcaactccactctcctttgtggttttatccaaatcctacccaccttccgatggggcgtttgacggtagccatgataatgtcttgggacctttgttggacttcctggaagagaaccaatcaccttttatggtcaatttatatcctttttacgctattggagattcttctttggatgctgttctgtttaagtcaccctcttccattttcgtagacccgaataccggttttagttacaagaacatttttgatgctcaactagatgctggtcatttcgctttggccaaacggaaatccagaagcataccgattattgttacggaaaccggctggcctacgagaggttcaggaagacataggttagcgatggctagtcttgacaatgatgacgactcctatgctagtattgacaatgcccagacttacaacaccaacttaat

SEQ ID NO: 18098 - DNA, 503 bp, Gossypium hirsutum
  unsure (1)..(503): unsure at all n locations
  Clone ID: uC-gsflnu33B141e05b1
ngtcatcgcgtccggaaaatgaagggtctgcaggcacttatattggcaatggtaatggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggctctccatatttgatctcaaatgtgagggaaaatcatgcttattataagcctctacttcacataattgtactgaccttcgggttatctttttccttatttctttatatgcgctggggttcgattggcatcttatagtcgtgtgatttctcaccataatcaatatattagattgtttccacc

SEQ ID NO: 18099 - DNA, 438 bp, Gossypium hirsutum
  unsure (1)..(438): unsure at all n locations
  Clone ID: uC-gsflnu33B141e06b1
ncgtcacgcgtccggttccgctggtggattggctgcgatattgcactgtgacaggtttcgagctctccttcccgcttctactaaagtaaagtgcatttcagatgctggcttcttcctccatgcgcaagatgtctcgggagggaagcacatagaagaattctatggcaaagtggctagactacacggatccgttaagaatttaccagcgtcttgcacttcaagaatgggagccagaccagagttgtgtttcttccctcagtacgtggtgcagactatgcaaacaccaatcttcttcgtaaattcagcttatgactcctggcagattaagaacattttggctcccagtgctgctgacacaagtaaggcgtggaaaagctgcaagcttgacttgaagaagtgttcagcagccgcagctaaaacccttcaagatttcaggac

SEQ ID NO: 18100 - DNA, 474 bp, Gossypium hirsutum
  Clone ID: uC-gsflnu33B141e08b1
tttccgtcgctgctcttcgcactgtgctcaccgccatttccaattctcagaaggcaaaagcatttgaaacgggttcaacggcgactagtcctgcagatgaagctgatattgaaaagctggaagaagaagcctcgaatctcaggaaggagcttgcaaacaagaatctatacataaagcgtctaatagatcaactacgggagcttattacggatgtatcgacttggcaaagtccttgttccatgtaaagtttggacgataaaactgacttatctcagttgccgaaaagagtgccctaggaggtaaatatgaaaccagatatctacattgaatgatgatgatatggtttacttggaggaaaattacctgtgataggtgctatttgtgttatttgatgatagtgcttaagagtttgaatgagacatgacacatatacttacaagttacttaagtttgactacaaaaaagatcgagttc

SEQ ID NO: 18101 - DNA, 362 bp, Gossypium hirsutum
  Clone ID: uC-gsflnu33B141e09b1
taatgctagaagctctgcaagttgtgggggatggtcatgatgcccacttgggagaaggctttgagggtaataatggatatgttcctacatctcgtgaggaagatgaaacaacagggaataagttaaggatgaaactgaaagagttccacagaagtgcggcatcattctctgaaatagataggaattacctcaccccattcttcacgagccagaatggagattctgaagatgaggaggatgatccaatgcctagttctagaaggggagtataccacggacatagttgattctacaaagacaagcggatgacaacacatactggagaatactttgatttcattaatggtgactcgtaccgacct

SEQ ID NO: 18102 - DNA, 525 bp, Gossypium hirsutum
  Clone ID: uC-gsflnu33B141e11b1
ttcagtttatacacctccaaagaaagaggaggctatttctaaaccaccagtatatgaacctccaaagaaggagaaacctgagccaaaaccaccgatttatacacctccaaagaaagagaaacctgaacccaaaccacccgtatatgaacctccaaagaaggagaagcccgagccaaagccaccggtttatacacctccaaagaaagagaaacctgaacccaaaccaccagtgtatgaacctccaaaaaaacctccaatgtacgaacctaagccaccaaaaccaccggtttatacacctccaaagaaagagaaacctgaacccaaaccaccaatgtatgaacctccaaaaaaacctccaatgtatgaacctaagccaccgaagccaccggtttatacacctccaaagaaagaaaaaccagaacccaagccaccaatgtatcaacctcccaacaacccaccaatatatgagccaaaaccacctaagccaccagtttatgcaccaccaaaggaagaaaagccaaaacc

SEQ ID NO: 18103 - DNA, 256 bp, Gossypium hirsutum
  unsure (1)..(256): unsure at all n locations
  Clone ID: uC-gsflnu33B141e12b1
tgaggaattagtgttggttgattgggtatgggagattttaatacaatgttgcttttttaaagngacagacattaggctgaatggcaaatatgattaaagtgaaatgtcgatggtgcttaaattctgcctaacttgttaaaatgacatgccggtgacacattctaccatgaggcaagctgtgaggtatttagatggagaggcccaactacctgatagggcgaggtcatcatcattattcgacagtgataaagggaat

SEQ ID NO: 18104 - DNA, 336 bp, Gossypium hirsutum
  Clone ID: uC-gsflnu33B141f01b1
ctttggtgcggatgatgaaatacatggctggtgcaccttttgagtatgagagaggactttttgctcatactgataaaccagtcagtacacttatttgtgaggatcaagtttcaggattggaaattgaggtcaacgacggccaatggatcaagttgaccaatctatctccttcttcttttgtttttgtagttggagatcctctcaaggcatggagtaatgggaggttgaaatcagttaatcacagagtgatgatgagcggagacaaagattcgtactctatagcagtctttgtaattccaaatgagggtacttttatcaggactccccgagagctta

SEQ ID NO: 18105 - DNA, 504 bp, Gossypium hirsutum
  Clone ID: uC-gsflnu33B141f10b1
taaaaagagaaaatctctcctctgcacacagggcatttcaaatgaaaagcaaagtgatttgagaaatttccaatctattcaaagcaatagggaaaaaaaagttaaagagtgaattggagggaaattgatttttacgtatgtaatgcatcagaagaaatcggaagttcagatcggaaaagaaagcagcggcgtctcctccggttttaatcccaaaccttccaccgttcaccaccaccaccaccaccaccaccagcatttcaattaccaccaccgcttacaacagctttccgatacaacagcgccggcgggtaccgggacgtctccggtttacgttttccctcagataatttactcagagctcgtctggaaatgatgcgatttcatctcctccgtcttcatcttccatttctccgaacccttacaagagaccccttttgacccaaacgcccgtctcttaccaaatcccctactttgtaccgcttcaccccctcccccgcagttcaa

SEQ ID NO: 18106 - DNA, 372 bp, Gossypium hirsutum
  unsure (1)..(372): unsure at all n locations
  Clone ID: uC-gsflnu33B141f12b1
nttgccacgcgtccggatccagctcctgcaacaaccttttttcacttggatgccacaactgtgttgncccgacagatctctgagcttggtatttatcctgctgtggatcctttggattctacatctcgtatgctctctcctcatattttgggtgaggaacactacaacactgctcgtggtgtccagaaggttctccaaaactacaagaacttgcaagatattattgctattatggggatggacgtgcttagagatgatgataatgttatctgttgctctttgtcctctagatccttattttcattgcgttacacttttttattgcgttttaaatttttcttctggtacttttacccatcattttcctctctt

SEQ ID NO: 18107 - DNA, 463 bp, Gossypium hirsutum
  unsure (1)..(463): unsure at all n locations
  Clone ID: uC-gsflnu33B141g01b1
ngtangtcatatccatttgctaacaaactggtgcattcataagaagttcttgagctgtatagtgatttgatgaaattggatccaacacattaccagtactacaaggatgaacatagcatggtcttgctacataaggtgacttctagtaaagagtctttacttcaacattgctttcagtataaggactcagtttcatcagccatatgtggtcctatctgtctccggctgaataacttatcgctatcacggatgggagcttttgagaaattattgtgggtccaaatgttagatctcagcgacaatgaactacaatcaattgaaggattggaagctatgcagctcctctcttgtttgagtttgagaaacaataaactgagaagtttaactgctctggagcctctgagaaagctcacgttattaagagtactggatatttcatacaaccagattggtgatcattcta

SEQ ID NO: 18108 - DNA, 223 bp, Gossypium hirsutum
  Clone ID: uC-gsflnu33B141g03b1
attgtttggagcagagtatgtgtcgctgcatgtgagtgtagagtaacagggcagcgtttaatctgtatacccagacgttggggtataagattcatgatgtggaggccaagtattatgcagatggggaggatgcatatgacatgaggaagcagttgaaagaaaagacgaaccatcatcatggtcatcattatcaccaccaccaccaccatcatcatggtggtgg

SEQ ID NO: 18109 - DNA, 305 bp, Gossypium hirsutum
  Clone ID: uC-gsflnu33B141g07b1
tccacgcgtccgcccacgcgtccgcttgaccggcctaccaacagttacaaaccacagttccacgttgccaacctttctgcttccaagcttaacccagattctgggatcagtgtttaatctttacctactaaataaatgctgtatctttttgggcatattttaagcctaatccgtatatgtttatgttatacaaagctgtaagagcattgctctcaagtctggttacgtaatgagtgtgtggaatctgttcaaatcaaaatttctaaaaattccttctatcttaatcataaggggtggcctgtttt

SEQ ID NO: 18110 - DNA, 292 bp, Gossypium hirsutum
  unsure (1)..(292): unsure at all n locations
  Clone ID: uC-gsflnu33B141g10b1
tcncgcaacagcctggagacctatatctacaacatttaaaaccagattaatgataaggataagctcgctgacaagcttgaatccgatgagaaggagaaagttgaaaccgcagtgaaagaggcacttgagtggcttgatgacaaccagagtgccgagaaggaagactacgaggagaagctcaaggaggtagaggcagtatgcaacccaatcatcacagcagtgtaccaaagatctggtggagccccaggtggcggatcaactgaagaagatgatgattctcatgatgaacttt

SEQ ID NO: 18111 - DNA, 194 bp, Gossypium hirsutum
  Clone ID: uC-gsflnu33B141g12b1
tcccacgcgtccgacttaacagttttttagaccaattttgatatgtgttcatttggttgagactggcatctgcccacggattgtgtgtttgctttttccgtgtcaattgtagttgaattccttcaaagaatgctagtttgatatttccttgttttcttaatgttatgatggtcctaagccttcgattttcaact

SEQ ID NO: 18112 - DNA, 316 bp, Gossypium hirsutum
  Clone ID: uC-gsflnu33B141h05b1
ttaaaatcaccattacaagtcccaaagaagacccccgtttattctaaaagaaagaaccagagttttctttctctttagtttacgtttattgtccttttggaatttttgatactaaaaaaaggaagcaacgaagaagggaaatggagggcaaagaagaggatgttagattgggagccaacaagttcacagagaggcaaccaattgggaccgcggctcagagtcaagatgacgggaaagactacactgaaccaccaccggctccatttttcgagcctggcgagttaacctcatggtctttttatagggctgggattgc

SEQ ID NO: 18113 - DNA, 330 bp, Gossypium hirsutum
  Clone ID: uC-gsflnu33B141h07b1
tcccacgcgtccgcttcttaagctgatcaatgcgaagaataccatggaaattggggtttatactggttattctttgttagccaccgccctcgctttacccgatgacggaaagatcttggccatggatatcaacagagaaaactatgagttgggattgcctgtaatccaaaaagctggcgttgcacacaaaattgaattcaaagaaggccctgccatgcctgttcttgataaattggtggaagatgaaaagaatcatgggtcgtatgatttcatctttgtggatgctgataaagacaactaccttaactaccacaagaggttgatagagtt

SEQ ID NO: 18114 - DNA, 421 bp, Gossypium hirsutum
  Clone ID: uC-gsflnu33B141h09b1
tgctactcttccgtatgaagtctggcacgggcatgatctatccactcttactcgggagggtggagaacaggcagcccagtatcgaccaggggtatactactatgacggaaaccaagctagtttaggaagagagactatggaaccgaatcgaaacgagttgatagaggagaaacacgagactgagactctgccggcgaaacgatcaaatcggtcggtagagtaccatcagcaatatttagaaaaaggaggaggttactgggctaaacagtcgtactgaacaggatgctctgggcccgatagaagctagggctgaagaaagcccttttgaaatgtttttttttaatatcatgatggcacttaagctttttgtctgggaataaacaagttatcatgttttacttttgttgtggtctgaagacat

SEQ ID NO: 18115 - DNA, 371 bp, Gossypium hirsutum
  Clone ID: uC-gsflnu33B141h11b1
ttgttgtaatgaatgaggtgcgtgtgagcagtccatatctccccgagtctgttagtggaggaactcctgcagccaatgaacgagtgagaaaagtgctggagtttgaaaggaagaggatgcaaactcgtggtactagccagtgacaaactcacatttgtgttcaaaggttggagaaaccaaaatgtgttatgattggtattattgtggtagttcttttgcctcacatttttcttattttattgaaagagtttaaacaaatgcctgatactgaattgttagtcctaatataatgctacctaccttttttagatgagtttgctggtaatgaagccagtacaagtagggggaagtccggggtatgattttaattt

SEQ ID NO: 18116 - DNA, 285 bp, Gossypium hirsutum
  Clone ID: uC-gsflnu33B141h12b1
taaaacttaccagactcaatattctcacaacaaaacttaaaatgtctcgctgctcaggaaaatggggctgcggtgctgattgcaagtgtggcagtggctgtaacggatgcagtatgttccctgacataatagagaagactacaactgagactattgttcttggtgtggcaactcagaaaatgcactttgagggatctgagatgggagttggggtttgagggccggacgcctgcgaggagacttcggcggacgcaacccttgctcttggggaacgtgctcaattta

SEQ ID NO: 18117 - DNA, 545 bp, Gossypium hirsutum
  unsure (1)..(545): unsure at all n locations
  Clone ID: uC-gsflnu33B142a02b1
tttccctctttctataaattttctgtgctagggtttctcaacccatcatcgtcgtcgccataatcgccgtggctccatcgtggacggtggtcggagccacacgaaggccagattttcaaccctttttaagagagtccgaaagcaaagccctccaaactcggaaaatgcgaaagaaaaggcctctccccctcccttttaagtccgattttgacgacggggaatagatccgttgatgtgacgtgggattatccagtgaggtttcttctcttattttgtttaaaataaatttgtaatagaaaataaaaaaaaataaaaaataaaaaaataaaaaaacgaaatgaaacgaaaatgaaaaatagaaacagtcaaccttttttttttttgctttttgattgctcaatatgctgtgtgtaccctttacaacattttgtttctgggcttatattgcagaaaaaaaatacacttgatttaacgntattactattggctatgcctttgtggttctttgtttctttttgctttggggcttggttgttctttttttt

SEQ ID NO: 18118 - DNA, 447 bp, Gossypium hirsutum
  unsure (1)..(447): unsure at all n locations
  Clone ID: uC-gsflnu33B142a03b1
tccgctcctcaccttccggaccagacaggcgcagattctctcagcccagcgaccatgacaaagagaacgaagaaggccggaattgttggaaaatatggtacccgttatggtgccagtttgaggaagcaaattaagaagatggaggtgagtcaacacagcaagtacttctgcgagttctgtggaaagtatgcagtgaagagaaaggctgtaggaatctggggctgcaaggattgcgggaaagttaaagctggtggtgcttatactttgaacactgccagcgctgtgacggtgaggagtactattaggaggttgagggagcaaactgagagttgagcagctgctgactacgttatgttcaactttggtatgatgttcngttatgtgttggctacaaaccagttgagtcattttgttgacaattgtggcgcttagttcttaatttatatc

SEQ ID NO: 18119 - DNA, 467 bp, Gossypium hirsutum
  Clone ID: uC-gsflnu33B142a04b1
ttcacctgaaaagtctagatcaaggtctcctcgttcccgctctgcatcaaggtctcgctctttgtcaagatctccttcaaggtccaggtctcctttgccttctcgtcaaaaaggaaggagcaagagtcccaaaagacgcagtgttagcaggagtccaagtgggagcaggagcaggagcaggagcaggagcaagagtgtatccgggtcttgatctgaagctcctctgttgtcttttcactggtgagatgctattgcggggtgtatcaggagctgaagatgcctatgaagcttttatgtttggataaaaattagcatggagtagtgcgtaacttattagagttgtatcaactatgctggatttgatcttcattgctatattcagaacatcggaccgtgggtgtgttattttaactagactgttacatacctggttttgcgatactttttgacatgatttgattggtggg

SEQ ID NO: 18120 - DNA, 325 bp, Gossypium hirsutum
  unsure (1)..(325): unsure at all n locations
  Clone ID: uC-gsflnu33B142a05b1
ttttatgaaaaaggagttccccaggatggccaaggcggtcaaaaaccaggtgacagacaactactacaggccagatttaacaaaagcagcccttgctaggttgagtgctgtgcacaggagtctaaaggtagccaagtctggtgttaagaagaggaacaggcaagcattgaaggttcgtggctggaagtgagctagacctttcaggttgtatgagctctgctattttcattgccccagacatttttttactccttttttgaatttgncttattnnnnatggtttgaactgagttgttgaaattttatatctagatagattttgaaa

SEQ ID NO: 18121 - DNA, 428 bp, Gossypium hirsutum
  Clone ID: uC-gsflnu33B142a07b1
tcttccacgcgtccggtaccgggagcatccaggccatgatttctgcatttgaatgtgtccacgatggttggggagttgcagtgcttgtgggggttcccaacaaagacgatgcattcaaaactcatccagtgaatctactgaatgaaaggactctcaagggtactttctttggcaactacaaacctcgaactgatattcctgctgtcgttgagagatacatgaacaaggaacttgaacttgataagttcatcactcactctgttcccttctctgagattaacaaggcatttgagtacatgcttgctggcgagggcctgaggtgcgtgattcgcatggatgcataaggattggctggccatggatgaagggctttttgttaagtatatgtgcattttaagggaataaataatgtaatataatgctacatc

SEQ ID NO: 18122 - DNA, 450 bp, Gossypium hirsutum
  Clone ID: uC-gsflnu33B142a08b1
tctgattataagcacctccccataagcaaaccacaaaggaaagcttggagagagacccaaaaacaatgtctaaggaagtgagtgaagaaggacagggtcgtaaggactatgtggaccctccaccggcacctctgattgatatggctgaactcaagtcatggtctttttacagagccctcatagctgagttcatagccactctcctcttcctctatgtcactgttgctaccgtaattggtcacaagaaacaacaagatgcatgtgatggtgttggtctcttgggtattgcatgggctttcggtggcatgatctttatccttgtttactgcactgccggtatctcaggtggacacattaaccctgcggtgacttttgggttgtttttggcccgtaaagtatctctcatcaaggctgtggcttacatggtgtcacagtgcttgggtgctatat

SEQ ID NO: 18123 - DNA, 102 bp, Gossypium hirsutum
  Clone ID: uC-gsflnu33B142a10b1
tgcccacgcgtccggccatttaacagattggggtgatttatttatttatttttctttttctctgatttaacacttcattacttatttattatttattggggg

SEQ ID NO: 18124 - DNA, 451 bp, Gossypium hirsutum
  Clone ID: uC-gsflnu33B142a12b1
tctttcttattcgttcatctccgtgtaagcttagaaacaaaacctctatgtgaagaatcagaatcatgggtgatgtgagatatgagtttgaggtaaccttcccaattgatacagacaggctcatcaaggcttttgctcttgtagctgtcaaggtttgcaccacggctgcccctcatgcatacaagagagtggagctcgatggtgaagctaggactggaagtatcgacacgatcacctttgttgaaggcctttcataccaatatatgaagcaccatattgggtgacacgacttaaacaatttttcatacagctacagtatgattgaaggtgggcctttaggggacaagcttgagaaaatcaactatgagaaccagattgtggcagctgcatatggaggaagcatttgcaagagctcaattaaatattacaccattggcgactatgtaatcac

SEQ ID NO: 18125 - DNA, 459 bp, Gossypium hirsutum
  Clone ID: uC-gsflnu33B142b01b1
ttttacgcgtccgaaggcttctcaatggatggttcagattgggtggagctttttgttagagaaatgttgaatgcttccaacatcgatgatgccagagctcgtgcttctagagcactggaggttttcgataagtccatccatgctcgtgccggagcagaggtggcccaaaactatcaccaggaaaatatgatgctgaaagaacaactggaaacactaattcaggaaaatactattctcaagcgagctgttgctgttcaacatgagcgccagaaagaatatgaaaatcaaagtcaagaattacagcatctgaagcaagtaatatctcaatatcaggagcagttgagaacccttgaggtttggcttcattcaccggaagcatatatgcatactatgttactcaattatcagttggagtggttgctacctgatatgtgtagatacgaacatgcttaatttttt

SEQ ID NO: 18126 - DNA, 393 bp, Gossypium hirsutum
  Clone ID: uC-gsflnu33B142b02b1
ttttcaggtgtgtctattgaattctttccttcactttctcgagaaaaaaaaacgtcttcagcttgcaattgccgatctagctgcatctgcggcgacagctgatcatgcatcaggaacctcaacctcggattctccgagacgacaaccagcgctcacaccatcatgttcggagttgcgccagtgaagatgacctttgaggcaccagagatgagcactactgaatcaggacatgcatgcaagtgtcgatcaaactggtctcgtgatccatgcaactgttgaaaagcttgatgaatgccctcgagtatgaagatcgaacgcctcaaaatggcacgcctgtggagtgatttattatcaaggatgaatgcctgcaaggactacgactataattatgtc

SEQ ID NO: 18127 - DNA, 480 bp, Gossypium hirsutum
  unsure (1)..(480): unsure at all n locations
  Clone ID: uC-gsflnu33B142b03b1
ttcacgcgtccgcccacgcgtccgctcatttccagggtattctcttatcatgtactggagagctgacatttccatatccagtttctctgccaagtgctgatggaattgcgcaattcgcagatggttatgccgtcggaccattccatcaataggagtcaattcacctgtcatcagtttcagcagtgtactcttccctgcaccattaggtcctactaatgctatccttgagtccaagtctaccccaaagtccaagttcttgtagatcagattctcaggcgtgtatccgaaagtaacttccacaaactgcagtaccggtggaggaagttttccgacatcaacaaatcgaaacaccagaaccttgtccctgactaccttctccgtgagtccacctcgctccatctntgccaatgtcttctccttactctgtgcctgcccggctagtttggctgacccgtgaccgaaagcgagcatgtactcctt

SEQ ID NO: 18128 - DNA, 483 bp, Gossypium hirsutum
  Clone ID: uC-gsflnu33B142b05b1
tcgtttactcggatatgtaggataggtagtcataataagaatcagtggccggggagggtatgaggtgaggattgaaggtgccaagaagcgcatagaagagaacacccgtcacatgcacaatcttggactccttatcattgcttgtaatgttgtatacgtcttgggtaggatgctgatcttccattcctcattcacatggaaacattgggttggtctacttttgacctctgcggcttactttataccctatcaacaactttcacagatggcaaaacctgcttattctgatgatggagaacttcttgacggaggatttgatatgagtactggtggaatatgtggctatttacatgatgtcatctacattacaagttttgtgcaactgatgtccatcatctttgacaagttttggtatacatatcttgtgaacccggatttggagcatacaaatcttttggttcttagaggttttctatattaggc

SEQ ID NO: 18129 - DNA, 415 bp, Gossypium hirsutum
  Clone ID: uC-gsflnu33B142b06b1
ttttcctgtcttgtctttacaaccagtaccggattccggtcaccggcaactacagaactgtactttaaaccctcacaaagatattcagaagctaagaagagtccaagcttatctcaagaagataaataagcctgctgttaagaccattcagagtccagatggtgatgttatagactgtgttccatctcatcttcaaccagcttttgatcatcctcagcttaaagggcagaaaccattgaaaccggctgtgaggccaaaaggacataacttaacagaagcagtctctgaaagtttccagctatggagagatacaggtgaatcatgtcctaaagggacagttccaattagaagaacaactgaacaggacattcttagagcaagttctcttagaagatatggaagaataagaagacat

SEQ ID NO: 18130 - DNA, 429 bp, Gossypium hirsutum
  Clone ID: uC-gsflnu33B142b10b1
tcggacgcgtggggttatggggttcttttttctctatctttcaaggagatttgaagatttgcagcttctgggggtgattaactctataggaacaagaattaggggaaggaatgggttttttttggttgtaataaatggttttttttaatattttatataattttatgaggcgtattcggatctactgcctctgaaattggggagaatattgtataaggtcgaaatgcatcactcctccttttgtgaaaaaaactttggaagaatatccaatgtctttgctgaggaaattctcagcattggggcactttaaatttcttttctttgaaacagatattattcattggttcataatatgttacataaatttgccacttttcaaaattacaatgctgttgcttttatcaagtcaaatcacctttctgtatatta

SEQ ID NO: 18131 - DNA, 386 bp, Gossypium hirsutum
  Clone ID: uC-gsflnu33B142b12b1
tctgttacagacgatcgatctcttcccgcagtggctgatgctcaaactgaaaaacccctttccctttccgagcaatatgcactacaggagaaagaggaaaaattagatgtgactacaaaaccagcagaagcaaaagaggctgaaaatcctgtaaatgcagccactggttctggggatgttgtaactgagaaattggaggagactcctgccgatccagttgagggaagcactgaggcccctcctcctgctgctgaagaaagcactgaagcaaatcctgctactgggaacagtggtgaagatgctgcacaggaaaactcgggtgactctgaggaaactacagagataaagactgagactgccccagcggatttgcgctttccaactac

SEQ ID NO: 18132 - DNA, 255 bp, Gossypium hirsutum
  Clone ID: uC-gsflnu33B142c01b1
tccacgcgtccgcccacgcgtccgcaagagggttgattaggttggtctctgcgcattcaagccagcagatttacactagggcaacaaacaactagatctttagttatatttttgcttaattagttctatgaagtattgccatggttgagttttgacttggataaatgatttttcccccttcaaatttggtttaaaacttctctttggctactttttctagaatgatttaatggttgaatttcagcttctttggcc

SEQ ID NO: 18133 - DNA, 463 bp, Gossypium hirsutum
  Clone ID: uC-gsflnu33B142c05b1
tgattacctcccatttatgattcctagctaaaactgctgttgtagctaaccccgtttcctatgaaaacgaagcatcaaaattaatcttgatgataccatcattcggtggcttccagaactctttcacagcaggtccaacaacagaactgaaattcgctgtatggaaacttagttctcgtgcatatccacgaataaaacctagggtttcctgttttgagaaaataacaccttcatggactaccttatttctacaatgccagaggctccacaatgaaatagcaataagatttttggtgctgttatcaaccgccaaaaaagttctaataaaactttctttatgctctagtgaatcgacaggaggatgagtctgcacttttaaatcgtcccaaatgtcttgcaaaatagcacacgtccacaagagatgagaagaagattccagttcagtcttgcacagtgggcagac

SEQ ID NO: 18134 - DNA, 245 bp, Gossypium hirsutum
  Clone ID: uC-gsflnu33B142c07b1
tgcccacgcgtccggtttcagggaaggtactgaatcagcaccaaggaagaaggttgcagcaacttttgcttaaaaggcaaattgtaatggtatgaggttttgttttggatgaagccatgtttatgaggaaacatttagtgatgaatagtgaaattatgttccattggatgctttagttatttagtttctatttgaatgtagctgtcttaaattttgaacaattattggagctaatgtttgaccct

SEQ ID NO: 18135 - DNA, 306 bp, Gossypium hirsutum
  Clone ID: uC-gsflnu33B142c08b1
taattgctcggagggaggcttctggccccgagtcgtgcggcggttggggttgcttggctacgacgctaggagttgtgctgaaggttctagggttttttagtgttgggctggtttgtttattgtttgggtaattgggcttgagttttaattttgttgggcctgtattggtttaggcctgggcaataactgggctttacatgtttataaaataatgagatctattaaatattatttcaataataatattttcaaaattaccatctataagatttctccttcttactatttctattttataaacccttt

SEQ ID NO: 18136 - DNA, 375 bp, Gossypium hirsutum
  unsure (1)..(375): unsure at all n locations
  Clone ID: uC-gsflnu33B142c11b1
tcaacattcccatttccaatctccagctccgaaggtttatatgccgatcagaaacatagcggntggccggcccgaagaggctactcaccccgatgctctcaaggctgctttggctgagttcatctcaaccttgatcttcgttttcgctggatcgggctcaggaatggcctttaacaagttgactgacaacggagcaaccaccccggctggtctcgtagccgccgctctagctcatggcttcggtcttttcgncgctgtctccgttggcgccaacatctcaggtggccacgtcaaccctgccgtcaccttcggtgcttttgttggcgggaacatcactctcttgcgcggcattctttactggatccgccaacttct

SEQ ID NO: 18137 - DNA, 314 bp, Gossypium hirsutum
  Clone ID: uC-gsflnu33B142d01b1
tgaaaacttcctagaggtacctttagggttggtttatggttcaattaaattgcagaattaagtcgagttacccgtctctgacatagtatgtcgttatcattattaaataacgcctgagaaggctgattaggaggaggatcagggttggaacatgggaggaatgttgggactttggacttctcattgccatgatgcttctcaggtgaaaaggagtgtgattattatggatattgactcttattcgtggaatggtatttcaatctcttgtgcttttcatctgaaacttttctaattaattgaaatataaaagcttc

SEQ ID NO: 18138 - DNA, 452 bp, Gossypium hirsutum
  Clone ID: uC-gsflnu33B142d02b1
tttcaacacagaagcaagcagctagcagtttgctttgaattatactactataactccaccactttccaccagatttacattgcagatggcttcatcaatgctgtgggcttcaagggcggcttcttatcttaggatctctgtcttccacagaggcttttccactgttctaaaggatctgaaatatgcggattctcatgagtgggtgaaggttgagggtaactctgccactattggtattactgatcatgctcaagatcatttaggtgatgttgtgtatgttgaattacccgaagtgggagctgctgtaaagcaaggtgaaagttttggagcagttgaaagtgttaaggctactagtgatgttaattctcctgtttcaggaaaagtggttgaagttaatgaagagctcagtggctctcctgctaaggttaactcaagtccatatgaggatggat

SEQ ID NO: 18139 - DNA, 481 bp, Gossypium hirsutum
  Clone ID: uC-gsflnu33B142d03b1
ctcacgcgtccggcaaaaactgcacaaaaatgatgggctaagactccactttggaagagagctgagctccttcataaagctgctgctatcctaaaggagcataaagcaccaattgctgaatgcctggttaaagaaattgcaaaaccagccaaagatgccattaccgaggttgtgaggtccggggatcttatttcttacactgctgaagaaggggtaaggattcttggtgaagggaaattcttggtatctgatagttttcctggaaatcagagaaccaaatattgcctcacgtccaagattccgcttggagtgattctggccattccaccattcaattatccagttaacccggcttgtttcaaaaatcgcaccggctttaattgctggaaactcccttgtacttaagcccccgacacagggtgctgtttctgctcttcatatggtacactgttttaatttggctggtttcccaaggggctaa

SEQ ID NO: 18140 - DNA, 193 bp, Gossypium hirsutum
  Clone ID: uC-gsflnu33B142d04b1
ctcacgcgtccgggcacacgtacgaacgggggggggctttagacactgtagcttttatctgcccgacaaccaaagacgaccgttagagtcacagtataataagttgaagagcatttcaggagctcagaaccaggaactaaggttggtcaagagggttccaatgtacagcacaatgagggagagcatagaaacc

SEQ ID NO: 18141 - DNA, 187 bp, Gossypium hirsutum
  Clone ID: uC-gsflnu33B142d05b1
ctcacgcgtccgggcacaattacaaacggggggcggcttttagacaaatcggattttatcagcccgacaacgaaagacgatagttagggaccgactatacgtagtggaagaccattcgaggaggccaggacctggaactacggctggtagaagaacgtaacaatgaataggaaaacggaagagcgca

SEQ ID NO: 18142 - DNA, 274 bp, Gossypium hirsutum
  Clone ID: uC-gsflnu33B142d06b1
ctcacgcgtccgggcacaagtacgaacacggggcggcttttgagaaaggatacttgttcaggccgaacacctcagtcgatagtgcaggacctactatccatcctggaagaggattctatcaggactgaacaaggaactatggatggaagaacaacgtgaatatggttttgaatcagatggagcgcaaccataccctgggtcagagcagtacagggaagcaaattaactaggatgagatgactacgcgcaacacgattgtgagaagctacaagcg

SEQ ID NO: 18143 - DNA, 273 bp, Gossypium hirsutum
  Clone ID: uC-gsflnu33B142d07b1
tggccacgcgtacgggcacatgtacagtcgggggctttcaactggaaacgcatattttaacaggccgacaacctgatactatagtccgggacatactatacgtagttgaagagctttctataacgcctgaacatggaactactgctggacgaagggcgtacacatgaaagataataaactatagcggaaccacagataggtactgacagctacagggaagaaaattatcgacgatgacaataatatgcgcgacatgattgggatcagtaagat

SEQ ID NO: 18144 - DNA, 145 bp, Gossypium hirsutum
  Clone ID: uC-gsflnu33B142d08b1
taccacgcgtgcgggcacaagcacagaggggggtttttgaatcaaagtgcatattattacagggggacaacgaaattagattgtgcaggacaaactatacgtcgttgaagacccttctacaactcttggacatggaattgccgat

SEQ ID NO: 18145 - DNA, 417 bp, Gossypium hirsutum
  Clone ID: uC-gsflnu33B142d10b1
tgccgagattattgtccatgggaaatctgggttcaacattgatccttaccatggtgatcaagctgctgacatactggtcgatttctttgaaaagtgtaagaaagatccatctcactgggataagatctcccaaggaggcttgaaacgtatcgaggagaagtatacatggaagatttactcggagagactattgaccctgaccggagtgtatggattctggaagcatgtttccaaccttgaacgccgtgagagtcgtcgttaccttgagatgttttatgctcttaagtaccgcaagctggctgaatcagttccattggcagaggagtaaatttaagctgttaaataacattgggcccggttttcttggagaataatattctggttttgtaatttcaattggagacgctcttttggatt

SEQ ID NO: 18146 - DNA, 422 bp, Gossypium hirsutum
  Clone ID: uC-gsflnu33B142e01b1
ttgtattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaagggctataattatgtctctgtctgtgtcttgggtaatagaagctttgtttgggtgaaaataatgta

SEQ ID NO: 18147 - DNA, 168 bp, Gossypium hirsutum
  Clone ID: uC-gsflnu33B142e04b1
tccacgcgtccgggcacgctttcgaagggggggtggctattgacactggatattggatctggccgacaaccaaagaagatcgtttgaatcaaagtattcttagttgaagagctttctaggggttcaggtacagtgactaagtttggtctataaggttgcaatgttttg

SEQ ID NO: 18148 - DNA, 164 bp, Gossypium hirsutum
  Clone ID: uC-gsflnu33B142e05b1
tccacgcgtccgggcacaataagagaacggggggcatctattgagaactcatatttgaactggccgaaaacgaaacaagataggtagagacaaagaatacgtacttgaagaccatactagcaggccagaaccaggaactacggatggaaaacaacaacaaaatg

SEQ ID NO: 18149 - DNA, 183 bp, Gossypium hirsutum
  Clone ID: uC-gsflnu33B142e06b1
tccacgcgtccgggcacatccacgaacacggggcagcttttgacaacgcagcttttaacaggccgaaaacgaaagacgacagggcgaggcccagtgtacgtagtggaagggcattccacaaggcctggaccaggaacgaccgatggtaaggaacaacactatgaatgcgaaccaggaagagcg

SEQ ID NO: 18150 - DNA, 165 bp, Gossypium hirsutum
  Clone ID: uC-gsflnu33B142e07b1
tggtcacgcgtgcgggcacaactacgaaggggggttttcaattgggagcgcttattataacagggcgaaaacgaaagaagatagggcaggacatactatacatcgttgaagggcattcgacaacgcaagaaccaggaactaccgatggagaaggacaaaaacatg

SEQ ID NO: 18151 - DNA, 162 bp, Gossypium hirsutum
  Clone ID: uC-gsflnu33B142e08b1
tgacacgcgtacgggcacaagcacgcccgggggctattaaatgaaagggcgtatctgaacagggggaaaacgaaaaaacagactgcaggacctactatacaaagatgaacaccaccggggaacacatggacaaggaagcgatgatggaagaaggacacacag

SEQ ID NO: 18152 - DNA, 323 bp, Gossypium hirsutum
  Clone ID: uC-gsflnu33B142e10b1
tgaaaaaatcaaaatacctaatttcccccgcttgctactgctagggtttctttctcttctctctcgcaactcaccaggtttctttggagaaaaaaggaaatgtctcgagtttacgtgggtaaccttgacccacgagtttcggagcgagatcttgaagacgagtttcgtgtctttggagttattcgaagtgtgtgggttgctagaaggccaccaggttacgctttcattgactttgatgatcacagagacgccgaggatgcaattcgtgaattagatggcaagaatggctggagagttgagctttctcataattctagaggcag

SEQ ID NO: 18153 - DNA, 436 bp, Gossypium hirsutum
  Clone ID: uC-gsflnu33B142e11b1
tggccatccagattcttgagggaaggagtgcgggacttcaaaggcagcaacttcgagttcatcccgttcgggtcgggccgcaggtcgtgtccgggtatgcaactcgggttatatgctcttgatatggcggtggctcatttgctccactgttttacgtgggaattgcctgatggaatgaaaccgagtgaattggacatgagcgatattttcggactcactacacctcgggcgaaccgactgtatgcggtgccaaagaaacgcctcgtttgtccactcttttaatggaaaactctaaaaaaatcaaaacaattccattgagtcttgaattgcaacttatgcagagtaatcccgaggaatgcccgagaagaaggtgacagaggtggcttttacaagccggaccttggttttttttatcatcatcatataatcaatatat

SEQ ID NO: 18154 - DNA, 400 bp, Gossypium hirsutum
  Clone ID: uC-gsflnu33B142e12b1
tgcttcatggttgcttaaaaaatcatttctcgagttttaaaactcgaaattaagatcctaaatttttcctgaaactagactcatatatatatctacaaatattttttctaaaattttttacttagccaattagtacagtttattagttaaagttacccctatttcagaattcgactgcactaattggctaagtaaaaaattttagaaaaaatatatatatctaaaaaaaattttctagaatttttgacttatccaattagtacattttattagttaaagttacccctgttttagaattcgactacactgccctctacttactacaaacccaaaaagcacgctcttcttccttgtgtaagcggcgccggcaagaagctaaggccagtccacctcggatctc

SEQ ID NO: 18155 - DNA, 424 bp, Gossypium hirsutum
  Clone ID: uC-gsflnu33B142f02b1
tcccctctttctataaattttctgtgctaggggttctcaacccatcatcgtcgtcggcataatcgccgtggctccatcgtggacggtggtcggagccacacgaaggccagattttcaaccctttttaagagagtccgaaagcaaagccctccaaactcggaaaatgcgaaagaaaaggcctctccccctcccttttaagtccgattttgacgacggggaatagatccgttgatgtgacgtgggattatccagtgaggcttcttctcttattttgagtaaaataaatctgtaatagaaagatgaaaaaactaaaaggtcaaaacctaaagaaactgcaagaaacgaaaatgaaagattgaaacaggcaaccttctttttttttgctttttgaatgctcaatatgctggtgtgtaccctttacaac

SEQ ID NO: 18156 - DNA, 280 bp, Gossypium hirsutum
  Clone ID: uC-gsflnu33B142f03b1
tgagctgccattatatataacaaagaccatgcatgggatgatcattggatcttctgggttggacccttcattggagctgctcttgctgcaatttaccaccagataatcatcagggccattcctttcaagaccagagcttgaaaatgatataatcattattttgcatcttttcatagttttcttctacatgttgtccttttgtgcatctacttcactgatgtgtctctcaactttttgtctcacttaatttggattatgttttatggcgttaattaaacgt

SEQ ID NO: 18157 - DNA, 247 bp, Gossypium hirsutum
  Clone ID: uC-gsflnu33B142f04b1
tccacccgtccgggcacactactgaacggggggcatctgctgcaacctcctctttaaactgtccgaaaaccaaacatgacagctcgaaacaaagacttcctacttgaagacgaccccagcgcttcagaagcagtacctaagtttggtacctcaacttggaatgttttgcacacactggaggagcaactgaccctattgatacccaacaacaagttcaagaaccccaaaatgaggactcttcagatgc

SEQ ID NO: 18158 - DNA, 169 bp, Gossypium hirsutum
  Clone ID: uC-gsflnu33B142f05b1
gtcacgcgtccgggcacatacacgaacggggggaggctattgagaccgcatattttaactgctcgaaaacgaaagaggacagggagagacacagaaggcttagttgaagggctttctagcacgacagaaccaggaactactgatggtaaagaacgtcacaatgaacagg

SEQ ID NO: 18159 - DNA, 116 bp, Gossypium hirsutum
  Clone ID: uC-gsflnu33B142f06b1
gtcacgcgtccgggcacaacctagaacggggggaggctgttgggaccggatattataactgatcgaaaacgaaacatgatagttagagtgagagtatccttagttgaaggggcttt

SEQ ID NO: 18160 - DNA, 234 bp, Gossypium hirsutum
  Clone ID: uC-gsflnu33B142f07b1
tggtcacgcgtccgagcaattccttgttgtcaccaaagcaagagggaaatcatatgaattcatatcggatacgctggaattcaagtcgggaactcatgtccggagcttaagggccttgaacatgaaatgcaacccgatggaatgatgcccagcgacaccactgtgggtgtagaaaatgaagcgttcaacactatctttagtgagactggttcagggaaacaagttcatagagct

SEQ ID NO: 18161 - DNA, 255 bp, Gossypium hirsutum
  unsure (1)..(255): unsure at all n locations
  Clone ID: uC-gsflnu33B142f09b1
natgataaaaagcgcggtgacagcgagtacagggccttttacgataaacccgatttgcgggcttttcctcttgctcacatccgatgacgtgtacgttcaggatttttgcggtcaagtatgtgggttccattatttcacattcccatccatcgtgggttacacgctcccatacgcatgggtggggaactcggcgaagctttgcccgggggtatgcgcttatcccttcgctgtgcctaaagacatgacggggttcaa

SEQ ID NO: 18162 - DNA, 265 bp, Gossypium hirsutum
  Clone ID: uC-gsflnu33B142f10b1
tgcccacgcgtccggtcttcccaaatcttggcttttcattgatggcggatctcaggtcagcatttctcaatgtgtattcccagctcaaatcggagctccttcaggatccttctttcgagtttaccgatgattctcgtcaatggggtgaacggatgctggactacaatgtgcctggagggaaactgaatcgtggactctctgtgattgatagctaccgcctgttgtaagatggaaagtgattgtctcatcgttttgatttttctta

SEQ ID NO: 18163 - DNA, 163 bp, Gossypium hirsutum
  Clone ID: uC-gsflnu33B142f12b1
tggttctagatcgcgagcggcactggtgcaggcagagatacatgtgccacttctggtgaaggcttgtatgagggactggactggctttcgaacaacattgcaaacaaggcatagatggcatcattgagctcacagacttaccactgctggtcctttttagaga

SEQ ID NO: 18164 - DNA, 504 bp, Gossypium hirsutum
  Clone ID: uC-gsflnu33B142g01b1
ttttatggtaggcaccaagaagtcggccataagagccttttgcaaagcgatgctctttaccagtatatattggagactagtgtatatccaagggagcctgaacccatgaaagagctcagagagttgaccgctaagcatccatggaaccttatgactacatcagctgatgaaggtcaattcttgaacatgcttcttaagctgatcaatgcgaagaataccatggaaattggggtttatactggttattctttgttagccaccgccctcgctttacccgatgatggaaagatcttggccatggatatcaacagagaaaactacgagttaggattgcctgtaatccgaaaagctggcgttgcacacaaaattgaattcaaagaaggccctgccatgcctgttcttgataaattggtggaagatgaaaagaatcatgggtcgtatgatttcatctttgtggatgctgataaagacaactacctcaactaccacaagaggctgatagag

SEQ ID NO: 18165 - DNA, 400 bp, Gossypium hirsutum
  Clone ID: uC-gsflnu33B142g03b1
tcacgcgtccgcccacgcgtccgcccacgcggacttccacgcgtacgaccactcgtacgattttcccctttcttaccgaaccctaaatccctctgtcaagcatcaatccaccattaagaatggcgccttatgctttgggcctcgattcatcactctttggcctcaagaaccctcccttcaacttcgatttcgacgaagcaagaggggatcaacggcagatacgcgaggtacgggcgatgtgctggcgtatggaggcgcaggcgtacgggggctgttgacgtggaggcatgagcggcgttggggctgtacggtggctgaaggctaccgagcatctgctgctagggctagggtttggcaaaaatttgttagcatttgggttgttgggcccatttagagtgct

SEQ ID NO: 18166 - DNA, 389 bp, Gossypium hirsutum
  Clone ID: uC-gsflnu33B142g04b1
tgaagcagcacacaggtccatctccgtctcctctctttcccgcttccttcgacttgctttctcgccttttgcttcaaaccctacttctcttcttcattctcaaaatgaagctcgtcaggtttttgatgaagttgaacaatgaaacggtgtcgattgagctcaagaacggaaccgtcgttcacggaaccatcacaggcgtggatatcagcatgaacacccatctgaaaacagtgaaacttacattgaaggggaaaaatccagtgagtttggatcacctcagtgtgaggggtaacaatattcgctattatatcctgcctgacagcttaaatcttgagacattgctggttgaagagacaccaagagtgaagcccaagaaggcaacagctggc

SEQ ID NO: 18167 - DNA, 192 bp, Gossypium hirsutum
  Clone ID: uC-gsflnu33B142g05b1
tcacgcgtccggggaccttcacttgcggaagaagtcaaactagagctaacatcataactgctcgagaaggccacagcaaagggagtgtctctgttgctgtcctttaaggcgattgttgctgtcaagaccaaggctgtagttctcggaaaggaggtgccagtgtaagggatcccagaatggtggatgggcacc

SEQ ID NO: 18168 - DNA, 164 bp, Gossypium hirsutum
  Clone ID: uC-gsflnu33B142g06b1
tcatgcgtccgggcacatactaaatgagggggatgttatttggaactgatattttaacaggtcgagaacgaaacacgaaagggagagatagattagccttagttgaaggggatacgagcaggcatgaacaaggaagtactgattgtaatgaacaaagctgtgaa

SEQ ID NO: 18169 - DNA, 283 bp, Gossypium hirsutum
  Clone ID: uC-gsflnu33B142g07b1
cctggtatgctgtgctgctagtatttgcagacaagcatgatcttccaaatgctatgaatgctgctgagattaccgacaagcttggccttcattctctccgccagcgtcactggtatatccagagtacatgcgccacatctggtgaaggactgtacgagggactggactggctctcaaacaacattgcaaacaaggcatagatggcgtaattgacttgtctgtctcagaaaatgccagcccctttcggaattattgatgtttctacgtccgttcaaatgttttg

SEQ ID NO: 18170 - DNA, 247 bp, Gossypium hirsutum
  Clone ID: uC-gsflnu33B142g08b1
ctcccacgcgtccgaagttgcagggatttgatggacattcaaaaacttatggaggaaaatcttgtggatgttatcaacattaaattatccaaatttggggttcttggtatccttgaaattgtagaaatggttaaaaaatctggattggaacttatgattgatagtgttgctcaaactagacttgctactggtgttgctggtcatttagcacatggcctttgatgtttcagatatgttaatatttgtg

SEQ ID NO: 18171 - DNA, 470 bp, Gossypium hirsutum
  Clone ID: uC-gsflnu33B142g10b1
tcccacgcgtccgcccacgcgtccggggagcccttgataacttggggagtttaaagcagcaatatggtctggcaaagtcggcaaatgaagtgattttggtcattgaagcttacaaggcccttcgtgaccgagcaccttatcctccaaaccatgtggttggccatctaattgggagctttgctttcattgtctttgacaaatccacctccactttgtttgtggcttctgatcaatttggtaaggttcctctctattggggaatcaccgccgacggatatgtggcctttgctgataatgctgaattgctgaaaggtgcctgtggcaaatctcttgcttcttttcctcaaggctgtttctactccacagcagttggaggaattaagaagctatgagaatcctaagaacaagatcactgcagtgcctgcttgagaagaggagatatggggtgcttaattcaaggtggaagggcc

SEQ ID NO: 18172 - DNA, 358 bp, Gossypium hirsutum
  Clone ID: uC-gsflnu33B142g11b1
tgctcacgcaatcgaggacgactccgtcaacgggtattaccacgcgaccgtgtttatagaaggaagggcttgaaaatgggttccaaacaaggcggggaacgaatcaaagtatatcgtgtacttgttaaagcagtgaaaaaccacaatggaaaagaagagtataaaaagcattgtagccagtatatagcagagcaatttaggaaaaacagtcaactttcagacccttctttagttgctcaaagaattaagcttgccaatgattatacttatttgcttaacagtgggcatcatcacaaggacttaatggtcttatacaaaaaacgggagataggtcagatgaaatgaaaagaatacctgg

SEQ ID NO: 18173 - DNA, 289 bp, Gossypium hirsutum
  Clone ID: uC-gsflnu33B142g12b1
tgatcacacatgccttttaagtgattgtacgggctccacttggcttgcagttttatcttcttctttgatccttttttagaatcctatgaatttgcgtgtctattgttaaggactcgaagcctttgatggtgtgggcgggaagcttaacgcctattcagctcatgtatcaacttatattaaatttatggcaataataagttactttgcaaactattctacctcaggaaagaacacgcgctacactgatggattcaacaagagtataaccttgactctacaggaacagaag

SEQ ID NO: 18174 - DNA, 458 bp, Gossypium hirsutum
  Clone ID: uC-gsflnu33B142h01b1
tttagattctcccaaattttaactcttttgagttttttttgagagttctcaaagaacaaaaaaggctccctgtgtattctttcggttatgatttagccctaatagccttgagtatcacttctcattatgaacaaccaatatggtgaagatggagatgaagccactgttatggggtttgaagtgcccagatcacctgattcaagttataataatgtgtaccccggatatgaagacgatgcacgtgacccgcctgttgtccctccgcacctacatcgtaccatgcttagctgccctgcaagcataaatgcttctgggagtcttcctttacctgggaatgtgagtttaaaccacttttacattgaaaacccggaggcaccctaaatccgtagcggccctttgattcacttaacgattccgctcaaaggttgttcctgcatacttatcaaaccggttccaaa

SEQ ID NO: 18175 - DNA, 456 bp, Gossypium hirsutum
  Clone ID: uC-gsflnu33B142h02b1
tcccacgcgtccgcaaacattcggaaatgttagtgttgatggtagaagttatgcagttaataagatgggatcttctgctcttgctgctacacttcatgctgctgctttgcttcttaagattaattcagattgggattggtttatacctttaagtgcctcttcttatcccctaatgaatcaagatgatctcctccatgcttttactttccttccaagggatctcaacttcattgattatactagcaatccgggttggaaacagaggggagagataaaccgaattgttgtagaccccaacttatattataagagcaataccccaattaactatgatgttgaaactcgaaaaccagacgctttcgagatttttggaggttcaccatgggtgattctttcaagaccattcatggagttttgcatctatggatgggataacatttcaagaaagctataaat

SEQ ID NO: 18176 - DNA, 426 bp, Gossypium hirsutum
  Clone ID: uC-gsflnu33B142h03b1
tcctacgcgtccgcaaaatatctgctttttgttagttttcctttttgtcccttgtttatttgatatttccccctcatggccgccgctgatgtcgagttccggtgcttcgtcggagggctcgcatgggccaccgacgaccgggccctcgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgcgcaaaagtggaggcggtggcggaggatttggaggaggaaaccgtggttacagccgcggtggaggcggcggcggatatggtggtcgccaagga

SEQ ID NO: 18177 - DNA, 514 bp, Gossypium hirsutum
  Clone ID: uC-gsflnu33B142h11b1
tcccacgcgtccggaagtttgggtagtgaaaagaattatctggtaccaaattttatatcaaggctattgcacattttcttccctgccaagtttcaactctgtccaagtcaatttcatccccaacccaaaaatggcatctccaatctgcttctaccttcttttcctctccctcctctctcaaacccaactctccttttccactacctacacaccaatcgatcacggccgtccgttggtcacctcaatcgctgatgtgcacgatctgctgccaaagtacggccttcctaagggtatcgttcccaacaacgtcaagtcttacaccctttcatccaccggagacttcaccatcgagttggaaagcacctgctatgttcagtttgatgaccttgtttactatgacaaaaccatcagtggaaagctaagttacggggctgtgcacgatgtgtttgggattcaagctaagaagcttttcttatggttgccctgtactgggattgaggttaatggccaatcc

SEQ ID NO: 18178 - DNA, 355 bp, Gossypium hirsutum
  unsure (1)..(355): unsure at all n locations
  Clone ID: uC-gsflnu33B143a03b1
tctatctacgagtggcgatgaggctgtccaaacgaaataaaatagtttgcactactactatttgcttttatattatggaatactatatttaaataaatntgacagccagcaataaaagattgccatgtgtgcttagtttgcttaagacaaaacaagcatattactacgggaagatttaagagaggattatccatcaaaactaaggatagattgactgcacaaggaggagctagtgtggcatgcaaaacaaaataaagctgctgggggggacgctgtctggaatcacacccttgacccttcgatccggactgccttggtgttttatctgtccgcttaagacacagagactgccctg

SEQ ID NO: 18179 - DNA, 334 bp, Gossypium hirsutum
  Clone ID: uC-gsflnu33B143a08b1
ttcacgcgtccgcccacgcgtccgcgcaaattggcggagggagtatactatggaagatatactgacccagctgaaaaaggagatggcagcctctcataatcgaaagctggtccaacctcctgagggtacctacttctagctctcgaattcgtatcgatattctggatctaatttcatttgtggttatgcaatatatagtttgtaatgcttgttgatcctttataagaacaaactgtggaattggtcaaaaaacttctcgattacttctccttggcttcatgttcttgttctcaaaccggatgctgtttttctaacagaattttatccatgtttc

SEQ ID NO: 18180 - DNA, 346 bp, Gossypium hirsutum
  Clone ID: uC-gsflnu33B143a10b1
tctgttaaacacaacttaccatctcaaaaacccgaggttttcactgacacaaaacttgtcacattcaccatgactggcacgtgcggaaactgtgactgcactgaccgcattcaatgcacgaagaacggaaacagacgctccatgatcgttgtgactgagaagagctacatcaacaaagttgagatggatgctccagatgagaacgatggcacgtgcaattgcgggactggctgcagatgcacagactgcacctgaggccactaagtcaacatacaatggtcatgcttcagatcatggcatatatagggatctaaatagtgaatttaaggatgaataatgtgtgtct

SEQ ID NO: 18181 - DNA, 471 bp, Gossypium hirsutum
  Clone ID: uC-gsflnu33B143a11b1
tctttcaaggtgtacaagcagtttcagatacacctactgatacagaaacgtttgagattgtaaggaaagatgatgatcgtaaccgagttcgattcatagcatcaaatggtttgttcctacaggcacaatcggagacactggtaactgcagattatgcagagtctagttgggatgatagcgatccatctgtgttcataatgacaatcgtaaacaccatacaaggtgaatttcaaatcactaatggttatggccctgataaagcccctcaagtcatgcaggatcattggaattcttacatcactgaggaagatttcaatttcatgtctgcaaatggactgagtgccgtgaggatacctgatgggtggtggatagcgcaggatccaactccccctaagccttttgttggaggctcttcaatagccctcgacaatgctttcacatgggcagagaaatatgggatggagggaatta

SEQ ID NO: 18182 - DNA, 183 bp, Gossypium hirsutum
  Clone ID: uC-gsflnu33B143a12b1
ttttctttataacttgcgtgaaacccttgattgggtcttgaagaaactgtgaaaccctttgtttcggtcaatgtaacaaacaggtctttggttctaaaatgaaatgctaggttcatgcaggcacaatcggtggcagtggtaactgaaaataattcaaagaataaccgagataataacaaaacg

SEQ ID NO: 18183 - DNA, 543 bp, Gossypium hirsutum
  Clone ID: uC-gsflnu33B143b02b1
cctacgcgtccgaatatactacatggtgatgcagggcttgggagccatatgtggggctggtgtggttaaagggttcatggggaagacaaggtatggtgctttgggtggtggagctaactctgtgaatcatggctacaccaagggagacgggcttggtgctgaaattgttggcacctttgtgcttggttacactgtgttctgagacactgatgccaagcgcagttccagagactctcacgtacctattctggcaccattgccaattggatccgcagtgtatagatggcgcacttagccaccatcccaatcacaggaaccggtattaacccagctcgtagtcttggtgcagccatcattttcaacaaggacaagggctgggatgaccattggatcttctgggtgggtccattcattggagcagcactagcagcactctaccatgttgttgtgatcagagccattcctttcaaatcaaaatgatcaaaataaacggttcatatgatctgaacataatgaaaaattccacttatgcaccctttgagt

SEQ ID NO: 18184 - DNA, 335 bp, Gossypium hirsutum
  unsure (1)..(335): unsure at all n locations
  Clone ID: uC-gsflnu33B143b05b1
tgtgcttttattgttctaccttgaaaaacattggataattttctttgttagttttcagagatggcgaaagtttgcttctctaaagatattttgatcatgcttatggctgttgtactctccgtcgccaccattgtatcagctcaggacagtgcaatggcgcctgcaccgtcaatggacactggatctgccttctcaatgccggctactggtgataccgttacgttgtctcttattatttcccttcttgctcttttgaagtcagtgagttacataatctgagcggttggatgcgtatctgcatagagaaatggngattttacataccctaccgcagc

SEQ ID NO: 18185 - DNA, 450 bp, Gossypium hirsutum
  Clone ID: uC-gsflnu33B143b06b1
gcgcttttcttgtcaaggccagacgacgacatggggaggagacctgcaaggtgttatcgccaaatcaagaacaagccatacccaaaatctcgatattgccgtggtgttccggatcctaagatcagaatttatgatgttgggatgaagaaaaaaggtgttgacgagttccctttctgtgtccatcttgtcagttgggagaaagagaatgtctcaagtgaggcgttggaggctgctcgcattgcctgcaacaagtacatggccaaatttgctggaaaggatgcgttccatttgagggtaagggttcatcccttccatgttctgcggatcaacaagatgctttcatgtgctggtgctgataggcttcagactggaatgaggggttgctttgggaagcctcagggaacatgtgcaagagttgacattggtcaggtcctgctttcaggtcgttgc

SEQ ID NO: 18186 - DNA, 521 bp, Gossypium hirsutum
  Clone ID: uC-gsflnu33B143b08b1
ttcacgcgtccggcaggcagccatggcaaggagcaaggtgcacgagttaaggagcaaatcaaagacagagctgttgactcagctcaaggatttaaaagccgaactttctctccttcgtgttgccaaggtcactggtggtgcccccaataagctctccaagattaaggtggtgaggctatccattgctcaagtattgacggtgatatcccaaaaacagaaggctgctttgagggaagcttatacgaagaagaagtttttgcctcttgatctccgtcccaagaagaccagagctattcgccgtcgtcttaccaagcaccagcaatctttgaaaaccgagcgggagaaaaagaaggagatgtactttccgatgaggaagtatgccattaaggtataagcttgaaatttgacttaagatggatacctttatgttacgttcaaagtgactattcgaggttattggttaagtcttgagttgctgaattttcgttttcttaataacattccctattatggttgagttt

SEQ ID NO: 18187 - DNA, 505 bp, Gossypium hirsutum
  Clone ID: uC-gsflnu33B143b10b1
ttcacgcgtccgcccacgcgtccgtgaacctgttgggcaagtggaaagaatccgaatattcaggtggtcagtttattcccgttggtggtctagcttactatgttactgcccctgcaagcttggcagatatggcagcaaatcccttccatgctctgttttatctagtgttcatgctttctgcctgtgccttgttttcgaaaacttggattgaagtttccggttcttcagccagggatgttgctaagcagctcaaggaacaacaaatggtgatgccaggacatagagattcaaatctacaaaaagaactaaaccgttacataccgaccgcagctgcatttggcggaatgtgcatcggtgcattaactgtcttagccgatttcatgggagcaatcggctcaggtaccggaatattgctagccgtaacaatcatatatcagtatttcgaaactttcgagaaggagagagccagtgaactccgctttttcggtctctaagttttgataaa

SEQ ID NO: 18188 - DNA, 358 bp, Gossypium hirsutum
  Clone ID: uC-gsflnu33B143b11b1
taaagagagagaggagaaaatggagaagcagagcaaatcttatggtgttgttttacctacaatggatgaagatcatgaagaatttgttttcattgatgaagattatgatgttgatgatgatctttcccattgggaattcattgattcctctgttaccgattctgatgatgccgatgatgatgtctggtttcatcgtggcgaatcattgagaagaaacgtcatagtcgcaatgcctttaactgtcccgtttactcctataacggaggtgaataagtgcattccgattgctgctcctattcaagatactgttgatcgttgtctattactttgatggatttgatgatcaagatggagatgt

SEQ ID NO: 18189 - DNA, 368 bp, Gossypium hirsutum
  Clone ID: uC-gsflnu33B143b12b1
tttgttagtcgtggacgaagagctcttgaaagggtatgatataaagttgaacagtgcaattttagctgaggagaaacaccttcccatgtatcaagaaatggcatccaagcccaatgtagagtatattgctggaggtgctactcaaaattcaatcaaagttgcacagtggatgcttcaaattcctggtgcaactggttacattggctgcattgggaaggacaagtttggggaggacatgaagaagaactcaaaagctgctggggttaatgttcaatatcttgaggatgaaactgcaccaacaggaacctgtgctgtttgtgttgttggtggagaaaggtcactcattgcaaatctatcagatgctaact

SEQ ID NO: 18190 - DNA, 308 bp, Gossypium hirsutum
  Clone ID: uC-gsflnu33B143c01b1
actgtttgctactctaatacccagataggtgatgaataattttaaactgtttccatgaataaaaacttgatgaaagatgtttcaattttagttaagttcgacaagatacaacatttatgcagtttgagaatggtgggaactgaaaatgtctattgttccaatgttttttttttaaactaatgtggaacattattcttcgtgatatgagtaatcttccccttttattctcatggtggaaaatcaacatgtccggcctaagaacattgtaataaaaaaaaaatgtaggctggaccaaataaaaggctccg

SEQ ID NO: 18191 - DNA, 107 bp, Gossypium hirsutum
  Clone ID: uC-gsflnu33B143c02b1
tctgatgatccagttcgccgtgcagtctaacatagagaatatgaagcattacgccacggatttttcgttggtattttaaggaaaatttggagatgtttaaacgtttt

SEQ ID NO: 18192 - DNA, 311 bp, Gossypium hirsutum
  Clone ID: uC-gsflnu33B143c03b1
tctgttttttccttcttcctaagccttacggtttctgtttgcggatgagatttatactccgatgtctttccttccgaggattctgtcctcagatctgctcgcatcggttcaacatatcctctttgatttctgatgttgcactgcgaaaggagtagcggtcgtgggatctatggtttaaagggccttggctgggcacggaagcaaagatgggaaggattcatgatctggttgttttttaaggatggtctaacaaggggctggaattaatccgtttttaaaaggcaagtggaaaataaccagggcattgaatg

SEQ ID NO: 18193 - DNA, 432 bp, Gossypium hirsutum
  Clone ID: uC-gsflnu33B143c04b1
ttcattcggtccatcaccagctaggggaccatctggggcttatatgggcgatgatgtggacgagcctacactcaggattacggtggtgaaactgagcgcgtacttgagcggccggaacatgccgcggatcgtgacgggcacggcggtggatacatttgacgaaactgctgaggaagaggcgatgctggaggctatcatggagggttaccgtgactgcgacggtgaatcgctctacaaatcggtgaagccattgggagaggctatggcagaagctattaagtacgggattatcgcatgtcgcgacgaactttgcatcactctcaagatatggtgcactgaagcgtatactgatgttgatcttgacgctgtcaaaaatgctctcaggatgcttcagatggagtactaggacctttatttgattcactggcctat

SEQ ID NO: 18194 - DNA, 286 bp, Gossypium hirsutum
  Clone ID: uC-gsflnu33B143c05b1
cttacacgtacgatcagactcctatgtacagcgggggtttttgaaaatgaatgggggtgtctacaccatgctagcttgaacacctcatagaaacggtaactccacgaacgaccccagtgctagcccctgcaactagatacaccacggcgagccagcttggctagaatctaaaagagactccggaccttgaggcccacgaacggagagggaataacagaacagtgcagcaccaagaaccaccacactggcaccaggctacacacactagaatgaaccagcagtacga

SEQ ID NO: 18195 - DNA, 91 bp, Gossypium hirsutum
  Clone ID: uC-gsflnu33B143c07b1
ttcacgcgtacggtgggactacggtgttcgggggagattcttgacactgagtgggtatggccacttcacgagagcgtgaacacgtcagaga

SEQ ID NO: 18196 - DNA, 87 bp, Gossypium hirsutum
  Clone ID: uC-gsflnu33B143c08b1
tgtcacgcgtacggtgggactacggtgatcgggggtgatttttgaaacttattgggtatttccactccacgagtgcgtgaacacgtt

SEQ ID NO: 18197 - DNA, 336 bp, Gossypium hirsutum
  Clone ID: uC-gsflnu33B143c11b1
ttctgatacccctcatttcttccacgaaggtgtgtgctactgggacactaccttagaggcctcgagtaccgtctggaactaatggaacttttatccttgacaagcagtatcaacaataacgactgtggagatgaccagtgagcacatcggtgtgagttgctctgattcgaatgcttccatctgtatataatcggtcgatactaacttctttttctgggaaaagaagaaggatttcaattgaacaagatttgacccatcactgtcttacagatggagagtttcttaatgtacaacacttcaaaaaagcaagattattgcactcattttctttttgtt

SEQ ID NO: 18198 - DNA, 483 bp, Gossypium hirsutum
  Clone ID: uC-gsflnu33B143d01b1
atttcgcgctcgtcaccaacctagatcggattagcatacttataaccccgaacgcgtgtataaggacctgaggacacgatgatcaaccgtagtgaagacactcgagagacagcattattaccaaatgcgagtgctgctaacttgagaaccacctggttccagcgcccaaaagacaatcttaggtgatacaaagctccgacggataggagcaatcgttcccggggactctcgtggtgtaaattcgacggatccggctccggaacttgtctcaccggcgattgcgggtcgggtcaagtagaatgcaacggactcggtgctgctccgccggtgactctagctgagttcactcttggaaccaccggtggtcaagatgtttacgacgttagtctcgtcgatggttataatatgccgatgatagttgaaggccgtggcgggacgagctttttgtcttcgacgggtctgacgactgattcgaccgaaaat

SEQ ID NO: 18199 - DNA, 541 bp, Gossypium hirsutum
  Clone ID: uC-gsflnu33B143d02b1
gttactatcccagacagggtcttacttgtaaacacatatcgaaatcacaaattgatgccatggacttactcgcactcatatatcagaatcctatgtcatgacatatgtatcctagctattcctaaggttcatacggggctttgcacgttgtgactcggtcgaatcgaactcgaaagtgtaataaccatattcaatcacattcggccataatatatttagtttctaacatttcaaaacctcaagtaaatataacattaagttaccaataaacatgtccatttgcttctaaacttacctcggacgtcgtaaaacgagacggggctgctagtcgacaacttttattttttctcgatccaaatctgattttctttggttcttgatctaaacatattcaaattaagctcattcaaacatattttcattcaatttaatccaaaaaaacataaatgggaaaattaccattttacccctaacatttacaatttttacaattagtccctattgccaaaacacaaaaacatcaaaattcccacaccaagct

SEQ ID NO: 18200 - DNA, 502 bp, Gossypium hirsutum
  unsure (1)..(502): unsure at all n locations
  Clone ID: uC-gsflnu33B143d03b1
ctctcgcgtccgtggggctgagcatgcaggatgttcttttcctggcaaatgacatgaatgttgcagaatactttgatgcaactctttcaagtggtgctgacgtaaagctagctgccaactggatcatgggtgatattgctgcctatatgaagaacgaaaagctgtccattaatgatatcaaacttacaccacaagagctagccgagctgatagcttccattaaaagtgggacaatcagtggaaagattggaaaagagatactatctgagctgctagccaaaggtggaactgtgaagggactcatagaagagaaggatcttattcagatagctgatcctgttgagatcgngaaaatgatagataaagtgatttctgagaatccaaaacagctagaacaatatcgcggcgggaaaactaagctgcagggcttttttgccggccaagtaatgaaactatcaaaaggcaaagcaaaccctggcctgttgaacaaaatccttttgga

SEQ ID NO: 18201 - DNA, 92 bp, Gossypium hirsutum
  Clone ID: uC-gsflnu33B143d04b1
cttacgcgtacggtcatactatgatgttcaaacggggttctttaaactgatttggggtttctactacacgtgtgcgtgaacaagtgaaatga

SEQ ID NO: 18202 - DNA, 86 bp, Gossypium hirsutum
  Clone ID: uC-gsflnu33B143d06b1
ctacgcgtacggtgggactatggtgatcgaacggggttcttgaaactgattgttggtttctactccatgcgtgcgtgaacacgtga

SEQ ID NO: 18203 - DNA, 94 bp, Gossypium hirsutum
  Clone ID: uC-gsflnu33B143d07b1
tgtcacgcgtacggtgggactacggtgatcgggggtggtttttgaacctgagtgggtatttctacttcatgcgtgggtgaacaactgagagaaa

SEQ ID NO: 18204 - DNA, 91 bp, Gossypium hirsutum
  Clone ID: uC-gsflnu33B143d08b1
ctcacgcgtacggtgggactacggtgatagagcgaggtttttgaaactgaatgcgtatgtccacttcatgagtgcgtgaacaagtgagaga

SEQ ID NO: 18205 - DNA, 105 bp, Gossypium hirsutum
  Clone ID: uC-gsflnu33B143d09b1
gtcacgcgtacgatgttgctatgatattagggggagattcctgaaactgaatgggtatttccactccacgagtgcttgaacactttagagaacgtgatcattgac

SEQ ID NO: 18206 - DNA, 412 bp, Gossypium hirsutum
  Clone ID: uC-gsflnu33B143d10b1
tccacgcgtccgaaagagataagatagagagggaagatgcccgaaactagagttgaggtaccagaaatggtgatgttggagattctgtcaaagcttccagttaaatccttgacacgtttcaggtgcgtatgtaagccttggtgttcatcttttcaaacccctcatttcattaccaaacatcatcaaaacaacctccacaacaacaaccttaatctcctcctcaaacgttgtcagggtaacacccgtgatgacatctactatttctctcaactttcaattgagaaaggccaaaacttttcggcacaacacaacatccacttaccctttttcgaggattgttggtatgctcctgtggtttcaggtccttgtaatggattattgcgtttacatgatgctgataaggtagcccttt

SEQ ID NO: 18207 - DNA, 207 bp, Gossypium hirsutum
  Clone ID: uC-gsflnu33B143e02b1
agtcaccacaaggactgctttctccccctctgtggcggttcaactccacctccagatcggccataacaacgatggcgcctcgacggcgcgctgccgccgatgtgtgcgcgacgtgcgcaggggagagtcatgctgcgacattcgaggaggcgagggtgaggctgcagttgggatgtgctggataaggctggaggctactagggtttt

SEQ ID NO: 18208 - DNA, 548 bp, Gossypium hirsutum
  Clone ID: uC-gsflnu33B143e04b1
tttacgcgtccggacagtggcagttgacatatagtattcacatatcatcaatatataatagtaattcaatcattaacttacaaattctagcatgttcataatatcagagaactcagttaagtgaataaaattgataaaatcaatctggggataatccaaggattaagctgaacaattcacaaaattttgtgcaaaactataaaatagtggccacatggtcgtgtggccaggccatgtaacagactgtggtagtgtggcaaatgtaaaaatcaacctacaggaaggacacgaccatgtggcaggccgtgtggaaggttggttcatgaactagcctagagtttgcagggcacatggacacgtgaagggctgtgtggtccacatgcctatgcgagagactgtgtgaccctattcctacacacgatcaccactgattcacttgggatagaatacacacctttcaccgagagtccaatcgacatttctcgcggccaaatctaatctaatccacctaaataagtcttttaacgataaatttgcacgaattaaca

SEQ ID NO: 18209 - DNA, 90 bp, Gossypium hirsutum
  Clone ID: uC-gsflnu33B143e05b1
ctacgcgtacgatcagactacggtgatcaagggggattcttgaaactgaatatggatttctacttcacgcgtgcgtgaacacgtgaaaga

SEQ ID NO: 18210 - DNA, 80 bp, Gossypium hirsutum
  Clone ID: uC-gsflnu33B143e06b1
cttatgcgtacggtcatactacgttgaacaaagggggttctttaaacttaatatgggtttctacaccacgcgtgcgtgaa

SEQ ID NO: 18211 - DNA, 91 bp, Gossypium hirsutum
  Clone ID: uC-gsflnu33B143e07b1
ttcacacgtacgatcggactcccatgatcgggggtgtttcctgccccttagcggttatttccactccactcgtgcttgaacacgccacaga

SEQ ID NO: 18212 - DNA, 468 bp, Gossypium hirsutum
  Clone ID: uC-gsflnu33B143e08b1
tctacgcgtccgatttacaaatctaattgctgagggtttgtttagcattgcttcttagaaacactttttgggacaaaaaacacttttgagaaaaaaaccattgctagacaagatgctttgagtttttgaaaagcattgctaaactagccctaagtttgatttcatcatccaaatctccaattttaactttcaaacatggtttttccggactcagaaaaagcgagtttaccaactgggcttattacggtaggtttcaatatcccaagtaattcttaaacttgcccttattttcatctctccttcacaatcattttttttttctctcgtacatttatggattaaatgtgaagactctcagaaaagaggtataatacatatacatactgcattgaacatcagctggcctaactagcatttgagaacatggatggtataaggtaatttgatggaacacacacattcactaca

SEQ ID NO: 18213 - DNA, 456 bp, Gossypium hirsutum
  unsure (1)..(456): unsure at all n locations
  Clone ID: uC-gsflnu33B143e09b1
gtcttctccttcgccttgagcgaatatgaataccaagttgctttcagcatgttcatgcaccaatatcaaaagtcctatgatcacctcgaatttgccaagagatacaacatcttcaagagcaatttggactttatcaacgcccacaacaaggcaaacaagaccttcactgttggaatgaacaaatttggagatctctccattaaggaattcagcaaaatctacttgggaactagaatcactaaacaagtcccagctcacgtaagaaagacttccaccagaggacttcctgcatctgttgactggagacaaaagggagctgttactcacgtgaagaaccaaggacaatgtggatcttgctggtctttctctaccactggatctgttgaaggatgccactttctctcaactcanaaactctgttttctctctgaacaaaacttagttgattgctctact

SEQ ID NO: 18214 - DNA, 446 bp, Gossypium hirsutum
  Clone ID: uC-gsflnu33B143e11b1
tcacaatctccgacgccgtctcctgtttcttgggcgaagaaatctccgtcatctactccgacaccgatctcttcacctcctacaatatctgctccgtctccgtcggaggttccgtcagcgactacaccgtctccagcaactgttgagtcacctccatctccttctgctctgtcaccgaatgccagtcccacgtcaatttctgaacctcctgccggagctccgggaccagcggagaatagtgccgttaggtttggtgctgctggatctgttgcggttggagtgttgatggtcgctatggtactgtaggcatatccagatcttccttctcttgatgatagtataaataaaatctagcttatgtatacttcctaggcttattttgcaattttgttttttatataatggcgaatttatacaatctcctatattactgcctatggattatg

SEQ ID NO: 18215 - DNA, 374 bp, Gossypium hirsutum
  Clone ID: uC-gsflnu33B143f03b1
tgtgcctctcccaattttttcttcactttgagggttgagcagatcggatggcaccaaagaaagataaggcccctccaccttcttccaagccagcaaagtctggtggtggcaagcaaaagaagaagaagtggagcaagggaaagcaaaaggagaaggtgaacaacatggtgttgtttgaccaggctacttatgataagcttttatctgaggctcctaaatataagctcatcactccctcaattttgtctgatcgtatgaggattaatggatcccttgctaggaaggctataagggaattgatggcaagaggatcgattcgtttggtgtctgcccattcaagcccagagatttacactagggcaaccaacacctag

SEQ ID NO: 18216 - DNA, 531 bp, Gossypium hirsutum
  Clone ID: uC-gsflnu33B143f04b1
gttatttccattgattttaggggctatggactctcagagcatccatcagaaccagagaaggcaacctttaatgattttgttgatgatgtcgttgccgttctcgactctttgggcatcactaaggcgcatcttgttgccaaggattttggggcctttgtagcagccatggtgggcatacttcaccctgatagagtgtccaccatcattttactaggcgttcctttcctgctaccaggtctctctccactccagtctcaacttcatctcattccaccaggcttttatatgctaagatggatggtgccaggaggagctgaagcagattttggccgctttgacacaaagacggttattcgcaaggtttatattatgttctttggaagtttacccccggttgctgctgataatcaagagataatggaattgatcgactcatttgcacctctcccaggatggttgagcgaggaggatcttgcagaatatggttctttatacgagaaaagtggattccgtacggcactgcaagttcat

SEQ ID NO: 18217 - DNA, 448 bp, Gossypium hirsutum
  Clone ID: uC-gsflnu33B143f05b1
tttacgcgtccggagttagaaaaggaattgaaggagagtatggaaagagaggagcagatgagacaggaattacgaaagatgtgggaaaggctgagggtggcggaagaggcggacgaaaggctctgttcttaggtggggacctgtagcagagtccgacaatcaggcccgtgcttacaacgaccacatactttccctcatggaccagctctccaagggtagcatccttctcatcaacagccacccatcccctgcatgcatctgcatcctctgatttttcttttggctggtgatctttttatctatctaagcgtaggcatggtgcttgataaatccgttaactttgagtatggtatggcatccgacatagtgtgtgttctagatgcttgctttagtagtagaaagttctgcccagaggcagcgtcagatatgcctcagtttggttgctgtt

SEQ ID NO: 18218 - DNA, 460 bp, Gossypium hirsutum
  unsure (1)..(460): unsure at all n locations
  Clone ID: uC-gsflnu33B143f08b1
tcacgcgtccgcttggaaacgcatcgaaaagggagggttttcgctccttacgattatcgagatcgtccttttgaattgaagtatgggaaagaggaaatcaagagcaaagcctgctcctaagaagcggatggataagcttgacactgtgttcagctgccccttttgtaaccatggaaccagtgttgagtgccgccttgatatgaagaacttgattggcgaagcctcttgcagaatatgccagganagctntagcactgttataacaggctttgactgaaccaatagacatatacagtggaatggattgatgaaggtgaacgtggtaccaccttgaagaagaagacgatggggatcaggatgaagggttatgtgcctagaaaacggggtttgacatctgaatgggactagcagtagcgatggatgttttagtacttaccaaggctgaaatatgtaggtttct

SEQ ID NO: 18219 - DNA, 309 bp, Gossypium hirsutum
  Clone ID: uC-gsflnu33B143f10b1
gtcctctgtagccgccgcctgcgtctctctcttcatctctctgaaccaaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgctcggtgctgtcgatggttaccttctggcgaatgattgaaaggaaggggctcatgatgatattggtcttacaagcgcgctcgtttggtgtattgaatgtcttcaggcttattttctt

SEQ ID NO: 18220 - DNA, 67 bp, Gossypium hirsutum
  Clone ID: uC-gsflnu33B143f12b1
caggcaccggtccaaaacccccggcgacccccacgccctcgtatacccccccacacaaaccaaccac

SEQ ID NO: 18221 - DNA, 445 bp, Gossypium hirsutum
  Clone ID: uC-gsflnu33B143g02b1
tgtttgtatcagatcggaaaggcaaaggaagaaaaagagtgaaagatttgggttttgagaaaatcaattcaaaacgactggtttcactcttttttttcctgccttgctgatctttttggggttcttccacaaaaagaaacaaacaattttgggtgatctgtgctgaccaggaactcaaatctggcgacatttctaggaactcaacaaaaatgcattgcatgcaacaagactgtttatctggtggataagtagacggctgataatacggttttttcataaggcttgcttccgttgccaccattgcaagggtaccctcaagcttagcaactacaactcatttgaaggggtgctatactgcaggccacactatgatcaactcttcaagagaactggcagttttgacaagagttttgaaggaacaccctaggttgccaaacctgaaaga

SEQ ID NO: 18222 - DNA, 440 bp, Gossypium hirsutum
  Clone ID: uC-gsflnu33B143g03b1
gcgctttcccctgagcagtacattctaaaagttggtgacggagagctagctcaatgcattagcggattcggagctctcgatgtaccgcctcctggcggaccactctggatcttgtgcgacgtgtctatggttaagttccatacggttgtcgactatggaaacatgcaaattggatttgcagaggctacataaagtaatcacttcaacagtcacacccctttggtatgtataatatgcagtgctaagtattactgttataaaaataagagagcgggatttagtatgtaatgataatttgcatgtaaatatattgttgcttgtggtaggagcttatattaggaaagaattttacttactctatacttataattaatgatgcaactgaattttagctcttatgagagctaaagttacatatttgtatgccccccagggggaca

SEQ ID NO: 18223 - DNA, 361 bp, Gossypium hirsutum
  Clone ID: uC-gsflnu33B143g05b1
tgtaaagagaagcttatctagaaaatgaacttgcgaatatgtgggttctcgttgccaaattaaaaaaatccaatggagttgatacttaaactgtagtttccgaatcaactaaagggaacgactggttcagttcagggcacagtttattcacaaacaataattcggcttcggctttgatttagtatttggtttcagagagtagtgtcctgagaatgttgtgcattgcatgtagaggggccattgtacattccataggagttttttcttattcatcaaatttgttgcatcttttgggttcttttatccattggggcattgtatatgaaaagcttcagtttttgtacatattagctttgaagca

SEQ ID NO: 18224 - DNA, 463 bp, Gossypium hirsutum
  Clone ID: uC-gsflnu33B143g08b1
ttttagcttgagagtggctagtctatggcattcgatgcacgctatctcacagcagctatcgcctaccactggttgttctggaattgagctacttgaagctgatacatttgatctccattgttttcaatctcttaccgggacaaagttctttgtagtttgcgaacctgggacacagcacatggaggctctcttgaaagttgtttatgagctctacacagattatgttttgaagaaccccttctatgagatggagatgcctatacgatgcgaactctttgacatcaacctaacacaggcagtacagaaggatcgtgttgtgcttttggggcgataagctgtcctggaacctttatcttaccaaaatgtcaccatctcttatctttatccgtacacttttgatggaagattgctatcaagttttgatcaacctgtgtattgggatattatcaagctcctttggtta

SEQ ID NO: 18225 - DNA, 468 bp, Gossypium hirsutum
  Clone ID: uC-gsflnu33B143g10b1
ttcacgcgtgcgttcttcttcgtcttcataatgattatttggccgtcctattcggcgacatgctgcgtcagaccacgcttgtcgggcttgccctcgggctcgcctccgagtcgtccgcccaggtgtccagcgattgcgagagcggctggtaccagaccgaatggcccgtctacgcgcctgactgccaacagggcggcacggcgagcctcgacacgacgaccgcgcacagcggcaggaactcgatcagggtggactgcgccggtggctactgcgggcatgccttcttcggcaccaacaacattcccagcggcgatctctatatgcaggtttggatgaacgcgtccaacgccattggtgacttccacgtcacgttcatggtcctgccggaccccgacgagggcaccaacatgcaccttctgatcggcggtatgagcaacatcctgctgtacaaccgcgagtcggacgacg

SEQ ID NO: 18226 - DNA, 520 bp, Gossypium hirsutum
  unsure (1)..(520): unsure at all n locations
  Clone ID: uC-gsflnu33B143g11b1
tgttttcacaaaagaagcagaggtgagtaccccactcccaccagccaaggcttttaaggcctttgctgtagatatcgaaaacctaatgcccaaagttgccccacaaacaatcaagagcgtcgaggtccttgaaggaaatggtggctctggtactatcaggaagatcacctttgctgaagggcatggattaagtcatgcgaaacacaaggttgatgtattagacaaagacaacttggtgtacgcttacactgtgatggaaagcgatttttttaacaagaagatcgagaaaatcagttacgacatcaagtttgttgcagcagctgatggagggtcaactgttaaggtaaatgccacgttttacaccgccggtgacactgaggtcactcccgacttaatggcccagatcaaggaagcttccgagaagcgagcccttgntatgaaggctattgaaagttatgtcttggcaatcccgatgcctaaaactatgctttatggcgttaatgtttggatatttcatatg

SEQ ID NO: 18227 - DNA, 496 bp, Gossypium hirsutum
  Clone ID: uC-gsflnu33B143g12b1
ttcacgcgtccgaaaaaataaagaaaaaaaaagtgaaatttagctaacaccaaacattacaagttaaagaaaattagtgactaatagattccataatgatggttatagggagtatttgggagtattatccgtagcaacgttcatttagcatgtacgagaatgaaaggccctttttatgtgcctatgttcaagccctttggggtagtctttgcaacagttttcggaacctctttctttacaaacagtcttcattatggaaggtaattaaaatctttctcccttttctcttacctttcaaatctttatatcgttgttgacacaaaaaggttgtacagtgtgataggtacaataatagtaggaacgggatattatgctgtgatgtttggacaaatcagggaagaggaacttcgtaaagagcgtgaagttggaacagtgagtgatatttcagaccttaaggtccctctgttgcaggaaaaccaagatgcccaagtttaga

SEQ ID NO: 18228 - DNA, 470 bp, Gossypium hirsutum
  Clone ID: uC-gsflnu33B143h02b1
ttctttcctcctacttgcatgggtcactgcttggagaaaggtttaaaccatgcaggtgggtataaatgtgcacctgagaatgttaaggttgggtccttacagatgtatatgaagaatgccgggagtggtgaggatgtatgtccaggaggtttccctgtggaggaagcgcacaagctcagcgtgcttcatataagaatggcaaatgccgaccgatgcgccgtgaatatctttgatggtaaaggggaaaatgaccaaactgtgcttattccaattgatcatggctactgcttcgctgagaatttccaggatctcacatttgattggatatatggccacaatcacgacagccttactccatagagacttttgactatataaaatcacttgaagctgaacaagatgttgcactattgagatttacgggtgggtgatcccgctagtgcgcttgacgctttgatcttgccatgctt

SEQ ID NO: 18229 - DNA, 519 bp, Gossypium hirsutum
  Clone ID: uC-gsflnu33B143h03b1
ttcttgcgtccgcagaagaagaaaaacatctacaggcagattgaaattagagtaattgagaaaaacgcaatggctcaaaagatgttgatgatggcggtccttgtgatattggggacgaagatagcgacatttacggctgcggatccgacttgtttgcagagcttgatgtcttgtgctccttacttcaacaacgccactctccaactgaaaggcgattgctgtaaccctctcagacaagccagtcgcttctggacttacttggctttggaggcttattaattaccctactttggttaagtcttttcaacatcaacatcccaatccttgcagttctaaggatcactcgtggctgcggtgtcactgataagatgaacggctgcatccccgctactctcacccctgctccttccccatcagctacttctcccaaggcttgttcactcatcaccaggaggtgaaagtggaggtgtccacaagataacttcgaccagaatcatcactttgttgtttttttttttt

SEQ ID NO: 18230 - DNA, 564 bp, Gossypium hirsutum
  unsure (1)..(564): unsure at all n locations
  Clone ID: uC-gsflnu33B143h04b1
ttcttctcttatttgaactcaaagtcccagctagtgttagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaatgaaattctacactataggcgataatgttatcactgaagacgaaatcaaggctctcattaaagnggagtggggagtttacaagcctgttgaagcttacctcttggctaatcccgaagcctgcaactaggatataagttgcttaatttgaattcttatgcttgctttta

SEQ ID NO: 18231 - DNA, 450 bp, Gossypium hirsutum
  Clone ID: uC-gsflnu33B143h05b1
ctacgcgtccggaaattgaaagaagttcccggggacttcaagccgatgctttctgtggggtttgtgaagaaatctattcagaggggtttagacaattaccatgctaagtacattgagactgattccatcgaacctctttaccatatctgtttcggtgggatgatcttttcttatctcgtcgctcttcccaatgagcgtcgtcacctcgagcacaagcggcatgccgagcaacatggtcatcattaatcccattcagcttaaagatgggccgggttgggcttttctcgggttatggggtgaccatttggttgttattattttgtgaacattgtaggcaggatgatactgtcttgatcaatgcattgcagcattaagtaagaaaataaagatatcttttttgcttgtttttattaagctagaaaattaaggtatccttctgcttgtttttcc

SEQ ID NO: 18232 - DNA, 210 bp, Gossypium hirsutum
  Clone ID: uC-gsflnu33B143h06b1
tgtggccgaataaaatgtttgtttactcagtttctgttccaagagacgagtttgttaatgtgcaggtgagtaatggtgcaatggtactggtttgtaacgatcgatccattgcatttttcttttagcataagccaggttgccttctcttgatgttggtcatgggcttggtggatgtagggatggatgtaatatatgtatgtcaggatggtg

SEQ ID NO: 18233 - DNA, 465 bp, Gossypium hirsutum
  Clone ID: uC-gsflnu33B143h07b1
tttacgcgtccgcccacgcgtccgccaaatgtgaaatccttcattgcttcatctgtccttgttctattcttagcaatctcttttagttttagcagaacaaactactacaaaatcttcaacctcaaatcaagtctcgcttcttaccaccctacattccttcaatctgttttctcatttatgctaaaaaccccaaaacccaacaaatcccattggccaaatcccatttccaggccccctcactgtgttctatggatggctcccttcctttcaggtggggggtatagttcagaagcatggtcttatgttttagcactcgatgaatacatgaaaagtcgagaaaacccgagttttaaattgggtattcaccaacatggtgatttggagtcactagagttttgggaggggattgcctaaaatgcaagggatttggcaattgaattgcaccgaaccgattgcagaataaat

SEQ ID NO: 18234 - DNA, 500 bp, Gossypium hirsutum
  unsure (1)..(500): unsure at all n locations
  Clone ID: uC-gsflnu33B143h08b1
ttcacgcgtccggtttcggcaacacgaaagcttgcgagagagagaaaaaatggatccacagctaactgaagtgtcgcagatgttcgagcgattcaaagctgcattcattagaaaagatttcgattcatgcgccaatctcctttctcaactcaaggttttgctgacaaagtttaggagccttcctccgctatttgaaaacacccctaattcggttaacgaagtgctcttagcaagggaaatttacgaacatgctgttgtcctcagtgttaagattgaggatcaagatgcctttgagagggactttttccagttgaagccctattatacggatgctggtagccgtcttccaccatcccagcaagagtacctgattctaggtcttaatctcttgagacttcttgtccagaacagaattgctgagtttcataccgaactggaactgctttcggncactgccctggagaatccttgcatcaagcatgctgtggagcttgagcaat

SEQ ID NO: 18235 - DNA, 246 bp, Gossypium hirsutum
  Clone ID: uC-gsflnu33B143h12b1
tttggctatacatatgttggaaaagcggcaaagggtggaatcacttcattgctcattgaaccaattgcactttgaaattatgttaatttttcctctccaagcttgtttcttaagaaatagttattaagttctaattaataatgttttataatattcatatattataaaagaaagtccaaatcgattgtctttgtacttattgccttatattaattcaataaggttctttccaaacttttcattgtg

SEQ ID NO: 18236 - DNA, 438 bp, Gossypium hirsutum
  Clone ID: uC-gsflnu33B144a01b1
cccacgcgtccgctacctgcgaattctgcgttcactgctgtgaccgctctgacattttcatgcactcacactctccgaccggagacaggaaaaaaaacatggagcaaccgctgacgtctcgaaggacccgtaaatctcaagcgaaatccgagctatactctacctttgtcattcattccggttctgaatccgattccgattctggcaaatctaaaccgaaaccgcaaccatctcgtgacccggacctttacgccacaatggtttacaaagacgttgacgaagaaggtgaagatggatcttccatccctcctcccttcaaatgtgcgccgaaactctttggcggcggagggggcactccttccgacgccgaagatggcagtggcgatgcaggagatttgggaaccatgatcgggaaaagggatcatgttcgtgaagctc

SEQ ID NO: 18237 - DNA, 483 bp, Gossypium hirsutum
  Clone ID: uC-gsflnu33B144a02b1
atcttagtatagggaggaatacccagataggatgatgctgactttctcagtcttcccatctcctaaggtctctgatacagttgtggagccttacaatgccactttgtctgttcaccaattggttgaaaatgctgatgagtgtatggttctggacaatgaggccttgtatgacatctgtttccgcacacttaagctaaccactcccagctttggtgatttgaaccatttgatatctgcaacaatgtctggagttacatgctgcttgcgattccctggtcagctcaactccgatctcaggaaacttgccgtgaatctcatcccctttcctcgtcttcactttttcatggtgggttttgctccactcacttctagggggtctcaacagtaccgagctctaacagtacctgagctcacccagcaaatgtgggacgcaaagacatgatgtgtgctgctgatccttcgtacgggcgatacttgactgca

SEQ ID NO: 18238 - DNA, 221 bp, Gossypium hirsutum
  Clone ID: uC-gsflnu33B144a04b1
cattatgttttagatgagatagaagaagacccaaccgggggaaagataaaatgggaacagggaaggctcaatggagctcctaacaaggttgaggatattcgttagttacatattgtacttgtggcaacttgcttgcataaggcatatatgataccaggtggtggagcgtgcgttctatatggttcagtgataccttagattagcttagtaagcacacattc

SEQ ID NO: 18239 - DNA, 417 bp, Gossypium hirsutum
  Clone ID: uC-gsflnu33B144a05b1
cccttgctttcggaaagctgaagaggccagtagcgcgggtccagccccagcagctgagccccatcacgaagaggagtcaaaggaaaagaagggaattttggagaaaatcaaagagaagcttgctggttaccactccaaatcagatgaagaaaaagaaaaggcttgagattcaagttcacataaaaatactgatgggattgtgtgtttcttaaattgttcaaaaattatctgcttttgtgtttgaggttgtatttgctggatatttcatatttaagtttcttctttttccagcatttttagtacacatcataaggaaaaaaaaagtttgctctcggtatgtaagaaatgacatgtttccattctggctttttgtgattcgaacaggatttaatgaatcaattccttgcttctttgttt

SEQ ID NO: 18240 - DNA, 338 bp, Gossypium hirsutum
  Clone ID: uC-gsflnu33B144a06b1
ccctcgcgtccgctcatacttcactctaacattccgtttgaggttttaggaaaacagcagagaaattaaggaatggagaccttcctatttacctcggagtctgtgaacgagggacatcccgacaagctatgtgatcagatctctgatgcagtgctagatgcctgtttggcacaggatcctgagagcaaggtggcttgcgagacctgcagaaagacaaacatggtgagggtgctgggtgagatcactaccaaagccaacgtatactacgagaagatcgtgcgagacacctgacatggcatcccttgacacttaccaagaatgcgttggatgctgacaac

SEQ ID NO: 18241 - DNA, 397 bp, Gossypium hirsutum
  Clone ID: uC-gsflnu33B144a07b1
ccctcgcgtccgcccacgcgagcgagcacgcgtgcgcccacgctgagcggttcaattctctcatcccttgttttccttctaagccaaacgaaatctaatcatttttgaaaaatggcaccaaaagctgaaaaaaagccagccgagaagaagcctgcggaggagaagaaagccgtagctgagaaagccccggcagagaagaagcctaaggctgggaaaaagcttcccaaggaaggcggagcggctgccggagacaagaagaagaagagagttaagaagagcgtcgagacctacaagatctacatcttcaaggtcctgaagcaagttcaccctgacatcgggatctctagcaaagctatggggatcatgaacagtttcatcaatgatatcttcgagaagc

SEQ ID NO: 18242 - DNA, 449 bp, Gossypium hirsutum
  Clone ID: uC-gsflnu33B144a08b1
gtttcccgccatggaagtcgactcgcaagagcaactgcagagaaaacaatccacttacctctctttagatgagaatttcgagattcagaaggaagtttacagaggccagcagtacagtcaaatttactttgctcgtcttcacatgatgagaactttgctttactcccttgtgcccaactggaaatcccatctccccgtttgtacagttttagagctcgaagaaggcaaagaatgcatcattgttggtactctttataagcatatgaaactcaaaccttgcattcttgatgaatactctaaggagagatctgttgcccctcttataaaacctcataattttatgcatcaagatgactacttggttttggaagatgaaagcggacgagtgaagcttggcggtacttagcttttacccttagtttatgttacaaggtgttggtgttgcgttg

SEQ ID NO: 18243 - DNA, 521 bp, Gossypium hirsutum
  Clone ID: uC-gsflnu33B144a10b1
ccgtatcctgaaaatgctggacaaagcccaagaaggcccactaagagagagcattcgccaatcatggttcgctggtattggccttggcacatcaacaagcctaacaacttgtacttgggccttagactcttggtatggtggaaaacttatgtcacatggctacatcactgcaaaggctttgcttgaaaccttcatgatcttagtaagcacaggtcgagtaatagccgacgcaggaagcatgacttctgacctcgcgaagggctcagatgcagttggatcagtctttgctatattggatcgatacactagaattgaacccgaagaccctgacggttacaaacccgaaaagatgacaggccatgtagaacttcgcgacatagacttcgcgtaccccgcccgccagatattattatctttaaaggcttctcactcaaaattgaagcaggtaaatcaacagcatttgtaggacaaagcgggtcgggtaagtcaaccatcatcggattaattgagagatttatgat

SEQ ID NO: 18244 - DNA, 455 bp, Gossypium hirsutum
  Clone ID: uC-gsflnu33B144a11b1
cccacgcgtccgtggcaaaggagacagagaacaaaggatttacctttggtttgacccaaccaaagaataccactcctactctgtcctctggaacatgtatcagatagtgttctttgtggacgacataccaatcagagtgttcaaaaactgcaaagatttgggagtgaggttcccattcaaccaaccaatgaagatatactccagcttatggaacgccgatgactgggccacaaggggtggtctcgaaaagaccgactggtccaaagccccattcatagccgcatacaagagcttccacatcgacgggtgcgagtcgtcggtggaagccaagttctgcgccacacagggaaagcggtggtgggaccaaaaggcattcgaggacctcgacgcctatcagtggcgcaaactgcgttgggtccgcaacaagttcactatttacaactattgcagcgata

SEQ ID NO: 18245 - DNA, 489 bp, Gossypium hirsutum
  Clone ID: uC-gsflnu33B144b01b1
ggatgagttacctttttttttctccttttccaccgccggggatctcgatccctatcctcgttttcaaacaagctcaaaaaagatggccaacgctgcatcgggaatggctgtgcatgatgattgcaagttgaagttcttggagctcaagacaaaaagaacccaccgcttcattgttttcaaaatcgaggagaagcaaaagcaagttattgtggagaagcttggtgaaccaaccgaaagctacgaggattttactaaatgtctccccgctgatgaatgtcgatatgctgtgtacgattttgattttctaacggccgagaacgtcccgaagagcagaatctttttcatcgcatggtctcccgacacgtcaaggatcaggagcaagatgatttacgccagctccaaagacagattcaagcgagaactggacggaattcaggtggaattgcaagcaacagatccaactgagatgggtctcgatgtgttcaaaag

SEQ ID NO: 18246 - DNA, 372 bp, Gossypium hirsutum
  Clone ID: uC-gsflnu33B144b02b1
cggtcgcttgggttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgcttgaaggtactcttttgaagcctaacatggtgacccccggttctgactccccgaaggttgccccagaggttattgctgagtacactgtccgtgccttgcagcgtaccgttcctgctgcagttcccgctattgtgttcttgtctggtgggcaaagtgaggaggaagctaccctta

SEQ ID NO: 18247 - DNA, 484 bp, Gossypium hirsutum
  Clone ID: uC-gsflnu33B144b03b1
ccctcgcttccgatagctaagaaagtcctcactacgtggtgccaatggtgagcttcacccttcaagattctgtgagaaggatctactaaaagctgtggacagggaatatgttttcgcttacatcgacgatccctgcagtgctacctacccgttgatgcaaaagctgaggcaagtacttgttgagaacgcattgacaaatggtgaaaatgagaagaatgcaagcacttcaatcttccaaaagattgcagcttttgaagaagaattaaaggctgttttgccaaaggaggtggagagtgcaagggcatcagttgagaatggaaatgctgcaatccctaacaagatcaaggaatgtagatccttcccgctgtacaaatttgtgagggaagagcttggaactgggctgctaactggagaaaacgttatgtcacctggtgaggagtttgacaaggttttcacagctatgtgccaaggggagatcattgat

SEQ ID NO: 18248 - DNA, 532 bp, Gossypium hirsutum
  Clone ID: uC-gsflnu33B144b04b1
tctttagattttcttccttctatacaagacttcgggtcatccttattcttcttgctttcgtcgctcttttgcctcccgtttttttccacttcaagctccgccgtttgcatcagacgaaattaaggaagtgtggttggctgaacaatcctccccttgtgtgtgctcatggtggtgactcaaccaatgctttcccaaacactatgtctgcatatagtattgctcttcattctcaagtagactgcattgagattgatgtctctcgctcatcagatggagttttgtttgcacttcatgacagggatttgcagcggatatctggtaacagcacttctaaagttgggcactttagatcaaacgagctcaaagaactagatgtctatcatcagtcgggtaattcaaagattcctacaattgaagatgctttgaagttgatatcagcatcagttcggcaggtgattctagatgccaaggtggggcccccatcatatgaaaaggggctggcaaatgatattctttccactgttgagaagat

SEQ ID NO: 18249 - DNA, 478 bp, Gossypium hirsutum
  Clone ID: uC-gsflnu33B144b05b1
gttttctgtgaaaaactcctgaaacagttatcattttttgtgcctaattttttttgggcgtgttctaatatcaatgggttttttctttttctgattgaaatacagctgggttcaactgcaattgggctaaagacgaaagacggtgtcgttttggctgtggagaagcgtattacttcaccattgttggaacccagtagtgttgagaagattatggaaattgatgagcatataggatgtgccatgagtgggttgattgctgatgcacggacccttgttgaacatgcacgagttgaaactcagaaccatagattctcatatggtgagccaatgaccgcggagtctacaactcaagctctttgtgatctggcccttcgattcggtgaaggagatgaagaatccatgtcccggccatttggggtatctcttctcattgctggtcatgatgagaatgggcctagcttatactataccgatcccc

SEQ ID NO: 18250 - DNA, 484 bp, Gossypium hirsutum
  Clone ID: uC-gsflnu33B144b06b1
attttctgtaattctacaagtttcgatcttatcttgattgatgctgcgaatagcaagatggtgtatgaaataactgagcaacaaaaggttggcttgggtcttattggcttcggtatctccttcacatttctaggtgtatctctcttctttgacaggggtctgcttgctttaggaaatattttgtggttagcaggggtcgtaatattgatcggttggtattctactttgcagcttttcagaaaaaactacaagggtactgcttgttttattctggggctctttttcttattcgtgcgttggccaatagttggtataatcttggaaatatatggttgctttgtggttttcagtggcttttggccttcggtcagtgggttcctctgtcacattccggttgttggatgggttatacagtatccggtcacgttcttgaatcgttgagaaggggttaggatcatccgaatacaggatgaagtatgcgatg

SEQ ID NO: 18251 - DNA, 452 bp, Gossypium hirsutum
  Clone ID: uC-gsflnu33B144b07b1
caattaggggcggtgattcatggaaaggagtggacgtgctgatctttaacacgtgggattggtggacccacaccggaagaacccaaccatttgattacatagaagacggtgggaaaacgtggaaagacatgaaccgtatggttgctttttacaaaggattaacaacgtgggctagatgggtgaaccgcaatgtggatcctttgaaaaccaaggtttttttccagggcatttctccaacccattatgagggaaaggattggaacaagccaacagagtcctgctcgggacagacacaaccattcttcgggatgagatacccaggaggcacacccatggcttgggttgttgtgaagaaggtcctgagtaggattaagaaaccggggtttttgctcgacgttaccggactctctcagtaccgaaaagatgcacacccgtcggcatacagaggcatg

SEQ ID NO: 18252 - DNA, 487 bp, Gossypium hirsutum
  unsure (1)..(487): unsure at all n locations
  Clone ID: uC-gsflnu33B144b09b1
gggtattaggatttcaaaggacaggtggttgtggtttaaaagaacaattagcaaaaaccactcttaacaatgtaagatcacaagggcatacttatgtagaacttcgtgaggatggaaagcggttcatattcttctgcactttgtgccttgcaccatgttatagtgattcagtgttgcttgaccatttgaaggggagccttcacactgaaaggttagctgctgctaaggttacattgttaggatcaaatccatggcctttcaatgatggtgtcctgttctttggtgccacgaatggagaagagaaacagttggaagttgtaaatgataaccaaaataggttgttggagttttaaaacagtgataacaatcttgctatagttgaatatgttggtagtcaagctagtttctgtaacaaggaagtgaatggtagagcangggaatctgatctggtgataccaggtgtgctaatcaaggataaaatttctga

SEQ ID NO: 18253 - DNA, 541 bp, Gossypium hirsutum
  Clone ID: uC-gsflnu33B144b10b1
taaataaaggaagatgcttcagaatatttggtggtgaggttgaagttgataaaatgttgcattatttatatatcaacagcactatactaaacacacatatgtgcaaatataaggctgataataatgggatttgtaacatattctatgttggcatttataattttcaggttcattgatgcttttggaagagtcgttgttcaagcatgtcaattgccagacatattgcatttgaaaatttattattccactttacatggagcttattaagagcttgattcatagtgggaaaaccatctgagtgttgaatgtgaattttcacttgcatagctgaaatgagtcgggagaaaatttacttaattaagtgaggatgcatcaattgtttgagggtttaagcttaaatcatttctttgactatgaagttcatagtggatttatctttgggcaaagccccgcagacgtaggacgaggtccgactttgtaacatcttaatagactcttattttcttgtgcatatatgaccacttagaaaaacacattttat

SEQ ID NO: 18254 - DNA, 505 bp, Gossypium hirsutum
  unsure (1)..(505): unsure at all n locations
  Clone ID: uC-gsflnu33B144b12b1
tcgggataacatataatttgggtggcttggtttgatgttaaactcagttatatatatatacatactttattcatagtatgtttatttctttgtgtgtgtgttttgttttaggtttttattctaggaatacacaccttggaagggaggcaatgcatgaatttccggcaggggacaaaaaaacaagagatatggtttaccagtgttttaaaagaagtagaagaagaaccccagaccagggtcatggtaccgaaatccaaacccaagtcaacggtagcatcaacagtggtggaaggtgaaatcatgaaagctttcaaaagctggaactccatcctcaacgtgatgccgataggggagggaagtttggtgaaatggactatggaatntgaaaagcaaaatgatgatgtccctgatcctgtcaagtacggcgaagttttaactaccttggctaagaatgccgatacttaccttcttatgtctaattaagtattaaggacacttcttatat

SEQ ID NO: 18255 - DNA, 103 bp, Gossypium hirsutum
  Clone ID: uC-gsflnu33B144c01b1
attttcctaaaaaaaaaaaaaaaaaaaaaaaaaaggggggaaaaaaaaaaaaaaaggggggataaaaaaaaaaaaaaagggtgggggcggtcgatgtaccggg

SEQ ID NO: 18256 - DNA, 437 bp, Gossypium hirsutum
  Clone ID: uC-gsflnu33B144c03b1
ccctcgcgtccgatggggttttcaattaacaactcagtgacccaatcccacactcgtacccacaaaaccttccttatagccagctatttcctcttgggaacagcctccggttgtatcttcctcactctctccctacgtttactcccttccttatgtggtttcttcttcatccttctccacgccatcaccatagccggtgccgtcaccggttgttccgtcgccgtttctgggtcaaacagattctacgcagctcacatggtggttatggtgttaacatcgatatttcaaggatccgtttcggttttgatcttgacccgaagtagtgatttcttggggtacttgaaatcttatgttagggaagatgatgggatcgtgatattgaagcttgttggtgggctttgtgtgacggttttttgtttggaatggatggtattagg

SEQ ID NO: 18257 - DNA, 511 bp, Gossypium hirsutum
  Clone ID: uC-gsflnu33B144c04b1
gattaacttccctcccgatttgtgctctattaggggttgaaaagaaaccgatcgtcaccgtcatgcacaataccaccgagggcggtggttgaggccgtgcgaagggattttttgactctggcttagggcacccgaagatggtgctttacttggctcgagaactcgagagaataaacctcctttttccttttgggaatcggtctcaacgacaaaacaggggctccgacgaccgacaaccggctccgggtttccaggtccatggagggtcaacgggggtgaaaaccggccattttggtgcaaggaagcaaccatcgggcatcgtgcgtgccgagggcgcacatgggaggggggtacggcgcaagtgtgagctagggttttcattttcctaaacatgagtttaggtcttgggctaacgggcctaatctgtaaagggggtaagtggttaggttaatggtttataattgggttaaaactttttgtaagtggactgatattttttgggtttttattt

SEQ ID NO: 18258 - DNA, 420 bp, Gossypium hirsutum
  Clone ID: uC-gsflnu33B144c05b1
atttgcctcttgaaccatacatgatgcctccccgaaaagtgcgagaaatgaggcctcgtataagaagagctttgattcgagctcaaaagaaggctgaggagcaagaacaaggtgggagccaaagaaaaggcagaaagagggaggccaaaacagaagtggcagcatgaaaagtgatttgtgttcagtatggaagaaccgcaagtgcgggtgtagatcactttaattagaataatagtgtcttaaagtttagcaaagtttctttatagctcaaacatagcatttactgttttgctttttgaggtactaatagttaggtgcagcaaaagacgtggcctttgcctgcatttattggctgcatccctctggttccccaaagtctgaactcctttaaacataaattaaactatttcttcgtttagt

SEQ ID NO: 18259 - DNA, 495 bp, Gossypium hirsutum
  Clone ID: uC-gsflnu33B144c06b1
ccctcgctttcgcggacgcgtgggcgacccacgcgtgcgagtggctttaattcttgagcacaagtatgagcagcttcagcaaatgtctgacgatcccatgaattaaagtgttccaggtatttcgagaagtcactgctgtatgtaaaacgcttcagccgttataaaaatccagattctgttaggcaagttcgagaaattttgagtagatatcagttagctgaattcgagctttgtgttcttggcaacctgtgttctgaaactgtggaggaagcaatcgctatggtgcctttcatcaagactaaaggacgggcttacgacgaccatgccatcgagagaatgctaaatgacttgtcccttattaagaaatttgaatagtggccgctaaattactggctgtttatgacactgaaaacatttatagaatgttgaatggccctttcttttaaaatatacatttctatctattttaccatgtgcccaaaaatcttaagagtg

SEQ ID NO: 18260 - DNA, 445 bp, Gossypium hirsutum
  Clone ID: uC-gsflnu33B144c08b1
ccttcaacctaaattcttaaactaaaagctaagtgctaagtttgaagccccttcttcctttttgtacatccaagccaagtctccagcaataacccaagccaaaccaaagagagcttatctctgcggaactctcctgtaattttcaccttcttatttatacagaggtgattgctcattgattagatatatcaatcagaaaacaaatgaacggtggtgatgcttacggtatgatggaggcgcaatacatttggagacaccacaggcacgacatcagagacgaccagtgctcctctgctcttgtcaaacatgtcaaagctcctgttaacctcgtatggtcattggtaaggcggtttgatcagccgcaaaagtataagccgttcgtaagccggtgcatcatgaaaggggaccttggaatcggtagcgtcagagaagtcaacgttaaatc

SEQ ID NO: 18261 - DNA, 436 bp, Gossypium hirsutum
  Clone ID: uC-gsflnu33B144c09b1
gcctaaccctagcccattatcttaatttctcccttgagaaaaagaaaaaatctctccacccttccattgctcttcttctccaccgccatgtctcacttcggaagttcagggccgcccgacattagcgatacttactctcttctcatcctcaacatcacctttcgcaccactgctgatgatttgtttccgcttttcgacaagtacggcaaggtggtcgacatcttcattcccaaagatcgaaggaccggtgattctcgaggttttgcatttgttcgctacaagtatgcggatgaggcacaaaaagctgtggataggctcgatgggagagtcgttgatggtcgggaaataacagttcagtttgcaaaatacgggcctaatgcagagaggattcacaaaggaaggatagttgaatcagcaccaagatcagggcacaggt

SEQ ID NO: 18262 - DNA, 374 bp, Gossypium hirsutum
  Clone ID: uC-gsflnu33B144c10b1
tccagccaaggccgaatgacgatgttgagcatgttgacttttaccaattttaacagatctgacaagatcattgaagctcagatggttgtagtagaaaacttttaagtgtatcacgtatgctgtactctaccctgatgtgtgtatgaaaagggaaaaagacaaaaagttgtgttatttgtgaaagaaaccctggtttgtgatcaaaattgtgtttgtgtctatgcaattttctcatattgaagattaaatttctttttgttcttggaatgacttaaattccctgatgagttgtggtttataaggatgcaaatccaaacatgtatgaatttgcagaaattccaaggttcaccttggaacaggaactgctttgcttg

SEQ ID NO: 18263 - DNA, 487 bp, Gossypium hirsutum
  Clone ID: uC-gsflnu33B144d01b1
cccacgcgtccgcccacgcgtccgcccacgcgtccgcgttaccattgttgacacttcctcaagcatggagagcagaataaagcttattgatgagttgaagcgagctgatgccgtggttttaacatatgcttgtgatcagcctatgacactcagtcgtctgagtagcttctggcttcccgagcttcgtaaattagagatcaaggcgccagtgattgttgttgggtgtaaacttgatttacgagatgaacgtcagcccatgaacttggaacaggtcatggcacccatcatgcagcagttcagggagatcgagacctgtatagaatgttcctctgctactctaattcaggtccctgatgtattctattatgctcaaaaggcagttttgcatccaacagctccactatttgatcaagagaaacaaactcttgaacctcgatgtattagggcttttgaacggatatttatgctttgtgaccatgatatggat

SEQ ID NO: 18264 - DNA, 451 bp, Gossypium hirsutum
  Clone ID: uC-gsflnu33B144d02b1
ccctcgcttccgggagaagacaaatggagaagaggagtgaaaaagatcgattaaatctatatactcattgtttgcttcttccctttgatcttcctaccttgattttctcatctaccacattggttgaggacttttaatcgtctttctaagaaatggttctggacggaattgtatcatctccccttcgaaggtcagcatcaacgaggaggcaatcctcgagagatgaattcggtagctggtcaacacttgttgagaggcataggttcctcttaacagcattgggattgttggcattcctctgtactatctacctttattttgctgttactttaggagccacggatacatgttctgggttgaaaggaacagagaaagcaacatgtaatctgcagcatgtaagcttcactctctcccatgggaaactcaaattcctgtgacattcttcatgcta

SEQ ID NO: 18265 - DNA, 423 bp, Gossypium hirsutum
  Clone ID: uC-gsflnu33B144d03b1
aaggttttatatcggttttagcgtaaacagtacgagttgcgatggctcgagttgactcaggccgaggtgtactcacctcggtcgttacaagtatggagagcgcttttgaactggttggcttttttctatcagatctttgctcaaatcatcagagccgtcggtcaatatcctttgctttcttcttcttcgtcgtcgtcgatcacttcgacttcaacgcaccgttttaagcccttgcctgttgctgactctactcgaaccgagtctcgcgctacggtcgagatcgctgccgttttggactcacctgatgaagaccgcatcgaaaaactcagggtagttcttgacttggatgaaactctagtatgtgcatacgagacatctagtctgcctcctttccttcgtaatcaagcaatggatgctggatta

SEQ ID NO: 18266 - DNA, 486 bp, Gossypium hirsutum
  Clone ID: uC-gsflnu33B144d04b1
ccctcgcgtccgcggaagagcttcctttttttttgggtggccttttccaccgccgtggatctcgatccttatcctcgttttcaaacaagctcgaaaaagatggccaacgctgcatcgggaatggctgtgcatgatgattgcaagttgaagttcttggagctcaaggcaaaaagaacccaccgcttcattgttttcaaaattgaggagaagcaaaagcaagttattgtggagaagcttggtgaaccaaccgaaagctatgaggattttactaaatgtctccccgctgatgaatgtcgatatgctgtgtacgattttgattttctaacggccgagaacgtaccgaagagcagaatctttttcatagcatggtctcccgacacgtcaaggatcaggagcaagatgatttacgccagctccaaagatagattcaagcgagaactggatggaattaggtggaattgcaagcaacagatccaactgagatgg

SEQ ID NO: 18267 - DNA, 563 bp, Gossypium hirsutum
  Clone ID: uC-gsflnu33B144d05b1
ctctcagttcgcacgctctcatcattttcctccgggaccgtcagtcttcccaaacaccttctttccgagaaaaaaaaagctcaagagagaagaccatggccgatcaacttacggacgatcagatctctgagttcaaggaggctttcagcctctttgacaaggatggcgatggttgcattactaccaaggagctggggactgtgatgcggtcacttggtcagaaccctactgaggcagaactccaagatatgatcaatgaagttgatgctgatggaaatgggaccattgattttcctgaattccttaacctaatggcaaggaagatgaaggatactgattccgaggaagaacttaaagaggctttcagggtgtttgacaaggaccagaatggtttcatatctgctgctgagcttcgccatgtcatgacaaatctcggtgagaagcttacagatgaggaagttgatgagatgatccgtgaagctgatgttgatggtgatgggcagatcaactatgaggagttccgccaaagtcatgatggccaagtaaggataaaaaatgggtaa

SEQ ID NO: 18268 - DNA, 542 bp, Gossypium hirsutum
  Clone ID: uC-gsflnu33B144d06b1
aattatttcaagtagaatttctctcttgaatcactcgaagaatctacggattttgtcacacgaatcaagattttttcctgattctttatattcgagttacaagttctttaaagcttcttttgggtgtggcaacaatggtctgatgccaagatgtgaatttagcacaaagcctctaacgaggtcttttgatttccttccttatggttctcgatgtttagtgagattatcttcctttagcagtcagcgccaatgtgcttctcatgtgtcccatgcttccactgagaggaaatccaaaaagactcttttgtatcttactgcattagtgtttgcaatggtgggaagtagttacgctgctgtcccattataccaaagattctgccaggctactgggtatggtggtactgtccaacgccgtgagagtgttgaagaaaagattgctcggcatgaaaaagatgggacagtagcaacatgggagatagtagtgcaattcaatgctgatgtggcggatggaatgcccctgaaattttgttccaactcaaaga

SEQ ID NO: 18269 - DNA, 551 bp, Gossypium hirsutum
  Clone ID: uC-gsflnu33B144d07b1
tgtttgcaatggttattctgtttgctcatatctgttatacagtacttgctgtgagcccaattctctcggtcctcctatcgtccttcactggatttggtattgcaattagtacaaattcagttcttgtggaatacctcagatggagaataagaagacaaacacaaccacgacaacagcaaattaacggaaccttgcagcaatgaccagctaaggcgtcccaccctacatgcagaactgaccagcaaaggcggcaaccagaagactgccgccagtatattgatagtcgtgatattacattcagtggcagtaagaaaccattacaattcatttttgtcttaattttcagtttgcatatgctacttgacatttaggcaaaaaactttgaagtgcactttgagtttaggtgcttgagcttgaaagttgatcagatgtgaagacatgagaagcagctctttggtccgtaaaagtaccattagccccttgttctaagattagattgcattttgcccattctactcaaaaattgaaaaattaatttatgtccaattatt

SEQ ID NO: 18270 - DNA, 452 bp, Gossypium hirsutum
  unsure (1)..(452): unsure at all n locations
  Clone ID: uC-gsflnu33B144d09b1
aagtaacagggagagagctcatgaagtatatgtgcgtgtgaagacagaggttgagaaatgcatagcctacttgaaggaaaaaagagaagaagatccctacaggaatttaatgactcggttggtgtaccaggccatgcatggcttcaaagctccagtcccgacatttgagctttgatgcacagtatatataaaggttcatattgggttttctccttacaaggtttggcaataaaagctgcattgttacatgtcaagaaaacacagtatatataagctatagacaatatcaaagaaaggaatggtctacttttccttgcttttgtggggatgggtgactttttgttatacctattcactattggctntgattaactcaattgattatataataattgatatattatgtgtccttaaaggtgtatgtatattaatatttggaatataatatgtat

SEQ ID NO: 18271 - DNA, 436 bp, Gossypium hirsutum
  Clone ID: uC-gsflnu33B144d11b1
ccctcgcgtccgtttgattttgatttgagagagaagcgaagaaggaatggagaagcctaggcaaatctcagcaatggaggcattcgagaaattggagaaggtgggagagggaacctacggaaaggtatacagagcaagagagagagcgacggggaagatcgtagccttaaagaagactcgtctccacgaggacgatgaaggcgttcctcccaccactctccgcgaggtctccatcttgcgcatgctctctcgggatcctcatgtcgtcagattgatggatgttaaacaaggacaaaacaaagaaggaaagacggttctttacttggtatttgagtacatggatactgatctcaagaaatacatccgctcctttcgccaaactggggagaacattcccgttaacattgtcaagagcttgatgtaccaactgtgcaaa

SEQ ID NO: 18272 - DNA, 469 bp, Gossypium hirsutum
  Clone ID: uC-gsflnu33B144d12b1
tcggctttcaaagatggcaggaatcgcctttggtcgctttgatgattccttcagtttggggactgtcaaggcctaccttgctgagtttatctcaactttggtgtttgttttcgccggcgttggctctgccattgcttacaacaagttgacaactgatgcagccctagatcccgatgggctagtcgccattgctgtttgccatggatttgctctctttgttgcagtggctatcggtgccaacatctcaggtggccatgtcaaccctgcagtcacttttgggttagctcttggtggccaaatcaccatactaactggcatcttttactggattgcccaacttcttggatccattgttgcttgcttcttgctcaaggctgtcactggtggcttgacagttcctatccacggtcttggagctggagttggagctattcaaggagtggtgatggagatcatcatcacatttgca

SEQ ID NO: 18273 - DNA, 400 bp, Gossypium hirsutum
  Clone ID: uC-gsflnu33B144e01b1
attgtttgcctttcatttctttctctattccttggggcttcttcggcagcctctcggcttctgagtaatcgtagataaaaaaggatggggctgacttttgctaagctgtttagtcggctgtttgccaagaaagagatgcgagttcttatggtgggccttgatgctgctggtaagactaccattttgtataagctcaagctcggtgagattgtcactaccattcccaccattggctctaacgtggagaccgcagaatatcagaacattagcttcactgattgggatgttggtggtcaggacaagattctacctttgtggaggcactactttcaaaacactcagggactaagatctggtgttgatagcaatgaccgctaccgagtggttgaagcccgggatc

SEQ ID NO: 18274 - DNA, 480 bp, Gossypium hirsutum
  Clone ID: uC-gsflnu33B144e02b1
cggtcgcttgggcggacgcgtgggcggacgcgtgggcggacgcgtggggcacacgacattttcgtgggcaactggaaaccaaccaagaacgacacagaggaaaaacggggtcctacttttggctccaccatgaacgttctctacggagattacacttgcgggcaaggcgatattgatcccatgaacatcatcatctcccattaccttcattaccttgacttactaggtgtcgggcgagaggaagcagggccacacgaggagctaagctgtgccgagcagaaagcattcaacccaaccccagctccacctgctgccagtgctttctaatctttgggtcagccaatttcattgttaaaatgtagttgtcaatgaagggtaatttaataagagagctgggcaattaggttggtgtaaaatcatggtctatgtcggtgtgagaaaaggggccatcaatttcatgatattatatataggtatata

SEQ ID NO: 18275 - DNA, 469 bp, Gossypium hirsutum
  Clone ID: uC-gsflnu33B144e03b1
gttttcgtcttcctcatatcggcaatccccatcgcttagatcatctctgaggaacgtgccgtgcctgccacccacgttttccactaccatagcaccggctttttccgggagtgcgccaagtgggacgaccaaggccggcgcttcctcgtcagtttcttggaaggcggcgtcggtgaaatcctggttcccgacgattacgcaccgggaccgggggatgtcgtgttgaaagaggtcaccgtggtcaaagattttgacttggccggaaattcttccctcggaatcgccgtcgacaggctcagaaaccggctgcttgtggttgtcgccgacttgctcggcaaccgatacagcggtctcgcggcttatgatttgtcatcgtggaagcggctatttctaacccggctcagtggccctagcgatgaaaaattctttgccgatgacgtcgcaatagatgccgatggtaatgcgtatg

SEQ ID NO: 18276 - DNA, 505 bp, Gossypium hirsutum
  unsure (1)..(505): unsure at all n locations
  Clone ID: uC-gsflnu33B144e05b1
cagttctttccgtatcttatggtcttgaggaatacgctgcgactgttgtgaatgcgattcgggttgtttgtgatcgtaaatcggtcaaacatccgattatttgtagcgaaagtgggagagctattgtttcccatcattcgattttgatattcgaggccatgtctacaactgatacggcaccatcgatgaaccaaattaaccttccttttatcgagctgtccgaggatgctcgtagtgactattggaacatgagtgatgcagtaatgagacatgacaatgagacatgtttgttttatgctgatcaattgaaacaaagatgtgtagaacaatttaaagaagggagtttggggatcgaacagttagctgctgtcgacgggttattcgatttggttacgaaaattattgtcggaactgaacctgtcaggacatacctcgtaaacctttcgatttcacttcgatcccggatttttgagtattgatcaaattttccctatcgtncccattc

SEQ ID NO: 18277 - DNA, 508 bp, Gossypium hirsutum
  Clone ID: uC-gsflnu33B144e06b1
gattataaattactgttatttcgtcccttggtaatggatccgattctttcaactgcggttctttcacttgttattggagctgtgatcgctttcgttttcttcagaagctaccttctcaaacaaagatccgaagtgcagaccattgcgaaaccggatcttcattcagatccgaaaaagcattcaaagcctcctcagcatgtctctagaaagtctcactctaaatctcacgctcatgcccgtgacaaggattcaaataagcgtcatcatccattggacttgaatactcttaaaggtcatgcggattcggtcacaggactctgtttctcccctgatgctcgtaacttggcaacagcttgctctgatggcgtggtgaggatatttaagctggaggatgcttcaagtaaaagtttcaagtttttaagaattaatctgcctgctggaggtcatccatagctgttgcattttctgatgatgcatcttccatagttgtggcttcttaggctatgac

SEQ ID NO: 18278 - DNA, 414 bp, Gossypium hirsutum
  Clone ID: uC-gsflnu33B144e07b1
ccctcgcgtccggaaactttgaagtttttgtgtggagaaaaacaagtgttttttttagattatcctctgcgtagccatggcagctcgtagaatctcttcattacttactcgttcactctctgtttcatcttcatctgtttctactttgttttcatctctagggaaaaacagtggcagaaatggaattgggaaaaggttcagcacagctgcagctcttgaggatctgattgttccaccggttcaaatagcttacactcagaatttaattgatgggaaatttgtagatgccgcatctgggaaaacatttccaacttatgaccctcgtacaggggatgtgattgccaatgttgctgaaggtgatgccgaggatattgaccgagcggttgccgccgctcgcaggcattcgatgaggga

SEQ ID NO: 18279 - DNA, 571 bp, Gossypium hirsutum
  unsure (1)..(571): unsure at all n locations
  Clone ID: uC-gsflnu33B144e08b1
ttcctcgcgtccgcccacgcgtccggcaaaatgtgttatgtggggaaagcaacaaagatcttcatcttcatagttacagcgttggtggtattgggtcttgtcttgggattcgggctgcttcgtcaccataagtcgcactcacacaaatgctccggtggtgactcttgtccttctcctaatttcttccctaaccctatctccacccctaattcgccacccttttcttcttcctcctcctcttacaatcctcctcctcctgccattgggtctaaccagcccacctcccctaactcaccacctacctcaatccctactgctaacccaccaccaccagctgtccaggaccctacttctacacctncgtcgcctgacgctaacccaaatcctccaccacaatctactcctcctcctccttctgcagtgctttcagtgccttcctacaatcagcctacttccgttctggttgcttcaggtcctgtgcatgcttagacctatctggtagttccaattaaaaataaaccgtttttttttttactttcaaattcttgaactaagaaattttttagatggg

SEQ ID NO: 18280 - DNA, 395 bp, Gossypium hirsutum
  Clone ID: uC-gsflnu33B144e09b1
tgtttatcacatagtcgtagacaagcgaggaagtggatgaagagagcagctgatcgtggccatggcaaagctcaatttgaacatggacttgctctattttccgaaggggaattgctgaaagctattgtgtatcttgaacttgctacacgttctggtgaaactgctgcaactcatgtcaaaaatgcagttcttcagcaactctcggcaacttctcgtgaccgtgccctgcttcttactgataattggcgtgctttgccttcctcccgatgagtatacctacactgtttattgaactttctcatctaatcctgtaattgcctgttactttcggttctcttgttaaatgcttgacgagtgacaagaaaattattaatatattatggtgttgtctcaaa

SEQ ID NO: 18281 - DNA, 465 bp, Gossypium hirsutum
  Clone ID: uC-gsflnu33B144f04b1
ttttaatatttgttcaaagctttcgattacaaatgcctggcgaaagatgcagatctttgtgaaaactcttactggtaagaccatcaccctcgaggtggaaagctccgacacaattgataatgtcaaggccaagatccaagacaaggaagggatcccccctgaccaacagaggcttatcttcgccgggaaacagcttgaggatggccgtacccttgctgactacaacatccaaaaggagtccaccctccaccttgtccttcgtctcaggggtggcatgcagatcttcgtaaaaacccttactggcaagacaatcacccttgaggttgaaagctctgacacaattgataatgtcaaggctaagatccaggataaagaagggatcccttctgaccaacagaggcttatctttgcccgtaagcaactggaagatggacgcacccttgctgactacaacattcaaaaaga

SEQ ID NO: 18282 - DNA, 497 bp, Gossypium hirsutum
  unsure (1)..(497): unsure at all n locations
  Clone ID: uC-gsflnu33B144f05b1
ggtctgtttaagtccgggaaagagttgaagaagttattagggaaagctagtgggcttaatgattcagatgcagacgaagaagatgatgatgaggatgtggatgatgatatgaactntaatcctacaccagctcctaagcagaaggatgcacctaaagaagaaccagctgacaacagtccgatgaaaccggcaccttcagcttctgctcggggtaccccagctacatctaagtcatcaaagggaaagagaaaaggtgatgatacaaaagcatcaaatggtacccctctgaagaaggttaaatcagaacctgagtcaaaaacttctgtgaaggaggaaaatacagctgcttcgaaaggcagtgcgccttccaagggcacgtcatcctctgcaaaagctggatcaacatcagctgccagtgcatcttcttctaaagcaggttcagcatcaactgctggacctgtaactgaagaagaaataaggctgtgttattacaaaag

SEQ ID NO: 18283 - DNA, 453 bp, Gossypium hirsutum
  Clone ID: uC-gsflnu33B144f07b1
ttcttcgcgtccggtcgagtcatccgagctcaacgtaagggtgctggttccgtcttcaaggcccacacccaccaccgcaagggtcctgctcgtttccgcagcctcgacttcggtgaacgaaatggctacctcaagggtgttgtcaccgatgtcatccacgaccctggtcgtggcgctcctttagcccgtgttgtcttccgtcaccctttccgttacaagaagcagaaggaacttttcgttgccgcagagggtatgtacactggacagttcgtctattgtggtaagaaggctactcttgtggtcggaaatgtattgcctcttagatctatccctgaaggagctgtcgtttgcaacgtcgagcatcatgtcggtgatcgtggggttttcgctagggcttctggtgattacgctattgttattagtcacaaccctgataacgacaccaccaggatc

SEQ ID NO: 18284 - DNA, 401 bp, Gossypium hirsutum
  Clone ID: uC-gsflnu33B144f09b1
tggttgctgcctacttgcttgccgtcttgggagggagcctttccccttctgccgatgatttgaaggatattctcggatctgttggagctgaggctgatgatgataggatagagttgctattgtccgaagtcaaaggcaaagatatcaccgagctaattgcatctggaagggagaagttggcttcagtcccttcaggtgggggtgctgttgctgctgctcctaccgcaggtggcggtggtgccagcgctgcaccagctgctgaggccaagaaagaggagaaggtcgaagagaaggaagagtccgatgatgatatgggtttcagcctcttcgattaagccaagtaatgcagatgtcaaggtttttcttatgccgctagtgcttttatttcaagcggtatatga

SEQ ID NO: 18285 - DNA, 490 bp, Gossypium hirsutum
  Clone ID: uC-gsflnu33B144g01b1
ccctcgcgtccgcccacgcgtccggttaactagcagagcgattttccaaaggatgaagaactatactatctacgcagtttcgatcacgatccgtattgtgttcggatttttgtttatcgctctcatctggaagtttgatttttcgccattcatggttttgatcattgccattcttaatgatggaaccattatgacaatctcaaaggatcgagtcaagccatctcccttgcctgatagctggaaactgaaagaaatttttgccactggaatcgtgcttggaggctacttggcattgatgactgtcatattcttctgggtcatgcatgataccgacttcttctcggacaaattcggtgttcgatctctacgagaacgagaccacgagatgatgggcgctttatacttacaagtgagcattgtgagccaggctctgatcttcgtaactagatcgcgtagctggtcgtacgctgagcgttccggactactattg

SEQ ID NO: 18286 - DNA, 473 bp, Gossypium hirsutum
  unsure (1)..(473): unsure at all n locations
  Clone ID: uC-gsflnu33B144g03b1
cccacgcgtccgcccacgcgtccgccccctccatggtttctcaagctttttaagaatcacacaatttcaaaacagattattgtattcatttttgaatcattctctgaaaacccaaaagaaaaaccttggatttttgttcatattttttgttgccggaaatatgtttggttcaccggagaaaccaatttttaagcgaacttgtagcttgttaagtcagtacttgaaggaaaaaggtagctttggtgatcttactttgggaatcacatgcagtcacaacgttgaaaaagggatgccggagatagtccgtccggcgacggagacgaggacgaccaccatggatttgttccctcaaggagccggtttttctgccgataacggttcgagacgggtcggngtcgatgtggaccctcaaaacgcggcagcgccgatgacgatcttttactgcggacaagtgattgtgttcaatgatttcc

SEQ ID NO: 18287 - DNA, 488 bp, Gossypium hirsutum
  Clone ID: uC-gsflnu33B144g05b1
aaatataaaacaaaccagatgtcttcggtttattcagatccgatccatggaacccacccggaaccaatcgatcacttcgaccgtcttcccgattctcttctccttttagtcttcaacatgatcggcgacgtgaaagcgcttggccgatgctgcgttgtttcgcgtcgtttccactccctcgtccctcaagttgaaaacgtcgtcgttcgtgtcgattgcgtcatctccgacgacgattattccccttcttcctctgtcaaatcacgtgccgacggtccattttccaccctcttccgtctcgttttcggtggcattgtcaagcccctccaagctttgggccaattccttggccccgaacgcccctctctcaacaaaacgctcaatacctcttcatcttcctctttatctgtcggtctcggcggaggtgaagatggggaaagggaccaaggtggggttacccatcattcttcgacgcaagtgcttagaaa

SEQ ID NO: 18288 - DNA, 481 bp, Gossypium hirsutum
  Clone ID: uC-gsflnu33B144g06b1
cggtcgcttgggttcatcgtgatcttgagccttcgaacattttgcgggatgactctggacatctgaaagtcgcagattttggtgttagcaagctgctcacagttaaagaagttaaacctctaacatgtccggtgacatcttgtcgatatgttgccccagaggttttcaaaaattatgactatgataccaaagcggatgtgttttcatttgccctgattctacaggagatgattgaaggctgcccgccatttcttacaaagcaagataacgatgttaccaaggcatatgcatcaaaggagcgtccgcctttcagagccccatctaagtattacgctcatgggctcaaagagttaattgaggattgttggaatgagaaggctgctaagcgaccaacatttagacagataataaaaagactggaatcgatccatgacagtttcagtcataaaagcattggaggtgtggtgcaatctttttaact

SEQ ID NO: 18289 - DNA, 239 bp, Gossypium hirsutum
  Clone ID: uC-gsflnu33B144g08b1
tccttctggtggaagtggtgctggtcctaagagtgaggaagttgactaaatcattgattttcttcacctggtttctctattgttctcttatgttttttgggatttaaactgtttggttttgttgtttggtttctaatcggattgaaatgaacttttatagggtttgttccttttttgggatactctatcagtagcacctgtgattgttgtgttttggaaaacaggtcccttttgaactt

SEQ ID NO: 18290 - DNA, 353 bp, Gossypium hirsutum
  Clone ID: uC-gsflnu33B144g09b1
ttgaatcaccgccgacggatatgtggcctttgctgataatgctgaattgctgaaaggtgcctgtggcaaatctcttgcttcttttcctcaaggctgtttctactccacagcagtaggaggattaagaagctatgagaatcctaagaacaagatcactgcagtgcctgctgaagaagaggagatatggggtgctaaattcaaggtggaagggccaacagttgttgctgccacagagtagtcctttgctttctccttctaaatctatggatccatgggaatataggagctgcaaatgcatagcatatggatcagtctccatgtgaataactgagtcccagtacttgtagaatggg

SEQ ID NO: 18291 - DNA, 441 bp, Gossypium hirsutum
  Clone ID: uC-gsflnu33B144g10b1
tttaataaaattgccatgctattggcatagatgcgaccaaccaatcttatccatcaactagccaaggagctcaacatgctcccaatggtcattacgatgttgcatccaacgacagtgaaagtggcccttccagacagggagtcaagatggaagcttctggagaagtgtcatctacaatcgatgtaaatttcattacttacgaggtttgcagtgatacttccaaaagagaaaatgtgcagcagtgcatgtgcaagcctgcagaggttgtctcagctggttctgaggtttgccatgactaacatgcatgatcagagacacatcaactgcaacagtgtcggatatctgaaaaggtaatatagttactaatatggctcagctgaatgccaaatcttctgagcacatcatattgagttgaccgctattctggatcttaactcattc

SEQ ID NO: 18292 - DNA, 501 bp, Gossypium hirsutum
  Clone ID: uC-gsflnu33B144g11b1
ttggttaggaactttcaatactgctgaagaagctgcgagagcttatgatgctgaggcgcggagaattcgtggtaagaaagcgaaggtgaacttccctaacgagactccgcgtacctctccaaagtgtgcggtcaagacaaattctcagaaaccactttccaagtcgaatttgagccctgttcagctaaatctcaaccagaattacaattacttgagccagcctgagcaggaatacttcgataccatgggtttcgtagaagagaagccactggtcaatcagtttgcatatgtggaccctgttcctacgtctatagatgctggatttaatcaatcagataatgcccccttgtacttcaattcggaccagggaagtaactccataaattgttccgactatggctggggagaacagggtgccagaactcctgaaatatcatccattcttgaagcttctgtagtgggtgaagagtttctcgaggatgctaaccctagcaagagctg

SEQ ID NO: 18293 - DNA, 494 bp, Gossypium hirsutum
  unsure (1)..(494): unsure at all n locations
  Clone ID: uC-gsflnu33B144h01b1
ngattttattataaaaaaaaaaaaaaaaaaaataagagaaaaaatttaaataaaaaaaagccaaataaaaaaaaaacaaaaaaacaaaataaacaaaccctctttaatcctctcttcttttctttctaaggggtcgcccttttttggggttccatttttccctcccctttcttccaccgtctttttttttttttggtgccccttattttaatttctttgcccttctttttccaccgtttttctttgaaaaccccttgctttccccactttattccctttgcaccccttccccttttccccttttgggatttttgcaaagaggcccgcccctttcccctttcccaccttttgcccaccctatttgccttttggcccccccctttttgcggcctttttagcccgtgggttgtggtgtttccccccagtttgcccctttctttgtcctgttccttagccccccctcttttgttttttctcctttcttttttccccct

SEQ ID NO: 18294 - DNA, 530 bp, Gossypium hirsutum
  unsure (1)..(530): unsure at all n locations
  Clone ID: uC-gsflnu33B144h02b1
cccacgcttccgcccacgcgtccgttcactttgagggtggagcagatcgtatggcaccaaagaaagacaaggcccctccaccttcttccaagccagcaaagtctggtggtggcaagcataagaagaagaagtggagcaagggaaagcaaaaggagaaggtgaacaacatggtgttgtttgaccaggctacttatgataagcttttatctgaggctcctaaatataagctcatcactccctcaattttgtctgatcgtatgaggattaatgggtcccttgctaggaaggctataagggaattgatggcaagaggatcgattcgtttggtgtctgcccattcgagccagcagatttacactagggcaaccaacacctagatcctttgttatatttttgcttaaattagntctatgtagtttttgcctttcttgactatctataaatgatttttgcttttgctaaagacctccatctaaattgtgtgagctacagtttctggtggactggtcaatggataagattttgttctc

SEQ ID NO: 18295 - DNA, 486 bp, Gossypium hirsutum
  Clone ID: uC-gsflnu33B144h03b1
cttttccttataatcctgatggaagtataattagtgatgaagttctcttgaagatccttgacatgcccattttggtggttctagatgaagcttacattgagttttcaggaaacgaatctaggatgcagtgggtgaagaagcatgataatttaattgttcttcgaacatttagtaaaagagctggtttagccgggctccgtgttggatatggctcattccctttgagcataattgagtatttgtggagagcaaagcaaccatacaatgtttctgttgctgctgaagttgctgcatgtgctgcattgcagaacccaaagtatctagagttggtgaaagacgctttgatacaagaacgggataggcttttcaaacttctcaaggaaataccatttctgaatccatatccaagctattctaatttcattctatgtgaggtgacatctggaatggatgctaagaaattgaaggatgacctttcaaaaatgg

SEQ ID NO: 18296 - DNA, 462 bp, Gossypium hirsutum
  Clone ID: uC-gsflnu33B144h05b1
ccctcgcttccgcccacgcgtccgacggtctcgatattgcagtcaggcttctcgagccgatcaaggagcagtttcctatcctttcatacgctgacttctatcagcttgctggtgttgttgctgttgagatcaccggtgggcctgaaattccattccatcctggaagagaggacaagcctcacccaccacctgagggtcgtcttcccaatgctactgagggagctgatcacttgaggcaggtgtttagtaatcaaatgggtcttagcgaccaggacattgttgctctttctggtggccacaccctgggaaggtgccacaaggagaggtctggatttgagggaccatggactaccaaccctgttatcttcgacaactcttacttcaaggagctcttgactggagagaaggacggcctgttacagttgccaactgacaaagtttttctttccgaccctgtttttc

SEQ ID NO: 18297 - DNA, 512 bp, Gossypium hirsutum
  unsure (1)..(512): unsure at all n locations
  Clone ID: uC-gsflnu33B144h06b1
gtcttgttcaggttcagctgagggttgttggattgtttgcagataacaaaagatggcggctgcaatgaaactcatctctgttatgggattgattgtgcttattagcctgggaaaggtggttgatgcagcaggggaatgtgggaaatcatctcctgataatgaggcaatgaagctagccccatgtgctgaagctgcacaagatgagaatgcccctgtttcagccagttgctgcgcccaggtgaggaaaatcggccaaagtccgaaatgtctctgtgccgttatgctctctaacactgctaaagcatctggaatcaagcctgagattgcccgaaccatccctaaacgctgcaacatagccaaccgtccagtcggttacaaatgtggagcatatacactntcttgaaaggaaaatttgggagacatanaaagtgctggagctcacttgttgtaccacttaatatgtagctttaagctaccttttgatgaatacagcttaagcatgtttatattat

SEQ ID NO: 18298 - DNA, 356 bp, Gossypium hirsutum
  Clone ID: uC-gsflnu33B144h10b1
ttattgagagattgaaagaggagaattctatatttagtagaaaattgttatgggtatttggagttgtgaaataaaaatggcatggacaaagagattaggttgcagagaatgttgtatgtatagagatgaaaatttcagaaccataattttccaggcttacaatggcagccgccggcgccgctgctactgctgctagtttgtggctttttattgatattattctcttctcttttctttttctgttttactatcatacttttgttttttctttttgggtataatttgatgaacactttacttgtaaaaaataataattgtaagagtattcatataacgctatctgatacataaatatg

SEQ ID NO: 18299 - DNA, 396 bp, Gossypium hirsutum
  Clone ID: uC-gsflnu33B144h11b1
tgcttatgatgatatagacgagtatgactttgtgggattcattttggggcatataccaccttgttctagtgtttgcataggggtcctgtgtttattgcagcagcgatgtagaggcagttccgacggctctttttttttgtcttccaattcatggggaaatttagttgtctggtgaaaacatccataatatggaggatattattgttacatgaaccatgcaaaagtcttctagatggttttgggcagttttggtgttttttacctaaaaaatattcatatgatgttttggcaaaaggttaagaagtgttttcattgtaagagtatacaattaaccctatttgtttgtgcattataagaaccagttgtttcacatgattttaataagattgtttctag

SEQ ID NO: 18300 - DNA, 502 bp, Gossypium hirsutum
  unsure (1)..(502): unsure at all n locations
  Clone ID: uC-gsflnu33B144h12b1
ttcatcactgctctcgcatcaattttgctcggccggaagccttcttataccaacaccatcttgctcgcctttgcattaatggatgtggtatttgtgggaatcgttgcctcagccaccggttccgccggtagcgtcgcatacatcggattaagaggcaacagccacgtccggtgggacaaaatctgcaacgtttacgacgagttctgtcgacatattggaacggcaatcgcattctcgttatttgcggccatcttgttggtgttcctcaccatgttctccaccttcgccctttacaaaaagatccgttgataatttttagaaacacagttcttaattactctcatgtctgaatttggattgcgtgttcatcttttgactatataagtggcangtgttattgtctgtaaatgatggcttagttggattttggtttttttttcttagaattggttgaatggtttttaatatataggaaattggattggttcacatttaattagtt

SEQ ID NO: 18301 - DNA, 417 bp, Gossypium hirsutum
  Clone ID: uC-gsflnu33B145a02b1
cttgcattatagggttcactcatgtgtttgaatccacatttgaaagcacagaggggattgctgagtatatagctcatcctgctcacgtggagtttgcaaatctgtttctccccagcttggacaaggtcattgtatttgactacaaacccaccgttgtacgttgctaagttacaagcatagttctgtctcaatgtagcttttgtcctgttcatgtctgttgttattttgaataaagtttgacgtcttgtactatgaaatgcatccatccctagtgatcaaggcaaaagttggttggttttatcttctttaggttttacatacaataattccttgttgagattgtgttttgatgtattcttgagctgagttgagactaagcaataagaagcttgagtttgagataaacccaattttttg

SEQ ID NO: 18302 - DNA, 335 bp, Gossypium hirsutum
  Clone ID: uC-gsflnu33B145a05b1
ctcacgcgtccgatcgcaattccccagcagcaatggctactccaagtgtagagtattcgcctcctccattggatgctactgcagagcaacctgctatctttgatggaacaatcaggttgtatctggcttatccttgcccttacgcacagcgcgtgtggatcgccaggaattgtaagggtttgcaagacaagattaagttggttcctttgaaccttcaaaatagacctgcttggtacaaggaaaaagtttaccctgaaaacaaggagccgtccttggaacataatggcaaagtcattggggagagtcttgatctgattaaatatgttgatagcaac

SEQ ID NO: 18303 - DNA, 298 bp, Gossypium hirsutum
  Clone ID: uC-gsflnu33B145a06b1
tctttcacgcgtccggccgtggagaagttcgaaggacaactgacatccaatgagaaactgcagttcttcgatggcgaggtatgctcgtagttgacaacttcactcagtaacaaccggaatgcaacagcagcgatcagtctgaaagatccggggctgtgggatgcctggtgcatactcatctgagcatgcagtgaagtgtattggggacaatgccgatactaacttacactgtgactcaatcgccggcatggctgcacttacataggactggacctcggatgaaatttacaaatggcac

SEQ ID NO: 18304 - DNA, 439 bp, Gossypium hirsutum
  Clone ID: uC-gsflnu33B145a08b1
tatagtgttaaatttgatctttctctgccaaaagcaattccaaaaagagagaaaatcccaccaaaaaaatggcgaattctaatgacaacaacaacgacgagcaccatgaatcgagtcctcttttgagcaaacaagtggcagaccaagatttgaaggaaaaacctagtggtaaaaaggcaaaagaagctgccgccgaggtgccagctcatccggtagttgctaccggagatgggtttgggtggacggctgatgggttgccgttggtccaccggagtgtcgtcggagaacccttgggtcgatctcaatggaactcatctctccttgcttgtcttggccgtaacgatgaattttgcagcagcgacattgaagtctgtctccttggaagcttggtcccttgtgtgctatatggaaccaatgtcgaaagacttggatctgatcc

SEQ ID NO: 18305 - DNA, 475 bp, Gossypium hirsutum
  Clone ID: uC-gsflnu33B145a09b1
gtatgctgcaaccgattatgccaccatttcacctgctcttacaaggtgtccttcacttcaaagtactgcaactgctttggcttcgccacaggcacagttgtatcctttccccaggacatcttttagcaaactgcaagctgaactaccaattgcaaggagacactcacttcagcgttttcttgagaagcggcgggacaggctggtgaacaagaacccatatcctggtccatcaacaccaaaaatggttgatggcgccaaagctgacgtgagtgccacaacttcaccagagtctggctgcttcaaggcatcacccattcgtcaagaagatatccaaccaaaagctccagctcatgttgcgtaaagctaagcatataggattccttatatatatatatttgataaaaactgaatctagctctgttattgtaagttacaaagtgcagaggaatacatctgatctgccactggagttagg

SEQ ID NO: 18306 - DNA, 416 bp, Gossypium hirsutum
  Clone ID: uC-gsflnu33B145a10b1
tcggttccacgcgtccgggcacttggatttgaacttattagcgctgagttagttcaattcggtcttcaatgtggatatttattatcttgtggagttgaaccaagtacaggtagtcatttcatgtgcttaacacttaggtctatattttgacaggtaggggatgctttcagttctgcaaatatatgaataaggaccaaaattcactggtggacagaaagctcgctcatattggtgagagggccagactgttggagacagcatattttaactagcctgaatgtgcactagtagctacatatatgatatagcatgtgtattatgaacaggatgaatcactgtttagtcaccaccgtaatgaaactagtatgtagcatgtcgcttaaatttgcatatttacattacattgtctgatatgt

SEQ ID NO: 18307 - DNA, 383 bp, Gossypium hirsutum
  Clone ID: uC-gsflnu33B145a12b1
tcgttcacgcgtccggccgtggagaagttcgaagtacaaatgacatccaatgagaaactgcagttctttgatggcgaggtttcctcggagttgacaacttcactcagcaacaaccggaatccaacagcagcgatcagtctcaaagtccggggttgtgggaggtttggtgcatactcatctcagcatccgttgaagtgttgtgtggacaatgccgacactcacttcaactatgactcagtcaccggattggtgacacttacattgccagtgccatcggaggagatgtacagatggcacgtagaaattcaagtgtaagtttagcttcaagttattttattaggccatcatattaaaagtcataatgtattgagggagattttatg

SEQ ID NO: 18308 - DNA, 489 bp, Gossypium hirsutum
  Clone ID: uC-gsflnu33B145b01b1
tttacgtgtgggcggacgcgtgggcgagaatactccaaccacaaaagagggatactattacagaactatctttgagaagttttttccaaagaatgctgcaaggtcaacagttccaggaggtccaagtgtggcgtgcagtacagcaaaagcagtggaatgggatgcagcatggtcagaaaatcccgacccctccggtcgggctgcactaggtgttcatgcctctgcttatgaggcacaaaaaggaggaattgcgggaaagattgcaatagcataaatactgcatctttatttgatagctgactggcggatttatagacctagttcattgctgaaatgagaaggcatttgtttctttcaaatgctcaaaagtcatatgaatccaaatgtaatgttgtaaggtgcctctcatgtagttaagttcctatctctttcccattcctcccctttttctcccttttggtatttgactagtcagctcttgggttatgc

SEQ ID NO: 18309 - DNA, 267 bp, Gossypium hirsutum
  Clone ID: uC-gsflnu33B145b03b1
ttcacgcttccggaacctgcaacagcttcacacttgggttcaatttttttgatttaattcttctatgcagatggaagctggatggaaggtgtggtgtatatttgcattacacttcacatttacatttacccatatccatttgaacctcaatttgagatgttgaatagaatttggcggatgtcatgggtgaactgcaatttgcaatggaattggaacgttcaccttctcgtcccttgtggtacgagttggtcagtcggttggtagttt

SEQ ID NO: 18310 - DNA, 479 bp, Gossypium hirsutum
  unsure (1)..(479): unsure at all n locations
  Clone ID: uC-gsflnu33B145b04b1
ttctattctgccacctcctatggtgaatccaccaacaccgccgattctaccaccaccatcaccacctattgtgaacccaccaacgcctcctatcgtgaagccaccttcaccgggaacaccgtgtcctccaccaccacctncggcacaacaaacatgccccatagacactctcaagctaggtgcatgtgtggacgtgttgggtggcttagtacacatcggcataggtagcagcgccaaagacacttgctgccctgtactacaagggctgctggatttagacgctgccatttgtctctgtactacgatcaaagccaaccttttgaatatcaatattataatccccatagctcttcaagtcctcatcgactgtggcaaaactccacctccagggttccaatgtccagcacaatgatgaaaaacataaaaaccccatgttttttttttttttcgagtacaaaaattttcatgtcttattatat

SEQ ID NO: 18311 - DNA, 484 bp, Gossypium hirsutum
  Clone ID: uC-gsflnu33B145b05b1
tttacgcgtccgcaaagttgtaactcctgataaagtggaactgatgccaaaagtttttaaacctaatgaagagatcaaagacaacttagtggtagtccttgtccatccctactcgatcctgggtgggcgtcaggctcttttgaaggggattgcttctggattagctgaaaatggtcatagggctgttacttttgatatgaggggagttggagagtccactggaagagcttctcttacaggttttgctgaagtcaaggatgttattgctgtctgcaattgggtttctgaacatcttgattctcacagaatcctgttggtgggttcttctgcaggggcgccaattgcggggtctgcagttgatcaaatcgggcaagttgtggggtacgtaagtttggggtacccttttggcatgatggcctccatcctttttggaagacaccacaaagccatcctccaatcctcaaaacccaaactcttcgtcatg

SEQ ID NO: 18312 - DNA, 377 bp, Gossypium hirsutum
  Clone ID: uC-gsflnu33B145b06b1
acgtttcaatttttttcccaatcctccacccccaccatcgagacccacctcagtgtcctgcagaccccttttcaactgcaaaaacccgcaacaatacctatcaattacctgctcttcactgtcctgtacaccctcttgatctgcatcttctctctcttcgccaccggtttcatgactaacggcgatatccacggcttttatggtcgacccgtgaagatcctatccgctgtcaagtgagctttcacttattactagcccctcgtctccacttgccttgtaacggagctgatcatttctgggatcctttcaattgttgctctgatcttccttggattactgcaactaacccagctgttaggcttcgatgttgattacac

SEQ ID NO: 18313 - DNA, 479 bp, Gossypium hirsutum
  Clone ID: uC-gsflnu33B145b09b1
ggccagacccacgcttccgttcacgcgtccgcacccacagtagaagcaagccctgctacaatatggcgctgtgcttgtgatggaatagcatgccttctctcagtctcagaaacataactcacaggtatatttggactttggtgctcaagtactatgacaacatcatttccagtccaaacaaagctttcatcttccatcataagttgtggatcaacatcagccaatgatagcacaaagaggaataactctagctccataagttgggtgcagatcgcctttttacttctgatgcttctatttgcttatccttgccactaaaccaaggatggcagcttctaaaaataagcttgcctgaccgactggtgaggtgagcgagttttaagccccttacgatcaataccattttagatgctgcccgggaagccagagttgaactgccatactcttgcccagctgtagcttgcttcaaatgtgccggc

SEQ ID NO: 18314 - DNA, 465 bp, Gossypium hirsutum
  Clone ID: uC-gsflnu33B145b12b1
tttacgcgtccggtacgaattctttgggatgtgataatggatgctgttcagtggtctggaaagaaccagcagcagaatgccaattcagctttacgacaggtcaaaacatgggcaaagctgttaaattcgttctgcagcagtggaaaacttgaactggagcttatgtataaggttcatatgcaatgctatgaggatgcaaaattgatgaagctattcccggagattgtgaagtctctctatgaccaggatgttcttgcggaagacacgattctttactggttccgcaaaggattaaacccaaagggcatgcaaaccttcgtgaaagccctggagcccttcgtgaattggctggaggaagccgaaaaagaggaataagcgcgtggataatatagtgttatcaacaatcaagaagttatgataattgacccttgtatcttttgcttggctttattgagctatatgttt

SEQ ID NO: 18315 - DNA, 480 bp, Gossypium hirsutum
  Clone ID: uC-gsflnu33B145c01b1
gttccttcaggcatcaaaaaggacccccccgatcaaatttatcttttctggtttcgctatggcatcgaagcggatcttgaaggaattgaaggatttacaaaaggatcctccaacatcttgcagtgctggtcctgttgctgaagacatgtttcattggcaggcaactatcatgggtccaccagacagtccgtatgctgggggtgttttccaagtgaccattcattttcctccagactatccttttaagccacccaaggtggcatttagaaccaaggtattccaccctaatattaacagcaatggaagcatttgcctagacatcttgaaagagcagtggagtcctgcactaactatttccaaggtattgctatcaatatgttcattgctgaccgatccaaatccggatgatcctttggtgccggagattgcacacatgtacaagacagacaggaacaagtacgagacaactgcaaggagttg

SEQ ID NO: 18316 - DNA, 489 bp, Gossypium hirsutum
  Clone ID: uC-gsflnu33B145c02b1
ttcaacttcactactctcctttcacagttcaataacctaggacttaacacaactgacatggttctcctatccggtggtcacaccatcggcatatcccattgcccggctgtttcgccccgattgtacaattccactggccccggcggaatcgacccaaccatggacagcgagtacgctgaaaacctcaaggccaacaagtgtaaaaccgcgagcgataacaccacaatacttgagatggaccctgggagtcggaaaaccttcgatcttagctactactcactcttgctcaaaagaaggggtcttttccagtccgatgctgctttaaccactgattcaactagcttggctttcatcaaccagctcctttccagccccacacagttcttctttgatgagtttggcaaagctatggagaaaatgggtcggattaatgttaagactggatccgaaggcgagatcaggaagcaatgtgcacttgttaacagctaa

SEQ ID NO: 18317 - DNA, 488 bp, Gossypium hirsutum
  Clone ID: uC-gsflnu33B145c03b1
tttcttaatccagcggcggaaataactactacgctccaccaccacccggtggtgtcattggtggcatgtactaccctccaccaacgtacaaaaactacccaacgccaccaccacccaaccctatcgtcccttacttccctttttactaccatactccgccaccaccgtcagaggcgagaagcttatcatcaacagtccattggctttctatttttatttccatgttgggttttttcctttctttcttttaatattaaaaaaatgtaattaaagaagaaaagatggtgaaaataaatgtagaagatttgcagatctgaagaagccattgcagggatgaaaaaaaaaaaaaagggaactgagaaatttctgaagatatatgaagtaataatatttttctcttccttttttttttaatatttattttcttcttatgatgtagattttatcctttaatttttggttttatgatcatttttgtatctattttc

SEQ ID NO: 18318 - DNA, 324 bp, Gossypium hirsutum
  Clone ID: uC-gsflnu33B145c04b1
gttagtgttgatcaaagaaattaaaaaatgcgatacaggggggcgttgaaagtggctccgcttctgcttcttctgctaatcctttctacatttgcgaatgtcaagaagacaccccatgtgacctagttacagatcggagtcaagcataaccccaaattatgcaagttccaagctcacaaaggtggtcgactcaaagtgcactatcggcggcaactcactgatggaactgtcttcgattcaaggacagaaaggcgtgacccaattgaatatgagctaggtagtggaaaaggattcaaagggtgggtcctaggacaactaggcatg

SEQ ID NO: 18319 - DNA, 404 bp, Gossypium hirsutum
  Clone ID: uC-gsflnu33B145c05b1
attagactgactcaaggaatgggttgacaggaatttgcaacaagaggtctggaatccacaagctaatcaagaaggatatgcactctctgctgtcgaaactttgagaatcattgatgagactttagatgcatttttccagcttgcaataccagcacaaactgcattgctacctgatgtgatagttggcctagacaagtgtcttcagtattatgtgatcaaggcaaaatctggatgtgcttcacgcaatacatatatcccaacaatgcctgctttgaccagatgtgagattggatcaaagttccaaggtgtctggaagaagaaagaaaagtcacaaaatactcaaaaaagaaattcccaggttgcaactatgaatggagataagccatttgggataccacagctgt

SEQ ID NO: 18320 - DNA, 387 bp, Gossypium hirsutum
  Clone ID: uC-gsflnu33B145c06b1
ctatctttgccctttcattgcttccttgcctgccttaaacctccttcaagcatagccatgactactgaaatggtaatggttgatgaagtcccttttactccacaaatcacaactaccaagccactatctcttttgggtcatggaattaccgacattgagattcactttttgcaaatcaagttcacagcaattggggtttaccttgaaccagaagttgtaggacatttgcaacaatggaaggggaagcctgggaacgtgctagctgaagatgatgacttcttcgaggctcttattaatgctccagatgagaagcttcttagagatgtggtgattaaggagatcaaaggttcccaatatggagtgcagctagagagcgctgagagggac

SEQ ID NO: 18321 - DNA, 487 bp, Gossypium hirsutum
  Clone ID: uC-gsflnu33B145c09b1
tcgttaaaattgcaccgcattcaaaaagatcgttgaccgactcattaatataggcgttgtcaaatatgatgtggcctccagtgcagaaatttcgctacccaatcatgattgataatggagtgaatgcaatatatgaagaagtgttgggaaatgttcacatcaatgccatatatcaaaacacaattgaaaagggtatttatagatattcacccttatcaacttgaagatgttctacataattggactacggaggaaattcctatagtttttagagcttactcagagtaatgttcaaaacactcttattgcttttagcctataagtgataagaacaccttagtgaaataggttcatgcctgaacgttattattttagtgaaatacatttttgtgattgggttgaaccaatattttcattctttatgaataattcaagattctttcattcttttggattttctttcaaatcattcattcataatcatact

SEQ ID NO: 18322 - DNA, 366 bp, Gossypium hirsutum
  Clone ID: uC-gsflnu33B145c10b1
ttgacgcgtgggcaagatcacagtgagatggggattgaaccagagtttcctggccgggaccgactcagagttataagaccataaaggtccagatatgctatggacccatcaaccaagtcgaccgagcatggcggaaaaccgtggaccatgttaacaaagacaagacatgccagttcaagatcgtcaagaaaccttacaccaacgttaacgaaacccttgaatggaccatcgaacgagacgtgccgacggcgacgttctttatccgagcctacgctttggactccgactaccacgaggtggcgaacggacaaaacaccgacgccgagaagaaaaccaatctgtttgaaatacaagccatcaccggcc

SEQ ID NO: 18323 - DNA, 384 bp, Gossypium hirsutum
  Clone ID: uC-gsflnu33B145d01b1
tttacgtttaccaccacgtttgttgtgaattctgcaacctttggagtaacttaagaagaaatgggggaaaagagtttaattgccaaggatgtcaccgaattgatcggtaacactccactgctatatctcaacactgttgtagacggatgtgtggctaaaattgctgccaagttggaggcaatggaaccctgctccagtgtcaaggacaggattggatatactatgattgcagatgcataggagaagggtctcattgtaccatgctagagtgtgctgatctagccaactagtggtaatacctgaatatggttagcattcatggcagctgctaagggttacagactcatcattacgatgccttctataatgagtttagaaagaaga

SEQ ID NO: 18324 - DNA, 488 bp, Gossypium hirsutum
  unsure (1)..(488): unsure at all n locations
  Clone ID: uC-gsflnu33B145d02b1
tttcacgtttccgttcagctttttcacaatattcagctcccaccattggagtggattttaagatcaagttcttaacagttggtggaaagagattgaagcttaccatttgggatactgccggccaagaaaggttccgaacattaacaagctcttactatagaggtgcccatgggatcatatttgcttatgatgtaacacggagagaaacgttcacaaatttgtctgatgtttgggccaaagaagtggagctctattctaccaatcaagactgtgtcaagatccttgtcggaaataaaattgatcgtgaatctgaaagggctgtaagtaaagaagaagggattgaacttgcaaaagagcttggatgtacgttcattgaatgcagtgctaaaacaggacaaaacgtccaacaatgctttgaggacctttcactcaagataatggaagttcgtagtcttttgngaaaagggtcgactggtggaaaggacaca

SEQ ID NO: 18325 - DNA, 467 bp, Gossypium hirsutum
  Clone ID: uC-gsflnu33B145d03b1
ttcacgcgtccgctcttattacacagtgagctttttgcagtgttttatttattgattctcttagttctcgttttcatcggagaagaaaagtcaaaaaacaaaaatttcatggctcggaaattctttgtcggtggcaactggaaatgcaatgggacaactgaggaggttaaaaagatcattacaacattgaatgaagctgaagttccttctgaggatgttgtggaggttgttgtgagccctccatttgttttccttacctttgtgaaaagtctgttgcggtctgatttccatgttgctgctcagaactgttgggttcgcaaaggtggtgcttttaccggagaaattagtgctgagatgcttgttaatctgagcattccatgggttatcatcggtcactctgaaagaagggctctcttgaatgagtccaatgagtttgttggagacaaagtagcgtatgcactttctca

SEQ ID NO: 18326 - DNA, 332 bp, Gossypium hirsutum
  Clone ID: uC-gsflnu33B145d04b1
gtcagcctaagtaaattagaatcccaaaaaaggaaaaagtttgaggaaagtacagacgacctctctgaggtttctgcttgagatggattagttatcgtaataagttgcgttttgtgtatgttcttttcggttacatgttataggcttagggaattcgatccttgcttatctcaactgttgaaactgaaatctccaaaagcttaaccacaaaggcagtgtacgttagaaatttattgattcccttattgaaagaagaattttgatggggtcttcttttttatgtacgacacaattacaacaaatgaaatattggtaggtctgcttttcacttt

SEQ ID NO: 18327 - DNA, 399 bp, Gossypium hirsutum
  Clone ID: uC-gsflnu33B145d05b1
ttctcgtttacgagggaagcatctacttttactaatgaagagggatgggcctcacgacggagaaaaaaactgaatggtgattactgggaagagcgagcttctgcagcgtacccttgatggcctgatgctgttctgaggccagtactatgtctggatcatccaggcagggtcaacgaggcgctatgggatgatttgcggggtaacatatgcagaatgctgactgcggaaactgctcaagctatgggatgaacatactgaaaatcgcatgctttctcaaaaaatgacactgaagctgagccactgcgagtcagtgtcgccggactatgggggagcgtcactgtaacaacctaaagagaggatcaaggtgcacaattcttggcccgggtagcaagcggggta

SEQ ID NO: 18328 - DNA, 472 bp, Gossypium hirsutum
  Clone ID: uC-gsflnu33B145d06b1
acgcttggacttgtgcttcaacaagataacgacaacacgggcattgggtcagcttgtcgccaactacaactcattgcaagcattgaatctgttgggaaatccagttcagagcaacattagtgatgaccagctgcgaaaggcagattgtagcttgctccctaagcttacgtacctgaacaagcaacccattaaaccacaaatggcaagggaagtgctcactgatagcgttgccaaagctgctctagggagtggcagttggagctccagaagaaaagcatcaaaaagaacaagccaaggtgcttcaacatccgccagtgtgcataggggcagcgtgggattgaggcataagaacaagaacaagtcgaagagccgaagtcgctatcactcatctgcaaaatcacctgcactggcttcttcatcccgttaagatattttaccagtaacttgcctggacaattcatgggcacttttt

SEQ ID NO: 18329 - DNA, 398 bp, Gossypium hirsutum
  Clone ID: uC-gsflnu33B145d08b1
tcgtttacgcgtccgatccatcatgtatgcgtgcggcgctatcttgaagcgctatcgagggaagatactgggagagcaaatggactttgataccctcttgaagttcatcaatgagctgagtgggcagattgagctagatgcgatcctcagggatgcggaagctttatgtatatgtgcgggtgagaatggagctgcctgcatgccacctggaactgtaccttctttgccagttgacaatggtttattctatagtcagcaagatgatgaagtactgtaaattgattcaccattatgttttagtgtgaaacagattcattgatcttgtatttagctgtttttttaacaaaacattaatgcgaatggattggatgaatcataatataatttctttttcgttc

SEQ ID NO: 18330 - DNA, 462 bp, Gossypium hirsutum
  Clone ID: uC-gsflnu33B145d10b1
ttaagatggcaatttccctcccaaggactgttggttgcctctcatctccaagctcctcggctacgccatcgtcgccgcttccaccaccgtcaaactccctcagatattgaaaattgtgaaccataaaagtgttagagggcttagtcttatagcctttgagcttgaagtagttggttataccattgctttagcgtattgccttcacaacggactacccttttcagcttatggggaattggtatttcttttgatccaagccctaatcttagttgctgttatttactactattcaaaacccgtgggcatcacgacctggatcagggcactgctatattgtgctgtagcaccaacaatcttagctggccaaattgatcctattctttttgaagctctatatgcatcccagcatgcaatatttttctatgccagggtgccacaaattcgggagaacttttctaacaa

SEQ ID NO: 18331 - DNA, 459 bp, Gossypium hirsutum
  Clone ID: uC-gsflnu33B145d11b1
ttcacgcgtccggttttcatctacatttcgcctctgaaattatagtaaagcagagacaatgaaaggaacattgatgttgagttggattctgatcatctgcctctcccaagtagcagtgcggagccaatactactcagataccctaccatatcatcccaagccacctaaggtcaccaatcttcacttctttatgcacgaacatacgggtgttacagctgtcgtgctaacccaagctaacgtcacaagcaataattcatcagtgacatttgccaccctagctgccgttaatgatcccctcaggactggtcctgagcctgactcagaggtgattggaaatgttcagggtatttccctcttagccggatcaaatgcatcgagcacgcagtacatagaatttggatttaataccggtaagtttaacggcagctcttaagcgtattttaaagggagaacagggct

SEQ ID NO: 18332 - DNA, 458 bp, Gossypium hirsutum
  Clone ID: uC-gsflnu33B145d12b1
gttataataataaaaaggaaaataaaatcttgtgctttggatctattggcttataattaattaagaaggaaaattagcaaaagaaaaatggttctctgataaaaattaccgtttgtttcctgagcaaatctcgggaaggaataccctttttttccccctgatgttaactcgatgtgattgtgaagctttctttaaaagaatcctagttaactcgacgcgtttacccagaaagaggtgaagatgtcaactcctgcaaggaagagattgatgagggattttaagaggttgcagcaagatcctcctgcaggaattagtggtgcacctcaagataacaacattatgctttggaatgctgttatatttggacctgatgacaccccatgggatggaggtacgtttaagctgactctttagtttaccgaggattatccaaacaaaccaccaactgttcgttttgt

SEQ ID NO: 18333 - DNA, 502 bp, Gossypium hirsutum
  Clone ID: uC-gsflnu33B145e01b1
ttcacgcgtccggttggcctgagaggcttatctttatgtaccttatcgcttcccatcctccgtagtgcgaagattaagctgcccattcactcatttccaacgagtcgaagcctaaaacctctgttttcccctttcaatcctaccattctcaggggttttccctcgttttgtgcgtctccggacgtcaacgtggaggccaccgccacagctccgccggctacggaggcggaaaattctcagtcggcggacgatataaagaacgcagccaacctcctcgacataagggttggccgaataatcaaagcgtggagacatgaagaagctgattctctatacgtggaagaagtggatgtaggcgagcctgaacccagaatcatctgcagcgggcttgttaaatacatgcctttagatcttcttcaggatgcgaaagtggttgttcttgctaatctgaagccgaggaacatgcgaggtgtgaagtcttgtggaatgctaatggctgctt

SEQ ID NO: 18334 - DNA, 496 bp, Gossypium hirsutum
  Clone ID: uC-gsflnu33B145e03b1
cttggggttaaacctacagcaatgcaaagcaatcagcagccgtgccgtggagctacttacggagcagctatggaggtgtgatatccttttctaaactaatgcatacaaactcctccatacatagatttttcagaacagcctttgcaagtagccagcagctttttcctccagtacttggtccccttttccagggaatacggtcgttctttctttctttcttttttgcaggtttccatcatccgggatgatctgctactactttgtgagcctgacaatgggcgtcggtttcttcatggctgaatttccctgagatgggttctggatttttgcttagcctttgtgcatatttgctttaggcgaaagcttttgcttaatattgtccttatttaaagtaggttttccaatattgggttgtagtttgaggttgctttttgcagttacaaagcgtggtgttgcaagcttttcatgggcttttgccatggcagctatatatagt

SEQ ID NO: 18335 - DNA, 473 bp, Gossypium hirsutum
  Clone ID: uC-gsflnu33B145e04b1
atctaagtgggtatctaggcaatgatatagctaatcatcacttgagtgaatcactgcacctgataagcataggaaccaatgacttcctagagaactactatccttttccaacccgatcttcggtgtaccctgtcgataaatacgagatttttctaataggaattgccaacaatttcatcagggagctttacaatctgggagctcggaagatagcaataagcggccttcctccgatgggatgtttaccgttggaaagaacgacgaatatcatgcacggaagtgcatgtatcgaagagtataacgacgtggctaaagatttcaatcaaaagttgcaggattctgtcacggagctgaaccgggagctcggtggaatccaactcgtgatgtcgaacccctactataagctcttagaaatgatccaaaatccaattctgttcggttagtccttagcaatagttcatagtacttgcata

SEQ ID NO: 18336 - DNA, 401 bp, Gossypium hirsutum
  Clone ID: uC-gsflnu33B145e06b1
acgttcacgtcttccgcccacgcgtccgcatcgttctaacagcgaaggttgtagaagcagctgcgtgagcttcctaagctacctagggtttccttcattcgaaaatgatttacgacgtcaattctcctctcttccgctctttcctcagccagaagggaggctcctccgacaagagaaaaatggaggagcagaagcctaaggaacagagacccaaagcaaatgagaataagcctgtcatgacagagtaacagctgcttttgtttagtatgaatggcaagttggtggatggttgttcttagaactctgatatgttcgagattggaaatgcttgttgatgtattcaaatactatcacaacgatttttcttctttgagatggaatgatattcaactttgtggatg

SEQ ID NO: 18337 - DNA, 491 bp, Gossypium hirsutum
  Clone ID: uC-gsflnu33B145e09b1
atttaaaagaagaaaaaaaggtcacctaaacaaaacaaagtttgcttctttaggaaaggttttttcaaaagcacttgagattttaccatatcatttactatcacaattattttactcgttagggttttttatttaataacaagaggagagggaagaaagaagaaaaaaaccccaaaaaaaagaaagagaaggaaagagaaaaaagagtttttttgttgggtttttagctgttggtttagggttttcaaagatggcgcatgttcaagttcagggacaaagtgggggcgttaacaatggatctggtggagccaataaccagtttgtaacctcgctatatgttggggatttggatccaagtgtgaccgagactcagctttatgagtactttaaccatattggtcagctgcttacggttcggttatgcaccgatttgtcgacccggaggtcccttggttatggttatgtcaactatggcaatccccaagatgctg

SEQ ID NO: 18338 - DNA, 469 bp, Gossypium hirsutum
  Clone ID: uC-gsflnu33B145e11b1
ttacgttctccctctcttcttaggactgctgtatcttagttcttgattaattagccaatcacagcagccatgtctctcctcaatgatctcatcaacctcaacctcagcgacaccactgaaaagatcatagccgaatacatatggatcggtggatctggtatggatctgagaagcaaagcaaggactttgcctggaccagtgacggacccttcaaaactcccgaagtggaactacgatggttccagtaccaatcaagcacctggagatgacagtgaggtcattctttatcctcaagctatattcaaggatccatttagaaaaggaaacaacatcttggtgatgtgcgatgcttacacaccagccggcgaacccattcctaccaacaagagatttaatgcggccaagatctttagccaccctgatgttgttgctgaggagcctaggtatggtattgagcaagagtacactc

SEQ ID NO: 18339 - DNA, 467 bp, Gossypium hirsutum
  unsure (1)..(467): unsure at all n locations
  Clone ID: uC-gsflnu33B145e12b1
tttctttgtacgggtgaatctcaatactcatctccagaaaggaagtacggttcaacactgaagagcaacgaggcaagtctcgccaacattttaatttcatctgttcctcagtgtggcgagggctgcatttggaaagccgatttaataataagctttggagtatggtgcattcatcggatccttgatctttcgctgatggaaagccgacccgagctgtggggaaaatacacttatgatcttaatcgtctccagggtatcatagatccggcattttcgaaacctcgttccccaatgttaccctgcttctgccttcaaatcctggcggactaccagcaaagatcgagtcctccagtttcaacgnagtgttgcccccaaccgcgaaacctggccggggaaagtgtacaaatgcagccacgctcttggatataatcaaggatgtggagatcgctatttcttgccgaaaggtg

SEQ ID NO: 18340 - DNA, 504 bp, Gossypium hirsutum
  unsure (1)..(504): unsure at all n locations
  Clone ID: uC-gsflnu33B145f01b1
gtttgattttgcctgaggccacatcaaaagagtgtctgccagacgtaaaacttgaactcaactccgggaaaaaggattcttttgagggtgttcgagacattaatgctacagtcatacttccaagtggtgtacatagcctgccaaataaaggcgaaccttcatcactgatccaacgatggaaatctggtggagcatgtgattgcggtggctgggatttgggttgcaaacttaggattctgtctaataagagccaatgcaaccagcgccctagttctttgagaggttcttcaatttctaatcaatttgaacttttcttccagggaggtgcacaagacaacatgccttttttcagcttggcctctntcaatgacggtatctattcagttgagttcaattcatcactttctcttatgcaagcattttcgatttgtatagctgtttgggatagtggaaagcactgtgagctttcagaatcagttcccttgtatgaagaaagaactttag

SEQ ID NO: 18341 - DNA, 473 bp, Gossypium hirsutum
  Clone ID: uC-gsflnu33B145f05b1
ttcacgtttccggttcgataacttgtatggatgccgtcactcacttcccgatggtttgatgagagctactgatgtgatgattgccggcaaggtcgccgttgtctgtggttatggtgatgtcggaaagggttgtgctgctgccttgaagcaagccggtgctcgtgtcattgttactgagattgatcccatctgtgcccttcaggctctcatggaaggacttcaggttttgaccctagaagatgttgtctccgaggctgatatcttcgtcaccacaaccggtaacaaggacatcatcatggttgatcacatgaggaagatgaagaacaatgccattgtttgcaacattggtcactttgacaatgaaatcgatatgctcggtcttgagacctatcctggtgttaaacgcatcaccattaagccttaaaccgataggtgggtcttccctgaaaccaaaaccggcatcattgtgttgg

SEQ ID NO: 18342 - DNA, 414 bp, Gossypium hirsutum
  Clone ID: uC-gsflnu33B145f06b1
acggttatgtttcatgggatgttgataatgctcgactggagcaagtgttcagtgaacatggtacggtagtccaggctcgtgtagtctatgatagggagacaggccgatcccgtggtttcggtttcgtgactatgtcttcggaaactgaattgaatgatgccattgctgctcttgacggacagagtttggatggaagagcaataagagtaaacgttgcagaggaaagaccaaggcgaggcttcttttgatgttgaaaggatttacatacatgatctactgctgtttgctttttccttttcatttttcccaaataacttgacctatttttcccccttttttaagggtgaatttacaggttttagtatatttgtaaggaatatatattttatccattgttatgaaaccatcatttag

SEQ ID NO: 18343 - DNA, 483 bp, Gossypium hirsutum
  Clone ID: uC-gsflnu33B145f07b1
tttacgcgtccggttttcgcctttcactgattccaaatattgaggtttgattcaatgggattgcgaagtaatgaagttgagaatgtcatggaagatgatagcgatgttatggatgatgttagtgaggaagagtttgaatctgagtcggactcagaagaggaagatgtgaagttggccgagccttcgaagaactctatatacaatagagatgggcttattgagaagctggaagatatcagctggccggaaaatgttgaatggatgcacaagctttctcttgatattgatcaagagaaagaggtggatgtgaacgatgacctggctagagagcttgctttctacacgcaggcattggaggggacaaggttggcatttgagaagtttgagacgatgaagctacctttccttaggccttcggattattatgcggagatggttaagacagatgcccatttgcagaaggtgaaaggcaggcttttgtac

SEQ ID NO: 18344 - DNA, 427 bp, Gossypium hirsutum
  Clone ID: uC-gsflnu33B145f09b1
tgttctctctctctattctctttggcttatctatcgctttgatttcgcatacttgctgtgcatcgattagacagaaatcgagtcggaggacaaagaggtgcaggagagatgtcgccaggagctgcaaaaagctgccatgcaatgggaggtgatgcaccttgttaaccacggcatctgacaggagctcatgggtcgccgtcgcaacgccgccgactacggaggcggaaaattttcagagggcggacgatataaagaacgcagccaacctcctggacataagggatggtcgaataatcaaagcgtggagacatgaaaaagctgattctctatacttggaagaagtggatgtaggcgagccttaacccagaattatctgcgcgggcttgttaaatacatgcctttagatcttcttcaggatgcgaaagtg

SEQ ID NO: 18345 - DNA, 119 bp, Gossypium hirsutum
  Clone ID: uC-gsflnu33B145f10b1
tttgaattgccttcaattactttgaaaggcacgaaatttggtagtgtatcttttatgagcctaatgaaaatgtcagtactggctgtggctgtggactgactatattagcttctttctct

SEQ ID NO: 18346 - DNA, 454 bp, Gossypium hirsutum
  Clone ID: uC-gsflnu33B145g01b1
gtaaaatttatgtcagcttgtgaagaagaaagttggcttgatgactataatcgggatgataacagatacaatgcaagcaggggggcacatttaaacctcaagcgtgctgagaaagctcgtattctggtaaacaaaattccaggtatggttgacactttggttgccaaaactcgagcttgggaggaagatcgtggcatatcatttaagtacgatggtgttccgctccttgccatgctagatgaatatgctatgctcaggcaagaaagggaagaagagaaaaggaggcttagggatcagaagaagttcggtgagcagcaaaacacagaacaagaacccatattcggttcaaggtcaaccccagctcgaccggctagtacaaagaaggtggtgggacctcggaccaatggaacccccagcagacgcttgtctttaagtgccagtcaaaatggaagca

SEQ ID NO: 18347 - DNA, 66 bp, Gossypium hirsutum
  Clone ID: uC-gsflnu33B145g02b1
cttacgcttccgggagcgtggaagcccaccggtcagagggattcggtgggcttctgcgaagggctc

SEQ ID NO: 18348 - DNA, 477 bp, Gossypium hirsutum
  Clone ID: uC-gsflnu33B145g05b1
tttaattctttgagaaagaagcagactgagaaaatgttctccgatgatattatcaggttttatgcagcggaattggctctggctttggagtatcttcataatttaggcattgtttatcgagatttgaagcctgaaaatattatgatccaggaaaatggccatctcatgcttgtagatttcgatctttccacgaagctttctcctatgtcgcctgaaaaatcgattcctcccaactcggtcagacaaacgccgccggactcagtcaagaaaaagcgagtcttcccttttgttaggtgctgtaactccggaatctctccggacgacacggcatctcaagaaagtgtcaactcggaacgtactactgagtcagaatcattagagaaatcaaactcgtttcgtggaacagaagagtacgtcgcgccagaaatcatatcaggcaacggtcacgatttcgccgtggattggtggtctctaggg

SEQ ID NO: 18349 - DNA, 411 bp, Gossypium hirsutum
  Clone ID: uC-gsflnu33B145g06b1
gttatctttcatgggatgttgataatgctcgactggagcaagtgttcagtgaacatggtaaggtagtcgaggctcgtgtagtctatgatagggagacaggccgatcccgtggtttcggtttcgtgactatgtcttcggaaactgaattgaatgatgccattgctgctcttgacggacagagtttggatggaagagcaataagagtaaacgttgcagaggaaagaccaaggcgaggcttcttttgatgttgaaaggatttagatacatgatctactgctgtttgctttttccttttcatttttcccaaataacttgtcctatttttcccccttttttaaggttaaatttacagtttttagtatatttgtaaggaatatatattttatccattgttatgaaaccatcatttag

SEQ ID NO: 18350 - DNA, 499 bp, Gossypium hirsutum
  Clone ID: uC-gsflnu33B145g08b1
tttcagtataaaaccctaacaatccgccactaaagcacagcttaaatataaagaaaaaaagatgcagatattcgtgaaaaccctaaccggcaagaccataactctcgaggtcgagagcagcgacaccatcgataatgtcaaagccaagatccaagacagagaaggaattcccccggaccagcaacgtttaatttttgctggtaaacaacttgaagatggccgtagattggctgattacaacattcaaaaagaatcaacgcttcatcttgttttaaggttgagaggcggaattattgagccttctttaatggctttggctcgtaaatacaaccaagacaaaatgatttgccgcaagtgttatgctcggatgcatccgagagcagtgaactgtcgcaagaagaaatgtggtcatagcaatcagttgaggcccaagaagaagatcaagtaaaccatgactgacgatggtggtttatgtcatttgcttaaaaggacttgaata

SEQ ID NO: 18351 - DNA, 463 bp, Gossypium hirsutum
  Clone ID: uC-gsflnu33B145g09b1
gtttgctctgtatattgaaattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgaggtcgagagctccgacacgatcgacaacgttaaggcgaagatccaagacaaggaaggcatccccccagaccagcaacgtctcatcttcgccggaaaacaacttgaagacggccgtaccttggccgactacaaca

SEQ ID NO: 18352 - DNA, 474 bp, Gossypium hirsutum
  Clone ID: uC-gsflnu33B145g10b1
gttcttttcccccctcactttccagaacaaaatcatagaaactgaaagattgaatttttgttctctcgatcattcatatctttctttgcaaaaaagttactgattcaagtgcattgggatggaacaagaagtaggggaatccttgattcagctggggaactcagatggttctaattctagcagctcagatcccgtaactcgtgtaaggaagctattgtttcgccggatgctggtggggatcaaagacggccggtttttcttgggcactttccactgccttgacaagcaagggaatatcattctccaagatacaatagagtatcgtagtacccgtcggtcttctccgtctcctatggagcaacgatgccttggtcttgatctcatcccttcctcttgtcagaactcctgtcatgtggattgctccgacgaggaacagctgtcactgctgaaggtataagaaactagaatcttatg

SEQ ID NO: 18353 - DNA, 302 bp, Gossypium hirsutum
  Clone ID: uC-gsflnu33B145g11b1
ttaggttctctactaagaactttcaagctcctcgtaatcttgcaagatcaaatggaatggttgtcaacttgttcttacctgttaaccagataaattgtgtatattcttgtgaggtccgtcttttagccgtaattgcgctgtatggcttagtatagaagtgaagtacgagaattcaaagatatgtgtaataaggatcatgattctgccgtttgaatgtaggtagaaggatctccatgacaaaatatgatagatttcttatctattctcatattggtttattaaattataaccttagttatggc

SEQ ID NO: 18354 - DNA, 233 bp, Gossypium hirsutum
  Clone ID: uC-gsflnu33B145h05b1
ctcacgcgtccgctccttacgacgtgtgagatatgagtcctctcccatatttggcgacaaatcaaatgggttttggtactgtttgcatgcttaggtctttcaaatgtgaaacttatagtgtagtatggggtaatgtatgcaagaatgtagtctggtgtatatagagcttgtaatagtacggttcggccgttgtttgtcggaataagatttcggtgttggtttctcttttgctt

SEQ ID NO: 18355 - DNA, 475 bp, Gossypium hirsutum
  Clone ID: uC-gsflnu33B145h06b1
acgtttacgcttccgggcaactcagccattctcaacttccctgaactcgccaactctttacctcgacccgtgtcattagcaccccgcgacgtccaagctgcggcagccaaagctgcccaaatgggaaacttggactccccatcaccatccactacatcatcatcttccacttcaacattgtcatcatcgtcatccctatcctctctggtttctcacttggacttatcttcagcgtcagacgaattaaccgagatagtggagctaccaagtctagggacaagttacgagtcggtggagttggggagtgagtttatattcgcaaactcgatggacggatggttttaccctccaccatggcttgaaagcatggaagactgtgagtacgtttgtaatcagttagtagtacccgagagcgttttacaaaacggcttcaaacaaggtttgctatgggattactagtactttttttcttttt

SEQ ID NO: 18356 - DNA, 272 bp, Gossypium hirsutum
  Clone ID: uC-gsflnu33B145h07b1
gtatggggccaccagccgggtattattatactccatattgatttttccacatataaaatagataacttttctttgcttaccttctgtattatctttttctagttttctttccctttttatcgtttcctttgagatgatatgatgttctgaaatatgttcacgaaggacttgctcattctgtggatttttttttttgtgctgggaggttcatgatctggttgtgatgtctctttgtgcttttgtaatattagaattttatttacattcttatt

SEQ ID NO: 18357 - DNA, 459 bp, Gossypium hirsutum
  Clone ID: uC-gsflnu33B145h08b1
tcgtttagattctaacaatgctacttgtaatggagatacatctgaagtgcagatgacgaaagtttttaaagattccggtaaagatgccgagtgtatcattgatgtagaagatggtgaaagttcaggaaggtcaaatgacgtaagttgtggactagagagaacaactggtacaagaaaaacatggtgttcaccaaatcttggcacattgaacattgtaatcgccgataaatacaatgataggaccaaaaccaggtcaggcatcgagtccacacctaaagaaaaaggatcaaagcctttcttccgtaagcaaaggtgtggagatcttcctcaggccaaaggtgcttttaatttattctatcagcgctttggctggatcagtgggttattgagacatctccaaagtccggtgcacttgcaatttagttgctcattgcaacttacacttgctttactgatagc

SEQ ID NO: 18358 - DNA, 458 bp, Gossypium hirsutum
  Clone ID: uC-gsflnu33B145h10b1
acgtttacgcgtccgattgccagtaggctatcccaggagaaactggagaagctgaaaaagacgacatttggactgagatatggccacgtttctcttggaacagcaatgacacgagtcaaacttgctgcttcacttggggcttcattggtttggctatccggtggattaagcttagtccaatcattgattaaagaaacattaccttcttggttcatatgatcccatacacctgagctggaccgaggggaacctggaggcgtagtatccatgctaaggggttatgcacttgcatactttgctgtactttgcggtacattcgcatggggtgtggactcagtctaaccagaatcaagacggcgaccaaaagatctcgactcacacttggaatttgttgcaagtgcattagatgggaaaatatcgctcggatgtgattatgccacttggcgtgcatacgtaac

SEQ ID NO: 18359 - DNA, 278 bp, Gossypium hirsutum
  Clone ID: uC-gsflnu33B145h11b1
tatcgtttacgcgtccgtccacgcgtccgaaataaagatagtaatttaaaaaaagataaaaaaaaaaaagaaattagaacataagggcgggctttgttgtggcacccaattaagtcctaatggggtgcgggggctagctattatgtagggttacctgattttatttcactgggcgattgtttaacatcgtccttgcctgtgaaatcttgtggagttacttggatttatctttttggggtaaataactatttgggctggtggcgttatcacgaataggc

SEQ ID NO: 18360 - DNA, 466 bp, Gossypium hirsutum
  unsure (1)..(466): unsure at all n locations
  Clone ID: uC-gsflnu33B145h12b1
tttcactccgccatcttcaataatttcttccgttgatctttgttagagattagctttttaatttttcattatgggaaagatcaagatcggaatcaatggatttggaaggatcgggcgtttggttgcgagagttgctctccaaagcgatggtattgagctcgttgctgttaacgatcctttcatcaccactgaatacatgacctacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcgaagaaggttatcatttctgctcccagtnaggatgctcccatg

SEQ ID NO: 18361 - DNA, 418 bp, Gossypium hirsutum
  Clone ID: uC-gsflnu33B146a02b1
gcatgctccataaagtgcagcagaaaatcctacatttgactgtattactctgctcaaagacccagactagccactctgggaactccaaattatattcagatagaaaaatctggcatgctaattctccccatactgatactgaaaccgggcattctataaataagtgattcatcattctctgtcccactcccacaccttgggcaaattgtaatgtttgtcaatttcctttgttgcatgtctgcccgtaaaggaagatagttccatgtttactttcaaaatatataatttttataaaatctctttaatatttacaaattatctataattaattaacttattaatttctgtgtggctcttactctattaattaatttacttttctccaattatactctttatctctttttctttttaccac

SEQ ID NO: 18362 - DNA, 438 bp, Gossypium hirsutum
  Clone ID: uC-gsflnu33B146a04b1
gtgtatcgtatcctctttttttcttcaaatatggatatacaattctgaagaagtactctttaactgttgctactatctttaccggcatagcatctgctactctgattggccatactttgaccatgaacttcatcctaggaatttcaactgtgttcatctcaatgcaccagctcttttcgccgctttccaaagtcaaagaagaacaagagaatggaatgctcgaaccggtagattataaggaaaaccacaggtccaaggaatctttcattaatatagcagcaggagcacatgaagaggctagtcatcgtgttggatccgacgagagacaaccacttttttcaacttaaagttttagggaggagggaatttgttttggtagggacccaggtattgttggatagtgacagagattaaccagtttttgctcgagacgtttat

SEQ ID NO: 18363 - DNA, 511 bp, Gossypium hirsutum
  Clone ID: uC-gsflnu33B146a08b1
aatttaagagtttcacctcaacaaaacacctacttagcaaatatgccaattgagagctcttccactaatggcccaaccgtctgtgtcaccggtgccggtggcttcatcgcctcctggattgtcaagcttcttcttgaaaaaggttacactgtcaagggcactgtaaggaacccagacgatcccaagaattgtcatttgagagagcttgaaggagcaaaggagaggctatctcttcacaaagcttaccttcttgattaccaatctcttaaggaagccattagcggttgcgatggagttttccatactgcttcacctgtgactgatgatcctgaacaaatggtggagccggccgtgattgggactaagaatgtgataatggcagcggcagaggccaaagttcgacgtgtggtgttcacatcttccataggtgcagtgtacatggaccccaacaggagccctgatgtggtggtcgatgagtcttgctggagcgaccttgagttttgaaaaacac

SEQ ID NO: 18364 - DNA, 451 bp, Gossypium hirsutum
  Clone ID: uC-gsflnu33B146b01b1
ctctgagattcgttgtctcgttgatgtaccaggtgaaaaggttccttctattgccaatggggagatggcaaattatttgaagacagttgtggctcctcaggttccaccggaaatttacgattcatttgtagcagctgttgataagggaaatattaggacaatgccaaacagaagcatgccggcttctccttatcccactcctggagccctattaatgggagatgcatttaacatgcgccatccattaactggcggaggaatgactgtggctttatctgatattgttgttcttcgtgatctactgaagcctctgcgtgaccttaatgattgcaccaacactctgtaaatatctagaatcattttacaccttgcgtaagcctgtggcttttacaatcaatacattgggcggtgcattgtacaaagtgttttgggcattacctgatcaagccag

SEQ ID NO: 18365 - DNA, 56 bp, Gossypium hirsutum
  Clone ID: uC-gsflnu33B146b02b1
gtatataatcgacttccatcattatgtcattgaatgctaatcatagattttagtgc

SEQ ID NO: 18366 - DNA, 363 bp, Gossypium hirsutum
  Clone ID: uC-gsflnu33B146b03b1
ccctcgcgtccgcggacgcgtgggatctcctccatataccatagcccccgccgcccgtggcagcaaccacctctttcccatctcctccacacaccaagcccaacaacttagccaatgtttaatcaagtcatttcagaattgaagttacacacacccaagttccaagattggattttatatctgggttcttttgaaaaaattgattctctttgttttctttgtttgtatacctgtgtgaatttttttaagacatgtcgcgttggttggtgtatattggttgacatgtaaaatcaataagatttatagaagctataaataaatctatactagttcaagttgctttactccattaatacttttctt

SEQ ID NO: 18367 - DNA, 54 bp, Gossypium hirsutum
  Clone ID: uC-gsflnu33B146b06b1
gtctgtttcgatctacacctacggattaataaccggaagacagaagaggagaaa

SEQ ID NO: 18368 - DNA, 492 bp, Gossypium hirsutum
  Clone ID: uC-gsflnu33B146b07b1
aattatagttgtggagaaaaaaaatattacgtttgggaagcgagaaagtgcgagaaaatgagcggagcaggaaagaaagtagtggatgtggctttcaaagcaggaaagagcattgattgggaagggatggcgaagcttttggtctccgatgaggctcgcaaagagttcgccactcttcgtcgcactttcgatgaagttaactccactttgcagaccaagttcagtcaggaacctgagcctatcgattgggaatattatagaaaaggaatcggctcgcgattggtggatatgtacaaagaggcttatgagagcgtagagatccccaagtttgttgacacagtcactcctcaattcaaaccgaaatttgatgcattgttggttgaattgaaagaagcagaggagaaatcttttgaagagtccgagcgtttggagaaagaaattgccgacgttcaggaacctgagcaaaagatcagcaccatgacagcagatgag

SEQ ID NO: 18369 - DNA, 488 bp, Gossypium hirsutum
  Clone ID: uC-gsflnu33B146b09b1
ccctcgcgtccggaagattacaacaagttttatgaggcattctcaaagaacctcaagcttggtatccatgaggactctcagaacaggactaaaattgccgaattgctccgctaccactccaccaagagtggtgatgagctgaccagcttgaaggactatgtgaccagaatgaaggagggtcagaatgatatctactacatcactggtgagagtaaaaaggcagttgagaactctcccttccttgagaagctgaagaagaagggttatgaggtcctttacatggttgatgctattgatgagtatgctgtcggacagctcaaagaatttgagggcaaaaagcttgtgtcagctaccaaggaaggtcttaaacttgatgagagtgaggatgagaagaagaagaaggaagctttgaaggaaaagtttgagggtctttgcaaggtcatcaaggatgtgctgggtgacaaggttgaaaaggttggtttctgatc

SEQ ID NO: 18370 - DNA, 476 bp, Gossypium hirsutum
  Clone ID: uC-gsflnu33B146b10b1
gtcttgctgaacggctcttgggtggtcatcgccggtgattcacaagcacgattgttcaccctctctttgctaaatctgattttgggtcctcaatctcaacgcatggattcagttcgagctgatttgttcaaaaggcatagcgattacagcgttttagttaacgaaaccggtatgaaattggatttcatttgggcaccttatgttatgaatttgaccaatttggtgatgaatttcaagacccaaaagaattgccctgatgttatgatcatgggtgctggtctttggcacatgcttcatttcaccaatgcatcagattatgatctgcacttgcatatattaaaaactcaagtagtttccttgttgccattttcaactgagttagccatgaatgaaccggtgactggctcagtccccatcaagtcatcccacctgttttggctcgggatgccggtgatgatcaatgggatgtcgaacac

SEQ ID NO: 18371 - DNA, 469 bp, Gossypium hirsutum
  Clone ID: uC-gsflnu33B146c01b1
gtatctgttcctgcaactcctaggattttggataacggtagtgaggataggtatcctcagttatccccggttcagtctggtagtcagcttgcaagaatagcaaccaatgtgaattcgaacacttcagtttcacaagctaaccgtcataattatccgtttctacctcaaaattgcccatctggccatgaccaattgatgagggtggaaactaacagtccatcgaactcaggtcaagtttaccccctttattatggaattcactatcaaaatgcagagtcccaaacaggttctccagtgcaggaaaatctagtgtctgatacgataatagttgggagacctattggttcatccgtgttagagccagctgaaatgggttccttgcagaatttcttttcctcttccaagttgatattggtggcaagcgaattgggcagcaagatatcagacacactgatgagaagttacttgg

SEQ ID NO: 18372 - DNA, 450 bp, Gossypium hirsutum
  Clone ID: uC-gsflnu33B146c02b1
ccctcgcgtccggtttttgacaatggcggacaaagtattcccttcctccaaacccaccgccaccgctgcccctggtggatcagcagctcctactactactaccaccaccaccaccaccacaaccaacggcggaactacaaaatcccacctcattaaccccaccgcccgcctaccctaccgtccacagccccataacagacgtcgcaactaccgcccacggcgcaactactgttgctgctgctgtttctggatcatcctcataatcctcgtgctcgcccttttagtagccataactggcacagtcctttacgttctttaccgccctcaccgtccttctttcaccctcgctttcctccgtatccaccgcttgaagctcaaaaccgccgtcgacttctccacttaccatctttaacccttttcaacttaaccctttttttcaaaaaccccaac

SEQ ID NO: 18373 - DNA, 451 bp, Gossypium hirsutum
  Clone ID: uC-gsflnu33B146c03b1
gtctctacaattgctgaactgaaacctgggatcttgtcggtgcatgaaggaaatgatgtcacaaaatatttccttagcagtggttttgctcttatccatgccaactctgttgcggatattattgctgtggaagcagtgccagtcgaccgccttgacccagccttggtccagaagggtctggctgactttactcaaaagcttgtctcggctacaactgatctggagaaagctgaagcccaaataggtgttgacgttcacagtgctatgaattcagctatcacaggttaatcattttcttaaccagctttggttcaatcctaagactttttttctcatattgcttcccttttttgtatgtgttcatgatcaacaaatgactgagatatctcaagatgcctaaattgttggttttcagagtttggaataaaattttctgaaacaagaagcttgt

SEQ ID NO: 18374 - DNA, 427 bp, Gossypium hirsutum
  Clone ID: uC-gsflnu33B146c05b1
gtttcgattgtagtaaaacattttccgaaaaaagttttcagtctttttcagtgtttgtttggctgaaaatattttcctcacgtaaaatcaattacaaacacgagaaaaagaagccttaattttggaaaatgtcttaccgtttctaattcggtaagatattttcaggaaaattagacaccgatcttccctttcccttccctttccccttcccctatccttgacacctgatcttatgcttgccatcagctaacaccgattctcaacaccagacactagcgttcatcaaccttttttctatgttttgatttcggagcaataattgagggaatcagaaaatggagaaaactgatggaattgggaaagaaaatggaagcacagaagaaaagcaaagtttcaaagatgaatcaatttgtgggtataattcact

SEQ ID NO: 18375 - DNA, 347 bp, Gossypium hirsutum
  Clone ID: uC-gsflnu33B146c06b1
ccttcgcgtccgggaccttcaatttttcgtaggagagagcatgcatgatgatggatgcttggtgtttgcttactacaaggatggtgctgttgacccaacatttttgtactttgcatatgcattgaaggaggtcaagtgctgaggtttgaagcaaagaaaaaaaaagtggttgctgaagaatttagtcctttttattattgcttttgtctcttgttttcagtactctgctaaagacataaattatttgtggtttttgatgtttttgttttaattgtttgttgttttatcatggaatggtttctatttttatgggttggctaaacaataatttaactctttgttctatt

SEQ ID NO: 18376 - DNA, 524 bp, Gossypium hirsutum
  Clone ID: uC-gsflnu33B146c07b1
ccctcgcgtccgcggacgcgtgggttgcaactaagctcggtgcacgtcttactgatgttaggaagaatggcacctgcccctggctaaggcctgatggtaaaacccaggtcactgttgagtactacaatgacaatggtgccatggttccagttcgtgtgcacactgtcctcatctccacccaacatgatgagactgttacaaacgatgaaatcgctgctgacctcaaggagcatgtcatcaagcctgtcatccctgagaagtaccttgatgagaagacaatcttccaccttaacccatctggccgctttgtaattggtggtcctcacggtgatgcaggtctcaccggacgtaagatcattattgacacttatggtggctggggagcccacggtggtggtgctttctctggaaaggacccaaccaaggtggacaggagtggtgcttacattgttaggcaggctgccaagagcattgtagcaaatggacttgcccgcagatgcatcgtaccaggctcctatgctatt

SEQ ID NO: 18377 - DNA, 443 bp, Gossypium hirsutum
  Clone ID: uC-gsflnu33B146c09b1
atctctttcttctcttctttcaactcaaagaaaactcccatgtaatattagaatcatgggtgttgtcacttataactatgagtctacctctccagtcgcccctgccaggcttttcaaagctttttctcttgaagctgacaaggtttggcccaaggctgctcctcaggcagtcaagagcgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacaagcttgagaaaatcagctatgacaacaagtttgaggcagctgcaggtggaggaagcctttgcagagctcgatgaaattttacactgttggcgactatgtgatcactga

SEQ ID NO: 18378 - DNA, 469 bp, Gossypium hirsutum
  Clone ID: uC-gsflnu33B146c11b1
ctttcgcgtccggccactcgtacgatccttaggatggggtttggtgataattacaagtttcatgctgctggaagagaagatattgatgtgatgaagttctagtttgtgttgattgtttgcttaaactggagacatttttgtcccccacaaaaaatcagtgagtattgtgcttatctatggaacctattgcaggtccgaatgttgggttcaggcaggccttttctgcttgagatacaaaatgcacgccaagttccatccgaagagactgttaaggaaattgaatcaaagataaatggcttggagaataaactagttggagttaaaaatcttcaagtagtaggcagtcaaggttggacactgatgcgtgaaggagaagccgagaagcagaagcaatattgtgcattagtgtggatttcttgtccacttgaggatgaagatgtgtgctccatattattgcttaatgacatgc

SEQ ID NO: 18379 - DNA, 360 bp, Gossypium hirsutum
  Clone ID: uC-gsflnu33B146d02b1
ctctcgcgtccgcctaacgggtttgtctaaggctgttgagtggcactgtgaaatccttggctgccttctttatactgcaaagcttgttgcaaaacaggaagggctggaagatggattcaggattgtgatcaatgatggccctaaaggatgccaatctgtgtatcacattcatgttcacctcattggagggcgccaaatgaactggcctccaggctaaataaagatgttatagtttgatataggtatttcatggtagtgtgcattgtatgtttcatggtcctgatgatatcttcaataacgaaagccggtatgtgggctctcatcgatgatcaatggagtacgctcttgaattgggaaaac

SEQ ID NO: 18380 - DNA, 486 bp, Gossypium hirsutum
  Clone ID: uC-gsflnu33B146d03b1
tgtttttgcaacccttgacatgcttttaaagactcctcaagctcaggcttgtgccgaggacattgccatctgggttaagaaatacatctcaacgcgaggtcatgagttctcttattaagtgggtggtttcaaatgcgggaaaaaggattatgacaatgcctcatccactggcatccttttttgtttgaaaaagagaacaattacaaggatgccataaaagaggattcggacaatgtattgtatttgttctttcgtgctaatccgaacttcaggtttgcacctcggtttccaggtttatcctatgccctattctcttctttttttgtaagatagaacttttttctgattgtagattagtgagttgactcagttgagttgatattacttgctcttgagtgctgcacaccacattgagattttgtcaatagcattcttttttttttaccctgtgaatataatgtactatttctagccaataggggtttt

SEQ ID NO: 18381 - DNA, 166 bp, Gossypium hirsutum
  Clone ID: uC-gsflnu33B146d05b1
gttaacaaaccagagaccactgcatttctttgtattctgattctgagaggtcatgggttaacccgacaactgaactagaaaaagagtaaatattcgcccgcgaaaatttgagtttcattttatttgattgttccatttttgtcgatctgaatctgatatgaatttg

SEQ ID NO: 18382 - DNA, 59 bp, Gossypium hirsutum
  Clone ID: uC-gsflnu33B146d06b1
ggtgctcagtaagaatgatggtggtggtgatcgaactttgatcatctttgatatataat

SEQ ID NO: 18383 - DNA, 503 bp, Gossypium hirsutum
  Clone ID: uC-gsflnu33B146d07b1
ccctcgcgtccgattttttaacttataattgtaaattattgatttttattttttatatattttttacaattttataattttgtttctaatttttaataaattttagatgtttctaatttacaccttgattccaactatatttccaattccatcccttcatctctatgccatttgaccaattcgcagtcgttgcagcttgagagaaatcttttacatggttccatcccttcatctctacttcatttacctaatttattgtatctatccgtggcttcgaatcttttggaaggtcccataccccttgatattgagagtttgaatgccctgcaatacttagatctctcagacaacaaattgagtggaaggattcccctgcaaattggtggcttatctttataccagcttgatctaagccataacattcttcaaggagtgaaacctttccagtttgagaggtttaactcaatttaacattttaaattttagtcgggataatttaacgg

SEQ ID NO: 18384 - DNA, 259 bp, Gossypium hirsutum
  Clone ID: uC-gsflnu33B146e01b1
tgctttgatgtcttctagtggatcacctcatatgggattctctagaagctctagtagactatctttccaggatgacatggatgattgtgagctctcttgcccttttgatggtgatgatgtcgatgtatctgattcattcagtcaaaacacaaaggggaaaaaggcttcagaattcactgcacagtcaaaactggctggttaaaaatcacaagatgctgctggtggcattcttggtcaaatgcttagaacagcaccggct

SEQ ID NO: 18385 - DNA, 478 bp, Gossypium hirsutum
  Clone ID: uC-gsflnu33B146e02b1
tcgctctctcgtccgtccacgcgtccgcaaaattggacaatctctataccgcgaaggacctggtaaagatccattcctacctgatcaaaagacacccataaagaacttctttcttgctggatcatacacaaagcaggattatttagatagcatggaaggagcaactttgtctggcaggcaagcatcagcctacatatgtgatgccggggaagagttagctgcactgctaaagaagctcgtgatggttggttcttaagaacagatggaaacttcaagtgttaccgatgagttaagtcttgtatgattgtttatctgtttagtaatattactcaaaccacctaaaatggccgagacaaggtggctgactgtgccttcattcaacatgttatataacatttatattatcaaaggaagttattaggaaattacttttacacccttcctattttctatgctcataatctcaatgaattttccc

SEQ ID NO: 18386 - DNA, 491 bp, Gossypium hirsutum
  Clone ID: uC-gsflnu33B146e04b1
attatatgcagaaaaacaagaaaaacgtaaagaaaccatcacccttaatccgactactgtttctgtatcttcacaaccctagctaatcccaatttaatcaatatgtcagcagctgttgccgccgccgccgccgtcgcaagcgtctcatctaacaccacttcttcttctcatcatccaagtaaccaggcgccgaaccatggctggatacccttttttcaaccaccggcacaacgtgcagcgctcccagctttgagccgctacgaatctcagaagcgacgtgactggaaggcgtttgtagagtacctgaagaagcatcgcccccacttgggtctctcccgctgcaccggagtgcatgtgcttgaattcttggactatcagttcgggaatactaaactccacacacggaactgttctttttggggcaacccttctgacctaccatcgccatgctcatgctcttgccctttcgaccaagcatggagcagcttgga

SEQ ID NO: 18387 - DNA, 348 bp, Gossypium hirsutum
  Clone ID: uC-gsflnu33B146e06b1
tgtttgtgaatgcatcaaatcagcgtctaagaatattaaacccaataaccaattagctcaggctcttccttctaattgtggaatcactttgcccgtcgccatttcaccaaatgtcgattgttccaaggttggttgagagcttggaagctgaaactgggagtgcttggatgggcatgaagtaattaaaaaactccatgatagaagctcaattgttttgcttatcaataaactggaatcctccggtcttggaatttggattccttgggtgaataaaagtttaatgctaccatctacttgttttcctctttttcagggttcatacatatgagatgatcatgttgtgtattc

SEQ ID NO: 18388 - DNA, 503 bp, Gossypium hirsutum
  Clone ID: uC-gsflnu33B146e07b1
ccctcgcgtccgggagaggtggcaacctgggtcagcgccactgtggtctccgcctttttctcctctctcgagcgcttctcctgcgttaacctctccaccaacgaccctgacgatgacgacaatcccgacgaggccaaggaccgccctctcacctactcctgaatatctctctcggtacttgccacgtcatagactctcttgctttctcttgatttagggtctttgtatacagaaccaagaaaaaagtattaaggaaactttaaatgctctctatatgtgttggtcctcctgattgaaaagggaactcttgtgtaataaaggccttttttttttggatatttaatcatctaagtctgttggtgctgtgttttctcaaaagtcacaagtcaaaaccctcgatcaaacaatatggagcttgaatttgattcctaggttttgttatggaactgtcttttccttatcagttaaagggagtactgtgtgtgtgtgtgttttgaatattg

SEQ ID NO: 18389 - DNA, 421 bp, Gossypium hirsutum
  Clone ID: uC-gsflnu33B146e08b1
ttgttaacaaccagctaagtcagcatatatcatagtgaaagggattcgctccattcttattgctttaggcctctttgcttttgcttgctcatcggcctcagcatatgaccccagtcctctccaggacttttgtgttgctatcaaggacatcacgaatggcgtgtttgtaaatggtaaattttgcaaagacccaaagcttgcagttgcagaagatttcttcttttcaggcctaaacaggccggggaacacatcaaatccagttggatcaaatgtcactatgatcaatgtagatataataccaggacttaacactctagggttatctctggttcgaatcgactatgcaccttatggtgttaaccctcctcacactcacccttggggatccgtgatcctgcttgttgtcgaaggcacactttat

SEQ ID NO: 18390 - DNA, 381 bp, Gossypium hirsutum
  Clone ID: uC-gsflnu33B146e09b1
ctgtgtttaagttcccttgcttttctctgccctgttcatctccctaaacgatgtcgcttgtctatgataggaataatgaaaatagtagttcaatgagacgctcggggtttatccacgggatgcagtgtatctccgtctatgattcgccggaggagaaaagagatgataggttgcggttgctttcgacggaggaagaggaggaagagagagacgatgatgagtcggggtcttgcagttcgtcgtcgataggaaggaacagcgatgattccggtggatcaccatcggatgatgatgactcaccggaacctgaagtacaaagccagcttaaaggacctttggatacaatggatgctctacaggagatttttgcctttgggaaaa

SEQ ID NO: 18391 - DNA, 334 bp, Gossypium hirsutum
  Clone ID: uC-gsflnu33B146e11b1
ggtttgaaaaagccacgggaaaaaaaagaggaggttcattttaaaaaagaagacaagagaagccaccaaacacaaaaagaaaaaaaggcaaacaaagcggcaaagaaagaaagaaaacggggaacaagaaccaaacaacaggacgaggaaaaagagaaaagggcacaaaggaggaaagaggacaaaaaagaaggaaaaaaaaagaaagaagaaaagacaccgaaaaaaaaagaaaaaaggagaccaaagggaaaaacaaaaccggggacagagaaagaagggcaagaagataaaaaaaggagacaaggaacaaaagggcaaaaaaaaaaaaaga

SEQ ID NO: 18392 - DNA, 528 bp, Gossypium hirsutum
  unsure (1)..(528): unsure at all n locations
  Clone ID: uC-gsflnu33B146e12b1
ttcttgcgtccgattggatctggctctttgcctactaaggctcgaaaaggtggttggcgatatctagatgcagggcaagtgctgatcgagagtgcatgctctgtagatcatgcagaggaagctttaaggacgctgttacctatgcaccctgagatccattacttccggttcaatccagtggatgaacgatgtgacatggagctggatgagacggatccaacaatttgggcaaagttggaagctgcaacgaaggattacatcgataacaattcggaaactttcaaggatgcttgtgaaagacttgttgcaccatttaaaaatgcgtaagtggagagaggtataaatataaatctcaacaaccaatcatgtattttgttgttaccagtgaaaagatataaaatgttgaaatcgtattacgtagatgaagagagaggggattagaaaaaaacatctgagacctctttgngatgaatcagatgagagccgtaattaaaaaaaaaacctttttattatttattttttgcagaa

SEQ ID NO: 18393 - DNA, 492 bp, Gossypium hirsutum
  Clone ID: uC-gsflnu33B146f03b1
catgttcattatttattgaacaggtaaaaaaccaattattttttttccctttttcttaaattaaagaccatgccattaaggtaaatgcatattattgttaactattaattatattaactatttattttacattaaattaatgtttaaacataaaaaataaaataagaaacaatcaaaccaactggtttaacctgtggtccagtttctttaacattggtatttatgtcctttaatgtcgaatttctacatttatgtctttcattttgaatttttagatgatagtagtgtcaatgaattctttgtcccttgttatgctattagttcctttggttttcattttctttttttctttttttcccaaagccacttgtcccagttgtcatgtttttttatgcatttccttggctatggggttttgcttggtagttatgcagctttttattggaagctgaaactcatgcctgttttatgaatgcttacatgcatggcaag

SEQ ID NO: 18394 - DNA, 517 bp, Gossypium hirsutum
  Clone ID: uC-gsflnu33B146f04b1
gtgtaattgaaaaatatctttttggaggttaaggcaaaatatgagacggcattgggaatatttaggaaggagaagatcaccattgacccagatgaccctgctgctgtttctcagtatgcaaaagttatgaagacagttaggcagaaggctgacttgttttcagaatctcagcgcatccagtacaccatccaaatacgagctcaggacgttccagatgctcgaacatatttattgaccctgaaggatataaggatcaagagaggactcactgatgaccttggtgctgaggctatgatgatgaatgctttggataaagtcgaaaaagaaatcaagaagcctcttatgaggaatgacaagcaatcaatggctcttcttacagcagagtttgacaagatcaataaaaagcttggaatccggaaggaagatctgcccaagtatgaagaacagttagaactaaaaattgccaacgcacaattggaggagctgaagaaggatgcttttgaagcaatggaaacac

SEQ ID NO: 18395 - DNA, 315 bp, Gossypium hirsutum
  Clone ID: uC-gsflnu33B146f05b1
atataaaaaaaaaaaaaaaaaaaaaaaaaaaaaaggtaaaataaaaaaaaaaaaaaaaaaaaaaccaaaaaaaaaaaagaaatcaaaaataaaaaaaactcataatttcaggggcggcccttttaggggttccgggttttcttccgggggtctccgcccttttaccttttctttgggggcccctaatttttattgtaggggccctgtttttcccccctccgggcgggggaaaccccgggggttccccaattaattggcggtgggagcccatcccccttttcccggttggctttttatcaaaggggcccgctcctt

SEQ ID NO: 18396 - DNA, 466 bp, Gossypium hirsutum
  Clone ID: uC-gsflnu33B146f06b1
gcttcaatcatgcaaagatttctttcaatatcatccaaatcaacctctctcaaaaatcagaagcagcttcacctccccctcgtttcttcagtttcttctgccactccaaaagggcaatcctgttctcattatttcaatcaaaagtcaccttctttaggctccaggttaggttttgatcgggttttctcgtctgggtattttccaaatcgtgttaatttgagggaacacgaaagaaatggaaatgggtttttgaggtcgaagggattggttggggaaattaggaattatagcagtgaaactgacagggagtctatagattatgatgttgtcattgttggggctggcccggctggcttatctgcagctataaggttcaagcaattgtgtcaggaaaaaaatgctgatttctcagtttgtgttgttgaaaaaggtgctgaagtaggtgctcacatcttatctgggaatg

SEQ ID NO: 18397 - DNA, 429 bp, Gossypium hirsutum
  Clone ID: uC-gsflnu33B146f07b1
tttttatggggatgcatcagaagaaataatttcaactgatactactgatgaagaagctgttactgccattgaagcttaagtatgcctgtgactcggaacgaaaccccctttgttccccttacaggttcattcctttgctgattgaatttttcagtggacgatgactgaaggatttgaaggttcttcgattcacagcaaacattcaaccttttgccatacaaatagacaacattgtaaggtaaagtgtattaagttgtatttgttttgtacatgtatggtatagtggggtttgaatgtttttgtggttcaataggctgaagaattacttgatctttattgaaatctccaacttctctactggcatatgtccagccccatttaacatgttattgaggccaaatatatgttatatataggagtattttttat

SEQ ID NO: 18398 - DNA, 376 bp, Gossypium hirsutum
  Clone ID: uC-gsflnu33B146f08b1
atgttagtgcgcgtgaagtgcaacgacgacgacacgattggagaccttaagaagctggtcgcggcccaaactggaactcgagcagacaagatccgtatccagaagtggtacacggtttacaaggatcatattaccctcaaagattacgaaatccacgacggtatgggtcttgaactttactacaattaaaaaaaatatatttatgtaatccgtgtggtctttgcttgaacaagctctaaattttatatatgaatgtaatataatcgtggatgatggtatttacttttctaaggattttcaatagaagaaaataagtttatagatttggatgatcaaaaaaaaaaaaaaaaaaaataaaagggcgggccgttttgag

SEQ ID NO: 18399 - DNA, 102 bp, Gossypium hirsutum
  Clone ID: uC-gsflnu33B146f10b1
aatttaaaaaaaaaaaaaaaaaaaaaaaaaaaaaggaaaaaaggaaaaaaaaaataaaagaatacagaataacaaaaaaaaacatacaaaattatatatagg

SEQ ID NO: 18400 - DNA, 360 bp, Gossypium hirsutum
  Clone ID: uC-gsflnu33B146g01b1
tcttgcgtccggttattacaatgatttgacaaaggtggtttatggtaaagtaacacctgctacaaggcagattgatcatgacctttcaccgaacctttcctggccattcaaggttggatactccaaagggccatgctgcttttcggcgtgtgctagtggggtattcttttcgggattctgatgtaggttactgtcagggcttaaactatgatgctgcattgctatagcttggtatgaaaacggaggaagatgcattttggatgcttgccgttctccttgagaatgttttagttaatgattgctatacaaataacttatttggatgccatgttgagcaaagggttttaaagatttgtttac

SEQ ID NO: 18401 - DNA, 448 bp, Gossypium hirsutum
  Clone ID: uC-gsflnu33B146g02b1
aaataatgtgacaaaggaataacgacagcgaacggttgcattggggagttcaaatcaaatctcttattctttaaaattcctgggaggaattgcatctctctctctctctctctcctctcagctggacgagaaagaggaaatttcggctggtataaaaatgcaggtgtttgatagaatgactattccaattcgcagagtttggaccggtgtcgccacccgcttcggcgttcgtaaaagtgctcatatgaagcttcgaaaagatataagctcttgcgaataccaggatgtgcgagtgatgtgggaaatgctgagcagaaacgaagcataaaccattcgatccccaacaacaagtaaaggaagatgcataaagagaccaatgtggaattgctttcaatggcaaagcgagctccctttctttgtccaaccttctgaataacctgccaagagt

SEQ ID NO: 18402 - DNA, 376 bp, Gossypium hirsutum
  Clone ID: uC-gsflnu33B146g06b1
gtgttggaagtatttgcaagagctcaatgaaattctacactgttggcgacaatgtaatcactgaagatgaaatcaaggctctcattaagggaagtgagggagtttacaagcctgttgaagcttacctcttggctaatcctgaatcctgcaactaggatataggttgctttgaattctgattcttgcttttaaagagtggtcatttcttttaatggtgtgttttttatattttctttttccttttaaaacctaaattgtcttctaattatttacataagagtggtggtgatcgagcttttgtcatctttattttcattacagtcaaagaatttgggttgtctttgacatatatagaaataaaataaacaaataaact

SEQ ID NO: 18403 - DNA, 466 bp, Gossypium hirsutum
  Clone ID: uC-gsflnu33B146g07b1
cattgttctacaggttctcaaacgagttcaaacagttgtccggttaacatggttacggcatacaccatacgttgaaaggtaaactaagtacctatactataccccaggtttgcacttgatttacacttgggttgttttactgttcaatggaacaaaatattggttttttctaaaaataatttttgattggcatattaggaagcttctaataacacggtgcttaatgatgattcagatgataaaagaaaaagtaaataaaatggatattttcttaatgctgtcttatttttggaatttcaatcatttgaagctttttttgtgacttgataaaagtcgtataagctcattctgatcctttgtttgaaattgtttctatcaaaccctgttattgtcctcttccttcaacataccattcgttgtgaactccagtttgacgaggattctataaattcaccagttaaatact

SEQ ID NO: 18404 - DNA, 381 bp, Gossypium hirsutum
  Clone ID: uC-gsflnu33B146g08b1
ttctctcgtccgtatgtatctcaaggacacatggggcaaggtgggtatacaggagcttattagcaacctctccatagatcgagaaggaaaaatacttgttgaagatatcttcaaattagggggtgaaacagatgacgctgacactgctgaagcaggaagatcgtagggaactactgaaatttttgttgttaaaccctgtttaaagggtcattagtgcctctattacaacattattgtattttaacttagaaataatgtagcacttgacttcagtatccgctgattttaatgtacctactacaatctgaatatattacaagttgaggaaaaaagaaccctatggaatctttgtctcagtagttatagtgaaacactggctgc

SEQ ID NO: 18405 - DNA, 309 bp, Gossypium hirsutum
  Clone ID: uC-gsflnu33B146g09b1
ccttgcgtccggccacgcgtccggttttccttcttgctttcttcaagcattaaattgaagggcttgtttggctctcctctctgtgtggctgtctttcatatatatgtatatgtatgtatgtatgtatttatgacaccattctttcttagtaaaatgaattgtgatgaacttgattttatgaataaaacgcttcacgtttgttttctagagcgtgaggagcatcttgatgctgcattccgatactttgatggggatggcagctggagtattccagctgacgagctccaacatgctagtgctgagcttttc

SEQ ID NO: 18406 - DNA, 514 bp, Gossypium hirsutum
  Clone ID: uC-gsflnu33B146g10b1
cgtttccaatcagctgtccgccttgactgaccgtccggcatcgtcttggccctcgattttgcccttttgtaaaccttttttttcaccaattcccgaaatggcagtgaaaccctccaaggccgataagaaaatcgcgtacgacgcgaaactgtgccagctcttagatgagtacacgcagatcttgatcgccgcagccgacaatgttggctcgaagcagctccagaacattcggaaaggtctccgaggtgactcagttgttttaatgggtaagaacactatgatgaaaaggtctgttaggatgcatgctgagaagactgggaacgaagctttccttaaccttatccctttgcttcagggaaatgtgggtttgatctttacaaagggtgatttgaaggaagtcagtgaggaagttgctaaatacaaggttggagctcctgctcgtgttggtctggttgcgcctattgatgtggtcgttccacctggaaacactggtcttgacccatcacagaccttt

SEQ ID NO: 18407 - DNA, 544 bp, Gossypium hirsutum
  Clone ID: uC-gsflnu33B146g12b1
ctttatagagaaaaaaaactaaaagagagagtaagagactgctgttagagaaacaatgggagaccaaatgccatgtgcagctttgtctaatgtatggaacaaagtgaaaccattcttggcaatcatctccctgcaatttggatatgcagggatgtatatcatctccttggtttctttaaagcatggaatgagtaatttcatcctttgtacctatcgtcatgttgttgccaccattatcattgctccctttgcctttgttctcgaaaggaaaatccggccaaagatgacccttcctatcttcctcaggattgtggttcttggtttgctcgaaccagtacttgaccagaacttatactatttgggaatgatgaagacaactgcaacatattcatcggctttcgtcaacatgcttcctgctgttactttcatattggcaatgatttttaggttagagaagatcaatttgaagaagatatacagtgtagcaaagatcattggaacagcaatcactgtggtaggggcaatggtgatgactttgtacaaa

SEQ ID NO: 18408 - DNA, 412 bp, Gossypium hirsutum
  Clone ID: uC-gsflnu33B146h01b1
ggttgtggtggctactacaggtacggcgggcgtacaggtgaatgttttagtgaagaaaacccacaaggttgctcgatcatgtaaaaaaaccgcgggaatttgctgctgaaagcaatatatagctgaatttgatatactgtaatagtaataataaattctcttgtttactggtgtatgaatctgggggagtcattttgtggatttttatttatttctagttttattgagtttataaaagtcgtaaagatcattaacaaggttggtggcgttggttgtggcggcgacaacggctgcggtagtggtggtggccgtgtgctccaggcttgcaaaaagtttgtttaccatagttttaaaatttaataaataaaaatgatgtatctttttatctgtcagagtcttttgtttttaatta

SEQ ID NO: 18409 - DNA, 466 bp, Gossypium hirsutum
  Clone ID: uC-gsflnu33B146h05b1
cataatgtggggaggtgttattgtttggaatgggtttggttgtttaaaggattcagaattcaagcccagtgccaagaacataattcccatacaggaccttgagaatatgtttgaagtattcattgggcaattccggcaactatttggtttcaaatctttgaatgtttacacgaatgcatcaggcgattggaaccttctgcctagtgaaagaggttttaccgagtgggaattggacgtcttgtcatggcaacacacgtgttttaatcttcattcatgtgctacgacacttggatctcttttaagattggttcaatcactgccaaggatgattatcaaggatgagataggaaaacaggtaaagctttctcttgaagcagcaaagctggcactaagtaatgcctctagtggagtgtatgaatctttagctgcttcattcagtcaggcaaggttttttggagaggatgcc

SEQ ID NO: 18410 - DNA, 271 bp, Gossypium hirsutum
  Clone ID: uC-gsflnu33B146h06b1
ctctggtaaaaaggtatgtgcttgatgaaatctgtgatctcaagttcattacttttcaccatttacttttatttgccttttgttttcattataatattcacatgtattttaaacaagttgggaattttggatttttggctattcttttttctttcatgggctgaaaatagtcatagggccctgtttaaaatagataataatggtcatatctcatatgtaggacaattacatgacattgtgtgtcaaatttgcttacttccctttggtacct

SEQ ID NO: 18411 - DNA, 480 bp, Gossypium hirsutum
  Clone ID: uC-gsflnu33B146h07b1
ccctctcgtccgcttttctctcccgctctttgagtgttccaaacttaaaaagctatggctcagactgttgttctcaaggttggtatgtcatgtgagggctgcgttggagccgtgaagagagttttggggaaaatgcaaggtgtggaatcatatgaagtagatttgaaggagcagaaagtgactgtgaagggcaacgtccaacccgatgcggttctacaaactgtgtcaaagaccggaaagaagactaccttctgggaaggagaagctccggcagaagccgagacaaagccgggcacggcttaaaatgttttaagcccttattgattgaatgattgaacattttaaactattctatttctatgaactgtagaaatcttggatgattgggaattaccttctggggtggggaacctaaaaccggagaagatttccttatgatatttccctaccttttaaacaaaaaaaaaaaaaaagggcggc

SEQ ID NO: 18412 - DNA, 342 bp, Gossypium hirsutum
  Clone ID: uC-gsflnu33B146h09b1
cgtttcgtgggctttttcaccaactcctctccggttttcttgctctttttcttcctttgcatttacttctgatttgcaaaaagcaaaccaatccttttccccccagtggatcccaccagcactacaaccatgattgtgaatgtgaaagaatcaacaatggtaaggccggcgggggagactccccggcggagcctctggaacgccaacgtggacttggtggtaccaaggttccacacccctagcgtttacttctacaggcccaacggagcggccaatttcttcgatccgcaagtgatgaaagaggccttgagcaaggcccttggtgccattttaccccatggc

SEQ ID NO: 18413 - DNA, 429 bp, Gossypium hirsutum
  Clone ID: uC-gsflnu33B146h10b1
ccttatttcctttgccgcccctagggtttaatggcattcttcacatggcttctgcagatgtcgagtaccagtgctttgtcggaggtctcgcatggaccatcaacgaccgtgctctcgaagaagccttcagtgcttacggcgagatcgtcgattcgaagatcattaacgatcgtgagactggaagatccagaggctttggcttcgttactttccgtgatgagaaatcgatgagagatgctattgaaggaatgaacggtcggagtctcgatggaaggaatataaccgtcaacgaagcacaatctcgccgaagcggcggcggaggtggtggtggaggatttggaggaaaaggtgggtacaaccgtggtggaggcggtggatatggtggtcgccgcgaaggtggatatggaggtggtggatacggaagtggac

SEQ ID NO: 18414 - DNA, 536 bp, Gossypium hirsutum
  Clone ID: uC-gsflnu33B146h11b1
attttaaggaagagaactgcagaatggttaagaaggatgcatgcattattgagagcacaagcacgtgctcgtgctggccgggcccaaatttccgagtcttcccaatcaagctgcaaatcgtctcacttccatcatccggatccagcaacccctgaaaaatttgaacatgttattcgatccaagggtacaaaatatgaacaatcatcaatgttgaagagaaatggatcaaagtcaagtggaaggactgttgataatcaagagaaattacactcaggttggtatcgccgtgttgatgagcaaacatgggagcattcaacaagaattggtcctaatgatgatgaaaagaatgacaaaatccttgaagttgacactgggaaaccaaatttcatctctaaacggagaaacctctttcattcaacacatctttctctgaattctgatttatatagctgtagtttcactaattcgagagactcacaccaaacagctcctagtccttcatctggtgaagttcagtctttaacttcattgatgct

SEQ ID NO: 18415 - DNA, 239 bp, Gossypium hirsutum
  Clone ID: uC-gsflnu33B002a02b1
tataccttaccagggtttctcacttgtagttgtcattattggaatcaaaaggaataagctcccatttccgaatcgggaaaaaaatggtgaagggacgccaaggagagcgagtcagacctctatgtaagaggaactatcttggcgtacaagaggtcaaaatcaatccagcctacaaccactttatcgatccagattgagggagttaacactaaggaggaagcagtttggtatgccggcaa

SEQ ID NO: 18416 - DNA, 378 bp, Gossypium hirsutum
  unsure (1)..(378): unsure at all n locations
  Clone ID: uC-gsflnu33B002a03b1
tttcaacctcattgngttttgtccaccaaaaggattggaggtttatggtgtaggtcgatcaacatttgcatcatttatgcaacctgattgggatgaaaaactcaaattttttgaggacgtttatattcataaagagctgataccattcaaatgacagtcttactttttggagagtattcatagacgctacttgacaaatattaccacatgaaaacgtaaagaactgtaaatacttttccttttttacccaaactttaatctttcattttatcctttaacgcttttaggtccctattatatacattaatcattaatattggctctgttaaacttaattgtttatttttcataagggatgccaacaaatttaatagtcat

SEQ ID NO: 18417 - DNA, 222 bp, Gossypium hirsutum
  Clone ID: uC-gsflnu33B002a07b1
taaacaccttcctttaattttttttcgagtgttttttatttaaaaaaattaaaggaaaaccctaatgaacgtgacatggaattttcaatttcctcacatttgccacttatataccccattatctacattaaattcggggacatgacagcggttgaaaaactggaattcattttaaatttactacatttaacaactttaacagtaaagcactggataatcatt

SEQ ID NO: 18418 - DNA, 369 bp, Gossypium hirsutum
  Clone ID: uC-gsflnu33B002b01b1
taaattttttagactaaataaaaaaaaagaaagaaaaagatttttttttttaaaaagagagtatatttttggtggagattttcagaggaattcatccatggcaaccaaagtgtatattgtatactattccatgtacggacacgtagaaaaacttgcagaggagatacagaaaggggccacatctgttgaaggtgttgaagccaaattatggcaggtccctgagactctatcggaagaaattctcggaaagatgagtgcaccaccaaaaagtgatgtaccggttattacaccgaacgatcttgctgaggccgatgggtttgtttttggtttccccgacaagattcggaatgatggtcccacaattcaaag

SEQ ID NO: 18419 - DNA, 317 bp, Gossypium hirsutum
  Clone ID: uC-gsflnu33B002b02b1
tttaactttttggacaccgcgagaatcggagaccgagattccgactatttagggttaggtccggattataatttttgtagcaatggcggaagatacggagagtaagcagtcggcggtggagtctatgatggagaagatcagcgagaagattcacggcaatgaattcatcgtcatcttcggattcggatcatgagaaaccggcttccccttcctccgctaaggctaagaattatcggttgctttggaagagagagaccagttcattacgtgctcggaggtggaaaacctgccgatgtgtacttgtggaggaacaagaa

SEQ ID NO: 18420 - DNA, 375 bp, Gossypium hirsutum
  Clone ID: uC-gsflnu33B002b03b1
tacttttgtatacctgtagcatatagtaatagtaagcagtaatagcaatggcctcctccatgatctcatcggcaaccattgccaccgtgaaccgctcctccccggcacaggccaacatggtggcccccttcaccggcctcaaatctgcctctgctttcccagtcaccaggaaggccaacaacgacatcacttctcttgcaagcaacggtgggagagtgcaatgcatgcaggtgtggccgccttttgggaagaagaagttcgagactctcttattacctgcccgatcttactcccgtaccagtgtctaaggaagtagactaccttcttcgctctaaatggattccttgcttggaatttgaattagaaggaagggtt

SEQ ID NO: 18421 - DNA, 291 bp, Gossypium hirsutum
  Clone ID: uC-gsflnu33B002b05b1
ttttaatattaaagaaaaaagaaaaacataatgtcacatgttactgttgtgttttttgcttgagacttcgaatttcgcttccttgtttggagaggaaggccgaatccaagacagaagcatgcagcacctttcctgttaaaagcaatcttcttgattcagacaccacccaagtttggttatggaggtaatgagcagccctctttgccccaaaacctcgtacgcctcggaccttgctattccttgactgccttaaacccattcccgatgtacccaaacacatgacacccctta

SEQ ID NO: 18422 - DNA, 327 bp, Gossypium hirsutum
  Clone ID: uC-gsflnu33B002b11b1
taaatacgatttgctctgctttttctcttctgtcaaatttcttttcttttccttcactctctcactttgacagacagagcagcgtctccgaaggcagagagaggttccgaaactaccaactgaacttttagacctggatattcaaattccgaacacatggattagattcctgatcgcatttctttaaacatcttttacttatttctgaatataacagttcagcgcgtcacacaaattacctatttagctgcgatatctgtccttaaagggcagagttgaaacagctgaggccaattgactaagtggttagaccttggatatttccaa

SEQ ID NO: 18423 - DNA, 305 bp, Gossypium hirsutum
  Clone ID: uC-gsflnu33B002b12b1
tgtagatctccggggacaatttaaagtctgatatgatcataaatggttgatggttgactccaaactggctgaacagacgaggataaagggtgagcgaatgaacaatctttatcttttaaagggtccagatgaaggtagtgcaagggataaatttgggtgtcatgaagacaacaaattcgagaaccttaacttgaatatgtagaacttggacttcatgatcggtgattgagtaagcattagtaccttgcgaaatggtttttacaacaccgatgctgctctatataaaaataacaagtcacaaacaa

SEQ ID NO: 18424 - DNA, 433 bp, Gossypium hirsutum
  Clone ID: uC-gsflnu33B002c01b1
taagaagtggaatattggtgttgctcaattgctttcttttccttcaattcccaacccttggtttatatatacgtgttttggtgtgggaattgcagtgtgcttgagctcactattcagtttcattgtctctaattgtatcagcacatctgtactttgtatttatattttcagcgtttgctcccttcttcttctggaaattgccgtgattgtcaccattctcttcaagaacgactggagttcgctaatttcaaaatacattgatgagaatcatgaatttttcaagaactttgttgtcttccatgaaaagatgtgtcgtttgattactcttttgattctagtcccacaggttggtgtaatagcatttgcaataatttatggtgggttgggattgaaagttatccgcaagtgtgtcattctgattaggggtttttcc

SEQ ID NO: 18425 - DNA, 192 bp, Gossypium hirsutum
  Clone ID: uC-gsflnu33B002c09b1
tccacgcgtccgcccacgcgtccgcttttctggcaacatttatcataatcgcacctctgtactactcctatcaatctaatcacgagccgaaccctggcatggcaacaaatggtccgtggagtcgtctccgacgctccggccccgctcatgctcacccctgtccacgatattgtacttgggaatgtggctgcc

SEQ ID NO: 18426 - DNA, 238 bp, Gossypium hirsutum
  unsure (1)..(238): unsure at all n locations
  Clone ID: uC-gsflnu33B002c10b1
aacgtaaaaacccaaagaacgaaacaaggaacaagggggaagattaggggngaaacgcgccggagaacgcgaaagaaaaaaaggaaaaagggaaagggctggaacgagaaaagaaaggaaacggtagaaaggcaacgagaaaaagaacaaaaatgggggagaacaggaacgcgcaaaaaacagggaaaggacgtcaccagagaaaaacacaaaaacaaaaagaaagaggaaaggaaac

SEQ ID NO: 18427 - DNA, 412 bp, Gossypium hirsutum
  Clone ID: uC-gsflnu33B002d03b1
tgatgattgcctaaaatacatgtctgctttacctgatcctgcaatctttcgattttgtgctatccctcaggtcatggctatcggaacactagccttatgctacaacaacatcgaagtcttcagaggcgtagtgaaaatgaggcgcggtctcactgcgaaagttattgaccgaaccaacacgatggctgatgtctatggtgctttctatgattttttttcgatgtcgaaagctaaggtcgacaaaaacgatcctagtgcacaaaaaactgtaagcagactttgatccgatcctcaagacttgcagggactcaggggtcctgattgaaaggaaatcttacattattccaaatcagaccaatttcatttccaattatggctgcctcgctttttcatttacctggccatttttttt

SEQ ID NO: 18428 - DNA, 259 bp, Gossypium hirsutum
  Clone ID: uC-gsflnu33B002d05b1
tacttagcaattagcattttcgctttctcactacaaacattggcggcgatttctggccactgcacattccggtcacaccaattccctctctctttcaccgcccccgtcgccttctcttcctctttctacggggaagctatccgatcttccagcatttccttcgcttctcctccgtctgtccaccgatcccttatatcttgccaggcctccttcgccgcgtaaccaccttattcctccgtcaacgggacagcaaaagggg

SEQ ID NO: 18429 - DNA, 141 bp, Gossypium hirsutum
  Clone ID: uC-gsflnu33B002d10b1
tctttatctctttttattcaccgttaaaaacctgaacttttaactatttaaacgcggcttgatcctcagagatttctgcatgtactgcttggggctagacgttctgccggatatgttctaagtagatatgttcatattata

SEQ ID NO: 18430 - DNA, 224 bp, Gossypium hirsutum
  Clone ID: uC-gsflnu33B002d11b1
tggacgcgtgggcggacgcgtgggtttctgtgcaccataactttttacgctcaggtactcacatatctatatggtttgccatgagatctttcttggactgggtttcatgttggagtaccactcctcaagtgtccatcagggaggaggtggagacgcctccaaagaaggaggagacaaactccttgatgcctttagatactgaagatctgtggaagaagaatatt

SEQ ID NO: 18431 - DNA, 354 bp, Gossypium hirsutum
  Clone ID: uC-gsflnu33B002e01b1
tataactcctactctctcactttgctctcttgttgttcttgttctctttcaccaaactatcgctcgacaacctcttcaaaagaatggcatatgaagggattctgttggggatgggtaatcctttccttgacatttcgttagtcgcggacgaagagttcttgaaaaaatatgattttaagttgaacaatgcaattttagctgaggagaaacacctttccatgtatcaagaaatggcatccaagcccaatgtagagtatatttgctggaggtgctacttcaaaatttaatcaaagatgcacagtggaatgcttcaaattcctggtgtaactggttacattggctgtattgggaagg

SEQ ID NO: 18432 - DNA, 268 bp, Gossypium hirsutum
  Clone ID: uC-gsflnu33B002e08b1
tactttttccagttagttccacagcacactgccgaattttgaatccagtaacaaatagattttgttgaacactttcgaaaagttaaggcacgttcagatcgcagtgatggccaatgctgacgtggaagcggtggatttcgagccggaggaagatgacctcatggacgaggacgccgccggagacacctcccctcaagctcccatgcctaagctcaagaccgccatcactggcggtgcttcagcctctctttctgcccttaagaaaacc

SEQ ID NO: 18433 - DNA, 192 bp, Gossypium hirsutum
  Clone ID: uC-gsflnu33B002e10b1
taataactcagggcaaaaaccatcttcttttttctgctttctagcatagcatcctgttttgagaaactttactttttgcgggaatcagaaaatgtcatcggagaacgggaaaaggttgctggaaactgatgccgacggcctgaattttgaggcttaccgagctgactttagggttacctggagagcctagag

SEQ ID NO: 18434 - DNA, 388 bp, Gossypium hirsutum
  Clone ID: uC-gsflnu33B002f01b1
taagtagcgacgaacatggaaagagagcaacaagtttacttggcaaggcttgctgagcaagctgaaccatatgacgaaatggtcgaggccatgaaaaatgttgccaagttggatgttgaactgactgtagaagagaggaatctgttatctgtggggtataagaatgtgattggagcaagaagggcatcgtggcggatactgtcttcgatcgaacagaaggaggaagctaagggtaatgaacaaaatgtgaagaggataaaggagtatcggcagagggttgaagatgagcttgcaaagatctgtgatgatatactatcccgcattgataagcattttattccatctttctcgacaggggaatcaactgttttttattacaagatgaaag

SEQ ID NO: 18435 - DNA, 262 bp, Gossypium hirsutum
  Clone ID: uC-gsflnu33B002f02b1
tcacgcgtccggggaaaagcaggaaagcagaactagatcgagatggtaggattttcttcccaaacagaatcttgggttgccaccagaaactcaatctacgaatcctagaaagaggcagattgctttgaattggatctaaaacgtctagatctgataaagatagatcaagaagacgagaataataatattaacagccaagataagattagcaccaccaagaagaacaagaagaaaaattaggcgttgctggaggggtacgtgg

SEQ ID NO: 18436 - DNA, 95 bp, Gossypium hirsutum
  Clone ID: uC-gsflnu33B002f06b1
ttgcaaccttacaacgtttacacaggctttaaggttttgtggacctcacaacctgcttagtactctacgggcggcgtcgatgaccgtaaagaaaa

SEQ ID NO: 18437 - DNA, 111 bp, Gossypium hirsutum
  Clone ID: uC-gsflnu33B002f10b1
tataatctaaatatgtataaagatctatgtaatgaatttaggaataataaatgcctattaactaaaaaaaaatatttaatcccaataaattataactttataatacataat

SEQ ID NO: 18438 - DNA, 311 bp, Gossypium hirsutum
  Clone ID: uC-gsflnu33B002f11b1
tataaaatgatgaggatggtgtataagaagctgctctgtttaccctacccattcgcctaccctacagactctgccacgtctttaccaccagaatgtcattgatcactacaacaattcttgtaacgtcggatccttcgacaagatcgaccccaacgttggcaccggtctgttcggtgcacctgcttgcggtgatgttatgaagctgcaaattcaaaatccacgaggattctggcataattgttgatgcttgctttaaaacctttggattgcggcctcgggtcaattgccttttattctggccgcttacttga

SEQ ID NO: 18439 - DNA, 279 bp, Gossypium hirsutum
  Clone ID: uC-gsflnu33B002g01b1
ttcacgcgtccgtccatggctactgcagagggtgtattatttcagactgcaatccatgtcgagaaacctgaagaagtggtcaaggctggagaaattgttactgacgaggtaccggctgttgcttctgcagcagaacctgtcgttgaagaaccaaaggaagcagtgcctgaagcattatccggagaaccccaggctccacaaactgaatgccacagttgaaactgatttaaatgaggttggttaagagcctcatggtttgatacttgatgagccagaatt

SEQ ID NO: 18440 - DNA, 128 bp, Gossypium hirsutum
  Clone ID: uC-gsflnu33B002g04b1
taaaaaactctccctagatccaacgcataatgggtataatttcactgaaacaccccgagttagcgctgcaaagaaaagggagtattagccgaaaccatatgtgagaagataggagattgagtttggca

SEQ ID NO: 18441 - DNA, 264 bp, Gossypium hirsutum
  Clone ID: uC-gsflnu33B002g05b1
ttggagctcacattggacctgaaccaacgattgacagatttgatgctgttatgcccggaaccgatgaaagaagtgttctagggaacactatcgttgtccaggcatatatgctattcagtggcctcactactttcggaactgcatttttgtagaagtttcgagtgtactcaacagccacatccactgttggagtacgttacactcgcagatactcctggagtgttataaggagaaaaacaacttaactcaactagcctcttattt

SEQ ID NO: 18442 - DNA, 359 bp, Gossypium hirsutum
  Clone ID: uC-gsflnu33B002g10b1
tatacccttaccatcacccctaaattccccaccactttttcctatccaccttcatctccgccttttctcctccgccatctgtcttcgtcacagtcgatctttctctttcttaaccttctgcgccggcggcgatggtggtgatattaacagcaataacaactcgggcggcggcggtggaaactatgagattggaaaacacaggggtggtgatgacttagaatgcgggtgacaagaacaggaaagaggcgatgattgtcctggcggaggcagggaggtcaacggtgagttctgccgaaggacttgctggttgagaaccaatgctgttaggatcccccgtctggtcatccgagaggctcttg

SEQ ID NO: 18443 - DNA, 70 bp, Gossypium hirsutum
  Clone ID: uC-gsflnu33B002g12b1
taaagacgagaggtcaggcgttggttacgacggaggttttgagcgcattgccggcgatacctgagaggtg

SEQ ID NO: 18444 - DNA, 339 bp, Gossypium hirsutum
  Clone ID: uC-gsflnu33B002h01b1
tgtcacgcgttcggaaatcatctggtccacagtctggagtagtaacaacaagcggacgccaaaattatggtcctattcctcccgttctccctgcaactggccttattacgtccgggcccatcttttcaggcccattgaattcctctggggctcctcggtaattgtctggtcctttggactctatgggatcaatgaaagtaaaaagttctgtcgttaaatagtcaggctgtgaatgttcttagccaagatgatgacttttctttcaagaggaactttccaatgctaattttttggggcactgatatggtttttggaatggggatcattggtggtggtttt

SEQ ID NO: 18445 - DNA, 307 bp, Gossypium hirsutum
  Clone ID: uC-gsflnu33B002h02b1
tcacgcgtccgattggctctgactgttggagaggcttttgaacaaaaagaaaaatgaaagccacacttcccacaccccatctccggtctttcccttctccaaccccactttctttcaaactctccttcgcattccctgaaaccagaaggaaatcactaagcatcagctctactccgaagggaacaccatctccttctttggcttacgtgccactgagggcgagtgccagttctcaagccgctgctgcacctactgtcaatttgacggcaatacccaccgaaatgaaaggcttgggtgcacggtgaat

SEQ ID NO: 18446 - DNA, 321 bp, Gossypium hirsutum
  Clone ID: uC-gsflnu33B002h04b1
taaatacaggcgtatggaaacggctctgctaggtgacatttttattgaaaaccgacaaacacaccttcttcgaacatttctgcgccggtgaaacaacgacggaggccggtgagtgcttgaggaaaattcaggtggctggtctgcgagggatgcttgattacggcgtcgaacacaccagcgataacgtcggatgtgaccggaatttggagggctgttcacagagtgttgagttcgccaagtcactacccccttctattagtaagctttgtgaaagcgtaaataacatgcactgatgtcccattagttttcttaagagggtgt

SEQ ID NO: 18447 - DNA, 217 bp, Gossypium hirsutum
  Clone ID: uC-gsflnu33B002h07b1
tgacaatcaaatcaaccaaacatgcaacagggtactgttggaactgagaccgaggttactcgggaggatcaacagaatattaacaagcttggaagattaaacaatctatttcatgagattgaagatgaaactaaggttgcctttgaagcaattgataacctgtaggatgctagtccatgagttgattttatcctgacgaggaagtagctcggttttc

SEQ ID NO: 18448 - DNA, 380 bp, Gossypium hirsutum
  Clone ID: uC-gsflnu33B002h09b1
ttctttgcgaagaaccaaagatgccgaagaacaaaggattgggaggaaagaaccgtaagaggggaaagaacgaggccgatgacgagaaacgtgagcttatcttcaaagaagatggccaagaatacgcccaagtctcacgcatgatgggtaacggacgctgcgaagctatgtgcatcgacggcaccaagcgcctttgtcacatccgggggaagatgcacaagaaggtctggatcgtcgccggcgacatcatccttgtcggccttagggattatcaagatgacaaggctgacgtcattttgaaatacatgcccgatgaagcaagggttttcaaagtttacggtgagctacccgagaataccaggtttgaaatgatgggattg

SEQ ID NO: 18449 - DNA, 391 bp, Gossypium hirsutum
  Clone ID: uC-gsflnu33B002h10b1
tccacgcgtccgatttaacctacctcacctcctttcatttcattataactcccctctctctttctctctcttagaaccatcgttcaatggaacacccaaaggacttatgtccaggaacttctgccatagtttttctccttcttactggccttctctacttatgtgtatggactccttcaaaccctttacttcccttccatgaacccaatggttcacccaaaaattatactggcgtagagttccttgtgaaagatgagcttgatttggcgttggaggaagcttcgatgccgtacaagaccgttataatcgcggttgtaaatagggcttacgttgagcaaagcgttaatgcggagaccataatgctggaccttttcttggagagcttttgggt

SEQ ID NO: 18450 - DNA, 231 bp, Gossypium hirsutum
  Clone ID: uC-gsflnu33B002h11b1
tccacgcgttcgcagctgcatagattgtgttgtagttcttacaaaggaaaacgcaaaaaatggaataaatacaatcggttgttatatgaaaacggctgttagtttttgcggagaagaagaatggtgcgagaattgaggagtgtgattcgtgtatttccacgggcgagctgtaggtggcgctgatgacgtatttccattacctaggataacggggtatgctctggagaaacg

SEQ ID NO: 18451 - DNA, 330 bp, Gossypium hirsutum
  Clone ID: uC-gsflnu33B003a01b1
taaagcaagctttctgttgtttgtgagagggtacttgtcaagtgcttagcaccatcaacagccaccggtgagggttgtgataatatgaccatgatcttggtgcagttcaagaaaccgatcaaatccacctcatccgcagaggagcaatcctcgaattccgaatccactgaaactgaaccaaagctagagggaaatgcagaaaagtagttgctgcaactgttgggggagccttggaggtgtcagatcctctgattgaagatttgacgaccctttggttcctcaaatattgtggtatgcatttgtagatgggttagagaaggaatttttttg

SEQ ID NO: 18452 - DNA, 425 bp, Gossypium hirsutum
  Clone ID: uC-gsflnu33B003a03b1
tcggctgttgattgggttgccgataatgatcccacccttctgtccccgccccctggttctgccttcaaagtaaccttcttgaaactcaaagagagtgttagcaatgaagtgcaaggtgggattctaggggaaattaaaggggtgaaggaggggatctctggtattcaacagatgacttgcggagagaatttctcacctgcaagagcaaagggcttttcacttgcctcggtcgctgcttttggtggagttggagaaatggaggcagcagtgggaaatgaagagtatgtgaacctacagaagcaaaaggttagggacaatgtggatggtgtcattgttgtcgattatgtggtgccagcttcttcaccatagattattaactaaaagaaagaacttggttcttgaatgatggaagctttggatcaata

SEQ ID NO: 18453 - DNA, 229 bp, Gossypium hirsutum
  Clone ID: uC-gsflnu33B003a08b1
ttcatgcgttcgtccactcgtacgtccacgcgtccgcattttatgaacgaggatggacatggctattgttggttgacacttagttacttgatacattattttgggatgaagttaatgtatgttcttgtttttggttagaaaaaaaataaaaaaataataataattaaaaaaaataataataaaaaaaatatataaaaaataaatatatatattaaatatatatttaaaa

SEQ ID NO: 18454 - DNA, 431 bp, Gossypium hirsutum
  Clone ID: uC-gsflnu33B003b02b1
tcgtaatcttgcgcggttgacgaaggaagggaaggaagaaaccgtcgacggagatcagtggcggaactgagctgagttgtcatcggaaaagatatttccggcaatgggaagcttacgtggcatttcggttgccatttttgtagttcaagctttgttagcttcagtaactttggtatctgctcagggatctaccaacggttctcgttggcagactctaagtgggaaggcaccctccgtcatagctcacggtggattttcaggaatatttgctgactccagttttggagcttatagtttggctttattaactagtctacctgatgtcatcttgtggtgtgatgttcaattaacaagagatggagctgggatttgctttcctgatcttaagctagataataattctgacgtggcagttgtatacaaggataggc

SEQ ID NO: 18455 - DNA, 334 bp, Gossypium hirsutum
  Clone ID: uC-gsflnu33B003c04b1
ttcacgcgtccggaaagcaagaaaatagtctgcttttttttttctcttcttctgcaaatccttttctacaacaccctaagaaaacggcggcatcttctagaaaatcgagtggaccggttctccgatccctctccccataaggccgattcagttctcactatgtttcacactctacgtcttcttctttctcggcttttgcttattccagttcgagctttactttaacgctcttctactttctttaatcaacctagatctattactccaccgcgcgtcaatgcttataaccacactcaatcgtcgcaatctgttccgattctcgctcgatagccgt

SEQ ID NO: 18456 - DNA, 423 bp, Gossypium hirsutum
  Clone ID: uC-gsflnu33B003c07b1
ttccacgcgtccggttaattgcaactcatctcaggaagttcttagtggaccgcagtataattccgttatttgaaatgcatatgcaaaggtctaatcatcagatggatcacatgccacctcatcaatcctggggtccacctcaaggtgtccctccaaatgctagtggaggttctggttatggtcataatcctctgtacatgccaccttctcggcaaatggacaattactaccctcctgctgatatgccacctcatatggaaaaacagccccatcagggtatttctgcctatggaagagaggtgccaatgggtgcccatggatcatcaaatccccagaatgcaccatcaatgatcacacaggtcactcagcaaatgcaaattccactatcttatgctgatgctgttattgggacagctggtgcaa

SEQ ID NO: 18457 - DNA, 428 bp, Gossypium hirsutum
  Clone ID: uC-gsflnu33B003c08b1
ttcggactgtccggctgctataaatcgtttggtgacctctggggttccagccacggtggagcaccgggccgcggcggctgcctcagcgactacctcggctgccattgtggctgaatgtgtgcagaattttattactgccatggattcattgaaactcaacatggtggctgctgatcaagtgtacccattgttgtctgacctctcagcatcactcaataagcttggtattttgccacccgatttcgagggaaagatcaaaatgagggaatggatttcaaggttggctaatatgggggcagcggatgtgtcaacagatacagcatgctaggcagctccattctgacttggaatcttcatacaattcatttatgggatctttgcctattgctggtactttgaagttaaacccaatacttccatatttttgt

SEQ ID NO: 18458 - DNA, 166 bp, Gossypium hirsutum
  Clone ID: uC-gsflnu33B003d01b1
ctcacgcgtccgatcaaaaatacaatatagggaccgtttatggatcggtaacaccaaaatcactaggggataaagctacaataaaatgaatcaaacctatacgtgaagccataaggtatatacttttactttgtatcccatatcagattgagttagataaataacc

SEQ ID NO: 18459 - DNA, 430 bp, Gossypium hirsutum
  Clone ID: uC-gsflnu33B003d03b1
tccggcagccgtgttcgcctggaaaggtgagaccctccatgaatactggtggcgtaccgtgagagcccttgactggggtcccaccggtggacctgatctgatcgtggatgatggtggcgatgctactctgttgatccatgaaggagttaaagccgaggaggtttatgagaaaaccgggcagctcccagatccgtcttccaccgacaatgccgagtttcagattgttttgacgataattagagatgggttgaaggcagatcccaagaagtatacatggatgaaggagagattagctggtgtttctgaggaaactacatccggcgttaagaggctttatcagatgcaggccaatggaacccttgtgctccctgctattaatgtcaatgacctctgtcaccaagagtcagttcgataactttgttttgttgcc

SEQ ID NO: 18460 - DNA, 307 bp, Gossypium hirsutum
  Clone ID: uC-gsflnu33B003d05b1
ttctaacccaaaaaaagaaaagaacgctcaaaggatttgcagcaatgggtctctcaaaggcttctctaatccttgttctcgtcgctgtttgttctctaacgggcacaggcatcgttgttgaatccccagcaccgagtcccaccttaggaaccggctccatcttcccctcattcgtctctgttctctttgccgccgtcacggctctgctttttggctctactcacaggatctgaagggtgctggctattgatggtgtagagagggtgtttgatttctcatttatatagatctgatttcgggggggtga

SEQ ID NO: 18461 - DNA, 182 bp, Gossypium hirsutum
  Clone ID: uC-gsflnu33B003d10b1
tcacgcgtacgcaaacgcgcccgctcaagggtgcagtttcaaaagcgaaacccacaagcaccaagaatgcagaggcccggacagatggggcgatacaccacgacggtgagaaggcaacaaaggttgagataatttaaacctcgatattaggtaaaatatgatagaacccaagaatggctaaa

SEQ ID NO: 18462 - DNA, 342 bp, Gossypium hirsutum
  Clone ID: uC-gsflnu33B003d11b1
tccacgcgtccgcccactcgtccgacccaggttactgttgagtactacaatgacaagggtgccatggttcccgttcgtgttcacactgtcctcatttccacccaacatgacgaaactgttacaaatgatgaaattgctgctgacctcaaagagcatgttatcaagcctgtcatccctgaaaagtacctagatgagaaaacaatctttcaccttaacccatctggccgttttgtcattggtggtcctcacggtgatgcaggtctcactggtccgaagatcattatagtcacctatggtggctggggagcccatggtggcggcgctttttttggaaaggacccc

SEQ ID NO: 18463 - DNA, 80 bp, Gossypium hirsutum
  Clone ID: uC-gsflnu33B003e05b1
ttcacgcgtccgaaaaaaaaaaaaaaaaaaaaaaaaaattaaaaaaaataaaacaaaaaaaaaaaaaaaaataaaataaa

SEQ ID NO: 18464 - DNA, 321 bp, Gossypium hirsutum
  Clone ID: uC-gsflnu33B003e07b1
tcggaaggttcttataaagccaattttaaaggacagttacacttcttcggatatgaaggcaggtgtggtttgcctactaactttgatgcatcatactgctatgctttgggctatggtgctggtgctctcctccacagtggaaaaaccggattgatatcatcagtaggaaatttgtgtgccccagttgaagaatggactgctggagggactgcccttacatcaatgatggatgtggagaggaggcatggtaaattcaagcctgttatcaagaaggcaatggcagaattggatggtgcaccattcaagaaatttgctttcctg

SEQ ID NO: 18465 - DNA, 75 bp, Gossypium hirsutum
  Clone ID: uC-gsflnu33B003f01b1
ttcacgcgtccgaagaaaggccgacagaatggagcgtatttggaacagctccaccacaacgcgacgaagctgaag

SEQ ID NO: 18466 - DNA, 191 bp, Gossypium hirsutum
  Clone ID: uC-gsflnu33B003f09b1
tcacacgtacactgatcttcgctctcttggtttgtttcaggatgcgtaacaaaaataaaactccctccaaccggatgtatatagtcgaatgttatataaacgattgggattatatcctagaacttttgctaatttcccattattcttttacgttagctgacactagaatcgatatggagcaggtaccctgc

SEQ ID NO: 18467 - DNA, 69 bp, Gossypium hirsutum
  Clone ID: uC-gsflnu33B003f11b1
tccataggtccgcactaagccccataagcggggcgctctcgagcagagcaaccctaggaccccaaacat

SEQ ID NO: 18468 - DNA, 311 bp, Gossypium hirsutum
  Clone ID: uC-gsflnu33B003g03b1
ttcacgcgtacgattaatcgatgaagaaaaggagcgtttttggttcagagacaccacagaaaaaatggtatgtagcaaatatagattgaatcaaggtttcaaggtggagattaaggatcatagtataagaatggacaacatacttgggtgagaaaattcagtaaccatatagattagattaatggattttgtaaacgtacaaatcactgacatggatgactgaagaggcctataatatataatgtgtacagaaacaggcccagaaactacaggtttgcctacagtaactaagatattaaacagtaaaaata

SEQ ID NO: 18469 - DNA, 433 bp, Gossypium hirsutum
  Clone ID: uC-gsflnu33B003g04b1
ttcacgcgtccgtccacgcgtccggggaaagcttcatgtgatcactaaagatgccaacaacaatatttcagtcttgcaggctgatgtgcaaaaccattttacttccctatcatcagcttcattggatagctcacctggtgcacatcctgagtctgcagaacctgcaacagcatttgaaacggatctttggagggttattgccacaaggacgactggatcttccgaactagtaagttgtcaggcactcaatatctagtgccactgttggactacttagggatctaagtttcaacttttccgaaaattatttggttgcccttatttgtttcactagatctgttgattttacaagcggcacactgaaattgggatttatgtaagttataacctttactcttgtatccttgtataatataaagcaaaggaattctct

SEQ ID NO: 18470 - DNA, 325 bp, Gossypium hirsutum
  Clone ID: uC-gsflnu33B003g05b1
tccctgcccccttttgctgtccagttaacccccagaatgctcctttcttcatctatgcgccaccatgaacggcgatccgcgcattcgaactccaaaggagtgattttcagccttgagaccccattcggacttcgatttcaacgaagtgaaggggaaatgacagctaacttacatggtacgggcgctgtgctgacgtacgggggctgtgctggcgcaggcgtggctgttggaggatacggtggtcagggctgatgcctgtctgccgtgcgagtgctggaaagagaccctagtgtttcttgatccaaatttttcgtttcattctatg

SEQ ID NO: 18471 - DNA, 200 bp, Gossypium hirsutum
  unsure (1)..(200): unsure at all n locations
  Clone ID: uC-gsflnu33B003g12b1
tccacacgtccgaacaagcgaagaattatgggaacatttttagaacattgacacctaatccaaaatatggaaatgtaaatagttaatcgattaatatngcaaggatgagaatacggtatcgattatcataattgtcacgatgcttgagctgtaaaattatgttatgacataataagagtgatatcgtatgatattgacta

SEQ ID NO: 18472 - DNA, 288 bp, Gossypium hirsutum
  Clone ID: uC-gsflnu33B003h02b1
ttcacgcgtccgattaatcgcacaaggaaaggtccgtttctggtacataggcaccgcatccagaaggtgctatggcaaatgtcccttgagtcaaagtttcaagcgagagaataagggaacgagtactagaacggtcaccatacttggacgggtacacttaggtaccatatacttagcatgagtgagccaggacacgaccaaatctctgacatggattactgaagagcccattatgtattatgcgcacataaacaggcgcaataactacaggttcgcgaactacaatta

SEQ ID NO: 18473 - DNA, 118 bp, Gossypium hirsutum
  Clone ID: uC-gsflnu33B003h04b1
ttcacgcgttcgaagaatagatgaacaaaaggggcgtgtttagaacgaaggccccacaaacagaagatgcggaggcaaatgtgcattgagttaaatgtatcaagtcaggaataaagga

SEQ ID NO: 18474 - DNA, 353 bp, Gossypium hirsutum
  Clone ID: uC-gsflnu33B003h07b1
ttcacgcgttcgaacacgcgtacaatgacaggcagtttttgtgttcgatgagccgtctattatgacactgagactggaaaggaggatccgatcaaaagtggggtatgtagcaattccctatgcaatagaaagcctgcagatatagttcagatcactgtcccttctggcaagaaaatgctaatgcctgaagataacccaaatgccaaccacataatgattgccacaggaactggtagatgtcccttcagaggctacctcagccgcatgttcatggaagatgttaactgttaagttgaaaggcctcgaatggcttctattaggggtggtcaacaaggacagatttctttatagat

SEQ ID NO: 18475 - DNA, 393 bp, Gossypium hirsutum
  Clone ID: uC-gsflnu33B003h08b1
tcctaacaaaagaaaaaataaaaaaaaaaatgaggacaatttaataaacttaaacccaaataatacaaaaaaccaaaatcaatatcatctacaatcatgggccggcccctctctgggtcccacgttttcttccccgggcctgccacttattttttttcctttggggcccctctaatccatttcctgggccccccgttttcccaccctcttcctcggcattcccctgttgggcccccaatttattttccttggacacctccccccctctttcccgtggggatttcccctttggggccccgccccttctgcctttcccaaccctttcgccctcctcttttggctatcgggacatctcccttctccacttccttcttttccccgcggtgtgtgggg

SEQ ID NO: 18476 - DNA, 422 bp, Gossypium hirsutum
  Clone ID: uC-gsflnu33B003h09b1
tccagtcgggcgcatagaagttatgcgtcaacatttgattagtatatggaaactgcattgaagtcgagtgctgccattgtttcagcctgtcaagctttcataggaacggaagaagcagatgaaactgcatatcaatggctgatcaatactgattacaaagctcataaagccctcaacataattgctcgcttctaccatgatttagcgactaatgaggatgaagaaaagagaggactggtttgtggaaccagttgcttcatgaaacaatatggtgttacaagaaaggaagcggtcgaagcttacagcgaattgattgatgctgcttggtaagacatgaacgaaacttgcctgaaacccatgcccgtttcaaacaataatcacgctacgagcttctatttatggccggttaatggacctttttt

SEQ ID NO: 18477 - DNA, 322 bp, Gossypium hirsutum
  Clone ID: uC-gsflnu33B003h11b1
tcatccaggggataaatggaaccagtaatgaaaccttaaaaacgactagtacatgttaatcctctactggactttcgaggtgtcgatggtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccctctttatgggacccatgtttccttccgcgggcagtatatgttaaagttttgtataaagggaccaaaatttaaattatttggcctcagtttcacaacgttcttgaatggtaaaaccca

SEQ ID NO: 18478 - DNA, 222 bp, Gossypium hirsutum
  Clone ID: uC-gsflnu33B003h12b1
tccacgcgtccgcaaacgcgaccagggaagggatcggttttagcacagaggcacggaaaacagaatgggaacttgcaagggtaaaatgggacaagttttcaaggtatagaaaaaggagcataggaaaagaacgaacaagatacaagtgcgggtaaactgagttaccatccaataagaggacgagggtaaggatgcgatgaatcactgactgggatgaaagaa

SEQ ID NO: 18479 - DNA, 488 bp, Gossypium hirsutum
  Clone ID: uC-gsflnu33B004a01b1
tgtacaatgccatagctatggccttcttattagccattatctctggcgccgtcaatgcttgcccttcttccgaccgagaagcattgctagctttaagttcatcgttaaaggagccttatttaggcatcttcgattcatggaaaggcaccgattgttgttccaactggtacggtattagctgtgaccccaccactcaccgagtcaccgacgtttccctacgcggtgagtccgaagaccccattcttcaaaaaaccggccactcatcttccggttacatgaccggtaccattaacccttctatttgtcagctcgaccgggtcactactttaatcattgctgattggaaaggtatcgccggagagatcccatcatgcttggcgtcgttgcccaacttgagagtcttggatcttatcggaaattccttatcgggaaaaatgccagaccagatagggaaccttcaaaagctcaccgtcttgaacttagctgat

SEQ ID NO: 18480 - DNA, 137 bp, Gossypium hirsutum
  Clone ID: uC-gsflnu33B004a02b1
atgataagcaattattagcttgtataaacacgatacatgttttacctatggtttatactgcaagtcctatggttagatttaaaaaaaaaaaaccccaaaatctatataaaaaaaaaaaaaaaaaaaaaaaaaataaa

SEQ ID NO: 18481 - DNA, 493 bp, Gossypium hirsutum
  Clone ID: uC-gsflnu33B004a05b1
ttagccttggttgtatgtttgctggaatgatattccggaaggagccattcttctatgggcgtgataattatgatcaactaatcaagatagccaaggttcttgggacagatgaattaaatgcttatctgaataagtacggtatcgaattggatccccaacttgcatttattgttgggaggcatagtcgcaaaccttggacaaagttcattaatgctgagaatcaacatctggcattacctgaggccatcgactttctcgataagttgcttcgatatgatcatctggaaaggctaactgcaaaagaagcaatggcccatccttatttttacccgattagaaatgcggaaagcagcagaattcgtacctaacatgccaaattcacaaaaatgatgatgtcaagacatagcatcttctttcttcatatgcatggttagatcctcttccctttgtagaatgacagaagatgaaagaagcccttttttctttatctttt

SEQ ID NO: 18482 - DNA, 463 bp, Gossypium hirsutum
  Clone ID: uC-gsflnu33B004a09b1
tccacgcgtgcgcccacgcgtccgaacagattatgtaaaccccatattaaacagaccatattcatacttaaatgaattctttttggctcctaaaaaaaaaaaaaaaaaaaaaaaaaaaaaaaaaaaaaaaaaaaaaaaaaaaaaaaagaagcaaaaaaaaaaaaaaaaaaaaggaaaaaaaaaaaaaaaaaaaaaaaaaaaaaaaaaaaaaaggggggggccctttaaaagaaccaagtttacctaccccgggcatgaaaggaaaaacttttttaatggggcccccaaaattaaattaatggccggctttttaacaacgtggggctgggaaaaacccgggtgttcccaaattaaatggcctggaaaaaaacccccttttccccagtggggaaaaaaaaaaaagggccccaaccaatcccccttccaaaaagttgccaaacttaatgggaaaggggaccccccc

SEQ ID NO: 18483 - DNA, 97 bp, Gossypium hirsutum
  Clone ID: uC-gsflnu33B004b02b1
ttataacgaacaggacaagagataaacataggggaagattaaaagctataggtcggatggttcccaatttacccaaaaagggtattagctagggagg

SEQ ID NO: 18484 - DNA, 489 bp, Gossypium hirsutum
  Clone ID: uC-gsflnu33B004b07b1
tttcaatcaataacctcagcagtaaacataattaaagatcaagatggtgggtcaatggacggcgactaaaccaagccggagcgatgaagttttggactcggatcaacaacaacgaatcaccaaccaggtcagagctcagttcgattcgatggtcccaaaacgacccaccaaacccaaccggagtgaaccggatttgacatcctccaatcccccttcagatgtggaccaaaacatacccgagcttgacaagttacggtcccttcaatctcaatctcaggcgaagatctcagaggggggagctacagtggaacaagaggagtttgtggagacacagtattacagggagatgaattccattgacaaacagcatcacacgacaggaagtgggttcataagagtgatgaaagaaggaggtgaaggaaatggatatgatattcaactggaaagtgggcaggatgcaatcaagaagcctatcttcaaaagcaaccc

SEQ ID NO: 18485 - DNA, 383 bp, Gossypium hirsutum
  Clone ID: uC-gsflnu33B004c09b1
ttgacgcgtggggctgccgatcatcgttcttgatgcctcgtcaaaatcgaagatgaccggcaatcaccaagggaatatgtagttgatctagttggggagccaggaaatattcacggtccggattcctccatcaatggaggattcctttcttcaatgccttcgccatttcaaatttcttatctaaaagagttccagcaacctgacatggatactgcaccgtgttgtcagataaaagatttgaagaattcacattctttttgtggcattgagaaatctcaacagtttaagagcaacgggttgcttgaaagtcaaaaggcaccatatgtttacaccaattgatcaagactgtcttggaatgtcattgatgacttttgaagcttcag

SEQ ID NO: 18486 - DNA, 510 bp, Gossypium hirsutum
  Clone ID: uC-gsflnu33B004d01b1
ttcacgcgtccgggggagtttaaagcagcaatatggtctggcaaagtcggcaaatgaagtgattttggtcattgaagcttacaaggcccttcgtgaccgagcaccttatcctccaaaccatgtggttggccatctaattgggagctttgctttcattgtctttgacaaatccacctccactttgtttgtggcttctgatcaatttggtaaggttcctctctattggggaatcaccgccgacggatatgtggcctttgctgataatgctgaattgctgaaaggtgcctgtggcaaatctcttgcttcttttcctcaaggctgtttctactccacagcagtaggaggattaagaagctatgagaatcctaagaacaagatcactgcagtgcctgctgaagaagaggagatatggggtgctaaattcaaggtggaagggccaacagttgttgctgccacagagtagtcctttgctttcttcttctaaatctatggatccatggggatatagga

SEQ ID NO: 18487 - DNA, 506 bp, Gossypium hirsutum
  Clone ID: uC-gsflnu33B004d05b1
ttcctgctcctcgtctgaaaatctgtgatttcggttactcaaagtcatctttgctgcattcaagacccaagtcaactgtcggtactcctgcttatattgcaccagaagttctttctcggagagaatatgatggcaagatggctgatgtatggtcatgtggagtgactctttacgttatgttggttggtgcttacccatttgaggaccaagaagatccaaagaattttaggaaaactattagcagaataatgtcagttcaatacaaaatcccagactatgttcatatatctcaagattgcagacacctactttctcgcatatttgttgctagcccctccaggaggatctccataaaagatatcaagagccatccatggtttttgaagaacttgcccagggaactgacagaggcagctcaagctgcctactatagaaaagaaaacccaactttctcccttcaatctgttgatgaaatcatgaaaatagtccgaagagcgaaagtagct

SEQ ID NO: 18488 - DNA, 471 bp, Gossypium hirsutum
  Clone ID: uC-gsflnu33B004d07b1
ttcacccctcccttcctctctgcttttactttgctaagtccaagctttcgacaatggccgaaccctctaccatttcaccagctcccctcttgaaagatgagctcgacatagtcattccaaccattcggaacttggactttttggagatgtggaggccctttttccagccttaccatctcatcattgttcaagatggcgatccttccaaaaccatcaaggttccggagggcttcgactatgagctttacaataggaacgatatcaacaggattttgggtcctaagtcttcttgtatctctttcaaggattctgcttgtcgctgctttggttacatggtttccaagaagaagtacatttataccattgatgatgactgctttgttgcgaaagatccatccggcaaagacattaacgcactggagcagcacataaagaaccttttttgtccatctactccgtttttcttcacac

SEQ ID NO: 18489 - DNA, 503 bp, Gossypium hirsutum
  unsure (1)..(503): unsure at all n locations
  Clone ID: uC-gsflnu33B004d09b1
ttttgccatgagggaggctgggaaacctggaatgtctgatgaagaggtgcctttacatatttgttatgtgatatattacattctttcgacttttcacttttggtgaagtattcgtgcttgagggatatgggtattgaaatataatcctctaaggatcttttataacttttaaatatatcagggacgaagcccgaagtttatctttgggatcaaaattaaattataaaaatttagaaggatcaaaatataattttatctttgtatatgtttgttattttagaattttaaagggattaaattaaaatattttcatctgtggagggagaggggggcaaaattacattttaaaattttaaaattttaaaatggtcataggactatgttatctttgtatatatgcttgntattttaggattttaaaacgactaaactgaatttttttaatctggnggagtgtattttttaccattaactaataattttaaaacctaaggatcgaaatg

SEQ ID NO: 18490 - DNA, 429 bp, Gossypium hirsutum
  Clone ID: uC-gsflnu33B004e01b1
ttcacgcgtccgcccacgcgtccggttggctcggatcggctcgtctaagactccggtcgagatggaggaggatgaggaggaggcacccaaagagctcaacacaataaatagctcaggagggttcttggatgtggcgcctgataagttgtcggtgaagtatacgagcgtaagcctccatggccacgatgtcggtgtggttcaagccgataagccggctccaatgaggcgtctgctttattacttcgagattcatgtgaaggacgctggggcaaagggacagatagctattgggttcaccaatgaaggctacaagatgcgaaggcaaccagggcgggaagtaaacagttgcgggtatcacgccgatgatggatagctataccgtgggcaaggaaagggagatgcttttggtccaacatatacaacgggaga

SEQ ID NO: 18491 - DNA, 94 bp, Gossypium hirsutum
  Clone ID: uC-gsflnu33B004e12b1
tactataccaggccttggggatgaataatttggtagttttttagagcagcaacggggccgccccccctgggctatctacaaaaaaaattttttg

SEQ ID NO: 18492 - DNA, 432 bp, Gossypium hirsutum
  Clone ID: uC-gsflnu33B004f01b1
tagaagacctgcaaggtgttatcgtcagataaaaaacaaaccttacccgaagtcacgttattgacgtggtgttcctgatcccaagactaggatttatgatgtgggaatgaaaaagaagggtgtggatgagttccctttatgtgctcacttggtctttggggagaaggaaaatgtctctagagaagctctggaagctgcttgtattgtttgcaacaagtatatggctaagtatgctggaaaggatgccttccacttgcgagaccgtgttcacccatttcatgtaacgcgtatcaacaaaatgctttgatgtgctgcagctgataggctccaaactgatatgcgaggagcttttggcaagcctcatggatcatgtgctagagttggcattgtttaggttcttctttcaattttttgcaaggacagcatcagtta

SEQ ID NO: 18493 - DNA, 504 bp, Gossypium hirsutum
  Clone ID: uC-gsflnu33B004f07b1
tttgacgcgtgggcggacgcgtgggcggacgcgtgggaaaaaaaaacacaccctaaagagacaatgagaaagctgctagcctttgcctttcttttcttcttcttttgggataaaacattagctcaaatagctccggcgccgccgttaaaggtggacaacatcacttccatcctcgaaaaaggtggccaattcaccactttcatcaagctattgaaagccacacaggtggctgatcaactaaacaaccagctaagcacaccggaccctaacgacgggataacggtgtttgcaccgagtgacaacgcgttctccggactcaaacccgggacgttaaactcactttccgaccaagagaagcttcagttggttcagttccatatactcccgacgttaatgtcgacgtcgcagttttaaaccgggagtaaccctttgggaacccaagctggggatgttaaaggggggaaaggttccctttaatgtgaccgcggaggggaaccaattgaa

SEQ ID NO: 18494 - DNA, 438 bp, Gossypium hirsutum
  Clone ID: uC-gsflnu33B004f08b1
tggacgcgtgggcggacgcgtgggcggacgcgtgggtttcatcttgtttttactcacgagagatgtttctatcactggtaatttcgttccttgttttgatctacattttattggctgttttggagtttcagtggaacaataatggagttcgttcttcgctgtttcttcaagattgttgcttccctatgtcgcatctcgtttcgaaaaagatgggtaattttgtgagtgattctaagtttttgaatgtattggaaaatgaagcgtttttcccttagcgatttgcttcaccaaaaaagaaagaaaaaagtttggattaatgtttttttttggggtttaatttgtagggtattaaccaaaggtttaatttagggtttcaatgtaaaaagaaatgttaaaattctgttgacataaaactctggatttcctctttagtttgct

SEQ ID NO: 18495 - DNA, 353 bp, Gossypium hirsutum
  Clone ID: uC-gsflnu33B004g06b1
ttccactgtgccagaaggtgtggtgactgctgaatcgagtagaagaggagttgttaatagtgggaggaagcagatggcgaggggcacaaagaatttggggaagttggatttgaatgtggagtttagtaatgaagttgaagagccggcaccgaggaggaatgaggggaatcaccccagctatggggaggaggataacattgaagggaatgggttctttgagggtcttgatgagtttttgagtagcttgcctatactttcagctgttggggatgataaagttaaggctacttagtgaagtaagatccttgctttttgttttttcgcaatagttgtatgttgtgttactgctttgt

SEQ ID NO: 18496 - DNA, 438 bp, Gossypium hirsutum
  Clone ID: uC-gsflnu33B004g07b1
ttattactacaataatctgaaagaaaacgaccttgagtatggaggagagcatcaaaattttttggaggctttaagccctagctgcctgtcccttatgaatcatcttcgcatttatatccctgaagtaattacttttaaaattctgcatttgatttgttctgaactttgaaattcagttggcattgaaatgttctaattttcatgggttccacagctgtttccggaactcaacaagatagtattcttggacgatgatgttgtagtacaacatgacatatcatctttgtggacattggatctcaatgggaaaatcgttggtgccgtcgttgattcatggtgtggagaaaactgctgtccaggaaggaaatacaaggactacttgaatttttcacaccccggaattccatctcacctcgaccaagattcgttgtgcatggc

SEQ ID NO: 18497 - DNA, 404 bp, Gossypium hirsutum
  Clone ID: uC-gsflnu33B004g08b1
taaacccattgggcaattgggaaattagggcagagcaaaaatggcgagaacatcatccagcaaagaaaatgctcaagctttattccattctcttcgctctgcttatgctgccactccagtcaatctcaagatcattgatctgtatgtgggtttcgcagtcttcaccgctctgatccaggtggtttacatggctagcgtgggatcatttcctttcaactcttttctttctggagtgctttcttgtgttgggactgctgtccttgctgtttgtcttcgcattcaggttaacaaggaaaacaaggaattcaaggatctaccacctgagagagcttttgcagattttgttctttgcaacttggtgctccatttggtgatcatgaattttcttggataaaatcataatt

SEQ ID NO: 18498 - DNA, 392 bp, Gossypium hirsutum
  unsure (1)..(392): unsure at all n locations
  Clone ID: uC-gsflnu33B004h02b1
taaaatctttccagtttcaattttctcacaacaaaactgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttgagggtngngatgctccgtgtggagacaactgcaaacgcagcccttgcacttgcgggaagtgaacaaccaagagaagctgagaggccttggtcattgtaactaattaaactgtattactttagtatgagtcatccaatcttgatgaggattcggtcactacttatgagtgatgtgg

SEQ ID NO: 18499 - DNA, 457 bp, Gossypium hirsutum
  Clone ID: uC-gsflnu33B004h03b1
tttccatggtcgcttctggcactacaggagtagctgtccctatacaaactcagccttctgctactttctctagttctccacatcagcttgcctaccaacaagctcagcacttccaccaccaacagcagcagcaacaacagcagcagcttcaaatgttctgggctaaccaaatgcatgaaattgagcaaacaacagacttcaagaatcacagtctcccacttgctcggataaaaaagataatgaaagcagacgaagatgtgcggatgatatcagcagaggctcctgtaatttttgcgaaagcttgcgaaatgttcgtcttggaactgactttacgctcttggatccatacagaagagaacaaaaggaggacactacagaagaatgatatagcagccgctatttcgaggactgatgtctttgattcttggttgatattattccagggatgagttgaaag

SEQ ID NO: 18500 - DNA, 412 bp, Gossypium hirsutum
  Clone ID: uC-gsflnu33B004h04b1
tgttgatgcttcaagagtacagatatcaaattcaaaagggaattataatgagaaatcaatttacagtgttgcttcaaatacacttaatgctaggatgaacaaagtgtttgatcctgaagtggctgctctgcttgatgatagtgatttgttgcgttttggatctgatgttgaggatttggaggaggatttttgttgttagggcaaacactggtgaagaaggggagggtgatgagagtggtaagaagtgcatactaagatgtgcggatgatatcatcagtggctcctgtaatattttcgaaagtttgctatttgctcctcttggtactgactttactctgttggatccatacagatgataacaaaacgagttcacttcttaagaatgatatagtagtccgttttttccggactg

SEQ ID NO: 18501 - DNA, 445 bp, Gossypium hirsutum
  Clone ID: uC-gsflnu33B004h05b1
ttaatttttcgcacatgtagggatattagcagtaaccaaatgcacgagcttatgaggctttatgacaccatacatagtgatcatgaaggtggaaatgttagtgcccacaccggtcacttggtgggtagtgcgctatcagatccttatctttcctttgcagctgcattgaatgggttagctgggccgcttcatggtctggctaatcaggaagtgctactttggataaaatctgtggtagatgaatgtggagagaacatatccaaagaacagctgaaagactatgtctggaaaacactgaacggtggaaaggtcgttccaggatttggtcatggagtgttgcgtaaaactgatccaagatacatgtgtcaaagggagcttgctttaaagcacttgcctgacgatcccgtgttcaagttggtttcacagctttatgaagtggtgcctc

SEQ ID NO: 18502 - DNA, 426 bp, Gossypium hirsutum
  Clone ID: uC-gsflnu33B004h09b1
tgccacaccccatggcaacaagaagctggatagtgcttttgaagatgcacagagaatagctgcagggaaacctaggggctgttcaatcttccttttcttttctgttaatgccagtggacaattctgcggtgttgcggagatgattggctcagttgacttccaaaaggcaatggatttttggcagcaagataagtggagcggaagcttccctgtcaagtggcacatcattaaagatgttccaaatagccactttagacacatcatagtagagaataatgaaaacaagcctgtgactaatagcagggatacgcaagagataatgttcaagcaaggtgtggagatgctgaaagtattcaaaaatcatacaatgaagacttctttacttgatgacttcatgtactatgaaaatcgtcagcgaatcatgca

SEQ ID NO: 18503 - DNA, 433 bp, Gossypium hirsutum
  Clone ID: uC-gsflnu33B005a09b1
ttgacgcgtgggtttttttttttgaagctttcggcaatgggcgcctctgaatcgtctctcgcagcttattcactgagttcggccgatcaaatctccactatttctcagcgatcggaaacagtcgatccgattttagagaagcttaaatcccttagaattacatctcctatactgaccacaccgccaacggatggtagcttaacggacattttagtgcgaagaccgtcgtcatcttcatctcaagctgctgtaaatccaaaggtgttcctggagctgttatcagcgtaccgtgattggcaagaggagaaggctcaaacgatttgcaagaagcaggaggatatagaatacaaaatagaagtcgctgacgctttgacagttaaacttctccaaagttaaaccactcagtttccacaatgaagactgctttacaaca

SEQ ID NO: 18504 - DNA, 387 bp, Gossypium hirsutum
  Clone ID: uC-gsflnu33B005a10b1
tttacgcgtccgtccacgcgttcggaagaagatgtcgagggcgcaagacgggatattgaagtacatgttgaagatgatggaagtgtgtaaggctcaaggttttgtttatgggattattccggaaaagggaaagccggtaactggggcatcagacaatcttcgagaatggtggaaggataaagtgaggtttgatcgtaatggtcctgctgctatcgcgaagtaccaggcggataatgcgattccggggaacaatgatgggtgtaacttgatcggtcctacaccgtacactttacaagaacttcaagatacaactcttggttctcttttatctgcactgatgcaggactgcgattcaccttagaggcggtttcccttagagaaaggtgt

SEQ ID NO: 18505 - DNA, 376 bp, Gossypium hirsutum
  Clone ID: uC-gsflnu33B005b06b1
tttacgcgtacgcccacgcgtccgagaacacgtggacgaaaacatatatggaggttcatcggagttccgcccaaccgtccctgatattaaggatttcatgcccatatacatgaacttgacagcatgcatgaaagtgtccctgctgttgcaccacggagtttccgtgtatcagtcgatgcaaatgctgaaatacaacaatgggattatgaacacattgtcaactgatggagctaacatgtatgatttgaccattcaaaacaacgtagaagtggtgacattggagactaaggccatgactgcatagattacagggactttgtaggatgaagagtctttgattgcttacaaaattaacaaggtattggtgtccatggag

SEQ ID NO: 18506 - DNA, 494 bp, Gossypium hirsutum
  Clone ID: uC-gsflnu33B005b07b1
tttagccgcctaaaagagagccgggaaaggaagctagaagagcaaagcgaaaatgaagactatactttcctccgagacaatggacatccccgatggggttagcattaaggtcaaggctaaggtgatcgaggttgaaggtccaaggggtaagcttacccgcaacttcaagcacctcaaccttgatttccatctcatcaaggacgaagagaccggcaagcgtaagctcaggatcgaggcttggtttggctccaggaagaccagcgccgccatccgtacagctcttagccacgttgagaacctcatcaccggtgtcactaaaggataccgttacaagatgaggttcgtctacgctcactttccgattaacgcctccatcactaatggcaacaagtcgatcgagatccgtaacttccttggcgagatgaaggtccgtaaggcggatatgttggaagggtgtttcattgttcgatccgagaaggttaaggatgagattg

SEQ ID NO: 18507 - DNA, 494 bp, Gossypium hirsutum
  Clone ID: uC-gsflnu33B005b10b1
ttcacgcgtccggcgatggcgagtgttcgatctggtctcctacgagcagcccttcgcggcggctctcgtcctactgctcctcccacgcgtggcttcgcttcctcttctcatcacgatgatgcttatgaaaccgcaaaatgggaaaagataacatatttaggtgttgctacctgcactgttttagcgatttataacctatcaaaaggtcatccccaccatgaagagcctcctgcatacccatatttgcacattcgcaacaaggagttcccatggggtccggatggtctgtttgagagaaaggagcatcactagggatggccggatggatgcatatctttccgagttcggcgcatttttatcatttctctgagaaatcaatcagataattctgtggatcttttgtaattttagcactcgattttcggtttatggactttgaattgcaagttcatcaggctttctatatgtttgtgcctgcctaccatacctctgtt

SEQ ID NO: 18508 - DNA, 441 bp, Gossypium hirsutum
  Clone ID: uC-gsflnu33B005c05b1
tttaattcccgttttctaatctttttgggaaatcggtagcaaaaaaatgtcgtcgtcggggaggaagatcacccttaagagctcggacggcgaatcattcgaggttgatgaagcggtggcgttggagtcgcagacgattaagcatatgatcgaggacgattgcgctgataacgggataccgttgcctaatgttacgagcaagatcttagcgaaggtgatcgagtactgcaagaaacacgtcgaggctcctaagacagacgatcgatccgccgatgacgagctcaagagttgggacgctgactttgtcaaggtcgatcaagccactctctttgatctcattctggcaggggaccatttgaacctcaagggtttgctggatctcaattggcaaactggtgctgacatgatcaagggaaagaccccagaagagatcaagaagac

SEQ ID NO: 18509 - DNA, 415 bp, Gossypium hirsutum
  Clone ID: uC-gsflnu33B005c11b1
tttccgagtcataaactcggagctcgaactcaatcacagtgagagaaagagagtcgatttccttttctcaaaacaatttaaaaaagaaatcttttattttctgtgaatttctctttgactctttcggcactctctgcaactgcaatcatgacctcaattgtgcaaggcttttccaagtctttggccatgactgtgctatcggagatcggcgacaagacgttcttcgctgccgcgatcttggcaatgcgccatcccaggaaacttgtcttgttaggatgcctggcagctttaattgtgatgactattctttctgctgttgttggctgggctgctccaaatcttatctctaggaaatggacacatcacattacgactctgcttttctttggatttggcctgcggtctttatgggatg

SEQ ID NO: 18510 - DNA, 235 bp, Gossypium hirsutum
  Clone ID: uC-gsflnu33B005d01b1
ttaaaacgtatgtttgttgcacatttttttatcctttgtaaagttgtagaccagagcatgaacactttatggatggatataagtattaaagctcgtctgaaaagaaattaagtgacagccatgaatgatgtaccgacctttagcacggagaatatgcaaaatatcatgaaagttatatattacatgccgtacgtttatgtctattataggtggagttattgctgtgaattttagg

SEQ ID NO: 18511 - DNA, 496 bp, Gossypium hirsutum
  Clone ID: uC-gsflnu33B005d07b1
taaaagaggtcttccgtctcatattcttcgatcctctggaaagttgtagaccagagcaagaatacattatggctggacatagtgattcaagttcgtctgaaaagaaatcaagtgaagccatgaatgatgtaccgacctttagcacggagaatatgcaaaataacatgaaagttatatattacagccgaacgtttatgtctatcatcggaggagttattgctggaattttagggttcacaggctttatggggtttatcttttattttcttgtcatggcaattactttcaattggactcatagcaaaggcaaagtgttcagtccatttatattttgatcgctggaaccgtattattactccaaggtttaatgggcggtcttattgtactcgtgcttttttggacattttcctaccttcattgttcttcttttctgagcaaaatcttttacactcaacaccttactggtttgtggtacctgtttcttcccctatctttt

SEQ ID NO: 18512 - DNA, 300 bp, Gossypium hirsutum
  Clone ID: uC-gsflnu33B005d10b1
tataattacacagctcactgataacgtctacgtttgccgttctggatccgctgctgattctcagattgtttctgactacgtccgttatttccttcatcaacatacgatacaacttgggcagcctgcaactgtcaaagtttctgctaaccttatcaggctactatcctacaataacaagaacatgcttcaaactggtcttattgttggagggtgggataagtatgaaggtggtaaaatatatggaattccccttgtcggaacactggttgagccgccctttgcttttggaggacctggctc

SEQ ID NO: 18513 - DNA, 473 bp, Gossypium hirsutum
  Clone ID: uC-gsflnu33B005d11b1
gtactattcctatcccttcctccccccaaaagaaatctacccaaagctccaattctatacccaaagctgctgttattgtgattttttgagttctgggtatggaagaaacagagaaaccaatagaggtattagctatggaagctttgggaaaagggtacgatataactggagatttcagattgaaatatgctaaaggaacaaggttactggtgcttgatgaaaccaacaaacgagacattgttttcccaggtgctgcttcttttactatgaaagaagtttctcaagatattcgtcttgataaaggcgatcgtattcgtttcaaatctgatgttcttgaattcaatcagatgtctgagttacttaatcagaagtcttctatacaaggaaaagttccttcagggtatcttaacagtatcttcgatttgagtggaaattggctttatgatgctgcagacaccaaaactcttgctttc

SEQ ID NO: 18514 - DNA, 447 bp, Gossypium hirsutum
  Clone ID: uC-gsflnu33B005e01b1
ttgaacaacacattgtttgcacaatgaatacttgtgtgtgttgttcgaacttcgaacctatccagcatctgcaaatgatgatgaagattttgaagccatactcaggtgtttgtgattgtatgttaccgtgagtagtgcatttttaaggtttaattctaaatactgctgaagggcacctcttcagtggccgctttagggttaattttgcgtttgaacttccccgcctgtttgcttgagctaaaaagaaggagaaagttagtgtgttttcagaaatatgggttttgattggtttctctgaaaatggtaggaagggctgatagatgaaaatgggcagttgcaatgttgatttcagggatggtgctttgatggatgtggatcttgcactaggagtctaggattccttaggctggatctcaaggtccagaagcccgtgcttgcttttttgtt

SEQ ID NO: 18515 - DNA, 211 bp, Gossypium hirsutum
  Clone ID: uC-gsflnu33B005e12b1
ttcaagccacggtaaaagaggacagctaaccgacatggtgccagcagcgcaggcccgatatgagacccagatcggaagcgctcatcagggcagcggggggcccagtaggcccaggccctatctgaagccgtccaaaggcatgagaaggacctgagggaacacaaagcagcgtctagaaaagagatcaagacgggaaaatggctaaaagaaa

SEQ ID NO: 18516 - DNA, 391 bp, Gossypium hirsutum
  Clone ID: uC-gsflnu33B005f11b1
tttaaacaatggcgtcctcggatcttattggcaagctcgagactgatgtcgagatcgatatttctcccgaaaagttccaccatatgtggtgccacaggccgaaccatgtccaccacactagctctgaaatagtacatggatgcgatttacatgaaggtgaatttggaactcccggcgtcgttatctgctggagatatgtgcatgatggaaaggctaaaactgcaaagcaggtagttgaagttatggaccatgagaaaaagtcaataactttcaaaatgcttgaaggagatctgatggaggaatacaaaagctttgtgatttacaatccaaactttccccaagagcgacggtaaaggcagtataatgcactggactctggattatgaaaagc

SEQ ID NO: 18517 - DNA, 485 bp, Gossypium hirsutum
  Clone ID: uC-gsflnu33B005g10b1
tcctttctgttcttttatatggttctactactggtttctgtcgcgttttctcttcggaaagctgtcgttttccggcgatttttaattttggtgcctctaattccgatactggtggcttcgctgccgccttcattcaacctaagcctcctaatggagacaccttttttggaatgccgtctggaagagtatgtgatggacgactcatcgttgatttcaccgctgagagtttgggtttgcccttcttaagctcttacttgaattcactggcaaccaatttctcacatggtgcgaattttgcaacggtgtcttccaccataagattaccaacggctgatgttatcccccaaggccaggagaaatatatgcaagtctaatgccaagggaggaaacttttgccaaggcattatacactttcgaccatcggccaaaatgatctcacgcatagtctctttcttaacatgagcatagtgcaagttatcgctgcc

SEQ ID NO: 18518 - DNA, 151 bp, Gossypium hirsutum
  Clone ID: uC-gsflnu33B005g11b1
ttcacgcgtccgattcggacgggcgaagtcgtggttgtagaggcgatatattttttgaaagacgtcccactcccaccattgttaattttggcgtcgataagtgtgatactatcgagatcaatgccacctccatcatgcgtaaacttactaa

SEQ ID NO: 18519 - DNA, 95 bp, Gossypium hirsutum
  Clone ID: uC-gsflnu33B005h05b1
ttctgattatagttttgactgtgaaaaaaaaacaaaaataaaaaaaaaaaaacaaaaaaaaaaaaaaaaaaaaaaataaaaaaaaaaaaaaagaa

SEQ ID NO: 18520 - DNA, 464 bp, Gossypium hirsutum
  Clone ID: uC-gsflnu33B006a07b1
tgtagtgatggtatgcattctcctggcttccactctttttacccctacttttaccatggctcgacagctgggggagaaggacatcaatgatccaccagtgtttaccactgctacggcgggtgaacataatgaacctcgaaattgtggccgtggaaagtcttataaatactgcataggacctggaactccttctatggacccaccctgttccgtttataaccgccacggctgctaagagtagccaactaaaccttgaatgtaatgggcaagctataggatccattggcgaaattgtaatgcgaacatattaaaaccagatcacgaagttagttacattacctgcccatggttagtgtttttgtcaagacaattatgtagtttggttcattatatggagtgtgtctgcaataacgaggtatcatgagctcatcatcattggcttcttaaggctttcaattactatc

SEQ ID NO: 18521 - DNA, 440 bp, Gossypium hirsutum
  Clone ID: uC-gsflnu33B006a08b1
ttttggaacatcaaatcaactattattgcaacaattattccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaggggacccaggctctgtcccgggggcagggaaggctaaagtttttttatgggggacactaaagtgaatccacggcccggggtttaacaacctggagacgggaaaaaccctggggtctcccacctaaacagagtggcaccaaagaccccttttcccagtgggcgaaaaaccaaaaaggccctaacggatcgcctttccaaacaatggcgcacactgatgcggaaatggaccccgccgtgtatgggttcataaagcggggggggggggggggtta

SEQ ID NO: 18522 - DNA, 359 bp, Gossypium hirsutum
  Clone ID: uC-gsflnu33B006b01b1
ttctttcaaaactggataaattctcgttgctaagcgtatctcgcttgatattttagagggcgaactggcgaaacataagtcttacgccgaatatctgcttcaacagctatttcgtgcgaagaatatacatttaagggagggggaaacttttaagggagtagtagaaaatcatttggtttttgaagagcccttaaaagagcaaattgatgggctctatcaaatctgttgtgatctcattctaaatggggccaacagtagctactttctaaaaattgtggaattatatggatccacgcttggtatgtagccaagcccaagaaaaaaggaacgaggggaagaatcgacacggaatccataac

SEQ ID NO: 18523 - DNA, 366 bp, Gossypium hirsutum
  Clone ID: uC-gsflnu33B006b04b1
taccagctgtctccaaacctggccctgctcctgaaccagtagatatttccaagcaaattcctgctggtattaacagtatttccgcaaacaattacatgcgtgccgatggtcagaatactggcaatttccttacggatcgaccttccaccaaggttcattctgcccctggaggcggatcttctctggactacctatttggtggacctggaggtagtaaatgagattgtgccttaataacatgtaataacatctttgataagggagagtattgttggagcattcttattgctttccctaaatacacacttttctcttactgcgcctttgaatgtctgcacttgactgggcttaaagaccacctaatgt

SEQ ID NO: 18524 - DNA, 397 bp, Gossypium hirsutum
  Clone ID: uC-gsflnu33B006b05b1
ttattccttagcccaaggtctgaaccccaaatgtgacatccaagaaccatggctcaaacctgcaagtgttccatgtttacagtccatgctcacccttgaaaccctcaaaaccactctcatgggaagaggatgtgctgcaaacgctagccaaggaccaagccagggtgcagtttttgaccagcctcgtggctaagaaatctgtggtgcctatagcttaaggcaggcagattgtgcaaagtccaacttacattgtgaaggccaatattggaaccccacctcaaaccatgcttatggccatggatacaagcagtgatgctgcttgggtgccttgcactgactgtataggctgctcttctactgcttttgactaagctaaatgcaccactttcaagaccct

SEQ ID NO: 18525 - DNA, 342 bp, Gossypium hirsutum
  Clone ID: uC-gsflnu33B006b08b1
tacgattgataacgtgaaagcgaagattcaggacaattaaggaattccaccagatcagcaaaggttgatttttgctgggaaacagctggaagatggaaggactttggctgattacaatattcaaaaggagtccactcttcaccttgttcttcgtcttcgtggtgggttctaagccttaaggtcttccttaatgtgggttttctggtattacgtgaaggattgtgccctttgatggccttttaaataatcgttaatacgggattgccggatggctatatgtgtggtttgttgttgaacggaatctgcatatgcacctatattctctgctcgtgtcaaactatc

SEQ ID NO: 18526 - DNA, 354 bp, Gossypium hirsutum
  Clone ID: uC-gsflnu33B006c03b1
tcacgcgtccgcccacgcgtccgcaaaagcaaaaggctaaagagtaaggcccccttccctttgttgacatcctcaccaaatctcttgcttttcttctctcttgctactctcctctaatttttcaccttctgatttgtttaaagaggcaaacaacacaactcgtttttatccttatatatcagtttgggaaaaaaggtagaagaaatgaacggtgatgatgctcagagtatgatggaatcccagtacatacagagacatcacaggcacaacatcagagacgaccagtgcacctatgctctttgttaaacacatcaaagctcctgttcaatctcgtatggtcattggtaaggagat

SEQ ID NO: 18527 - DNA, 273 bp, Gossypium hirsutum
  Clone ID: uC-gsflnu33B006c05b1
tcactcccacatcaaacaaaccactctcacattaaatattgttagtgaaacaatggcgtcttcagctctgataagtaagcttgaggcagatgtagagattaaggcttctcctaagcagttccatgaaatgtttgcccacaaaccgcaccatgtgcaccatacttgttatgacaagattcaaggatgcgatttacatgaaggtgaatgggggaaagtcggtaccattgtccattggagttatgtgcatgatggaacggctaataaggtatatga

SEQ ID NO: 18528 - DNA, 222 bp, Gossypium hirsutum
  Clone ID: uC-gsflnu33B006c06b1
ttcaatcacccggagatgcagagatgaacaagaaccctttaatcgtcaccgccctacatatgcaagacatcatggccatcgctgattacctaaacccctacgacgggtggggcgcatgatggaatgggtgctctcgttcctatcaggaagatcacatttcatgaaaggaatggattaagaaatgccaaacacaaggacgaagcatgggccaccgccatagag

SEQ ID NO: 18529 - DNA, 286 bp, Gossypium hirsutum
  Clone ID: uC-gsflnu33B006c08b1
tataaaaaaaaaaaaaaaaaaaaaaaaaaaagaaaaataaaaaaaaaaaaaaaaaaaaaaataaaaataaaaaaaaaaaaaaatataaggggcggcctttttggggggcccttgtttacgttccgggctttgcgacgcggtagtttgtctttagggttcctttattttatttccctggccgcctttttcgcccgtcgttcctggaaaaccccgggggtatcccaatgggatgccttggctgatcctccccttttcccgggctggtttaatggggggggggccctgc

SEQ ID NO: 18530 - DNA, 405 bp, Gossypium hirsutum
  Clone ID: uC-gsflnu33B006c12b1
taagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatagtcaagaaaccctacatcaacgtcaacgaaacccttgaatggaccatcgaaagagacgtgccgacgtcgacgttctttatccgagcctacgctttggactccgacgaccacgaggtggcgtacggtcaaaacaccgacgctcagaagaaaaccaatctgtttgaaatccaagccatcaccggccgccatgtttcgctcgatatagcgtcgcgttgttttaatgctttttccgttgt

SEQ ID NO: 18531 - DNA, 217 bp, Gossypium hirsutum
  Clone ID: uC-gsflnu33B006d03b1
tccacgcgtccgatcgagggcgagcactctccttcctttttctgatgcttccggtatcgcatttcggtctggcaaaaaaggctggtactaaccgctgccgtggacttgacccataaacaaccccacctcaatacctctattcctttccaccaataacccagatttggtttttatatgttatacgccccacataataacagaacaaacccattgtttc

SEQ ID NO: 18532 - DNA, 215 bp, Gossypium hirsutum
  Clone ID: uC-gsflnu33B006d04b1
gtaagcaagtatggctaaggacgttgcggccggcggcattacttgtagcttcgacaagcctccaagctcagcacacacggtttcgaacccgtttcggacaataccgtctggttagactctcactccaagtcgtcttcttcgattgcaatttacgccaggaagaataactccaagtctgagccgtttatggagccaacctttgatgaacacgtcac

SEQ ID NO: 18533 - DNA, 395 bp, Gossypium hirsutum
  Clone ID: uC-gsflnu33B006d07b1
cgcccttcgcaacccgggaaacaccgaaccaaaacggggagatttaaaggaaaacagcggaacacgcacaggcaacggaaaaagcaccgacaaaacaggaacacacgaaacacacccaacaagcgcagagaaaagggaacacaaaaagctcgaaaaaacgaacaaacgaaaaaagcaagaaccagcaaagcaagaaaacgaggacggacacgccacggcggtgaaaactaaaaaaaacgatgaaaaccaacagcagatagaaaaagtagagaaccaaagccagtatcaagggaccagaaagaagccggaagaaaaccaggccgcaaggagaaacaaaaagaagccaaaacgagggcccccggaggagaggggaggaaaaaaacactaaagcaaga

SEQ ID NO: 18534 - DNA, 310 bp, Gossypium hirsutum
  Clone ID: uC-gsflnu33B006d08b1
taaatacgcaaattcaactccaggctgaatattcacgtgtcgacaggtggcgtgatagggaacgggcgggtaccgatagacttactgaacaagatgttaacgaggttgggagattggaaaccacccggtagcgtcagagtccaggcggaggcggttgaaaccctgtcgctaggagaaactaaaagaagccaaaccgttgccccttggaggagaggcgttgaattcaacttcttttgcaagaggacgtaggcatgttagtatagctcttgcagtcaattgggctgcactatcggaggaatccgcctttgga

SEQ ID NO: 18535 - DNA, 434 bp, Gossypium hirsutum
  Clone ID: uC-gsflnu33B006d10b1
tgaccgtaaccgatgggataattacccaagtgagggaatacttgaacacttctctcaccgttactcgccttggaaactctacccaatctccactgtccgactacaatcctccatcatcatcatcatcatcgacgggtgagattacctcggtgcattgcccttccgtctgggagagcagcattttccaacagggttggaaaatccgtgccgggtcttgtcctggcaatttagtcatttcactatcatatatctttctgatcaggtgcagccgtgagtaggaataaaataaaataaaaggagtactttcgtgtcagctccttattggcctttacttgctgatgcactaaaaaacagtgtcgtttaaagagagagagagatcaaaaatgtgaatttggtttggaccctgttcggtagggtcatattattatcctgtt

SEQ ID NO: 18536 - DNA, 532 bp, Gossypium hirsutum
  Clone ID: uC-gsflnu33B006d11b1
tttcacgcgtccgctcactcaacattcccatttccaatctccagctcccaaggtaaatatgccgatcagaaacatagcagttggccggcccgaagaggcgactcaccccgatgctctcaaggcagctttggctgagttcatctcaaccttgatcttcgctttcgctggatcgggctcaggaatggcttttaacaagttgaccgacaacggagcaacaaccccggccggtctcgtagccgccgctctagctcatggcttcggtcttttcgtcgctgtctcccgtggggccaacatctcaggtggccacgtcaacctccgtcgtcaccttcggtgctttcgttggcgggaacatcactctcttgcgcggcattctttactggatccgccaacttctaggcttaaccgtcgcttgcctgttgcttaagttcgctaccggcgacttggctgtaccagcttttggattggtatcaggtgtgggcgtgtctaacgcattgggtttcgaaatcgtgatgaccttcggattggtgtacac

SEQ ID NO: 18537 - DNA, 211 bp, Gossypium hirsutum
  Clone ID: uC-gsflnu33B006d12b1
tcctttccaagtggtgggaacctcctcctttgtttcctgcatgttccattagcagacgtttcctgtaacttgcttttatgtattcttcgtgctactgtatgggatattaattgcttccttggaaagatcatggggaggtacatgcagggatttatgcaaactttatgtatcaactaataacgctaattctctcaccttaacttaaaaagaa

SEQ ID NO: 18538 - DNA, 514 bp, Gossypium hirsutum
  Clone ID: uC-gsflnu33B006e02b1
tactgtaacaatgatcccaggcaaaggtcgaccgctgactcaggaagactgtgaaggcggaaaatttgcacctttgatgctttttgactgcaggggttatgagcctgtagggtttgtatttggcgttggctggaaggttgaatctctggaaggaactaaatttgaaggtattgacttatctggagacgacttctctgaatatgatgagaagggagagtgccctgtgatgatatccaacctccgttctacttttgaaccggtgaagtagagtaatactgcacacttttagtaaataaaaactgacaggtcatcatgaagtgaggtcgaaaccattgaccggaatacatgttggcattaagctattatatcctaaggtctgatgtgaaacattacagtttggtgcatgtccgtggatacactggcaatggttttactgattagtgaatcacgttatgctgtacttttatggttttctcagttttcagaatgattgcactaggtgcaatcacttttc

SEQ ID NO: 18539 - DNA, 269 bp, Gossypium hirsutum
  Clone ID: uC-gsflnu33B006e06b1
tgacacttgcgatcaaggttactaatgaggaaactattgatgttatcaaggcggaatctgaaggtaacttgaagggaattcttggttatgcagacgaagatttagtctcaactgactttatcggagacatcaggtcaggcatttttgatgccaaggctggaattgctttgaatgacaactatgccaagcttgtgacttggtatgacaccccaacggcatcacacttcccgtgttattcacctgattcgagacatttcactctggctcta

SEQ ID NO: 18540 - DNA, 313 bp, Gossypium hirsutum
  Clone ID: uC-gsflnu33B006e08b1
tcacgcgtccgccctcatgcattggaaattttctccatgctatatactatcaagagcactcaagcttgatatggcgtcatcataaaccatgctggtatataaactgtttgaagcaggtagatttgaaagaaaggaatcgttctttggttcatcccttggtgcagtggaatttttcttgggctatatcctatcaagggtactcgggcttgatatggtgtcatcacgaaccatgcaggtatgagaactgtctcaaacagttaatttcgaagtttttctttagttcatcggatataatgaaaccttaccactcaac

SEQ ID NO: 18541 - DNA, 463 bp, Gossypium hirsutum
  Clone ID: uC-gsflnu33B006f01b1
tttcttcacacaaaagaagaagaagaagaggctgagcatctggtagctttctctttgttcctccaaactgtgtgcttagatttgaagacctagtccctgtgatcaaatcttgttgttcatttctgggtttaatttctcaagaaaaagaagatgacaaaagataggcaaatcggtgtagcaatggatttctccaagggaagcaaagcagctcttaaatggtcaaccgacaatctggtagacaaaggagataccctttacctcatccacgtcaaacccaatcagagcgacgagtctcgtaaccttctttggttcaccagtggctcacctttgattccattatcggagttcagagagaaggaagtgatgaaacattatgagggtggaacctgacctgaggttttagacttggttgatacggctttaaggcagaaagaggcgaatattgtcacaaagatttactggg

SEQ ID NO: 18542 - DNA, 348 bp, Gossypium hirsutum
  Clone ID: uC-gsflnu33B006f02b1
ttgtgggagtcccaagctggagttcattcactgtcactagggatacatgcggagagaacattggtaggggtacaaagattactctgtttttgaaagaggatcaacttgagtaccttgaggagcgacgtttgaaggatttgattaagaagcattctgaatttattagctatccaatttcactttggattgagaagaccactgagaaggagatttctgatgatgaagatgaggaggataagaaggacgaagaatggaaaggtgaggatgttgatgaggagaaagagatggaagaaaagacaaagaagaagattatggtggtgtaccacgagtggtttttggtgaacaaac

SEQ ID NO: 18543 - DNA, 312 bp, Gossypium hirsutum
  Clone ID: uC-gsflnu33B006f03b1
taccctagccacttcaaaaatgaaggaaattcccactttcactattcagccgattaacactctaaaatccccatctcaggcttcaatttctatgaaggagataaggactccgatggctcgttttcgaaggtgtggagaaacggcagtacagaagaagccgttcgtggaagccatgcgtggaaactactcgtgggatcaatctgttgttgctctagcacattccagagacccctagagtttctagtgttttcacattattgggctcctttgggccgcttattaatggggtgggatgggtttcttgtctggaat

SEQ ID NO: 18544 - DNA, 256 bp, Gossypium hirsutum
  Clone ID: uC-gsflnu33B006f06b1
ttcacgcgtacgggatcctgctgctagtgacttgccttaattggatagcttggttcccattcttgttgttcgacactgactggatggggaaagagatttacggaggaaaagacaaggttgatgaccttcaggaagagcttgacattgatgttatggtatcatggagagcctgagagaaacgggttacactaatactttggtgagcagtagcctggattcaaaacttctgacaatgtgtaagtgccatattactgat

SEQ ID NO: 18545 - DNA, 326 bp, Gossypium hirsutum
  Clone ID: uC-gsflnu33B006f07b1
tccacgcgttcgctcacgcgtacgggagggtgacggcaactttagggagttcggagacgatcgtgggggccttggaaagagatgtgtatggtggttaacgggctgaccaccctggaaacggctgagacggcgggagcgagcacggggcggaagagcaccagacgtggggtggagtccggaaggtcctcggcgagaattgaaaatccggaggaccgagcgccgatcgcaacgtgttttacttataaacgaatgaggtcttcaaggtgaactatttttggtaaatggaacattctacgtgaggttagttcgttaactgtatctttaac

SEQ ID NO: 18546 - DNA, 275 bp, Gossypium hirsutum
  Clone ID: uC-gsflnu33B006f11b1
tccacgcgtacgtacaagatggatatagaggcgactattaaatactttacgggcaaccatgttgatacagactgtcggccaagaagaggaacatgcggcaacctacggtttggggcaaactgacgctgaagggcgagatggggtctctagggacgcaactaagtactcgtaacagagtgcaaccgaaagacatggaactggtactggataaacacctacaccagcccctgaaccctgtcgaactccaaaaagaaatgatagaaggtaagggacct

SEQ ID NO: 18547 - DNA, 458 bp, Gossypium hirsutum
  Clone ID: uC-gsflnu33B006g01b1
tgtcgtttcgaccaccgaagtgtcagcttggttgcggccaaccaacccaaagatggtaccatgttcctcggtcttggctgaaacctacacagaatctgttggttctttttgaggagctgggaggagaccccacaagaatctcacttgtaaaaagatctgtgtccagcgtttgtgccgatgtcactgagtatcacccgaatattaagaactggcagattgaaagctatggaaaggcacaacagttccgcagaccaaaagttcacttgcgctgtagtcctggacaatccatctctttcattaaattcgccagttttggaactcctttgggaacttgtggaagttaccagcaaggcccttgccatgctcctgctacatatgccatcgtggagaagaaatgtgtagggaagcaaagatgtgtggtcaccatagccaacagtaacttcgggcaagatccatgc

SEQ ID NO: 18548 - DNA, 321 bp, Gossypium hirsutum
  Clone ID: uC-gsflnu33B006g02b1
ttacttttgaggcattgataacaaagacgagggacgaaagatgaatgtttaagttacttaattgtttttccagttttatgttgttctacatgttaaacgcgatgtgcgattcttgttctaataatgatatcaatagatgagatatttgctctaaaattactgtaggtaaattagtcgctgcaaatccacctcaattttgatttgggttcatgataggggtaataatgctattgttgtccaactcattaatcactgttgccttttcagcaaacaaacataaacgtctttatcaaaattgaggtggatttgcatcttcttttg

SEQ ID NO: 18549 - DNA, 267 bp, Gossypium hirsutum
  Clone ID: uC-gsflnu33B006g04b1
atatatttcactacccaacaacccaaaagataaaaggaatcgtttacttgttcgtagcaatttatcgtcatttcaagctcaattctctgaaaatttttgtgctgaacttcttttttctctttgtaccaccatgtgtggaggtgctattatctccgatttcataccgccgtcgcggtcgcgacgattgacggccgattttttgtggcccgatctgaaaaaattcgggttgaagaaggggttggttaagagattctacaagcccgtgat

SEQ ID NO: 18550 - DNA, 433 bp, Gossypium hirsutum
  Clone ID: uC-gsflnu33B006g07b1
acccgtccgtaaaaactaaacagaatggctagcctggcagcagatatgtttgtaggaagggaaagatttgctacatcactattgatgcggctcaccacaatatgtcatcatatgcctttgcgaagatcaaagctgaccccacgagattgtggctggtcaaaagatctgagtccagcgtttgtgccgacgtcactgagtatcacccgaatattaagaactggcagattgaaagctatggaaaggcacaacagttccgcagaccaaaagttcacttgcgctgtagtcctggacaatccatctctttcattaaattcgccagttttggaactcctttgggaacttgtggaagttaccagcaaggcccttgccaatgctacagatacatatgccattttggagaatacatgtttacggacgcaatgatgcgaggtca

SEQ ID NO: 18551 - DNA, 326 bp, Gossypium hirsutum
  Clone ID: uC-gsflnu33B006g08b1
tgaagtttgaatccgaagatggtaaaaaagatatccagtcacagcttgaaaaactgaagaaatattgcactgtgattcgtgttttggctcacactcagataaggaaaatgaagggtttgaagcaaaagaaggctcatttgatggagattcaagtcaatggtggaacaattgctcagaaagttgactttgcttacggtttctttgagaaacaaattccaattgatgccgtgttccagaaagatgagatgattgatattattggagttaccaaacgtaaacgtttctatcgaagtttgaagtggatttgcatcttacttttgattctc

SEQ ID NO: 18552 - DNA, 384 bp, Gossypium hirsutum
  Clone ID: uC-gsflnu33B006g09b1
tcacgcgtccggctaatttagttcaaggttaaacctttccttgagagtataaaaaaaaattaagaacatgggtgtcactatcaatgctgagattgagtttccagccattgagtttcgttcatcagatttgaagcgaggaaccgatggatggcgccatttgtgcaaaaaggttcaagaggcttgtgagaaattcggttggtttgagggtggtgtatgataccatttcgacgaaaggtcgagaagagacttttgggttgatgaaagaattggttgaggtcccggtggaacggaaacaaaaaaacccttggcccatgccttacatggctgggatggaccatgccaggcacgttttttggtggatggaggctttcgaattgggaaatc

SEQ ID NO: 18553 - DNA, 490 bp, Gossypium hirsutum
  unsure (1)..(490): unsure at all n locations
  Clone ID: uC-gsflnu33B006g12b1
tccacgcgtccgcccacgcgtccgcccacgcgtccgcccacgcgtccgatgtggcttagtggtgcggaagctctgggaactgatgcagttcctgggtttttacccactgaggacattgtagaaaagaaagatgatgaagaattggcagtttctgctgatgaagatcagaacttatgtgcattatgtggtgaacccttcgatgatttttatagtgatgaaacagaggagtggatgtatagggnngggctgtctacatgaatgcacccagtgggtcagttgaaggcattgatagttcgcagttaggtcccatagtgcatgctaaatgcaggtcagagtctgntggtggttccccctgaagattttgtacggtatgatgggatnngttattttattttttgcctccaaattgcattgccattccaatattatctttaatagaccattcatgttatttcatcatcttattcaattccattcagtctgaaaagca

SEQ ID NO: 18554 - DNA, 358 bp, Gossypium hirsutum
  Clone ID: uC-gsflnu33B006h02b1
tcacgcgtccgcccacgcgtccgtagattcgttcctcgtgctgttctcatggatcttgaacctggaaccatggacagcatcagatctggccctgtcggtcagatttttagaccagataacttcgtttttggtcaatctggtgctggtaacaactgggctaagggccattacacagaaggtgctgagttaatcgattccgtacttgatgttgctccgtaagaggctgaaaactgctaatggctttaagggttttaggtttggccattaccagaaacagcaacttgtacacgacatcggacccctttaaaaaaaaaacaaaaaaaggggcggccgtttttagggttccaagttttctttc

SEQ ID NO: 18555 - DNA, 147 bp, Gossypium hirsutum
  Clone ID: uC-gsflnu33B006h04b1
ctcacgcgtccgatttggttggtaggaaagaagattgggtaggaaattatggtttcttcttgtatactatatttgtacataaattataattgactttacccaaaaaaaaaaacaaatccatagaaacaaaaataaaaaaaaacttat

SEQ ID NO: 18556 - DNA, 474 bp, Gossypium hirsutum
  Clone ID: uC-gsflnu33B006h09b1
tcctacgcgtccgtccacgcgtccgaataaaataaaattttttattaataaaaaaataaattttcatttcaatcaatggtttattttttattattatttggttgttattttttgggtgggccttttttggggcttaaagtttttgtccccgtgcatgcaatcttttagcttttttttgggggcttttaaggtcaattaatttgcctgccctttactgcacatttttggtttttttttgggggtatcactattttatttccttttgcagtatttttcccttttttccaggtggaaaatttgggaatagccccatttaaatcgttttttccaacatgtttttttcctgattggtaaatggaaaacggcttttttaccttttattttttttaaaatgttggtataggtttatttgtaatttggcccctttcttttttccccttttttgcccgggttttgggtttttttcctttcttt

SEQ ID NO: 18557 - DNA, 344 bp, Gossypium hirsutum
  Clone ID: uC-gsflnu33B006h10b1
tagccaacaagtgccttggatccgatttcgacacaaaacatagaggatgtgatagtgaagcttaagaagaaaaggagaatgacagttgtaatggtttcccacagcatcaagcaaatccaaagggttgcagatgttgtttgccttcttgtgaatggtgaaattgttgagattttgaagcctagtgaactctctgaagccaagcatcccatggcacaaaggtttcttcagctaagttcttaatttactttctatatagttgttatatttccctttttttctttgtgcttaggatttgatgttaatttggtttaaacaatgttcagcattgcaagtttatttgttgt

SEQ ID NO: 18558 - DNA, 496 bp, Gossypium hirsutum
  unsure (1)..(496): unsure at all n locations
  Clone ID: uC-gsflnu33B006h12b1
ttcacgcgtccgcttatgcagatccttcaggtcgagtggacacatggcctagccaagaagataagcttgagcagatccactcagctgaggcccatgagatgattcaaaaccacgtagcactcatcctgggaaatcgattgggtgagtcaacatctgtagcacagataagtaaactcagggttgggcaggtctatgctgcgtcggtgatgtatggatacttcctgaggcgggttgaccagcgatttcagcttgagaggacaatgaaagtccttccaagtgcttcagatgatgacaaaagtagcattgagcaaactgtggngggatgacacaagaccttctggtctaggggactcctatcaagctgcttcatcacaccctgaagtctcatcatggtctggtggggatcagtctnggagggtttggtagtgngaataaagccccttcgactaaggacttantgtatgtccttcgatggggagacacttcagagatacgc

SEQ ID NO: 18559 - DNA, 185 bp, Gossypium hirsutum
  Clone ID: uC-gsflnu33B008a01b1
gtcatacgaccgataaattgtaaacgaaaacgggcgacttgagcaaccgcggagcaggaaccaataggagaaacgacagtgactgcactgaaaaggtcaccttcgcattgcccaagacggctacaacgacgcttacggtattgttaggggcgaagtcattgtaatggaccatagagggaccgaag

SEQ ID NO: 18560 - DNA, 502 bp, Gossypium hirsutum
  Clone ID: uC-gsflnu33B008a02b1
cccacgcgtccggaaaaaaaaagaataaatcgatctgcttggatggttcgatcgcatggcttcctctaatcatcctccttctcatcgcactcacgttcctctcccatctgactcagaatgtgttgcaggtggcaatccatttgacgatgaagctcctccggttcctatccatatagtgaccaatgcttctcagctgccggcggagttcttgaacccttcaccggagaagcagttggttgtaggttttgactgtgagggcgttgacctttgtcgcaatggcactctttgtattgtgcagcttgcatttcaggatgccatatatttagttgacgccattgagggtggagaagtgcttataaatgcctgtaagcctgcacttgagtctagttacatcaaaaaagttattcacgattgcaaacgagatagtgaggcattgtacttccaatttggcatcaagttaaacaatgtcatggacacacaagattgcttattctcttttaga

SEQ ID NO: 18561 - DNA, 448 bp, Gossypium hirsutum
  Clone ID: uC-gsflnu33B008a06b1
tttatttaaactctgacatattgtcaaggctttggttttgggggcatctcctgcgatgatgggaagctttttagctggaagcaccgaggctcctggagcttatgagtataagaatggtcaacgtgtcaaaaaatatcgtggcatgggctccctagaagcaatgactaagggaagtgatcaaagatatttgggtgataccgcgaagttgaagatcgcacaaggggttgttggagcggtcacggataaaggctctgtactaaaatttataccttacacaatgcacgcagccaagcaaggattccaagatctcggggcttcctctctaccgtctgcacatgaactcttgagatcaggcacactgaggcttgaggttcgaaccggtgcagcacacgccgaaggtggagtgcagtgtttggtttcttatgaaaagaaattccttcgagatttt

SEQ ID NO: 18562 - DNA, 407 bp, Gossypium hirsutum
  Clone ID: uC-gsflnu33B008a07b1
tatagcgcgtgaggaagggtcaccggatttcatactaatagattgtccggcggggattgacgcagggttcataacggcaataacgccagcaaacgaggcggttttggtgacgacgccggacataacgagtttaaaaaaaaaaaaaaaaaaaaaaaaaaaaaaaaaaaaaaaaaaaaaaaaaaaaaaaaaaaaaaaaaaaaaatataaaaaaccactaaaaaaaaaaaaaaaaaaaattaaaaatggggggggccgttttaggggaccaatgtttacctccccgggtatgcaacgataaatcttttttttggggtccctaaatttaatttcatgggccgcgtttttacaatccgcggactggaaaaaccttggggtgtacccacttaaatttctttgcacaaaatccc

SEQ ID NO: 18563 - DNA, 504 bp, Gossypium hirsutum
  Clone ID: uC-gsflnu33B008a10b1
taaaaaaaaaagggaaaaaaagagagaaagaagcaaggtctccaattccaaccatgcgtttgcccatgatcatattgctggtgttaacgatctggaaagcaggaaatggttcgagagcgaatgagttaaaggcggatgggaaagtgttggagttggatgaatccaactttgactccgctattttatcattcgattacatcctcgtcgacttctacgctccctggtgcggtcactgcaaacgtctttccccccagttagatgaggcagctcctgttcttgctggattgaatgagccaatagttttagctaaagttaatgctgacaagtttacccgtcttgctagtaaacatgatattcgatggctattctaccctcaagttctttatgcatggagttcccatggagtataatggaccaaggaaagcatattaatttgttcaatatctgaaaaaattcgtggttctgatgtgttaattttagttcaaatttgccattatgattttg

SEQ ID NO: 18564 - DNA, 493 bp, Gossypium hirsutum
  Clone ID: uC-gsflnu33B008b03b1
ctcacgcgtccgaccacgcgtacttccacgtcgatgttttaagagtgagcagaccaagatgaaatctgtcctaggggatttgcttggtggggctgggagcaagccaacattgatagtgagttacaaccatatgggaaatattgatggcatgaatgtatgggcaccccaaaccttatgatccaaggagatctcaaagagcactgttgttgatgacatggcttcaagcaatggaatcctgtatgagcttggagaacatcctgatcatgttgtggacatgaagtatgtgccatatgtgggagacaggaagagagccatggatgagtatacatgagagatattcatgggaggcaagaacaccatgttgttgcacaacacaatgtgaggattccctgttggctgctcccattatcctagatttggttcttcttgctgagcttagcaccaggatccagtttaaggctgatggagagggcaagattcactctttccatcc

SEQ ID NO: 18565 - DNA, 497 bp, Gossypium hirsutum
  Clone ID: uC-gsflnu33B008b04b1
ttcacgcgtccgaataccagtacttggctagctcgttttacactagatcttgaaaccaaagccaccttccaagtcggggttccattcatcggtgaaacgggtgtcgaaatatcttccaaatacgaaacaggaatcgagtggggaaagaccaagacgatgaccaccgacatggaagttacgcaccaagttcgtgtgccgcccatgactaaggtgacggtgtatcttaagatgaccaatggcacgtgcgatgttcccttcgtgttcactcaaaaagacagcctttataatgggttcttcgttacaactgatgtcctaggcaacactttcaccggtactaattattacaacatccaatatgatagcaaagaagaacccctcacctctgaacccctcacctctgaaccccccacctctggaaatcagaacatcaacgtatattgtgaaataatttaaaatgaaaattttaaaaaattattggaaattcttcattttaaagt

SEQ ID NO: 18566 - DNA, 265 bp, Gossypium hirsutum
  Clone ID: uC-gsflnu33B008b10b1
tccacgcgtccgcggacgcgtgggttcaaattgaagctacgggtcgggttagcaacgggggagcaccaaagatccactgcaaaaacaatggatgggcaaaattcggatgactcaaagcaaagcactgctgatatgactgtttttgtgcaaaatcttcttcaacaaatgcaatctaggtttcaaacaatgtctgattccattattaccaagatcgacgacatgggaaaccgtataaacgaattggagcaaagcatcaatgacctaa

SEQ ID NO: 18567 - DNA, 344 bp, Gossypium hirsutum
  Clone ID: uC-gsflnu33B008c03b1
ttgaaggcatctctcttccaccattcggcttggccacttacaagatgcaaggaaacgtgtgggtctcggttaattctgggtggtaccaagagaggctggtgtcgcttttaagcgtggcagattcgtggctaaagcaacttagagtccagcaccatgacttcaattacttcacggggattcgacgtggctaaatacataattgcttgctgtagttttctcttgagaaccccatggaagtgactgatcactaattatcaaaaaaaaaaaaaaacttaaaaaaaaagaagcctctttttgggttttaagaatttttggttttgtgcttgggagtaatagtgaggatt

SEQ ID NO: 18568 - DNA, 326 bp, Gossypium hirsutum
  Clone ID: uC-gsflnu33B008c04b1
ttgtcggctgacggcaacgttagggagtccggagacgtctgcgggggcctccgggaagagttatcttttctgtttaacggcctgcccaccctggaaaacggctcagccggaggtagggtccaccaatcgcctgaatcctgccagtggagagatcctgcaaacggcagaaatcagggttaaaaacgactgcacaatgtaaatcgtgagccgatttggaaacagaaacaagattgtaatgaaaggtgggaacacaaagaacatcaggaaaggttaattgcggagataaaataaaagaaccagaatgagtaataggagaaatgctacca

SEQ ID NO: 18569 - DNA, 458 bp, Gossypium hirsutum
  Clone ID: uC-gsflnu33B008c05b1
tgggagagggtcaacgacaacaggcgcgtgcttcttcctctgccttcactcttcggtgtatctcactgcttcaacaactactctcttgcccaaagaccccctgcccaccaaatctggctaccttccggtcaaccacgccactggttctgctattttttatgccttctatgaagctcaaacccccacttcccctcactccaaaaccccacttctcatttggctccaaggtggccctggatgctcctccatgattggcaacttgtttgagctcggaccatggcgcgttgtctcttctcacatgaaaaacgctcaataatttgactcttgagcgcaatccaggttcttggaaccgcttttttggtcttctttttctcggtaatcctattggaacagggtttagcatcgcatcgacccccgaagaaattccccaggacccacttttctggtgccaagcattt

SEQ ID NO: 18570 - DNA, 485 bp, Gossypium hirsutum
  Clone ID: uC-gsflnu33B008c06b1
tatcctccttttcagcttctactctaaaagggtcctgcttttaatgcttgagcttctgtctcggctttactagctcgctcattcagttctccagcatctttttgagcatgagaaatactattctcaagattatttatcttctccaagcactgctggtattgaacatgattagcttctctttcagcctgtaatttggtgagggcatccttcaaagtctggacttcagcttcagcttgacttgctcgttcatttaatccctgggaatcctcttgtgcacgagagacttctctctctaggttcgctaatctatccaagctctgctggtactcaagtaggcctgcttcttttttagcttctaatctcgcaagagcattcttcaaggttaaaaactccatctaagctttacttacacgttcagactcagatgggactcgaaccctgggatcagaaccatcattcgctcgcagacttcttactttcttccc

SEQ ID NO: 18571 - DNA, 459 bp, Gossypium hirsutum
  Clone ID: uC-gsflnu33B008c07b1
tatctttgctttctttgtatttgcagcttctgtaggggaaaaaaaagatgaagagggtttcctttgttgccttgtgtgtggtggcactgtcggtggtgctgttttcgggtgaaagtcgcatggcggaggcagtgacatgtaatcccacggagctttccccctgcttgtcggcattcacgtcgtcctcgcctccatcagccgcttgttgcagcaagctgaaggcgcagaagccatgcctctgtggatacattaagaacccatctcttaaacagtatgtcaacagtcctaacgctaaaaacgttgcttcgacttgtggagtcacatatcctaagtgttagatgttgcttaatggtgtatctactatctactggcagcaaataagtggctctttttgctgcaaagtactgtttttgataacgaataattgttaaaatattagattaaattaaggcactattt

SEQ ID NO: 18572 - DNA, 359 bp, Gossypium hirsutum
  Clone ID: uC-gsflnu33B008c09b1
tctaatcgggcgacttcaagtgagaacaaacgaagggttatggaaggacataagtcaattgcgaagacacacttgtgatcagcgttggggacctaatgcaagcatggagcattggcaagttaaggtcctaagaacatagagatgtattgaaaagaaatgttaatacggatctctatggctatctattggtgcttagaggatgaaatggcaatatttgccgataatgaagtcgctttgatgaattcaaggatctataatcgatttgtttgaacataatttctggaagacttgataatcatctgaaaaggggaagaaatagagagggttgtataaacgttataatattttgaaataatacc

SEQ ID NO: 18573 - DNA, 473 bp, Gossypium hirsutum
  Clone ID: uC-gsflnu33B008d03b1
ggtatatttgagtgatggacttgcatcatcaaaaagcgatgtgtatgcatttggtgttgttctgtttgagattatatctggaaaggaggccatcatacggactgaaggcagtgcgatgaaaaacaccgaaagacgttcattggcatctattatgttagcagctctccggaacacaccagactcgttgagcatgtcaaacatgaaggactatattgatccaagtatgctggatctttaccctcatgattgtgtcttcaagatggctatgttggccaagcaatgcgtggatgaggatcctattgtacgaccggacatgaaacatatcgtgataaacttgtcacagatcctattatcctcagttgagtgggaagtaacacttgccggttacacccaagtatttagtgttttggcccatggctgatcgttatagatatctcgtccgaatttcttttctcattcttatgtccttatat

SEQ ID NO: 18574 - DNA, 52 bp, Gossypium hirsutum
  Clone ID: uC-gsflnu33B008d04b1
gtggaggaagatttggggctaggcccctagggtgagctctatagaaagaagg

SEQ ID NO: 18575 - DNA, 130 bp, Gossypium hirsutum
  Clone ID: uC-gsflnu33B008d06b1
gtaaatggtttgttttcctttctttctttgtttggcgtgatattactatgattgatgattgcttgtattgtatcaagtttgagtatataatagtgaaataataaagaagtttgtataaaaaataaaacat

SEQ ID NO: 18576 - DNA, 224 bp, Gossypium hirsutum
  Clone ID: uC-gsflnu33B008d08b1
tttcactccaaattctccatactataacttgtgcatttggcaagatggcttcaaaaagaacagcatcgcttgccctcttctttgccctcaacgttctcttcttttctctagtcagtgcttgcggctcttgcccttcccccaacccacattcatttcctactcctttcccatcctcctcaggcatatgtccccacgataccttccagttcgctgcctctccttct

SEQ ID NO: 18577 - DNA, 142 bp, Gossypium hirsutum
  Clone ID: uC-gsflnu33B008d10b1
tccacgcgtccgcccacgcgtccgcccacgcgtccgcaatgttgcatattactgaagggttttgcttagatttgcatctaaaacctgtatgaggaatagggtaaggctgtgaataaaccgcaaaatgcctatatacacatat

SEQ ID NO: 18578 - DNA, 494 bp, Gossypium hirsutum
  Clone ID: uC-gsflnu33B008d12b1
tatcacccagaggcgttccccaaattacagtttgcttcgacattgatgctaatggcatcttgaatgtctctgccgaggacaagactactggccagaagaacaagattaccataacaaatgataagggtcggttgtcgaaggaagaaatcgagaagatggttcaagaagccgagaagtacaagtccgaggatgaggagcacaagaagaaggttgaagccaagaattcattggagaactatgcctacaacatgaggaatactatcaaggatgagaagattggttcaaagcttgacccggctgacaagaagaagattgaagatgccattgatggagcaatccaatggttggatggcaaccagctagccgaggctgatgaattcgaggataagatgaaggagctcgagagcatctgcaatcctatcattgccaagatgtaccaaggtgcaagggctgacatgggtggtggcatggacgaggatgcccaacctaccggt

SEQ ID NO: 18579 - DNA, 318 bp, Gossypium hirsutum
  Clone ID: uC-gsflnu33B008e01b1
ctcattcgtccgttaaaacgtaactgaaaacagagtattttaacaatactgcacaacggaccaagtggagtaacaacagttactgctctataaaggagaccttcattttgcccatgacgacaccaccgatggttacgtcattgtcagggctgaatctattgttaatgaccattactgcactgatgatgttatcaacggggccttgtctaaacacattgtactacaaaatccagtgccatatagccaacagacaaggctgcatgaagggaaaagggattgactgtaaataccacagcagccatgagacagaggcagttg

SEQ ID NO: 18580 - DNA, 367 bp, Gossypium hirsutum
  Clone ID: uC-gsflnu33B008e05b1
tgagagagaacaaacaaaaaaagtcttctctatctttgttcttgcctttaacatcaacaacaaaaagaaaaactgaattatcgaaggaaagatctgaaagagaatggcaacttttgcagggactacccagaaatgcaaggcttgtgaaaaaactgtttacttggttgaccagcttactgctgacaacaaagtttatcataaagcttgcttcaggtgccaccattgcaagggtacccttaagctaagtaattatagctcctttgagggcgtcttgtattgcaagcctcactttgatcaactatttaagatgactggcagcttggataaaagctttgaaggaactcctaaaaccgttagggtagatcga

SEQ ID NO: 18581 - DNA, 444 bp, Gossypium hirsutum
  Clone ID: uC-gsflnu33B008e06b1
ttccatttcttctcttctttgaactcaaagtcccaactaatattagaatcatgggtgttgtcacttatgactatgagaatacctccccagtcgcccctgccaggcttttcaaggcctttactgttgaagctccgaaagtttggcccacggctgcacctaatgcagtcaagagtattgaggttgaagctaatcctagctctggaagtatcgtaaaaatcaactttgttgaaggccttccattccaatatatgaagcaccagataggaggacatgatgaaaataatttttcatacagttacgatttaatcgaaggtgggcctttgggggacaaacttgaaaaaataagctatgagaacaagtttgaggcagctgcaggtggaggaagtatttgcaagagctcaatgaaaattctacactgttggtgtcaatggaatactgaagatg

SEQ ID NO: 18582 - DNA, 407 bp, Gossypium hirsutum
  Clone ID: uC-gsflnu33B008e09b1
tccacgcgtccggggaaaactctggctgaggtttgctgtgattctttgaaagaattcaaccccatggttcatgttgctgtggaaacaggcgatatatcaacatttggtgtcgagttctttgaaaagtttgatgctgtgatcatcagttgttgctctcttggaaaaaaagaaattgatcaatcaaaagtgtcggaaattatcaaagcgtgtagcattttatacagttgagtgtagaggctcttgtggcgaaatgttcgtcgatttacaggactataaatattcaaagaaaaagctcgaggaaaccattgaatgccagatagaataccctagctttgaggaagccatttcggtaccttggagagcacttccgaggagagtgtcaaagcttttactttgctatgagagtg

SEQ ID NO: 18583 - DNA, 94 bp, Gossypium hirsutum
  Clone ID: uC-gsflnu33B008e10b1
tcttaacttaatgcattacaacgttaatggggtcggatatcatttaagttaacccatctactatccacaacgggataaaatacccccccataac

SEQ ID NO: 18584 - DNA, 393 bp, Gossypium hirsutum
  Clone ID: uC-gsflnu33B008f01b1
tgtataaaatggcgaggtacgatagagcgatcacagtgttctcgccggacggccatttgttccaagttgaatatgccctcgaagccgtccgtaaaggtaacgccgacgatggtgtccgaggcactgacatcgtcaaagctcggcgtacagaaaaaatctaccgtcatgctccaggactgcagatcggctgagaagatggtgaacttggataatcacattgcactggcatgtgctggcctgaaagccgatgctcgagtactcataaatagggctcggattgaatgtcaaagccacaggctgactgttgaagatccagttactgctgagtatattactcgatacattgggggtcttcaggagaagtacactcaaagtggaggcgttaggccgttt

SEQ ID NO: 18585 - DNA, 455 bp, Gossypium hirsutum
  Clone ID: uC-gsflnu33B008f04b1
ctcacgcgtccggattcttcgaaaaccataaacgaaaccaaatatggcggagaaagcaatcgagtcggttcaatgctttggccggaagaagacggcggtagccgtaacacactgcaagagaggccgtggtttgatcaagatcaatggttgtcccattgagcttgtcgagcccgagatcctccgtttcaaggccgtcgagccaatccttctcctcggccgtcagcgttttgccggcgttgacatgaggatccgagtcaaaggtggaggtcacacttctcagatctaacgctatccgacaaagcattgctaaagcccttgtcgctttttaccagaagtcctttgatgagcacagcatgaatgcgattaatgatattttggtctttactactatacctcttctgtcccctttattcttcttgttcttctcttttacctttttctactcattttttttt

SEQ ID NO: 18586 - DNA, 213 bp, Gossypium hirsutum
  Clone ID: uC-gsflnu33B008f06b1
ctcacgcgtccgcccacgcgtccgagctcctctttcgttcttttgttcactaagtattgtaaaagatggccgacggtgaggatattcaacccctcgtctgtgataatggaactggaatggtgaaggccggttttgctggtgatgatgctccaagggcagtttttcccagtatcgttggtcgtccccgacacactggtgttatggttgggatgg

SEQ ID NO: 18587 - DNA, 171 bp, Gossypium hirsutum
  Clone ID: uC-gsflnu33B008f07b1
tacataagtataatctgtgaggtttcaaattcttaatataagcctccaagtttttctgttttgtataatgcggttcggaggctgattccctataagtctaagaagatggggttcatttctctattttactgttaatgtttatggcaatctgggttttgtccccccgctggc

SEQ ID NO: 18588 - DNA, 401 bp, Gossypium hirsutum
  Clone ID: uC-gsflnu33B008g04b1
gtgcagagcagacagactagaaaagaagagaagatggagcaaacattcatcatgatcaagcctgatggggtccaaagaggcctggttggtgaaatcattggcagatttgagaagaaaggcttctatttgaaagggttgaagctcatcagtgtggatcgatcttttgccgagaagcactatgctgacctgtctgcaaagcccttctttaatgggctcgtagagtacattatctccggtccggtcgttgctatgatttgggaaggtaagaatgttgttaccacaggtcgcaagattatcgtagcctgaccccacactcaattcattctacttgacaacactccaacagatatgtcctcaatcagggagcggattctatgtggccaatcttgatcccaccactt

SEQ ID NO: 18589 - DNA, 488 bp, Gossypium hirsutum
  Clone ID: uC-gsflnu33B008g06b1
tttacgcgtccgggcgctggagcatggtatgacaaataaactaacaagaccttcgaaactgctggatgtatcttctgactttgcacttacttacaaggacaaagagggtgactggatgcttgttggagatgttccttgggagctgttcgttatttccgtgaagaggcttagaatcatgaggacatcagaggcaaccggattggctccaatgttacaaggaaggaaccagaggcaaagaagcaagcccaactagaatactattctctcaaagccgaccataacacgaataagacatgctatccaaagcagaaaagaaatacaacatagttaaaagcattttgactttagcaaagtttgaacccttcgagctcttctgttgctcgtattatctgattacatgctaggaatagtcaccataggtttttaaagtcattaatttctcaatgcaacaattattctgaaatcactattcaaacataaagggttgt

SEQ ID NO: 18590 - DNA, 145 bp, Gossypium hirsutum
  Clone ID: uC-gsflnu33B008g07b1
ttcaaacgtccgtaaacgcgtaaataaaagggttcttttttaataacactccacaaatcacatcctggaaaaaacattcttttcaccttttaacggaaattcttaatttatctaaaactcatattaacacgtatataataattat

SEQ ID NO: 18591 - DNA, 147 bp, Gossypium hirsutum
  Clone ID: uC-gsflnu33B008h01b1
ctcatcgcgtccgttcggccgtaaatgacaacagtcgactttaataatagggcacaactgagcaagtggagaaactactgttactggtctataaaggagacctttgacttgcccatgatgactccaccgacggttacgtcagggtca

SEQ ID NO: 18592 - DNA, 388 bp, Gossypium hirsutum
  Clone ID: uC-gsflnu33B008h03b1
tcacattgtcctacaggcataaccgatacatgtgcatctaaggaacctgccactgctaagttcttgagggttgacacattgagtagactcgaaagtgaccctgaagagaaacaagggagcagccaggatagtaacagagaagaggaagttgagtccatttcaggcaacaatatactaaatgaatgggaaatgggaaatgttgaaactgaatgtagaggtggatatgataacggtgaccggctaagattacgaaaaggtgtaaggcgattatgcatgcactcgatattccagttgagtaagccgacgaagaaaacacggaatttcgagattgtaaatactagaggaagaggctgcgaagattgggtatgatcaacagtcagtggtgatt

SEQ ID NO: 18593 - DNA, 353 bp, Gossypium hirsutum
  Clone ID: uC-gsflnu33B008h04b1
ctcacgcgtccgaccggagctactgccgtcgtcgccgccatggtgaagtttctgaaatccaacaaggccgtgattgtcctccaaggccgatatgctgggcgcaaagcggtgatcgttagatccttcgacgatggaacacgtgaccgcccctatggccactgtttggttgcagggataaagaagtacccgagcaaggtcatccgcaaggattccgccaagaaaacagcaaagaaatcgtgcgtcaagtgctttgtcaagctcgttaactaccagcacctgatgcccacccgctacacccttgacgtagacttgaaagacgcgtttactgtctatgcacttcagactcatggtct

SEQ ID NO: 18594 - DNA, 428 bp, Gossypium hirsutum
  Clone ID: uC-gsflnu33B008h08b1
ttcttcacctatggtacatggtttggagtgaaaggattggtggctgccagaaagaacttcaataacttgtctagtatccagaaggcctgcaattttctgctgtccaaacagctcccctcaggtggctggggagaaagttatctttcatgtcaaaacaaggtttactcaaatgttgagggcaacaaaccacatatggtaaacactggctgggctatgttggctctaattgatgctgggcacgccgagagagatccaacaccactccacaaaggagctaaatatttgataaattcccaaatggaggacggtgatttcccgcaacaggaaattatgggagtgttcaacaggaattgtattgatcagttactccgcgtattgcagcattttccctatttgggcattaggcgaatatcggacttcagcgttgc

SEQ ID NO: 18595 - DNA, 393 bp, Gossypium hirsutum
  Clone ID: uC-gsflnu33B008h09b1
tccatgggacaacttcacgactgtggaaaaggcggatcttaacaaagggaatagcaagtctccgagatgagaagctaaacggcccagccctagtggtgatcggaagtcattggatatccgattcttgggcgatactaagctgccatgtagacgttgcacaggctctagcctggacccgaggaaaaagactctagaaaggctcggcaccgtctacaccgccgaggaagcagcgcgtgcttacgatgcgagggcgcgcgagttacaggatcctaacttacaaacacatgtatgcgacaacatcgccatcgaattgacgcacatacatagacagagcagcaccgtggtgaccactgctccgactgcaatagccctgactctgcccagcctatgctc

SEQ ID NO: 18596 - DNA, 237 bp, Gossypium hirsutum
  Clone ID: uC-gsflnu33B008h10b1
tggacgcgtgggtttggggggggggtgaggggtttaattaaaaaggatggccgctagtacatacattagaaaagctgtatgacaaggattttgtggataaagatatttatataaagacatatggatgaatatgtttaatttattattgagaatgcaaatttctaggaagaagctaacgatttttttgcttatattaattaaattatctttatgatgaatgatatacaaatatattaa

SEQ ID NO: 18597 - DNA, 157 bp, Gossypium hirsutum
  Clone ID: uC-gsflnu33B008h12b1
tccacgcgtccgcccacgcgtacgcgaacgtatacgttttattaaagattgcagaattaaactggtggagtaaccagtgttgctattgtgaattggatatctttaatttgttccagacgaatccaccgatagattctacattgacagatgtatattt

SEQ ID NO: 18598 - DNA, 497 bp, Gossypium hirsutum
  unsure (1)..(497): unsure at all n locations
  Clone ID: uC-gsflnu33B009a01b1
tctcacgcgtccgcgaagcggaagcgtcgttaagtcgtgtaaatattgaactcgtagactggttgaagtaaaagcgaaaatggaagggattggattggaaggagatgggtcaaacggggaagctcttgggaagtgcttgagtgggttggtggacgatggtagcaccgagagtcatcgatactacctgtcccggagaactgtgctggagatgcttagggacagaggctatgccgtacccaacactgaaatcgacctctctctccatgaatttcgtgccattcacggccaaagccctgattttgatcgtctcaaactctctgttactcataaaactgactcttncaagcggacgctggtagttttctatgggcctggtgtagttaaagtcagtgggattcggctcattgctggtctaattactagcaaagaaactttacgggggttgatattaatcgtgcaaaaccacataacataccaagctttgaaagctttagacc

SEQ ID NO: 18599 - DNA, 248 bp, Gossypium hirsutum
  Clone ID: uC-gsflnu33B009a03b1
tgaacttgtatttttagggtttggggttttattgcttgctttaaactttgtaaatcttcggattcaaaactctgaagagttattgttcaaagaaatacatgagatttttaaggcaaaaaaaaaaacaaaaaaaaaaaaaaaaaaaaaaaaaaaaaaaaaaaaaaaaaaaaaaaaaaaaaaaaaaaaaacaaaaaaaaaaaaaaaaaaaaaaaaaaactaaaaaaaaaaaaaaaaaaacaaaaaataaa

SEQ ID NO: 18600 - DNA, 478 bp, Gossypium hirsutum
  unsure (1)..(478): unsure at all n locations
  Clone ID: uC-gsflnu33B009a04b1
tttagtggctttcctatcttcattttcattcgactctccgacaaaggaaaccagagaaaaatgaccaagtgttacccaaccgttagcgaggagtaccaaaacgccgttcaaaaggctaagaggaagctaagaggtctcatcgctgagaagaactgtgctccactcatgctccgtctagcgtggcactcagctggaacttttgatgtcaagaccaagaccggaggtccattcggaaccatgaagcaacctgctgagctcgctcatgctgctaacaacggtctcgattntgcagtcaggcttctcgagccgatcaggagcagttccctatcctttcatacgctgacttctatcagcttgctggtgtgnttgctgttgagatcaccggtggccttgatgttccattccatctggaagagaggacatgcctcacccaccacctgagggtcgtcttccccatgctactgatggagctgatcac

SEQ ID NO: 18601 - DNA, 440 bp, Gossypium hirsutum
  unsure (1)..(440): unsure at all n locations
  Clone ID: uC-gsflnu33B009b04b1
ttaaaaaatcagctcctccatgtgtcttttcctggattggaacccaacagccacatctatctcagtcggactttctgatggttctgtttcaataactacacttgcagagtccaaaatagaaaaattacaagagtggaaggcacatgattttgagctttggacaagttgctttgacattcaccaaccacaattagtatatacaggatcggatgactgcaaattcaagtgttgggatatgcgggataatccatccaggatggttttccagaattccaaggtgcataaacngggaggtttgttgcattgccaagagccccaccgacccaaataccatacttacaggtagctatgatgaatacttgagggtatgggatctaaggtgcatctcaagaccagtgaatgaaacttcagtttgtcttggaggaggagtttggagaatc

SEQ ID NO: 18602 - DNA, 473 bp, Gossypium hirsutum
  Clone ID: uC-gsflnu33B009b09b1
ttccagccaacccgagattttctattttccgattcttttaggtctttttcccaatttttttgtatttctaaaacagaaacaaataggtgtctcaatggcagaagagagcggtgcccctgtaagttgtgctgatttgcccgttaaaaggcccagagaagacgaagaaaacggggtctcttctgctgctgctgttgttgccatggaaatggaagctgataccaataacacttccaaggaagttgatgggatttcctctgttattcctgcatggttctctgagattagcccaatgtggcctggagaggcgcattcttaaaggttgaaaaggtcttgtttaggggaagtctgattaccagaatgttatgctttttcagtcatccacattggaaggttcttgttttgatggtgtggattcagctcacaagagagtgaaatgtgcatatcagagatgatcactcatcttccatttgctc

SEQ ID NO: 18603 - DNA, 75 bp, Gossypium hirsutum
  unsure (1)..(75): unsure at all n locations
  Clone ID: uC-gsflnu33B009c06b1
atcagtggncggaggttactccacgggaccccgcgtcgctggacagctgcataaaccggctccttcaactctatt

SEQ ID NO: 18604 - DNA, 482 bp, Gossypium hirsutum
  Clone ID: uC-gsflnu33B009c07b1
attaaagaccctaagcctaacctaacctaacctaacctaacctgcagactgctcgcaaaatcattaggtagcaatgggtacagttacagtgaagttggttgttgtgattatgataacggtgggtttaatggtggaagggtcaagagcaataagcttgtgtgacatgaacgatgagggtctggaagcctgcaagccatcagtgacccagccggatcctgtcgacccaacacctcaatgctgcgaggctcttaaaggagctaacctcacatgcttgtgttcttataagaattcaatgttgctgccttctcttgggatcgatccaacactcgccatgggtttaccagcaaagtgcagtctcgatatgccttctgattgttgattaaggtattttcggaggaaaatgaaccatgaagcggctttcatgttcgtcagccttttacaagttgtttttatttatttgtacgtggaaaactaagttcgca

SEQ ID NO: 18605 - DNA, 236 bp, Gossypium hirsutum
  Clone ID: uC-gsflnu33B009c09b1
tttacgcgtgcgaccacgcggccgcgatgatgacgctgactaaaccggcagagagtccgagacatgagaaagggcaggcgacgatgagtagcagagtggctgtgacctcggggatatatggcctgaaacctcggggatatacactatttgagtatgctacacgctttgtagacattcacgatagagctgaagcatgcattttcaagatctgaaactaggataggaaaaaactatgg

SEQ ID NO: 18606 - DNA, 314 bp, Gossypium hirsutum
  Clone ID: uC-gsflnu33B009d09b1
ttcggcgtaggatacttagggtttgggtggtgacgacgtggcgcttactggttcctccggaaagatgaccggcggctccaaaaaatgcagtgttgattgatttactgagcagatgaatggcattcatggttaaaaggggaagaatagagaagaaaagaggcaaggaaagaatgaataggctacaaatgggaggaattgtttgagtagtttcgagggatgttaacctgcccccaacaatctctatttatctttcatactgtgtttaatatgattgtccatttgatggttctctttaatgtgttctcttttatata

SEQ ID NO: 18607 - DNA, 429 bp, Gossypium hirsutum
  Clone ID: uC-gsflnu33B009d10b1
ttagaaaggtctcataacatttgaagccaagcaaagttcagattaggatttagggttttctgttttcttttctttttgtgaaaggcaaaatggatctggatatgaacgtgaacgcccctcactcaatgggcacaacaatcatcggagtcacctacaatggcggtgtcgtcctcggcgccgactctcgtaccagcaccgggatgtatgttgctaatcgggcatctgacaaaattacacagctcacggataacgtctacgtttgccgttctggatccgctgctgattctcagattgtttctgactacgtccgttatttccttcatcaacatacgatacaacttgggcagcctgcaactgtcaaagttgctgctaaccttatcaggctactatcctacaataacaagaacatgcttcaaactggtcttattg

SEQ ID NO: 18608 - DNA, 474 bp, Gossypium hirsutum
  unsure (1)..(474): unsure at all n locations
  Clone ID: uC-gsflnu33B009e02b1
tcagatctcaggactcaaattgctggatacttgtatggaataagccctcctgataatccccaggttaaggaaatccgatgcattgccatgccaccgcaatggggtactcatcagcaagttaatcttccatcagctcttcctgaacatgatttcttgaatgatctggagcctttgggatggctgcacacacagccaaatgagcttcctcaattatcgccacaggatgtgacatcccattctcggatattagagaacaacaaacagtgggaaggntaagaagtgcataatcttgacatgcagtttcactcccggttcttgctcattaacagcctacaagcttaccccaagtggttatgatgggngaccgggttaacaaagatacaggaagcaaccctcatggttaccttccaacgcattatgagaaggtgcagatgctcctaaggaatcggcttcttggattttatatgatacctg

SEQ ID NO: 18609 - DNA, 249 bp, Gossypium hirsutum
  unsure (1)..(249): unsure at all n locations
  Clone ID: uC-gsflnu33B009e09b1
taagaacttggttggaaagatgtgcagagatcaatggaagtgagcaagcaacaatccatggggatactagtcaaagccttaggctgcaactaaatactaattttcttccctagtgttttaaaaatgtttcatagggagaattaagtgtacaaatacttgtttaatttaaacaaaactgatctttgatgatcaaaagttaggatttatcaaatgttcaaagatcttataaaattcctttgtgttacantt

SEQ ID NO: 18610 - DNA, 563 bp, Gossypium hirsutum
  unsure (1)..(563): unsure at all n locations
  Clone ID: uC-gsflnu33B009e11b1
aagctaaggtaccgcctgcatggtacccgtgtccggatattcctcggagtcgatcccatcgcgtcctatctgaattattcaaaatgatgaaatatagatcgattgatggttttcctttaactacaaaggattatgtacaccgaatagggaggactggaagagctggtaggatgggaggtgctcacacattcttcacacagcaaaataagggacttgctggagaactggtaaatgatgtaaacgaagctgggcaggttgtaccacctgcactattgaaatttggaactcatgtaaagaaaaaggagtccaagctatatggggctcacttcaaggaaatagctgctgatgctccaaaggctaaaaaaataacatttgatgactcggatgatgaaaactgacgcacatggcctgcagtaaaatatgtagaattggttaatagaaactggtacacactatttttaattctatgacgttccgtaatatttatttactttttttaaaccagttttgataaagcattaattgatctgaatattgatcattctggtgntactataaaacct

SEQ ID NO: 18611 - DNA, 321 bp, Gossypium hirsutum
  Clone ID: uC-gsflnu33B009f05b1
tcagcttatcgtttctgggatcagtttgatccttggtttagccttttctgcagtagtcattttaggcatccaatttcattacccttcaccttatttcattttcctttgccttgtttacatgattattctcttgtttattgtggttcatttacaagtgaattggatatttgcttacgtagttgtcgtcgttgaatcaagctggggatttaaaccattaaagcgaagtcgaaatttagttaaaggaatgaaaggggctgctttgatgattatcctgttactaggattgttatctttcttaataccctacgcttagttatgaca

SEQ ID NO: 18612 - DNA, 452 bp, Gossypium hirsutum
  unsure (1)..(452): unsure at all n locations
  Clone ID: uC-gsflnu33B009f09b1
ttaaaagcaacataattatggctggctaaacgttaatgtcctccgtcatctttctgctatgctgcctcgtctcagcatcaatcttcgaggacacgaaccccattcagatggtatccgatggtctcgactcctctgttcttcgtgtcatcggtcatactcgtcgtgctatctcctttgctcgttttgcttacaagcatggaaagaggtacgaggatgctgaggagataaagctacggtttcagattttcaaagataatatggatttaatcagatctactaacaagaagggattgccttattctctatctgtgaatcagtttgctgatttaacatgggatgagtttcgaaaacacaggcttggagctgctcaaaactgctctgccaccagaagggcaatcaccagctcactgatgtcgcctttcttgatcgaaagactgganggaaatcggcat

SEQ ID NO: 18613 - DNA, 384 bp, Gossypium hirsutum
  Clone ID: uC-gsflnu33B009g01b1
tccacgcgtccgatcgttgggttcttgggggtattttgcttgcggctgctaccttgtcgatttcagtatggaatattgttcagatgggaaccgtcaaacaatatccacaagtgatgaaagtggcctcgtcttatagcttagttgggactatccagtgccttgttttttctttgatcatggaaggagatctagatgcatggaaactgaaacgcaagccggatctcctactcattattgtgacaggagtatttgggagtattatccgtagcaacgttcatttagcatgtacgagaatgaaaggccctttttatgtgcctatgttcaagccctttgcggtagtctttgcaacagttttcggaacctctttctttcaaacagtcttat

SEQ ID NO: 18614 - DNA, 480 bp, Gossypium hirsutum
  unsure (1)..(480): unsure at all n locations
  Clone ID: uC-gsflnu33B009g10b1
tttacgcgtgggcggacgcggggaaaaaaataaaaatcttctggcttcggatttcctcacgttttcttaaatcatcgatcgacgccgacctagaacaagaataaaacgaggaacaaacaacctctgattgtcgaattaactagaaaccaaaagcaaacgcgtaaagaaatcatgggttctgaacagaatgaaggaactagcttccctccatcggcgccaaaactttgtgccaacggctgtgggtttttcggcacggcggcgaatatgaacctctgttccaagtgttaccgtgacctccgtgcgtntggaggagcaagctgccaaggcgaaagctgccatggagaaatccctcagcgttaatacgaagcagaaagatgtccgttgacgagactgtgaagcctgttcttgagcttcctcatgtgggttcctatcgacggtggtcgagatacaaccggctgctattgtctccgatgataaacc

SEQ ID NO: 18615 - DNA, 350 bp, Gossypium hirsutum
  Clone ID: uC-gsflnu33B009g12b1
ttcacagcggaattagattaattgagaaaaacgcaatggctcaaaagatgttggtgatggccgttcttgggatattggggacgacgatggcgaccgttacggttgcaaatccgacttgtttgcagagcttgatgtcttgtgctccttacttcaacaacactgatgtccaactgccagacgattgctgtaaacctctccaacaagccgtcgctactgaacttatttgcctttgcagcctcttcaacctgccttctttgcttagtttcttttgacatcccctacgttggagctcttaggatcgccaatcgtggcggtgtcgttgataatcagcgactgcatcagcgctgctt

SEQ ID NO: 18616 - DNA, 463 bp, Gossypium hirsutum
  unsure (1)..(463): unsure at all n locations
  Clone ID: uC-gsflnu33B009h03b1
ttaaaccctaaattctttgctcttcttccactgaaaccgtaaggagaagatcggagagaaaatatggcggccggcgatcgcaccgttttgcagtttaactcaccgtcatcggcgatcctgtcagcgaaagttcaccctctcgtcatatttaacatctgcgattgctacgtcaggcgtcccgaccaagccgagcgcgtcatcggcacgctcctcggctccgtcctccctgatggcaccgtcgatatccgtaactcctatgcagttcctcactcggagtccgctgaacaggttgctttggatattgaataccatcataatatgttagtctcccaccaaaaagtgaatctaaagaagtgattgttggatggtattctaccgggctaggagtcacaggnggcagtgcattgatccaagatttttattctagagaagtacctaaccctattcattgacggtggtacgg

SEQ ID NO: 18617 - DNA, 356 bp, Gossypium hirsutum
  Clone ID: uC-gsflnu33B009h04b1
tttctctataactacaccactcatcaattgcatggtatttttgaggcagcaagttttgggggttctaacattgatccaactgcttgggaagacaaaaagtgtaaaggcgagtcgaggtttcctgctcaggtgagaatccgcataaggaaggcatgcaaggcattggaagaggatgcttttaggccagtcttgcaccactatgacggtcccaagttccgtctcgagctctcagttcctgagactttggatctaatggacctttgtgaacaagcaggctccccataaacaaaatgctagccgagtgcaaatgtagtagcagtgggttttgtgatgcacgtttcgggagatttttccat

SEQ ID NO: 18618 - DNA, 465 bp, Gossypium hirsutum
  Clone ID: uC-gsflnu33B009h07b1
ataaaaaaaaaaaaaaaaaaaacgcttgggaaaaaatataaaaaaaaaaaaaaaaaaaaaaaaaaaaaaacaagaatcagctgctgctccggactcggttctttgacatcataataaagcaactggcatggtaaaaaaaaaacttaaaataagaaaaatgaagaagcactaaaatatagccaggggggggggccccctaattggtccagactccaacgcccttggtcaagaccactgttttctcttttgcggagcacccacatcattgactggggctggcggagttttcaccctgtctgggggtctgatagacctccacagaccgccctttactggcggggggaacgccccggagctttagcgctagtgatttttagggacattgagaccatcaatccccttcacaaaggggaacgcccggaggtgggtttgtgggctccccttgttggccttttttttagagaa

SEQ ID NO: 18619 - DNA, 460 bp, Gossypium hirsutum
  unsure (1)..(460): unsure at all n locations
  Clone ID: uC-gsflnu33B011a01b1
taacatgtnatgcaacgccattgagaagttgcaaagggctcaggattggctgaaacatatcagatattggacgcctcagaagcgaggtctgctcggccgtatgatggctgtgccgaaagccctagcacatttccaactccagaagagggttccggtgaaatctcagcagatctggctgaggctgccgttgctcattgtcagttaattatcgtttccaagctcactgagaaactgcagcaagacataccaggaaagggagtgaaaacacagttggagaacctctgcaacgtatatgcatttgtcttcttttacacacacatggttggtgattatgcctacactgggtgcattaccccacaacaaggtgcactagcgaacgatcagctgagatcactttactcccaggtgcacccgaatgcgactgccctcgttgacgcattgaaatacactgaccactacc

SEQ ID NO: 18620 - DNA, 304 bp, Gossypium hirsutum
  Clone ID: uC-gsflnu33B011a12b1
tccacgcgtccgcccacgcgtccggatgatacccgtgcctacttgatccgtaataccatgagcataggagccatcatacggttgacctgaaggctaacccttcggtaggaaatgaccaggctcccgacctagctgcttttgttccatcagatgccccaattgtggcagatcttgctgctcaagcacctacacaagattctaccggaaaacatgttagtgctgctagtaattctgcagcagttgcagccaaagctattaagccatctggtaatgcgcataatgttaagggagaagccagtcaata

SEQ ID NO: 18621 - DNA, 518 bp, Gossypium hirsutum
  Clone ID: uC-gsflnu33B011b02b1
tttggactcatcttgttcaatctttctatgctgattttctttactggttttatgtttactcataaataaattgtcctattttaccatatatacatatatatataataagtagttatttagcttacaatttagtctctcttttttttccttttaatggcttcttctagtggaaactccatgtccaattcagtatccgaagaggatttgcacaatcaaaggaaacggaaaaggatggaatccaaccgagaatcagcgaggcggtctaggatgaggaaacaaaagcacttggacgagttaatggcacaagtgactcagttggttaaagataataatcaaatcttaaccaccatcaacttcaccactcaacactacatcaacatggaagctgagaactcggttttgagagctcagatgatggaactgagtcaaagactggagtcactcaatgaaattctccattatcttaatagtggtaccaatagcaacaacagcaacgatgggttttgaacgagtgaggg

SEQ ID NO: 18622 - DNA, 454 bp, Gossypium hirsutum
  Clone ID: uC-gsflnu33B011b03b1
taaagtccgaatcgactgtctttgtactcattacctgctattaattcaataaagttcttttcaagctctccatgtcataacaaaaggaaaagtaggaaacagaagaagctggctaaagctagaaaatggaaaatgattgagagagctagaaaacagagaagaacaacatgaaaaaaaaaaaaaaaaaaataaaaagaaaggggggggcccctcaagaggaccaaagttaacaacgccgggaaggcaaggaaaaacctcttttaaaggggccccaaaatcaaatcccgggcccctgttttaaaaccgccgaacggggaaaacccggggcatccccaaactaaatggcctggaaaaaaacccccttttccccagtggggtaaaaacgaaaaaggccccaccaaaacccctttccaaaaatttgcgcaccctaatgggcaatgggacccccccctta

SEQ ID NO: 18623 - DNA, 502 bp, Gossypium hirsutum
  Clone ID: uC-gsflnu33B011b07b1
ttaaattttaaaccctcctttctctctcacacacactgccccatactctctctctttcatttcttttctttttctctcccagacgttgctgttgcagagcttcgccattgttgtcttgcttcaagctttttcagtttcttattcacacccttttgagttttgctcttcaaccatggctgctttagtgctcccgctgctcatcctggccgccatcactggccgctcaagtggcaactggtgtatatgcaaagatggtgtaagtgatacagtattgcagaagacactggactatgcatgtggtgcaggcgccgactgtaaccctatccacttgaagggatcctgttttaaccccgacactgttaaggctcattgcagttacgccgttaacagttacttccaaagaaaaggccaagctcaaggcacttgtgatttttccggcactgctaccgttaccaccgctgaccccagctacactggttgtgctttcccatctagtgccagt

SEQ ID NO: 18624 - DNA, 436 bp, Gossypium hirsutum
  Clone ID: uC-gsflnu33B011b10b1
tacggatatgccccagtcctcgactgccacacctcacacattgctgttaagtttgctgaacttttgaccaagattgacaggcgatctggtaaggagcttgagaaggaacccaagttcttgaagaatggtgatgctggtatgattaagatgattcccaccaagcccatggttgtggagaccttctccgagtacccacccttgggtcgttttgctgtgagggacatgcgtcagaccgtggctgttggtgttatcaagaatgttgagaagaaggacccaaccggtgccaaggtcaccaagtctgctgctaagaagaagtgaaccgtgctggctaaacctaatgaagtttccgcagatggagcattttattatgataataatagtttgatagactctatcatttatgatatagttggtcttttgcttgggtttgcatgtt

SEQ ID NO: 18625 - DNA, 246 bp, Gossypium hirsutum
  Clone ID: uC-gsflnu33B011c02b1
taaacagagagtcaggacgcaccggctttatttattgggttttgtgttttattctgcgaccccctttatgatatttccagggctcgctattatccctttgcctctgatgccggactgctcaaagccatgatcatgcagccttatgctttttacttctccttaccagtgctatgcaataaaaatgctactatatgttacattacgattaatactttgcatacctcatccatttaccaaaagttcacc

SEQ ID NO: 18626 - DNA, 273 bp, Gossypium hirsutum
  Clone ID: uC-gsflnu33B011c12b1
tttgaaaagatgtataatggctcgacaattaaggtgaaaccacgaactttgttttctactgcggattgggctgtcttaacatttacattttctttttcatttattttcccttattgcaacctgaaaaaaaagtaggtaccattaagaatatatgtttgtaaaaaaatgttctgcggtcacattcattggctaatgctgctgaactgaattggctttttagcagacttttccactgcaaaaaactaaaaaaacaaaaaaaacaaacaaataaaa

SEQ ID NO: 18627 - DNA, 86 bp, Gossypium hirsutum
  Clone ID: uC-gsflnu33B011d01b1
ttttagcgcgtgccgctgaagaatacaagatgctatagtggagttgggttgctgaggatgagtccgtgggtgcacacaggctggga

SEQ ID NO: 18628 - DNA, 324 bp, Gossypium hirsutum
  Clone ID: uC-gsflnu33B011d06b1
tttcacgcgtccgcccacgcgtccgtagacctaaaacaaaaactctcttcttcttctcactaccatctctccctattggagaattttctgttgaatttcgctttcctttttcattgcatgtatggatccttccagaggactacaccaggagatggggaaccctttgccggaaagcatggcggttaactcaaaaggacagcagcagcaggaaagaaaagcaaggcctcaaccagaagaagcgctaaagtgcccatgatgtgaatccaccaacaccaagttctgctattacaacaactacagcctttctcagcccaggtatttctg

SEQ ID NO: 18629 - DNA, 494 bp, Gossypium hirsutum
  Clone ID: uC-gsflnu33B011d07b1
ttaagtttcgcagccgtaattggccattgattatagcattgacagctagtgctgaggatcatgtgcgggagagatgcctacaaataggaatgaatgcaatccttcagaaacctgttttattgcaaggaatggcagacgagcttcgaagagttttgcaacggacaggggaagggatttgaggagccgcttatactttaggccaatggggactgcatacttattcaaccccgggtaggcaggacaggtcttttgatacttggcctgccggtatgaggaggtagcctatttgatttccttacatgttcctaaacagcttgccgttcacctggttagagcagagagatcttcaacatagcatttgcattctgtcattccatggtataccaacatgtaggcattaaattttgctaaccattttgctcattgaacttattaccagaatttcatggaatgactgggggtaaaaatacttgtacactcattaaaaccaaaat

SEQ ID NO: 18630 - DNA, 493 bp, Gossypium hirsutum
  unsure (1)..(493): unsure at all n locations
  Clone ID: uC-gsflnu33B011d08b1
ttccacgcgtccgcccacgcgtccgcccacgcgtccgatcaggacctactaggtctgctagattccactctgatggagcaaagtttggaggatttaattcgactgacaacatttttcgaagtcacaatgaagcaactgcacccaggaaacctcccccagttgagagtaaattgccttgcagccttgaggagctgtacactggatcaactaggaagatgaagatttctagaactgttgtcaatgctgcagggcgacaagtacaggaatcagagatattaaccgttgatgtgaagccggggtggaaaaaaggaacaaagataacattcccggataaaggaaatgagcagccaaatcagcttccagcagatcttgtattcgtaattgatgagaaaccccatgatttatacaaaagagatggcaacgaccctgtcgttaaccaaagggtgttactagcataggcacttggnggtacaacagtaaatctggttactct

SEQ ID NO: 18631 - DNA, 497 bp, Gossypium hirsutum
  Clone ID: uC-gsflnu33B011e02b1
ttgcctggcatgcaaagctatagagggttctttcgatccaaatggaccgaaacatttcattttggttgctcaaactgtagtcttacgtgaagaaattttgtgagcattcatcagctcctctcagtttgagggttgaaccagagatatttcatgcagaagaaaaagaatggcatcacttacaccaggagtgttattaaagcttcttcagagtatgaactctaatgtgaaagttttaggggaataccgatccgtgctactgcaagtgatcagcattgtgcctgctttaacaggatcagagttgtggctcaaccaaggtttcttcattaaagtatctgattcttcacattcaacatatgtttccttgtcacaggaggacaatgagttgatcttgaacaataagttgcagcttggtcagtttttttacgtggagagagtgggacctgggaccccagttcctatcccttgtggtgtcaggccagctcctggaaaggaccctt

SEQ ID NO: 18632 - DNA, 506 bp, Gossypium hirsutum
  unsure (1)..(506): unsure at all n locations
  Clone ID: uC-gsflnu33B011e03b1
taattcataaaacatcccttcccgtcttcagccggaggtaagtcatggttaagcataacaacgttgtgccaaatgggcacttcaaaaagcactggcagaactatgtgaaaacctggttcaatcagccagcaagaaaggctagaagaaggattgcaaggcaaaagaaggcggtaaggatctttccaagaccaacttctggacctcttcgcccaatcgtccatggccaaactttgaagtacaacatgaagttgagagctggcaagggtttcactcttgaagagcttaaggctgctggtatttcaaagaaacttgcacctaccattggtattgcagtcgatcaccgtcgtaagaacaagtcccttgaaggtcttcaagccaatgttcagaggcttaaaacttacaaggccaaacttgttgtcttcccaagacgagctcngcagtttaaggctggtgattcaattgctgaggagctngcaactgcaacccatgtccaaggatcatacatg

SEQ ID NO: 18633 - DNA, 484 bp, Gossypium hirsutum
  unsure (1)..(484): unsure at all n locations
  Clone ID: uC-gsflnu33B011e08b1
tttaaaagaacactagtcccatgccttatcatggctgggttggaccatgcgagcaagtttctttgttgtatgaaggtttcggaattggaaatgcctccaactatgactctgttaaaagctttactcaacttatgtggcctgaaggtcacccacacttttgcgacactatacatactattggaacacaaatggaggagctaaacaaattaatctggttaatgctaattgatagctatggattaggagatgactcattgaagttgaactacacaacattagtgcggatgatgaaatatatggctcctccaccgggggagtatgagagaggactctttgctcatactgataaaccagtcagcacacttatttgtgaggatcaagtttcaggattggaaattgaggtcaacgatggccaatggatcaagttgaccaatttatctccttcttcttttggctatgnggctggagatcctctcagggcatg

SEQ ID NO: 18634 - DNA, 117 bp, Gossypium hirsutum
  Clone ID: uC-gsflnu33B011e10b1
taaaaatcatgacattatgactcactgttactacctttgtttcactgcaactgctcttagtttatatatatatatatgaacctttccttttttataatggcaaatcatatattttct

SEQ ID NO: 18635 - DNA, 503 bp, Gossypium hirsutum
  unsure (1)..(503): unsure at all n locations
  Clone ID: uC-gsflnu33B011e11b1
ttttatattcggcaacgcagccgttgtgtttcaaaactgcaacatatacgcacgcaatccccctaataagaccaacacggtgacggctcaaggccggaccgacccaaaccagaatactggaattataatccacaactccagagttacagcagcttccgatttgaagccagtgcaaagctcggtgaagacatatctagggaggccatggaaacaatattcgaggacggttttcatgaaaacgtatctggatagcttaattaacccggccggctggatggaggggagggnggaatttttgcacttaagacgctgtattatggcggagtatatgaacactggccccggttcatccacgtctaatagagtcaaatggggaggctaccatgttcttaagagcgcaagtgaggtgtcaaagttcaccgtcggtaactttctggctgagaattcttggctgccgagcaccggggtgcctttcacttcaggactttaatttggtgcaattt

SEQ ID NO: 18636 - DNA, 347 bp, Gossypium hirsutum
  Clone ID: uC-gsflnu33B011e12b1
tccacgcgtgcgattttctcccattaccaattcccttcaatttctccattttctctgaaatccaatggatccagtaagcagttggggcaattcctccctcgactccgtcgatcccgaaatccatgacctcatcgagaaagagaagcgtcgccaatgccgcggcatcgagctcatcgcttccgagaacttcacttccttcgccgtcatcgaagccctcggcagtgccctcaccaacaaatactccgagggcatgcctggtaaccgttactacggtggaaacgaattcattgatgagatcgagaacctctgcagatctcgcgctatccaggctttccacctcgacccta

SEQ ID NO: 18637 - DNA, 525 bp, Gossypium hirsutum
  Clone ID: uC-gsflnu33B011f03b1
tccacacaaacaaaacaaaaaaaaaaaaaaaagagaaaatttataaaaaaaaaaggaggctccccataatgctgctcctatgtgtcctacttggtgcccggcctctgctggtcgcttgcctcctcccttccctctgctcctccttttctgtgcttttgcgctccttctccttgcttcttgtggggggcccccttttttgggcccccctgtttcccccccgcctgccgctccctttttttttttcttgggggcccccttgttcttcgccggccggcctcttcccccccgggttcggggggttgcccctcttggcccccccctctttccccttggggccctgcccccttgcccgcgggggcccccttcagcgtgggggcccccaaccgccccccctcccctggtccgctccctttttgttgcctgtggcgccccccccctttgccccccttttttcggggggtggtgggcgtcccccccccctttcccctcctcttttggccccctcttgtcgcgcctctttttttt

SEQ ID NO: 18638 - DNA, 516 bp, Gossypium hirsutum
  Clone ID: uC-gsflnu33B011f07b1
ctactcacacggacgggagggagacgagaaaaggaagacaacgatggtgtctctgaagttacagaagcggctcgccgctagcgtcctgaagtgtggccgtggcaaggtttggcttgatcctaatgaaatcaatgaaatctccatggccaactccaggcagaatgttaggaaacttgttaaggatggttttatcatccggaagcctaccaagattcactcccgatctcgtgcacgcagaatgaaagaggccaagagaaagggtcgtcattctggctatggtaagaggaagggtaccagggaggcaagattgcctacaaagatcctttggatgaggagaatgcgagtactaaggcgtttgcttcgtaagtacagggaatccaagaagattgacaagcacatgtaccatgacatgtacatgaaggtgaagggtaatgtatttaagaacaagcgtgtcttgatggaagcatccacaagtccaaggctgagaaggcaagagagaagacactctcagatcag

SEQ ID NO: 18639 - DNA, 327 bp, Gossypium hirsutum
  Clone ID: uC-gsflnu33B011f08b1
tatttaaaatagattaaaaaaaaataaaaaagggaatattttaaaaaaatataggtagttccccgtagtaaaaccttgtggcttcttttctgggcctgggtgggttctggcggccggggttcttgcccggccccccttcgcccctgtctgctctgttgttcgccccgtctctttgtctccctgccccccctggtcgccctgcccttctgggggggcgggcggcccggccccccccccgctccttgccggcctgcccgccgttcccccttgggggtggcccgcctgtttgcctccctctgggccggttccttttttcccctcttgcct

SEQ ID NO: 18640 - DNA, 318 bp, Gossypium hirsutum
  Clone ID: uC-gsflnu33B011f09b1
tagcacaaaaaaaaaaaaacaccctaaagagacaacgagaaagctgctagcctttgccttccttttcttgttcttttgggataaaacattagctcaaatagctccggcgccgccgataaaggtggacaacatcacttccatcctcgaaaaaggtggccaattcaccactttcatcaagctattgaaagccacacaggtggctgatcaactaaacaaccagctaagcacaccggaccctaacgacgggttaacgttgatcgcgccgagtgacagctcgttctccggactcaaaccgaggacgtgaaactcactttccga

SEQ ID NO: 18641 - DNA, 494 bp, Gossypium hirsutum
  unsure (1)..(494): unsure at all n locations
  Clone ID: uC-gsflnu33B011g03b1
ttcacgcgtccgcccacgcgtccgggaaggagagaggagttggaaatgtgaagctcttgaagcacaaagtcaatggcaaagtccgtcttgtcatgcnccaatctaaaacccttaagatctgtgctaaccatttcgttattccaacaatgacagtgcaagaacattctggaaatgataaatcatgcntttggcacgccgctgatttcgctgatgggaatttgaaagaagagatgttctgtatcagatttccttctgttgagaattgcaagaccttcatggagacagtcaagaggttgctgaaagtcagggaaagaaagaggaaaacaaagacgccacagtcactgctgatctcctcgacaagttgagtgttggagaaattaaaagtgatggtaaagaagatacggtcgttgccttcaacaccaaggaagccgtcaaagatgaagcaaaaacagaggatgataagaaagatgaggctgcttcaaagcatagacctg

SEQ ID NO: 18642 - DNA, 509 bp, Gossypium hirsutum
  Clone ID: uC-gsflnu33B011g11b1
tttcgactgcttcggtaacggttgagatgggtcggtacttttggacgataactcgacgtttataggtgagaaaaccgcggttcctaacaataactcggcgagagggttcaacgtcgtcgacaacatcaaagctcggctggagaaagcgtgtcctggagttgtatcctgcgctgatattctcgccattgctgctcgtgattcggttgttcggttagggggtccgtcatggaaggtaaggttgggaagaagggattcgacaagcgctagcagaagtgccgcaaatgcctctattccaccaccaacctctaatctaagcgctcttatttcaagcttctcagctcaaggcctctcaataaaaaaccttgtagcactttctggttcacacaccattggcctcgcccgctgcacatcatttcggtcacacatttacaacgactccaatatagacccctcctttgccaactcgttgcgacggatttgcccgagatgcggcaacgatagtgtgctcg

SEQ ID NO: 18643 - DNA, 470 bp, Gossypium hirsutum
  unsure (1)..(470): unsure at all n locations
  Clone ID: uC-gsflnu33B011h02b1
tccacgcgtccggtgtaaatagcataacagaggaaagaaggaagagcaatcgaaaaaaaaggataaaaagaaccccaatcgataaaggaaaaaaagaaaaccttctcttgtgtattgatttcgtttttttgatacagtatgcgtgtccccttgaaacaatacagaaatggggtttttatagccccgaaaatacatacatttcccttctattttttctatttttttcttttctgttgctattttgctatttttctttttctctttctgtttgctgctggttctgttgtgcaggtacgggtggnaagggtgcgcgagcgcgcatatacggaggctatgcgtgaagaggcaggcgatcgtggggggagcgtacatgtgtgctggcgtcgatggctgaggggagttggaaaccctagggttttctgcttcagctaggctaagtgttgggccttcgtaattgggctagggttatt

SEQ ID NO: 18644 - DNA, 475 bp, Gossypium hirsutum
  Clone ID: uC-gsflnu33B011h05b1
tttcacgcgtccgcccacgcgtccgtgttaatggaatcaaaccaacagtgctgattggaacatcaggagtaggaaggacatttactaaagaagtggttgaggcaatggctgcgttgaatgaaaaacctattatattctccctttctaatccaacttcacaatctgaatgtactgctgaagacgcatatacatggagtcagggccgagccatttttgccagtggaagcccatttgatcctgtagaatacaaggcaaataatgcatacatcttccctggcctcggtctgggtttaattatgtctggtgcaattcgtgttcatgatgatatgcttctggcagcctcggaggctttggctgcacaggtgacacaggagaactttgacaagggactcatttacccaccatttagaaatatcagaaagatttcagcccatattgcagccagtgttgcagctaaagcatatgaactgggttt

SEQ ID NO: 18645 - DNA, 314 bp, Gossypium hirsutum
  Clone ID: uC-gsflnu33B011h08b1
taaaaatcaaaatacctaatttcccccgcttgctactgctagggtttctttctcttctctctcgcaactcaccaggtttctttggagaaaaaaggaaatgtctcgagtttacgtgggtaaccttgacccacgagtttcggagcgagatcttgaagacgagtttcgcgtctttggagttattcgaagtgtgcgggttgctagaaggccaccaggttacgctttcattgactgtgatgatcacagagacgccgaggatgcaattcgtgaattagatggcaagaatggctggagagttgagctttctcataattcta

SEQ ID NO: 18646 - DNA, 324 bp, Gossypium hirsutum
  Clone ID: uC-gsflnu33B012a03b1
gtatccaccatatgtggtgccacaggccgcaccatgtccaccacactagctctgaaaaagtacaaggatgcgatttacatgaaggtgaatttggaactcccggcgtcggtatctgctggagatatgtgcatgatggaaaggctaaaactgcaaagcaggtagctgaagttatggaccatgagaaaaagtcaataactttcaaaatgcttgaaggagatctgatggaggaatacaaaagcttcgtgattacaatccaaacttcccccaagagcgacggtaaaggcagtatagtgcactggactctggattatgaaaagctgcacg

SEQ ID NO: 18647 - DNA, 578 bp, Gossypium hirsutum
  unsure (1)..(578): unsure at all n locations
  Clone ID: uC-gsflnu33B012a04b1
tccacgcgtccgcaactggctaagccattcaggcctcatgatacgatcacaccccaaacctgcattaaagacaaaagatcaggtgaaagacaaatattccaaagttacacccaagcctgcagccaaggaaaatactaagcctcaagagttcaagcttcacactggacaaagagccgttaagcgtgctatgttcaattactcagtggcgaccaagttttatctcttggaaatacagaagaaacaagttgagaaagtgcaaaagatgattgaagatgaagagatacgttgtttaagaaaggagatggttccaaaagctcaactcatgcctttcttcgacagacccttttttcctcaaagatcgaaccggcctttaacgatcctgagagaaccaagtttccgcgcagtgaattctaaatgttggagttgcatatcggagaatgagctctattattttcaccatgctcatgcttggaaccccatcaaatgaacacacangtactaaaggttgcatactgtactcaaatcaatgtgattgatgggctacgtgcgtgcgtgcaatgcatgcatgaatgatccat

SEQ ID NO: 18648 - DNA, 146 bp, Gossypium hirsutum
  Clone ID: uC-gsflnu33B012a12b1
ttccacgcgtccggaaattttcgttgtaatttattactaaacttcctttgtacaatggattgtcaacctctgattggggattttaaagtccacgttagagtatgttttcattgcttttaaaaatgtgaactgccaaataaaaatat

SEQ ID NO: 18649 - DNA, 199 bp, Gossypium hirsutum
  Clone ID: uC-gsflnu33B012b03b1
ttcactcgaacgcgacagcgtcagcgcttgaggcataatacctgcttaatgccgtgaaaaacccactacctcttgacgacgatgacgaccacccttttaagtgcgatggattaggcccagattaaaccggcataaaaaatgttgtaaaggacatcatgtagatggcaaacaaagccaacgacacatgtggcatcaagga

SEQ ID NO: 18650 - DNA, 228 bp, Gossypium hirsutum
  Clone ID: uC-gsflnu33B012b04b1
tccacgcgtccgcccacgcgttcgcccacgcgtccgcccacgcgttcggttgtaaggattacatacagttggttatagtggagaatataagaagctgttctttccatttcctttgaatcactttttgatggtactttagccttgaaacgtatgttttgggaatttgttttatgcacttatggtttctacaaaaaaaaaaaaaaaaaaaaaaaatacaagactgtaaaa

SEQ ID NO: 18651 - DNA, 219 bp, Gossypium hirsutum
  Clone ID: uC-gsflnu33B012b09b1
tttccacgcgtccggacggggtcaatggatgatcatcaagatccatggcctagggtagtgacctccattgcactcgggaggggtgctcccctaaggtctccccaagttgggagagcctacgtcataatttgtggcagcgggggcctgcgttcgcgcggcccctatttgaaatattaaaaaaaaaaaaaaaaaaaaaaaaaaaaaaaaaaaaacaaaaat

SEQ ID NO: 18652 - DNA, 510 bp, Gossypium hirsutum
  Clone ID: uC-gsflnu33B012c05b1
tctactttgtataaagtccagaagaagcagattcaaggatattgagaagaagtttctaaagattttgttaagctagctatgggaactcttgcaatcgatacggagtgtgtggattctgatatataccgtgctttgggattcaaagaattgggtaaaggagttgttggaactccacggattttatcacttctttcttcgcttcttgaggaatccgtccaaagaaacgagatggagtccgagacggtgaacttgaaagataatgttgccatgtttcatgggttaagagctcccaccataagcattcagcattatatcgatccgcattttcaagtatgctggctgcagaccgtcgtgctttcttgttgcatacatttatgttcaaagatttgctcaacaaacggatgtgcatccgacttcccttaatgttcaccgacttccttataccagtgtattggtagccgaaagtttattgatgatgcgttttttaacattgcatattattgcccagtg

SEQ ID NO: 18653 - DNA, 477 bp, Gossypium hirsutum
  Clone ID: uC-gsflnu33B012c06b1
tccacgcgaacggtacttttgttggtgtatatgatggacatggtggcccggaaacgtcccggtacatcaacgatcatctctttcaacatctcaaacgattcacttcggagcaacaagggatgtcggctgatgtgatacgtaaagcatatcaggcaacagaagacggttttttgtcactcgttaccaaacaatggccgatgaaaccacaaattgcagctgttggatcttgctgtctggtcggtgttatctgcaacggaactctttatgttgctaaccttggtgattctcgtgctgttttggggagagctgtaaaggcaacaggggaggttctagctatttagttgtcggccgagcataatgtgtgtatagagtctggaagacgagagatgcaatcattgcattcccgatgactcacatattgtagtattgaagcataacctatggcgcgtaaaaggtttcatacaagatttccagatc

SEQ ID NO: 18654 - DNA, 385 bp, Gossypium hirsutum
  Clone ID: uC-gsflnu33B012c07b1
ttatgcgtaagatggctgcagtggctagggatagagcatgggccgaaaggctggtggaactgcaggggcttgaggaagagaagaaaaaggccatggcttgaaatttcacttgcttatatgctttgtcttccgatgttatgctgattttgagacggtttataagaacttaattatgtttccgtcctaatgtttggttacgccagccggtctacaatttaatggcatttagacatctgatgttggtttctctagttctgcactttttcatttatagactggaaatttgtatctttgtgtttaggactaggaaacagaaaggtgttcaaaagttccaattggccttgggtgaggacttatttttagcacagtgaatcaagatctgaaa

SEQ ID NO: 18655 - DNA, 491 bp, Gossypium hirsutum
  Clone ID: uC-gsflnu33B012d05b1
tagaaaaaatgatgcttggagaaactcatcgtgcaaattcaaccgtccacgtaccaccttggcctgatcttgacgatgatcagacggatgtagattactcttctatcacattacagtgcagccgacaacaacttgagcagtagacggcgacacggagttacctccatgaagcgttatcagttttacaacgttatttgccatcgaacggcccggatgttgagttggattccgagtttccgggtttggatagtccggattcaccggtcgatgcttattcctgtgaccatttcaggatgtacgagttcaaaatccggaggtgtgctcgtgggcggtctcatgactggaccgagtgtccgtacgcccatcccggtgaaaaagctcgttggagggatccgaggaagtatcattattcgggtactgcatgcccggattttcgtaaagggaactgtcggaaggagattcatgtgagttcgctcatggggtttttgagt

SEQ ID NO: 18656 - DNA, 504 bp, Gossypium hirsutum
  Clone ID: uC-gsflnu33B012d08b1
ttcaaactctggtgaagagtgctattgttcaagtcgatgctgctccattcaagcaatggtatctccagcactatggtgttgacattggtcgcaagaagaaagcagcagcaggagccaagaaagaaggagaggaaggtgaaactgctactgaggaagtgaagaagagcagccatgtcttgaggaagctggagaaacgtcagcagagtcgcacacttgacccccatatcgaggagcaatttggtagtggtcgtttactggcttgcatctcttcacggcctggtcaatgcggccgtgctgatggatatatcttggagggcaaagagctggagttttacatgaagaagatgcagagaaagagggggaagggagctgcctaaaattttgttgcttttgagtatttcatcattaagatcaaaatgtccttttttttttgcctttcaccatttgagaacatttgaaattgtgttagttttgagcttttttttttagttggaatattaatta

SEQ ID NO: 18657 - DNA, 518 bp, Gossypium hirsutum
  Clone ID: uC-gsflnu33B012e04b1
tatccacaatattccacagcttctctagtttgcattcattttctatcaatatcttgattgtcgacaagattggcaacccacacctatagtttgatttcgtttcggtcgttaagaaataactatgtcgaagaaaggcggagcttcgttgccaaaggatgatccatggcgggcctcagccggaaaatcagttcctaaaatccaccactcgcctgttcttcgtatacgtcaaaatcctaactccaattacgccatcgctgtaatgaagcacccggatcctataggaagcgggttagcgactgaggctattgtggaagcggagggacccgaatgtattgttccgggtcaggttactcccgttagattacttggtcttaaggtgtggccaattgaagttaacacgaaatttttggaaccagtcggtaaagaactaatgctgcttgcaaagttcatggacgacgctgtcaaccctatgaacaaatcattcatagatcgctaatggcctaggcattttatgccat

SEQ ID NO: 18658 - DNA, 458 bp, Gossypium hirsutum
  Clone ID: uC-gsflnu33B012e10b1
tctcacgcgtccgcccacgcgtccgccgaatatggaaccggatacggacggaggactgagggcgagtatggatcgggttatggaggtaggacagagactgaatacgggtccgggtatgagaggaaaccaagttatggtagatccgaggaagaggaagaaggatataggaagccaagttatggtagatccgaggaagaggcagaaggatataggaagccaagttatggtagatccgaggaagaaggatatggtcgcaggaaacatggcgatgaccacagtgatgatgatgatgaagagaagcgtcaccaccaccgctataaggaccaccaccataagcgccatgatgactatgacgactagtcagactggccgtttcctctacaaatggaaatgtgcagtaatagctattaaataaatgatcgaggcatgccatctttgatcggtttttgtaccattat

SEQ ID NO: 18659 - DNA, 440 bp, Gossypium hirsutum
  Clone ID: uC-gsflnu33B012e12b1
ttggacgcgtgggtgctgctgcaccaccaaaggctgtttaaaagaaaccgaccgacaaacccgccgcccagccggtggaagtgatcgaaatcagccccgatgtcgaagaaattctggaagtgaaggagaaaaaggagaagaaagacaaggctgaagtgattaacaacaataagaaagtaactcaaaaagagggttcacccaagaaaaaacatactttttcttcagcccttactgcaagaagcaaggctgctgctcatggaatatctaacaagccaaaggaagacattgttgatatcgatggagcagatactgataatcatttggctggtgttgaatatgttgatgaaatttacaagttctataaatcagctgagcatgagagcatgccaaatgattatatgcacttgcaaactgatatcaatgagaaaatgagagctatt

SEQ ID NO: 18660 - DNA, 458 bp, Gossypium hirsutum
  Clone ID: uC-gsflnu33B012f06b1
tccacgcgtgcgtctcgctctctgtagccgccgcctgcgtctctctcttcatctatctgaaccaaaaagtctttagcttttcgcttcgagagagaccatgttggtttaccaggatctcatctacagagacgagcttctttctgactcattcccctacacggaaatcgagaatgggatgctgtgggaagttgagggatagtgggttgtgcaaggagctgtcgatgctgacattggtggcaattctgattccgaaggtgctgatgaggatgaacgtgtagaggacgaacttgagaaccttgataccttcgtagtttgtagctaggacgtaggagcaaccccctttcgacatgaaccagtttgtcgcgttcatcaggaagtatatcaagaacttgacaccaaaactgtatgcggaaaagcaagagtgcttcacgaaaaacattgagggagcaaccaagttt

SEQ ID NO: 18661 - DNA, 261 bp, Gossypium hirsutum
  Clone ID: uC-gsflnu33B012f07b1
taaaaatcaaaaaaaagcgaaaaaaataaaggaaaaaacataataaaactaaacaaaaacaaaaacaaaaacaataaaaataaaaattcaacttgaaactacaacaaactccattaatggcagtggcggcaaaaacttgaagaagatcatcatatcattaagaatgagccatcgctggacgagtgttcaagcctatatgatttggtgcatttggtcggatacagcttacagaagctgtcgacagttcttgtcaccgtatct

SEQ ID NO: 18662 - DNA, 475 bp, Gossypium hirsutum
  Clone ID: uC-gsflnu33B012f08b1
ttacacatcattttcttggtggataacatccccattagagtcttcaaaaatgctgaatccattggtgtatccgttccccaagagccaacccatgaggatttactctagtttatggaatgctgatgattgggccacaaggggtgggttagtgaaaactgattgggcaaacgcacctttcacagcttattacaggaacttcattgacaatgcttgtgtctggtcaggaagaagctcatcatgcgctaaaactaactcggtctacgacggtgcatgggaaacatacgaacttgatgcaccaggaagaagaggattaatatgggatcaaaactattgcatgatttataactattgtactgaattgaaacgttttcgtcagggtgatccaccagagtgtcaacgcgcatggttataaaatgaaacctcttctcctttcgatgtaatatactcctgttgttcactacgtttcttactatgt

SEQ ID NO: 18663 - DNA, 376 bp, Gossypium hirsutum
  Clone ID: uC-gsflnu33B012f09b1
tgtccacgcgtccgacaagatatgaggccacgcggtcggagggctatgtgctgggatttaactagaccatgacggtggataccatcttccttgtggtctagtcattagacaccatggacaatgttaaagtctatatccatgacatggaaggcatcccttcagatcagcaacgccttatcttcttcggggagcagcttgaagacgggcgcaccttagccgactacagtatccagaaggaatccactgtttacctcgtcctccgtctccgcggcggtgctcaagaagaggaagaagaagacctacacgaaggccacgaagatcaagcacaagaagatgaaggtcaagctggccgttctccagttatacaaggtggacg

SEQ ID NO: 18664 - DNA, 416 bp, Gossypium hirsutum
  Clone ID: uC-gsflnu33B012f10b1
ttccacgcgtccggcaactcataactcctcaaaagtcttcttcaatggcagctcgagttcttgttttggcttcaattcttattttctcttgttttgcagagacatgctatggggtgatctctttctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgtggaccattttaacaaagacaagacatgccagttcaagatcgttaagaaaccctacaccaacgttaacgaaacccttgaatggaccatcgaacga

SEQ ID NO: 18665 - DNA, 423 bp, Gossypium hirsutum
  Clone ID: uC-gsflnu33B012f11b1
tgtccacgcgtccgccatggcttaagagtacccagcataagaattagacattatatcgaacgaatgttgaagtatgctcagtgcataccttgctgatatcttgtagcatacatatactcggataggtgaggataacaaattgatgtgacgttgacttcctgtatacgatcataggttccttattaccagtgttatggtggcagcaaactccattgatgacacgtatttcaacaatgcatattatggcatagtgggaggaatatgcgcagctaaagtgaacaggtgggagatgaaaggaatgcattagactagattttagactttaggtgagtatcattacgcttgaaagaggctgcttacagctccaaaaggaagggaatcaagtcgaacgggctatccgggctagtgggattaaagagagtt

SEQ ID NO: 18666 - DNA, 314 bp, Gossypium hirsutum
  Clone ID: uC-gsflnu33B012g04b1
tgtgaccgtccgaccactcgtcccttaactggtacctctacaactaaactgtcctctgattctcataccacaagtgttgaccagcatttgttaagattctgaagaaagtgttgtatatgattaacaattcatgggtaaatcccactaggaagcctgtagatgtcccattcttcaaaaactatatgcctactggggctgtcgatcacatggagccatgcaaacgtgcccgtgcaagccaggtccaacttgtcaaatagcgctgcctctggttaccacactggccgatcttactcactctgacacttgagaaaacc

SEQ ID NO: 18667 - DNA, 140 bp, Gossypium hirsutum
  Clone ID: uC-gsflnu33B012g06b1
tctttactcatgctcttaatcaccttttagttctttacctctattggatcaaatttatactcttctttaattgatatttaattcactattaagaagaaacagaagaaaataagaaagaaaaaaaaaaaaaaaaagaaatg

SEQ ID NO: 18668 - DNA, 394 bp, Gossypium hirsutum
  Clone ID: uC-gsflnu33B012g09b1
ttctcacgcgtccgcccacgcgtccgtccacgcgtccggtcgtcaagatgcagatcttcgtcaaaaccctaacggggaaaaccataacccttgaggtcgagtcttccgacaccatcgacaatgtcaaagccaagatccaagacaaggaaggcatccctccagatcaacaacgccttatcttcgccgggaagcagcttgaagacggccgcaccttagccgactacaatatccagaaggaatccactcttcacctcgtcctccgcctccgcggcggtgccaagaagaggaagaagaagacctacacgaagcccaagaagatcaagcacaagaagaagaaggtcaagctcgccgttctccagttttacaaggtggacgagtcgggtaaggttcagag

SEQ ID NO: 18669 - DNA, 498 bp, Gossypium hirsutum
  Clone ID: uC-gsflnu33B012g11b1
ttccacgcgtccgcaaccaacaataccaacattgccaaccactcagccatcgttacccaagcctggtgctctacctccacttcctaccatgccaacattgccgaccatacctaatgccccaaaactgagcatgccacctctgccgaacattccctccttccctacaataccagctactatgccatctattccattcttctcgccaccaccggccaaaaactagcccttcaaaatgttgtcatctggattatgcgtctttgctttggtgcgatggtgttttgttgcatctcttagggaatacatagatggttttttagacatttgtttcattccatcatacttgtgtgaggttcctttttgtttgcttcttgtggttcttccaccattgttgggtgctggcagaattatttgggtcgtgttcttgtatgataagaaagaaatcacttgtgatttatatattgcaacaatgatttatcgataattctcactccgatcggt

SEQ ID NO: 18670 - DNA, 225 bp, Gossypium hirsutum
  Clone ID: uC-gsflnu33B012h02b1
caagcgtctgtcacgcgtccggggctaatatggctctgtaatgtaaagggaattggctggtacccatggctattagctacaaaaatggtggccattataaatttttttgcagggttcaattgtataagtattgtatttattcatgtaatgtaaaatatggttttttttatctcgctaagaaaaataaaaaacaaataaaaacaatacaatgaaaagaaaacattg

SEQ ID NO: 18671 - DNA, 312 bp, Gossypium hirsutum
  Clone ID: uC-gsflnu33B012h05b1
tataaataaaaaaaaattatcgcacagaaaaatttattcatccaagttggaaacgtcggccgcaaatctccgctccgttaccgatatctgaaaaatgtccggccaaagccagcgcttgaatgtggttccaactgttacaatgcttggaatcatgaaagctcggcttgtgggcgcgacaagaggtcacgcacttctcaagaagaagagtgatgccctaaccgtacaatttcgtcagattcttaagaagatagtgtctacgaaagagtaaatgggagagattattaaaacctccttatttttcctaacagaggc

SEQ ID NO: 18672 - DNA, 223 bp, Gossypium hirsutum
  Clone ID: uC-gsflnu33B012h08b1
tcatgggaaggccgagagtgtgctgaaggcttgtttaggaaacgcctttggggtggtacttttggtgaagtctataaaagacctctatgctgggtggagcacatgtcattggataatgaaaccggattagaaccttgtggtataagagtaaggcctgtctctggcctagtggctgcagattacttcgctcctggatattttgtgtgggcagttgggagtgcta

SEQ ID NO: 18673 - DNA, 411 bp, Gossypium hirsutum
  Clone ID: uC-gsflnu33B012h10b1
tatgaagtccgagcatgctttctacctcaaatgggcagtccactccttcaggatcactaactgtggtgtcaaggataccacccagatccacacccacatgtgttactccaacttcaatgatatcatccactcaattattgacatggacgctgatgtgatcaccatcgagaactcccgttccgatgagaagctcctatcagtcttccgtgagggagtcaagtacggtgctggaattggccccggtgagtatgatatccactctgccagaataccatcaaccgaagagattgcagacaggattaacaagaagcttgctgtgctcgagaccaacatcttgagggacaaccttgactgagggttcagactggtaagtatgctgaggtgaaacccgaccctaacaacatggttggt

SEQ ID NO: 18674 - DNA, 396 bp, Gossypium hirsutum
  Clone ID: uC-gsflnu33B013a01b1
tctggaagtgggctggagataatagcaactgccgccgattggatgactaacgagcctaaggcacgtacagataacgccatgggcatcgagaaactccatggccactctggtatagctaggctgaagctttactatgctcgcggcctatttgggctcgtggatccaagccatggcactggagactgctcacgctggacttgctcattttaatggacatctgctcgctatgtgtgcagatgatctgacttaccatgatcgtgttactgcatctggggacttggaaaccgttggcagacatgattgtgatggtcaggtgaaatctacaactgttgctcaccccaaggttgatcctgaaactggcgaattctgtggtcttagctatggtgacctccaaaa

SEQ ID NO: 18675 - DNA, 533 bp, Gossypium hirsutum
  Clone ID: uC-gsflnu33B013a02b1
tgggtggacgaacgcgtccttctcgcgtccgcccacgcgtacggccacgcggtcggacatatacaaacagggtcgaattacaatggagaaaaacgcagtggctcaaaagatgatgatgatggcggtccttgtgatattagggacgatgatggcagcgttcacggttgcgcaagagacttgtgcgcagagcctggtgccttgtgctccttaccttaacaacgccactgcacaaccgcaggatgattgctgtaatcctatcagacaagccgtggatactcaacttacttgcctttgcaacctctttaacgaccctactttgctttcatcttttaacgtctccgtctctgaagctcttaggatcgctcgtgagtgtggtgtcactacaggtctcaacgcctgcaacaatgctacttctcccacgtctgctccacccccgccaggtgaaagtggaggtgctgataggatagtattgaccggaatcaccactttgttcttattgttagcatctatagcgttgtactaagatgacattt

SEQ ID NO: 18676 - DNA, 485 bp, Gossypium hirsutum
  unsure (1)..(485): unsure at all n locations
  Clone ID: uC-gsflnu33B013a05b1
agccgcgccgttattgccgggacgccacccgccttctacgcgtccgttggtgcctaaaataaaaaatttttatggttggatggctatttgtgtaatttacccaaaagataaatatgataaaattataaaaaaaagttatatttaaactagattatggtacacacgtgggtgatattgattatttaataatttttttaaaaaattgatataaatattagggtaaactacaaaaatagtcatttttggtttgccttanattacatttagtcacttatgtttgaaatgttacattttantntnttaacttagggttttgttatgaagtaaccactctgtcgttaagctccattacctccctaacgacagttttacatgggcagtcaaatggtttttaatgccaacttgaattgtcctgtttggataagaatagtatcctaataaaataaatttacctattgaaatttttaaatttattacactttgaa

SEQ ID NO: 18677 - DNA, 544 bp, Gossypium hirsutum
  unsure (1)..(544): unsure at all n locations
  Clone ID: uC-gsflnu33B013a06b1
tattgagcaagaccagaaaaccaggctgagagggatcgatgcccaaaaagccaacatttccgctggcaaagccgttgcccggatcctccgaacctctctcggacccaagggcatggataagattctccaaagccccgatggcgatgttaccatcacaaatgacggggcaacaatattggagcagatggatgttgaactgtctcggagtcaggattacgaaattggtgatggaacaactggtgtttgttgtcatggctggagcacttctagagcaggcagagcggttattggaacgtgggattcatcccatacgaattgcagaggggtacgaaatggcttcaagaattgccgttgagcatttggagcacatatctcagaagtttgattntggagcatcaaatatagagcctttggttcaaacatgcatgaccactttgtcctcaaaattgtgaaccgatgcaagcgccatttggctgagatttctgttaaagcagttctttctggtgctgatctagagagggaagatgtcaatttagatatgatt

SEQ ID NO: 18678 - DNA, 506 bp, Gossypium hirsutum
  Clone ID: uC-gsflnu33B013a07b1
tcttgaagtggtgtggagataattggaactggggaagatgggatggctgtgtttcccaaagctgataagaagaaagcttctggttttgagattgttggtttcgaggtggttccgtgcagtattaaatatgatccagaagccatgactaaacttcacatgtatgacaaagtttcctctgtgaactgccccttggggctcgacaagtcgcagataataagggaacgagaaaggatctcttttacttacgaggttgaatttgttaaaagtgatattagatggccatcacggtgggatgcttatttgaagatggaaggtgcacgcgtgcactggttctcaattctaaattctctaatggtgatcactttccttgctggtattgcgtttgtcatcttcttgaggactgtgaggaggggatttgacaaggtatgaggaactggacaaagaagctcaagcacaaatgaatgaggagctttctgggtggaagcttgttgtaggagatgtcttca

SEQ ID NO: 18679 - DNA, 416 bp, Gossypium hirsutum
  Clone ID: uC-gsflnu33B013b02b1
ttcttgttctagatcgcgagcggccgcctctcgcttattggttcaagatctggttttgatctgatcagatcggataaaaatatcaaaacatgtttgggagagcaccgaagaaaagcgataataccaaatactatgagattttgggagtatcgaaaaacgcttctcaagatgatctaaagaaagcttatagaaaagccgctattaagaatcatcccgataaaggcggcgatcctgaaaagtttaaagagttggctcaagcttatgaggtgctgagtgacccggagaagcgtgagatttatgatcagtatggtgaggacgcccttaaagaagggatgggcagcggtggcggtggccatgaccctttcgatatcttccagtcattctttggtggcaatccttttggtgctggtggaagc

SEQ ID NO: 18680 - DNA, 158 bp, Gossypium hirsutum
  Clone ID: uC-gsflnu33B013b04b1
tgaataccggatctgccatgattgaattctaatgcctttgtttatctaatgaacaatgcagatgtatttcactattgattcaacattctatgtttcattcacatttatgttatatcttacattacggattgggggaaaaaaaaaaacaataaaaatac

SEQ ID NO: 18681 - DNA, 498 bp, Gossypium hirsutum
  Clone ID: uC-gsflnu33B013c02b1
ttcttcgcgtccgcttggctcaacctactcgaaaacaagactgcattcaccacaaagaaagattatggcaaagaagaaagggaagcacaatgggcacttgcccaaagaacattgcacggacttcaaccaccggaaacttctaatctcttcaatgacaagaacagttaccgggagttatcggagatcgccgagcaggccaagagacgagcggaagttgcaaggcttcgagagcttcatacactcaaagggcacgtcgagtccgtggtgaaactcaaggggctggatatcgatacgatccagcagcattatactgtttagaacactggaaaccgacgccggaaaaacgaaaggatggcagttcattgacatttacagatgatgaagagaaaaaaagtaatttagttttcaaaaaagaacattttaacatgtctatggtttaatttgccaatcatgtaatggtctgtgttttacagtttcttgcttttcaatcgagcactc

SEQ ID NO: 18682 - DNA, 309 bp, Gossypium hirsutum
  Clone ID: uC-gsflnu33B013c04b1
tcttttcttttcctggtgtatgtattttgttgagcttttcttttgtgtttaacttgtgaccgttgatcatgcttactttatcatgatcatcatccaatggctgatgttgtttgtgaatttgtgttaatgctcctctgttttctataaaaaaaaaaaaaactgcacataaaacaataaaaaaataaaaagaaaacatagaacaattacaaaatcaaaatcaccagctccaaagggctgttcaaaaaaattgacaaacctaaaatgagtattgggacggcctttatacttcctccagttattcgggggggg

SEQ ID NO: 18683 - DNA, 128 bp, Gossypium hirsutum
  Clone ID: uC-gsflnu33B013c06b1
acccacgcgtccgctatgcttccggacctggaaaacttgttatattaaaaaaaggataactaaacacacctttttgaggttttgcgatggcatcaaagcggactataccatcatgcttactttatcag

SEQ ID NO: 18684 - DNA, 326 bp, Gossypium hirsutum
  Clone ID: uC-gsflnu33B013c08b1
tctctcacgcgttcgggcttatggtatgtgactagtgcttttccaggagctggaccagaaacaaaatattatcaaaaagataaagataagctgaacgctctataggttccttgatgcgataactgagcatcgggtactataggcacatgattttggattctaagtataatctagcttcatgatgactggcatcattgggactggaatcacagtggagttgccgtattatagagcttggaagcgtattctgtgttggccatctgacgttattgccatgtggcccaagcggatcgcttatagtaacaaaaatgcatgctgagttttta

SEQ ID NO: 18685 - DNA, 515 bp, Gossypium hirsutum
  Clone ID: uC-gsflnu33B013c09b1
tcttcgaaagcttatctcttttcgtctctgaatctgatcaatcaacacctgaaaaggaaaacttacaaacaacaactactactagtctactacccagcactagaagcagctcgtagccagccatggatgaagagtacgatgtcatagttctaggaactggtctcaaggaatgcatcctcagcggtcttctttctgttgacggactcaaggttctgcatatggataggaatgattactatggaggagagtctacatcactcaacctcattcagctctggaagaagtttagaggaaatgataagcctcctgctcatttgggctctagcagagattataatgtggacatggtccctaagtttatgatggcaaatggcactcttgtgcgtgttcttattcatacggatgttacaaagtatctttacttcaaagctgtggatggtagctatgttttcaataaagggaaggttcataaggtgccagcgactgacatggaggcactcaagtctccacttatg

SEQ ID NO: 18686 - DNA, 529 bp, Gossypium hirsutum
  Clone ID: uC-gsflnu33B013c11b1
tttctccttcaagtttttgaaaaacgcaatatattaaaaaaaggataactaaaaacacctttttgaggttttgcgatggcatcgaagcggatcttgaaggaattgaaggatttgcagaaggaccctcctacatcatgcagtgctggtcctgttgctgaagacatgtttcattggcaggcaacaatcatgggtccaccagacagtccatattctgggggtgttttcctagtgactattcattttcctccagattatccctttaagcctcccaaggtggcatttaggacaaaggtattccaccccaatattaacagcaacggaagcatttgcctagacatcttgaaggagcaatggagtcctgcactaacaatttccaaggtattgctatcaatctgctctttgcttacggacccaaatcccgatgatccattggtgccggagattgctcacatgtacaagaccgacataagcaagtacgagacaacttgcaggagctggacccagagtatgctatgggctgaaaacaagc

SEQ ID NO: 18687 - DNA, 518 bp, Gossypium hirsutum
  Clone ID: uC-gsflnu33B013d01b1
ttgtaatctcttctttttggagtttcatcacaccagatattacaatgggttcaatcggtgaaactcaaatgacacccacccaagtctcagatgatgaagccaacttattcgctatgcaacttgccagtgcatcagtcctccccatggtcctcaaatcagccattgaacttgacttgctcgagatcatggctaaagctggtccaggtgctttcttgtccccaaaagaagtggcttccaagctccccaccaccaaccctgatgcacccgtcatgctggaccgtatcttgcgtctcctggctagctacaacgtcctcacttgctccttgcgtaccttccctggtggcaaagtggaaagactctatggccttggccctgtctgcaaattcttgaccaagaacgaagatggtttcactctttccgcccttagtctcatgaatcaagacaaggtccttatggagagctggtactacttgaaagatgctgtgctggatggtggaattccattcaacaggcctatg

SEQ ID NO: 18688 - DNA, 144 bp, Gossypium hirsutum
  Clone ID: uC-gsflnu33B013d02b1
ttcctcgcgtccgcccacgcgtccgatttgtatatgactctgcaagtgtgtgcctagcggcattaccgtttgtgacccatcattcccctttgtgattaggaacattaagaatagaatactcttaaactgaatgacagtttattc

SEQ ID NO: 18689 - DNA, 119 bp, Gossypium hirsutum
  Clone ID: uC-gsflnu33B013d03b1
ccatccttacttacaaacaaacaaataaaaaaaaaatgacaaaaaaatttaaagaaaaaaaaaagtgaaacaccttatgccttatatgcccaaaaaaaattgaagaaaaaaaaaaaaca

SEQ ID NO: 18690 - DNA, 162 bp, Gossypium hirsutum
  Clone ID: uC-gsflnu33B013d05b1
gccttctcccacccggcgcccgcagcctcgataccaagcagccaagacactggactatatgtaggactgaacaaggtgcagggtgtaacacggaagggatggacacgactgctgtatcatcaacatggatcaccgcgcacagtggtacgtgtgatgaggaac

SEQ ID NO: 18691 - DNA, 193 bp, Gossypium hirsutum
  Clone ID: uC-gsflnu33B013d08b1
ctcactcgtacgggcttacggtatgtgtcagattcttatacaggaagaagtcccgaaacacaatattgtgaaccaaattacgattatctgatgggtcagtcggtgcgattaaacgactactgtagatctggtactgcagcacaagattttggatacagtgcaaatcttgtatcatgatgactggcaacactgg

SEQ ID NO: 18692 - DNA, 473 bp, Gossypium hirsutum
  Clone ID: uC-gsflnu33B013d10b1
tcccacgcgtccgcttaggcgtagctctcgatccacatcataaaaaaagtaaaggagaaaatgaagggtctgcaggcacttatattggcaatggtaacggttatggcgatcgctacaactgatgctcaaagcatttgcagcatgccagcttcaggtttgatggcatgcaaaccagcagtgacccctcccaaccctccgccgcccacgtcaacttgctgctccgccctctcccacgctgacatgcgttgcctttgctcatataagaactccaagctgttgccttcccttggtattgacccaaaccttgccatgaaattgcctagcttgtgcaagcttcctcatcctgcaaattgttagttcctggctctccatatttgatctcaaatgtgagggaaaatcatgcttattataagcctctacttcacattattgtactgagcttcggggttttcttttcctttatttctttttat

SEQ ID NO: 18693 - DNA, 562 bp, Gossypium hirsutum
  Clone ID: uC-gsflnu33B013e03b1
cgcccgcaggcacgggccgggacttactggctggaccgacgcatgcgtcctcgcattcgtccacgcgtccgggaatggagagcaaaaacccaaaatccgaactgactgtaatgaagttaaagccaatagaagcaaccccagaaagcttcaaagaattcggtcaagtcattgaagcatccccagatggagaaaaattcggtccgactgatgctcagctagacctttccaaaggaattcccaggttttacatcatgaaccttcagaaccggccgctcaagttttcaacgattacacatcatgccagtgtgacacaatgccttggatctatagggggtcatgtttggtatctcggaattgctaagccttccttggtggactcggaagaagttaagaatgagaaagggaagatagcggtgcagcttcgttgtggtcatttctacgtgcctccagccattgaagatgttcgtgtttttagaattgcaggtcctaagtttatcaaacttaatcgtggaacatggcacgccgggcctttgttaaagctgatgctatggacttctacaac

SEQ ID NO: 18694 - DNA, 95 bp, Gossypium hirsutum
  Clone ID: uC-gsflnu33B013e05b1
tttacgcatccggcgctcggtccacgcgatacttctttccctgccgactgaccagattcttgtggccttccttgacaagtgtaactcgggctcgt

SEQ ID NO: 18695 - DNA, 195 bp, Gossypium hirsutum
  Clone ID: uC-gsflnu33B013e07b1
tcccacgcgtccggcccccggttctctgtgaaattgctacaatgaataaagcccagaaacgggaaagtgttggagatatgaattacactgactgccttgatgagactgctataacacctattaatgttctagaagaccctgacaacactttggatactgtacactgcgacgatcggaggtgctgaactatactgt

SEQ ID NO: 18696 - DNA, 242 bp, Gossypium hirsutum
  Clone ID: uC-gsflnu33B013e11b1
actgtatctaagtctccgcaccaatcactgtcggaatacccaatcaacttgtaatcttccatatttgaataaaataacccgtgtgacaccgttccttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataggggcaccaagtttaaaaaaaccaat

SEQ ID NO: 18697 - DNA, 353 bp, Gossypium hirsutum
  Clone ID: uC-gsflnu33B013f02b1
ggtctggaccgacccacgcttgctaccacgcgtaggccctggggtaaagggggggttgttataagagatcctgacaagggtgcccgaatctggctcggtacatacaacacggctgaagaagcggctcgtgcctacgatgaagccgccaagcgcatccgcggggacaaagccaagctcaacttccctcaaactccacgcctaactcagcctcctgctaagaaaaggtgtatgatggctcctgagttgactccaccgagttctgaaaccaagagcccaccaaccccacaaccttttatgggttttggttacgagaaaggagttttacaggccgagtgaagcaatggaaagcgaga

SEQ ID NO: 18698 - DNA, 86 bp, Gossypium hirsutum
  Clone ID: uC-gsflnu33B013f05b1
tctacgcatccgggcaacggtaaatttattgcttgttgagatgctgacagtccagaaccctgcccaggtcctagacaagtgtacca

SEQ ID NO: 18699 - DNA, 147 bp, Gossypium hirsutum
  Clone ID: uC-gsflnu33B013f08b1
tcccacgcgtccggccaccggttaagtctgaagttcttttgcaggttaatgtccagattcacaatatccttaatgctttgaaaattaactgctgctactaaaaagttcgctttaactgctactgagcatcttgtattgcctgacaac

SEQ ID NO: 18700 - DNA, 460 bp, Gossypium hirsutum
  Clone ID: uC-gsflnu33B013f10b1
tttctcaactcgtctctccggcttcattgcctttttgctcagatctcctcatctccactttttttccttcttcaaatacccaatggccgtcactttctcaaatctccacaccgagtctggtcttaaagctcttaatgacttcctctctggaaaatcttacatctctgggaataagctgaccaaggatgacataaaagtttatgccgctgttctgaagaaccctggtgattctttccccaatgttagccagtggtataattctgtttcttctcaacttgccgccagcttccctggtaaagctgttggcgttgggtttggtggcaaagctgctccagctgagtctgctaaagctgaggctgctgatgatgaggacgacttggatctatttggtgatgagacggaggaggataagaaggctgcagaggagagggaagctgcaaagaagtcagctaagaagaag

SEQ ID NO: 18701 - DNA, 512 bp, Gossypium hirsutum
  Clone ID: uC-gsflnu33B013f11b1
tctattccatcttttcaaagctatatttatcttttgaagaaattttatcactattaaaccctcctaatggcttctagtgctacattatcttctcgacgtgctaatgttcgcagtcggctgtcagtaacggtttccgagcttgaaaaacccgagcttcctttgaagtcaattcccggtgattatggacttcctttcatcggtgcaatcaaagaccggcttgattatttctacaaccaaggtcgagacgaatttttcaaattcaaaatccaaaaataccaatcgactgtacttcgaacaaacatgccaccaggtccattcatttcttccaacccaaaagttgtcgctttacttgacggaaagagctttccaattcttttcgacatatcgaaagttgaaaagaaagaccttttcactggcacttacatgtcttcaacttacctcaccggcgggtatcgaattttatcatatcttgacccatcagaacccaaacatgccaaactcaaacaacttct

SEQ ID NO: 18702 - DNA, 282 bp, Gossypium hirsutum
  Clone ID: uC-gsflnu33B013g05b1
tttgtgtaaaccggcatgggggatatatgctttaatctcccattaaagaacctataagcaaaaatcaataaacattcatggggctgagctgatatttagtagattgagggatattctgtcttttctcatgtctggttatctttatttattgcttttattcagctttgattgtaaggttcagctctcatggttttcttgaaaggtacaataatgtatagttttgtttcttagaaaactactgggtgctaattcggaaaatttggaaagaagagctactaatgg

SEQ ID NO: 18703 - DNA, 519 bp, Gossypium hirsutum
  Clone ID: uC-gsflnu33B013g06b1
ttcttacagaaccattatggtatactcatcgatgcagtgctttcaataacaataacatctcttctattgaaagcgtggggaagcactgtcgacttaaccgatgaagatggcattcctggccgattgggattacctttcttaggcgaaaccttctccttcttttcggcttcttacagcacaaaaggatgctatgattttgttaaacagcggagaaaacagtatgggaagtggttcaaaacaagaatactcggaaagactcacgtgttcgttccgagtgttgagggggcaaaaacgattctagccaatgattttgttcatttcaacaagtcatatgtgaagtcaatgacagatgcaactggcgcaatgagtgtgttctccgtaccgcacaagatccacacaagaatcagacgtcttctctccgatcctttttccatgagttctttgtccaagtttgctgtaaaatttgacaagatggtatgtgaaaggctggataaactagaaaaaagtgggaaaagctta

SEQ ID NO: 18704 - DNA, 183 bp, Gossypium hirsutum
  Clone ID: uC-gsflnu33B013g11b1
agaaccattatggtattctcatcggtgcagtgctttcaataacaataacatctcttctattgaaagcgtgaggaagcactgtcgactgaaccgatgaggatggcatgcctggtcacaaggaactatcttatcctggcgcaagtttctaggtaatagcctctgatgatcgcatttgatgaatct

SEQ ID NO: 18705 - DNA, 441 bp, Gossypium hirsutum
  Clone ID: uC-gsflnu33B013h06b1
tttgttcaataaccatgtcttctctgtttctcctcctcttatccaccgccatcaccgccgccgtcgcttccattcccgcctacccttcagtgtcgacagactgcaccgtttccgccgaggatgataacccggttcccgttcgtcgtgaagtttacggcgacgggagaatcttcgacgttagccatagatacaccgtggatatgccttcgtgggggagcaaagatggtctgggtcagttcctttggcttccgtcaagcatgaagaacggttcaaggtccaataattccttgatgaagctgcagtcggtccattccggcacccacgtcgacgctccgggacatatggtcgacagctacttcgacgctgggtgtcgatgtcgacacccttgactttgatggccttaacgggccaagcttattagtggatgtgccgagggatagt

SEQ ID NO: 18706 - DNA, 544 bp, Gossypium hirsutum
  unsure (1)..(544): unsure at all n locations
  Clone ID: uC-gsflnu33B015a01b1
tttacgcgtacggttttatcactataaatctttgggttttcttaataaaattgaagcaacaattctatagttttcatctacatttcgcctctgaaattatagtaaagcagagacaatgaaaggaacattgatgttgagttggattctgatcatctgcctctcccaagtagcagtgcggagccaatactactcagataccctaccatatcatcccaagccacctaaggtcaccaatcttcacttctttatgcacgaacatacgggtgttacagctgtcgtgctaacccaagctaacgtcacaagcaataattcatcagtgacatttgccaccctagttgccgttaatgatcccctcaggactggtcctgagcctgactcataggtgattggaaatgttcagggtatttccctcttagccggatcaaatgcatcgagcacgcagcacatagaatttggatttaataccggtaagtttaacggcagctctctaagcgtattttcaaggtgagaacangggcttgcggtggtcggaggaagaggacga

SEQ ID NO: 18707 - DNA, 152 bp, Gossypium hirsutum
  Clone ID: uC-gsflnu33B018a04b1
taaataatgtataagccatttggttgggagcaaattttccttttgtccaaaggatttttgctgctcattcatggtgacttggtttatggttttatctgttgttgttaaaatcttataaaaatatatatcggttgctgcttttggtttgtatc

SEQ ID NO: 18708 - DNA, 513 bp, Gossypium hirsutum
  Clone ID: uC-gsflnu33B018a05b1
tccacgcgtccgagatgatcaatgaaaagccccagattatacaagagtacgaatccggaaaagctattcctaaccaacagattataggtaaactcgagagggcacttggtgcaaagctgagagggaagaagtgaggagggtcttgtcgttaatcaaacagaagttgaatatggtgtccagttcttgagtcctaaaaaatggtgatgtaaataaatgcgctctactgttactatggctcgcatgtaataacagcgtcttcgatgttatctgaagactgactatgactatgactgatgaaatgaagtgtgttcttgactgttgcaagggattctctgtgctatttatgttttgcttttgtgaaatcagaggaagacacacttctttgtcgaacagatgatggtttcaacaattagaaacaccaataaatttggtttggcgtaaacttgatgcaattgggattatgtgctcggatcttagggacatgtcattttcccttgtgaaattttgatcctg

SEQ ID NO: 18709 - DNA, 363 bp, Gossypium hirsutum
  Clone ID: uC-gsflnu33B018a07b1
tccacgcgtccgaggaaatagcagctgtcccatctacttcaacgggatctatgccagttgtggatctcacttctgattctagtgactcgcaacctgatcttggttacctttttgaggcttccgatgatgaacttggactccctccccctacggcttccacaactgatactgaaggaaggtccgaagcgactgatttggtgcgagctgactcaaactcctcaggaatcgatgatttgtgggggttcgaggaacagaaccctaactacgattctttcgagtttggattcgttaataatttcaatgatggtaccgttgcatatgatgcactgttcgagcattcctgatgtctattacgattcctcc

SEQ ID NO: 18710 - DNA, 345 bp, Gossypium hirsutum
  Clone ID: uC-gsflnu33B018a12b1
tacaacaatgagttatttgttcgggaacttgttcaaagcacgtacttttcagaatttcaagctaatcagatcttactcatgatttctatccctgtatagtcttcctctattggatgaagatatgaagtcaaaagatatagatggggagcaagaacaagtctcccttgcatagttaccaatatactgatacactgaaagtttctggtggtggttgtgtatctttcattatatcacttgtaagtaacatctgtacaaaatgaatgtttgcatggattgttcataagatgcaagtttgtatagaaagtcgactaggtgaataagaaaatcaaaataaatttcttctgg

SEQ ID NO: 18711 - DNA, 522 bp, Gossypium hirsutum
  Clone ID: uC-gsflnu33B018b11b1
tgttttctctctctctctctctctctctctctctctctctctctctctatttcttctccacaaaaatcccatatttttttcttaatctctctctcctttgcttacgataataacatatacgtattcaccaatgcatgatcttccgatccaatgtaattttgatccttagctttgaattttttaccgagtttgacccacctgattgactcactgagttggggcttctttttgttggagaaactatgttggaggcaatggagagttccgtcaatggcgggggtttctcgcagtttcagagctgcggagacagtagtgaagaagagctctcggttctgccacgtcatactaaggtggttgtcaccgggaataaccgtactaaatctgtgctcgttggtcttcaaggcgtggtcaagaaggctgttggacttggcgggtggcattggctggttcttaccaatggcatagaagtaaagctacagagaaatgcacttagcgtgattgaagctcctaccggcaatgaag

SEQ ID NO: 18712 - DNA, 364 bp, Gossypium hirsutum
  Clone ID: uC-gsflnu33B018c03b1
tttcacgcgtccgcccacgcgtccgaaaaaaagataaaaatttaaataaaaatttataaaaataaaaaaacaaaaaaatgaatattagtattatggggtttttttttttttattattttgtgttttagtgtttgtggatttttttttttattgttttttttattgttttattttaattctttatattctttttattgggggggggttttttttgggggctcccgttttttttccccttggtttgtctgtttttctttttttttttgggtcctttaatgtttttttggtggtgggtttttttctcttttttgtttggaaacccttgggtttcccccttttaagttttttggcgccttttcccttt

SEQ ID NO: 18713 - DNA, 438 bp, Gossypium hirsutum
  Clone ID: uC-gsflnu33B018c04b1
tcgtccacgcgttcgcccacgcgttcgcccacgcgtccgcaggaaaacaaaatttcaagcttgaaattttgattcaaacactttaccttatcattctctcataaaactcaaatcccaagttcttatcaatgggtttctcagtcgagaattcggtaacacaatcccacacgagaacccacaaaatcttcttaatcagcaattaccttctattgggagccgcctccacatgcgtcttactcaccctttccctccgcttattcccttccctgtgcggattcttccttattctcctccatgtcatcaccatcgccgccgccgtcttgggttgctccgtcgccatttcgggttccaacaaacgctacttggcttacatggagtcgatggtgctgacatcaatattcgaaggctctgtttcggtgctttatcatgaccccaacg

SEQ ID NO: 18714 - DNA, 316 bp, Gossypium hirsutum
  Clone ID: uC-gsflnu33B018c05b1
ttggattctcttctctgtcgcattttcaaagccagatattttcccgagtgcaggttccttgaatctgtagatggtaataacccattgtttgtttggaggagcatacatgcggccaggctactgttgttgaaagggatttggtgaaggttttggtacgggtcatagcattagagttttctcgaaccctttgcttccgaatgaaacaaatttttatgtcgagttgattcgattctgtttgatggcatggatgatctttgggtgagtgatcttttaaacactaggggtgacagttggatgttaagctggtaggatgact

SEQ ID NO: 18715 - DNA, 423 bp, Gossypium hirsutum
  Clone ID: uC-gsflnu33B018c08b1
tatcttcacctaccaggagtcctcacgcgtcggcatacgacaagaacctggatgatcaggtccatgcgactgtggttcctgatgatgtgattcagcctcaatcggacaagtactgggctcctgacccgcggacaggggtatttggtcctgctacggagcaacttaacgcatctgcgggtggggagcagggtacccattccagtggtgcatatttggtcctggaggaaaaggtgtggttttttttcacatgtattgaggacttgtcttttcttcttcattcctttattatttgattttatccttttactatatcgtttttttgcatttaaatctctttcgacttgttattttcattttcttatactacttatattttctcttatatcttttctttcaattttaattttctttctttcattttct

SEQ ID NO: 18716 - DNA, 457 bp, Gossypium hirsutum
  Clone ID: uC-gsflnu33B018d07b1
tccacgcgtccgaaagaatatcgttttcctcatcgttgctatatctctagttcttcaagccacggtgcctccaactgcgttagccgctcgtaacgaggttatgtcctctgccgctgtatcgaaagtggctaatgattccaacggtttggctgtggttttcgagaaggtaggccctggctgcaaacctaaaggttcgttttgcttgtttgacctaaccagttgctgtaggccttgcggatgccttgcagggtggtgctataactatgatcatgaatgcaatgagtacacataatggtcgctactgagtttaaaaaaaagaaagaaaaacagctctgagtcagaaaacgacatgggattcaattataaatgttctatatataacatatgtatttgaataaagaatctctcgtgttatgtccctgattggatgagctctgccattgttgtaagagttcat

SEQ ID NO: 18717 - DNA, 242 bp, Gossypium hirsutum
  Clone ID: uC-gsflnu33B018d08b1
tttaccattgtagaactttgttcagttattgctaagattttatcaggttttagagaatcgtatgttttgttcgattggggtttatattttctaacaaattctatcgaaatgtgtgactgtgtttcgattttttgccttgtggattggatttctttgcaaataggtaaactcaagaactaagaccatgaaattatatgtttaagaaaaaaatgatgaatgatttgaacattgcactttcgagt

SEQ ID NO: 18718 - DNA, 493 bp, Gossypium hirsutum
  Clone ID: uC-gsflnu33B018d12b1
ttccacgcgtccggttgattcaatgtctaaggttgctgaaattgaaggggctgagaaggaaaagatgagagaaaaggtgaaaaagatcatagcacatgggattaactgcttcgttaacaggcagttgatctacaatttccctgaagaactctttgccgatgcaggcatacttgcaatcgagcatgctgattttgatgggatagagcgtctggctttggtaacaggtggggaaattgcttcaacctttgacaacccagagtctgttaagcttggacattgcaagcttattgaagagattatgattggtgaggacaagttaattcacttttctggtgttgaaatgggtcaggcttgtactgttgtgttgagaggtgcaagccatcatgtgctagacgaagctgaaaggtctctgcatgatgccttgtgcgtactgtctcagacagttaatgacactagggtattgcttggaggtggatggcctgagatggtaatg

SEQ ID NO: 18719 - DNA, 530 bp, Gossypium hirsutum
  Clone ID: uC-gsflnu33B018e01b1
cttcgtatgatgacatcttgggatggggagttcccaataggattgatatgaagactctttcctttgaacgcaaagggtctgatcttgtcaatgttcgaaaggtcctcggtccccatgctaagaagattcaattgatgtcgaaggttgagaatcaggagggtgttatcaactttgacgagatctacgcgtgagactgatgcatttatggttgcccgtggtgaccttggaatggaaataccggttgagaagatcttgctagcacaaaagatgatgatatacaagtgtaatcttgcaggcaagcctgttgatactgccactcaaatgcttgaatccatgataaagtctccgcggccaacccgggctgaagcaaccgatgttgctaatgctgtcctggacggtaccgattgtgtcaatgctcagtggtgagagtgctgctggagcctatccagagcttgccgagaagatcatggcttgaatttgtattgaggcaaaattttcccttgactatggagcaatcttaaagaaatgat

SEQ ID NO: 18720 - DNA, 469 bp, Gossypium hirsutum
  Clone ID: uC-gsflnu33B018e05b1
ctgatctacctattcgttaaatgcctgaggttcatgataacatcgctatctggattaccagttcgccatgctaataacaacctacattgcattgaaagagagagagaagctcttttgaaattcaagaatgatcttattgatccttcaaacaggttatcttcttgggatgaaggagggcatcgctgcaaaggcgagtgtaaggcaccattgattgacactctcaattatatggctggccctcgttttaatcattaccccatcttgaagtctgttggtatccaattgttaattgccttgctttacatccctctttcgccagttggtgtaatatcatcaagtcccttaatttttgatctttcttacaatctgcccattcttaatggttaatggtactccccctgtagcggtccattaagctctattttcttcttagtctactcttaccttgaacttttcccttttccattca

SEQ ID NO: 18721 - DNA, 240 bp, Gossypium hirsutum
  Clone ID: uC-gsflnu33B018e06b1
gcagataatgaacgcattccattacataaaagtaaatcataaaattgtttatgccaaaacctacattgagaaactgcaaaacacttcttaaaaaggttaatgtaggcaccaaacatacaactgcaaaacaatttgagttcctactaaaaggaaatgttttaaaacctcatcacctacggctctactgcatctttgctttttttcttctttttttgcatctcgaaaagattgcttaatgaa

SEQ ID NO: 18722 - DNA, 522 bp, Gossypium hirsutum
  Clone ID: uC-gsflnu33B018e07b1
ttgcataaccatctgcgaattgcgcaattccatcagcacttggcagagaaactggatatggaaatgtcagctctccagtacatgataagagaataccctggaaatgaggaagagaagatgagaggtgcaatcgggaagtttggattgtcagggaaagcgcaagtgatgccaatgaagaacctatccgatggacagaggagtcgagtcatcttcgcgtggttagcatttcgacaaccccacttgctgctgctagatgagcccactaaccatttggatatcgagacgatcgattcactggcggaagcattgaacgagtgggacggtgtgttggtactggtgagtcacgatttccggctgataaaccaggtagccgaggagatatgggtgtgtgaaaatcaagctgcaacacgatgggaaggggacatcatggacttcaagcagcatttcaagagtaaagctggtttatctgattgaaacaaagtagtaattagcatataactttaagcagaggttacgaggaaa

SEQ ID NO: 18723 - DNA, 396 bp, Gossypium hirsutum
  unsure (1)..(396): unsure at all n locations
  Clone ID: uC-gsflnu33B018e09b1
ttcctgggggaaataccattaagctttttgccagcatgggagcaaccaccatcccaggggtatgaaaagccattctgattctacaattgtgcaaaatatgcgaagaaatactgcttagtatgtttacattagtcactcattgttgtctgttccatcctatggcaagttgcttttgaatttatgcttgtatatctctgctgctgataggaatttacgacatggtgaatgcatttctttcatttggctgttgcactacatcacaaaaggaaagaaagttcatcatgttcatttctaaagtatatttcttctccttttttgcttggattggattgagatctagaatgatattcaagtnaaaaaaaaaaaaaataaaaaaaaaaaaataaaaaataaaaa

SEQ ID NO: 18724 - DNA, 282 bp, Gossypium hirsutum
  Clone ID: uC-gsflnu33B018e10b1
tgttgttttagtaattacaagacacctttcaaataacattcttcaaattcatttgattttgaagaaagaaaccaaaaaaaaaaaaagcaatgcctgatgtaaactcaggcatacaagtttgtgtttgctttcatttagacattcatattcctgcaacttgtgggaaacctgtttgctgtaagacaaatctcaatttgaccttgaaatggttctgggaaactatgtatgttcccagcacgacattgtttatgccttttggttttagttaaatttactttttgc

SEQ ID NO: 18725 - DNA, 523 bp, Gossypium hirsutum
  Clone ID: uC-gsflnu33B018f12b1
ttccacgcgtccgccgttaccgattttcccgaatccgaccccgaatccgccatccttctccccagcgagaaaccccactttgaaccccccaaattactcgacttcaagcacgatgatgatgcctccggcgtcgcctccgttcctttgaccaagatcagttttaaccctgtcaaccgccaaggggagcgagtcagactctatgtaagaggaaccatcttgggttacaagaggtcgaagtcaaaccagtatcctaacacttcattaatccaaattgagggagttaacaccaaagaggaagtagcttggtatgccggcaagcgtatggcttatatttacaaggctaaggtgaagaagaatggttcgcattatcgctgcatttggggcaaggtaactagaccgcatggtaacagtggtgtcgttcgtgctaagttcaagtctaaccttccccctaaatctatgggagatagagtcagagtcttcatgtaccccagcaacatttgagttgtctagatgcctgacggca

SEQ ID NO: 18726 - DNA, 517 bp, Gossypium hirsutum
  Clone ID: uC-gsflnu33B018g02b1
ttgacgcgtgggtccggcctaaccgtttttctttccccgtaacaatgtcgcgctcccttcaatttttcactccctcccgtgctccttatttcactctccataaacttccgtcgacatcctacacccggttcccggtaattaacttcccgagcaaaaagcactatatcactatcacgaaatcgttatcttcagatctcgatgcagcgtcatctcaagtactggattccggaaacggacagaccggagtttcgcgggttttatcagcggacaacgtggtggcggttcagtctcatgcgccgtcggaatcgggagcggcggccgggatcgaggttgacgctgtgacggaggcggagctcaaggagaatggattccggagcacgagaaggacgaagttaatatgcacgattggtcccgcaacgtgcgggttcgagcagctggaagcgttggctgttggaggtttgaacgtggctcggattaacatgtgccatggcactcgcgagtggcatcaaatggtgat

SEQ ID NO: 18727 - DNA, 468 bp, Gossypium hirsutum
  Clone ID: uC-gsflnu33B018g03b1
tcacgcgtacgcgccctttgtttattacaggactaaaagataatcatgatgaaggaacagagtgatactagagttttacactcacaaatactgctttccaattggacacttagccacagttgtacaagtatgataaaactactctcaaacatgaaagttgctccagatattactttgtgaaaatttcaaagatagatacataagaaaaaggggtaaactgctaaaaggtatacgaacttcatgaaatttaatatcattatcccttgaggaatccattgtgctctaaattaccgtttgtgggtacgattctcataaatgtagttcaagttcaccaaccttaaagaaagcctccaccagtccatgcggcatctgattttccattacgaccaacggcattttttatcagatgcaccattatagaaactatcatatccatcattcttggggtcattccaaccaggccaacca

SEQ ID NO: 18728 - DNA, 216 bp, Gossypium hirsutum
  Clone ID: uC-gsflnu33B018g04b1
atcacgccttcgctgggaacatgcctggacttaagccgttacatgatggctcccatggttacgcacttgaggacacaactaacgcgggcatgtcaactggaccccatgttaatgctgatggagatgaggatggtgatacagaagatgagaaccatcaagctggtgatctagggaatgtaactggtggtgatgatggctgctctcagcctctccatg

SEQ ID NO: 18729 - DNA, 322 bp, Gossypium hirsutum
  Clone ID: uC-gsflnu33B018g06b1
ttttggttcaatagtatggggcaatgctcaaaaccaagttaaaagcccagtttccttctcatggtcattgatgtgagagtgtcccacagtttatatataattctgggtattctttccctcaatgaacctcacacaggacaagaaatctggtgcaaaaagggaccctcattcatggccgaaacctttttcattttgtggtttgtaatatttgttcacatttggatttaagttaatgatggtataagaactgctcagcctggaacgcttattattaaggtttaagcgccctatttccatggaattacttacctaataattcatg

SEQ ID NO: 18730 - DNA, 330 bp, Gossypium hirsutum
  Clone ID: uC-gsflnu33B018g08b1
taaaaagaacaaaaaataaaaaaaaaaaaagaaaaatataaaaaaaaaaaaaaaaaaaaaaaaaaaaaaaaaaaaaaataaaattaacaaattaaatatggggcgggcgttttggtggatccaatcttgggtccccgttcttgcaatgccatggcttttttttggtgtcccctaacttaatttccttggccggggttttccaactcactgcttgggatgcccttggctttccccaccttaattgtttggcctggcatccccctttccttgggtgggttgatacattatgggcccgccccgttcgcctttcccaacaggtcccattcctga

SEQ ID NO: 18731 - DNA, 521 bp, Gossypium hirsutum
  unsure (1)..(521): unsure at all n locations
  Clone ID: uC-gsflnu33B018g12b1
ttccacccgcctctcgtaacagccccggtgtcctattcgtttgcactcatagaaccctaatggaccctgtgatcttatccaacgttctaatgcgcaaaatcccagcagtcacatattccatttcacggatttccgaaatcctatcgccaataccgacgattagattaactagaatccgagaagtggacgcagaaaaaataaaaaatgaattagctaaaggtgacttagtagtttgtcccgaaggaacaacttgtagggaaccttttttattaaggtttagtgccctatttgctgaattaactgatcgaatagtcccggttgccatgaactatagggtagggtttttccatgcaacaacagcaagtgggtggaaagctttggatccaatcttcttcttcatgaaccctagacccgtttacgaggtaacgttcttaaaccaacttncgatggaagcgacatgttcatcggggaagagtccagaagatgtggctaattatgtgcanagaatcttggctgctacg

SEQ ID NO: 18732 - DNA, 73 bp, Gossypium hirsutum
  Clone ID: uC-gsflnu33B018h01b1
aatacgcgtacgcccacgcgtacgatagaaagctatgtttgtggtgaaaataatgtataagccatttggatgg

SEQ ID NO: 18733 - DNA, 534 bp, Gossypium hirsutum
  Clone ID: uC-gsflnu33B018h03b1
tatacttctttgcattatttgaaaccatctcgaagctattaggatattcacggctaaactttgttgtcactgccaaagtagctgataaagaagccttgaaaagatatgatggagagttgattgagtttggtgctacttcaccaatgtttgatattttagccacccttgcaatgttgaatttgtttggtatctttggggcactcaagaaggtcatcttggatgtagatgaggacttacaggttttggagaaatttgggttgcaaattctcctctgctttgttttggttacaatcaacttgcctgtataccaagcactctttttcaggaatgacaatggcaagatgccaagtagagttacttacaagtctattattttcgccatgctagcctgtactgcaaccatgtgtttttaaaaaaaaacacaagtgttgaagtttgattctttcaataagtttgattttatatattgaggtatatgagattctagaataaatgtgtcgttaagaggatcacaacaatttactagttgtattt

SEQ ID NO: 18734 - DNA, 222 bp, Gossypium hirsutum
  Clone ID: uC-gsflnu33B018h04b1
taattagttcggtgtgttggataactgtattcaagaatgttctgaaattaatgtcgatactgcctatggtcaatttgagtgataatttacacttggcaatgacattttaaatgcttggtataagttgtttggtgagggcatttaatttccgaaccattttggttgtgatttgagattatttgcttgtttataataaaaggttttggttataatttatctctc

SEQ ID NO: 18735 - DNA, 99 bp, Gossypium hirsutum
  Clone ID: uC-gsflnu33B018h05b1
taaattgtggatgaaaaaaaaaaaaaaaaggggcgccaagcttacaggcgcctgcatgcgacgcgatagcatgcgaatagtgacacctaaaataaagtc

SEQ ID NO: 18736 - DNA, 392 bp, Gossypium hirsutum
  Clone ID: uC-gsflnu33B018h07b1
tactgttaaaagttttgctcaacttatgtggcctaatggtcacccacacttttctgacactattcataccctagcgacgcaaatggaggatttgaacaagttaatttggttaatgttaattgatagttatggattaggggatgactcattgaagatgaactacacaacgttagtgcggatgatgaaatatatggcccctccgccaggggagtatgagagaggactctttgctcatactgataaaccagtaagcacactcatttgtgaggatcaaatttcagggctggaaattgaggtcaatgatggtcaatggatcaagctgactaatttatctccttcttcctttgtatttgtggttggagatccttttaggcttggagtaatggagattg

SEQ ID NO: 18737 - DNA, 466 bp, Gossypium hirsutum
  Clone ID: uC-gsflnu33B018h08b1
ttctggatggcactgcagtttttgtttccgccacatcagtgagttcatatttaagatgaaagcttacagccataatgatagagtgaggttctctcattatttgaacccaaagagagttcagagagttatttgcaagggtgccgatctgtttgacatgctcccggaggagtacacattcaaggatataattgggaaaatgggacctattcctcattccttctcagctgttcatcttccatcatatcttctagagaatgcagataaatataaatttcttttacctggaaattgtttgcgagaaaatgagtgagtcttttgtaaaggcttgtcagaattgctactgatgtgactccccccgaagtgttcaactgaacaattaatgactgctgtgtgttaccgggcacacgtttttcggttttcgcagttgcaaaaaatgttgaagagttttggataatgcctgtgaatt

SEQ ID NO: 18738 - DNA, 68 bp, Gossypium hirsutum
  Clone ID: uC-gsflnu33B019a04b1
ttcacacatacggaaggcagaagaaaatataatatgaatgtgaaaaaaaaaaacaaaaaaaacaaaaa

SEQ ID NO: 18739 - DNA, 559 bp, Gossypium hirsutum
  unsure (1)..(559): unsure at all n locations
  Clone ID: uC-gsflnu33B019a06b1
ctgcgtcctaaatatttccaagctcaagaagccatagactatggccttgctgacaagataatcgattcaagagatgctgcattcgagaaacggaattatgatgagatgcttgctcaatcaaaagcaatgaggagaggagctgcaggtggtccacaagcgactccttccgggttcaggtgatttagaaggggaaaactgattcattcattcaagcatcaattgctgttaatgaaatgacaaaaccattgctgttctttcaacatgcttcaaaaggacctcatatattttgttcctcacccttccatatgctacgaattcgggactttctggtgttgatttgccgttacttccctccatcatatctaaaaagtcgttcaatctcttgatccgacacatagattcagctacctggccatgaggtacctttgaaaggcgttcattatcgaacccgtctaaataattctcgatataacctaaaaaccatgttttacattcatcttgcaatgagtctgcaagatttctagctatattcaagaaagtgggatangatcagatgcca

SEQ ID NO: 18740 - DNA, 351 bp, Gossypium hirsutum
  Clone ID: uC-gsflnu33B019a09b1
taaaaaaaaaaaaaaaaaaagaaaaaaaaaagaaaaaaaaaaaaaaaaaaaaaaaaaaaaacaaaaaaaaaaaaaaaaaaaaaaaaaaaaaaaaaaaaaaaaaaaacaaaaaaataaaaaaaaaggggggggcggttttaagggacccaagttaacccaccggggagggcaagaccttaggtgagttatggggcgccacaaacaaaatcaatggcccggggttaaaaaactgttgaccgggaaaaacccggggcaaaccaaattaaatgccatgtaaaaaaatccccttttacccagggggcggaatataaaaaagggcggacctgaaagcctttccaaaaatttgcgaag

SEQ ID NO: 18741 - DNA, 413 bp, Gossypium hirsutum
  Clone ID: uC-gsflnu33B019a12b1
ctcacgcgtccggcagttttatgcagttaatcgtgggggtgatggttattttctcaattagcgtaagctgatgaaaaaatctaaaaaatattttaagcaatttaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaattaaaaccaaatgaagaaaaacctactaaagttaaaaaaaataaaccttactaacagctgactattctgaaaggttaattgtattcgccccctaacatgccataaagcacgctggactacctgttcccataaatacgacttttaaatttccaaagaccttttccccgatgattatgtttattttggttcattt

SEQ ID NO: 18742 - DNA, 497 bp, Gossypium hirsutum
  Clone ID: uC-gsflnu33B019b01b1
gttgtggctagttgatattctaatcgataaaaggatggcaaatgacttcgtgaaattgtgggcagatcaaaaggaacttgcagaactccattccaggattcccaccatgtaccgacatgaaatcagcaggatcactgctcaactatgtatcgcaattggtagaggaaacatcttggtgcccaaagacagccgattctctctgctgtcaacatggttggacgctctttacgaagattttagatggatgagaagggcttctagatctgtagataaaaaactaattgaggaaggactcggtcagacaattcttacgctttcgttgcggcaacaacaggttattctgctcaactggttccatcggtttctgaataaaggggatgactatcccaatatccagagagcatttgaggtttggtgagaagaagccttattagacagtacggtgacgtgcctgatagttcttacatgcaaataccatctgcaattatccaacctga

SEQ ID NO: 18743 - DNA, 492 bp, Gossypium hirsutum
  unsure (1)..(492): unsure at all n locations
  Clone ID: uC-gsflnu33B019b02b1
cgtcccggtaacaaccccanaaacaaccgccacgagacaaaccgcacccttttaaacaccaaaaacccccaccaaaccccccaacagaccaccaaccaacaaaaccacccacgacccgccccacgccgcccacccaacaacacgccccccccccccgggtaaccagcccccccgcccccgcccccccgccaccgcccccatcccttggggaccccccgcccccaacccctgccccgcggccaccgccctcccccccttagcccccccccacctttcccctcccctacccgctttccccttctcccccccttccccctttcccgcttatccggtcataaggctcaggccccgcccccgtcctcctctccaacacaatccccctatctctaatggtcctgccgccctcctccctttcttgcccctatgcccccgcgctttctctcttctctcccctcctcccctcttcccttccccgcctcctcccccctccct

SEQ ID NO: 18744 - DNA, 231 bp, Gossypium hirsutum
  Clone ID: uC-gsflnu33B019c03b1
ataaaaaaaaaaaaaaaaaaaaaaaaaaaaaggaaaggtttgacgaaatagagccaccaagcacaacaaacaacaaacatgcgaaccaataactgggctatagggtcacctcattttaatgcaccggccgtagcttttcaagggtgggactggaaaaactttggtggcacccaatttaatacgcttgaaggggataaccctttcgccagccggatttaaagcgctggggcc

SEQ ID NO: 18745 - DNA, 342 bp, Gossypium hirsutum
  unsure (1)..(342): unsure at all n locations
  Clone ID: uC-gsflnu33B019c06b1
ntccgtcacgcgtccgcactgctgctcaagtaaattgtatgtttcttttgtttgaatgaaaaatgctgccttgtcttggttattgtagtattatttgcttgtactgataataaacttgacatttcgattatgttttgtctttgtattttgatgtcatttatgttctgcaaatgttgcttgatggtatagatatcgacggctctggtttgttctgattttatgagatgtacttgaaagaacagccagatctgcttgtatatctacatttactgaggaatttgatgatacaaccaacgtagcgtttttcgacaaattaaatttatttaaaatcttttccaaact

SEQ ID NO: 18746 - DNA, 448 bp, Gossypium hirsutum
  Clone ID: uC-gsflnu33B019c10b1
taagggggaaaaaagtgaggatcaagcatagatggaatacatgggagttctaggcaaggtggtggattaccttctattgttatcattcttcagcatcacattaacagctcagttggacatccccgagtccatcctcccccacgcctacaatcccttctatcaagtttataccacgttaacccaagattatttggtgcttgagcagcctgcttttttcaaggcacttatgacgttggaacttgtttaccaactccctctcgctttgcttaacatctatgggttgttatactctaagccctggttcaacaccacctgcctcctctttggtgcctctatcgttgcctctacgacagctatggtgggagacattctcaattcccagaaggcatcagccaatttgatggccatgtattatccaccgtttcttccataggggttctggctttag

SEQ ID NO: 18747 - DNA, 525 bp, Gossypium hirsutum
  Clone ID: uC-gsflnu33B019c12b1
taagaatgcattcggtcggaaggatggatctgctatcatggaaaccgacggggagccaggagaagaagaaacggatccttctgaaaagaatgcactggacaaaaacttcgaaaagcccgacatcttaaataatgaagagcaaaatccagcttctgctctcccaacaactccactacaactttgcagacctttggtccaactgccattttcatcaaagagcaaacctccacggtccttcattgccatcggatcatcttccgcactgtatactggtcaaagatacggcaagcctagcattattcgacctcaaaacattatcgaaaagcatttccaaactattgctgaagatgaaacacccgagattctacgaggcaattcatcttccggaactgggattaagacttcgtcccccaacagtaagaggatctcttctccttaatatgagttagggtcaacccctggtggtcggagtgggccgaaggtaatattgcagtaataccctaatttctttccttacttctagca
